United States Patent 7,868,149 (PLANT GENOME SEQUENCE AND USES THEREOF) - sequence listing, part 99

SEQ ID NO: 52619 - DNA, 10504 bp, Oryza sativa
ctcaatggttgtgtacctaaacaaatatattcattaaataatgagaaatgtaaactgagaaaactaaatcattgacggaaaacaataattgtctgagatgtgcagatcatattcacaacaaaaagaagacaaaggaaaaatactgttcatcaaccacttaattggccttaagcaatccatttatattgcaaaagttaatccagtcttagcgactaaaagcctaccaaaatgggaagaacttcagctattcaataagatcactcagctagtcagctaggtcaataatagtggtaaaaattcttaaaacaaatgatgcgcatggattatgcgcattccctaaaaaaaatagtggtaaaaaacaaacaaaatttacatgaaagtgtgccatttaaccattgtacctcctctcaaagattacaagggtagttacttcatctgagatcacagagtgtttcatgtttgcaggaagataggcataagagtccacctgcactcagcaattacacaatcagtaaaccatattaatgctaggcaacctttacttctctaaagctggtaaaagatgatcaagttaaaacaatcaagtatcaggatcatgaaaagaattaagccatttactgcaggagtatgcaagaaacaagtgggagttccattcattcagttatgacaaacaatggaaattctgttgaatttacaaacatcagtatcccatatttagtacccttttatcatgtataatatttatattattgtcttttgacaaaattttaataacatcaccctacaaatttaacaactgatcatccataagtttaatttgcattatgttcaaacatgttatgccaatataacaacagaagcaggaatagacaaatccggatacaccatgtcgcaaaatctcattcaactacaatggaatttctgaacatggttgatactattcttcaggtattccttagtaatgattagaaatgatcttaaaaagcccatgcacattttgtaaatcatcttcatgcaattaaaaatattgtcaaccgcagttggcttaggctgcctctaaactttgaaaactatgtcgtatgatcccatcaagttatgtcatggaattagaaatgtttaaagtggattaacacttacataatacgacgaacatagagtatagtgaaaaaataactagatattcacaaaatagcagatactaagtttgatcgaatcttaccagcagagtatgggtattcccactctcctcagacaatagaatgcttccttggagtacaaagataagcctgaaaattgtttaccatggaccagtggaaacccattaactggatggtgaaaaaccaagtcgagtcaagtataggatgctgacaaatgagctacttaattggatgtgcatcacagtcaacatttattggctaggactaggagtgacccaatcattctgttctttgaaacagtgatgattacaagtgtgaatggttgctattctaactaagtgagaagcactgaacctttcaacaccttttggtggtagggctgattttgatccatctgcaaataaaacatataaaataagaactctctatcttgtcaacagattagtttgataagattgaacacaacatgtaccgatgtacaataataagaatacaagcttttaattgggagctaggcattcttggcccaatggccgaaatgaatccacacacacaaaaaaaaatgttcttgctaatccaatggttctgtggcaaacaaaatattctgaattcctagaatagaaaccaaactcggacctcaaagagaacttgttgaatattctgctatcatttacatttctacctatgctttgtaggtgggagaaattgcataccatgcatttttgccaggtacattgtgaaatgtgccccgatagctggactaattaaatatgctcctaatgtgttgatcctgaaaaaaaaagagtaaataaatgatattacatagttgtggaaagcaaagagaaagtacaacagaaggtggccaataccagtcaggcaaagggctgaatacatggctctctggtgtaatcaaagcatgatcccttttgtaaacactacgtgtgaagccaggtaaatctggagatacagaaaagtaacaaaattagcaggaacaggaaaaggaacgcatcctcttctgaaacacagatagcctacatgagtaaacgataaaatagctcagaagatatcctcattcaccgtgtaataagtaaaacagaagcataaaacataaattatctttaaagtgtgcttagcaagggaatacaagataatcttctcggccaatccaattcgacgaaaaggagtaactgacgagcgtgcatatcatatgccattctatttcagtcccacatgactacctactactacctacctagttcacagcctaattctcgacagcaagccacaccattcacagagaaattccttctagagagtatggtatcatcgtgaaactgaacgaactaaacactatcccgagcgtctcaaccagcatcaacatccatactccacaacagtaactccaaatccagaaccaatatcacgatattgcagttctaaaaaaacactgcagtgacgcaatccagagcacctatttaagcaataatctttaagattccatccaactcgcgacgtatcgctccgcctcacgctcactcaccctggaggtgcgcgggcgccagagtcgggttggtggccttccagtagagcggcggccgcacgccggagcagccgcccgacgccgccgacggctccgccgagcagaacccctcgccgacgccgacggcgcccgcagcgacggaagcgagcggcagcgcggaggcaacgacgaggaggaggagccgggggagcatcatcttctcgcccggcgcaggtggaggaagcaggcgcgcggcgtgctcgcggtggcgggttttttttttttttgggggggatttgcgggggagaggagagagagagagtggagtggatgtgaggcggcggcggcggcacactcgtggacggtggttggtaggtgggccccacttggtgactcggatgccattgcccacctgcccggctcccccaccacctctgttctctccattcacgattgatcattcacacttgtataaaagaatctggattttcatttgatagcccgttgagtcttgtcggaatagtcgttttagttcgcacacgaatttattaacccccacgtggacgtttcatgagtactaaaccaaatcctagatttaaatctggacataatatatattcaaatttaaacacatgattaagttttttatgggacggagggagtacttcgtaaaagcccgttgcatatgtatgcacgagaaagtaatcatatttgcaattgactatagatcataccgataagttttctatcactcattttctaatccaccatgtgcagcaacgcatccacgacaaactcttctttaccatcgctcctgtctgctcaccgtgataatttacagagtagatcatctgttactttcgttgttcggtggtagaggcagccaggtagggaggaaaagaattgaaaacttaagtcctttcttcaaccaagtgctatttaaatagggctatttgatctgctctttcaattttgttttggtttaggttgcatgggcaatggctaattactaattttcatctttagtaggcaaaaatagctgcaaggcatagtaaaacagttaaatttcgcgtgtgatcacaagcgctatgggtaagaagcatacgatcaaggatgtggcaacaacaatttggttgtgttggtgccaaagcgttgccacaggtgtgttggcctagagtactagattagtaggaatattataagcgtgtttggtcttggtgcgaagccagaatatgaccatcaaacttgaatgaagagagtattatgctcttttctagaggctagagtaggaagctaggaacgcgggattaacgaaacccgatcgaaaatcactcctgaatgattttgttgatttccgtaagatcatttgaaaaccggtaaaatatagatagagtaaaattttgttaaactagcaaaacaactgtgttttgcagtggacaaaaatgtattatacatgtgctaacattgtttggaacaattaattgtatggcttttgaaacaatttcatccttgtatatgtctttgcatgaaacttaaatagagatgaaaaaaagatattaacaatatgtgaaagacttttgtaatattgaagtacacaaaggtagttggtaaagaaaatataatagagttggtgggcaccaccattgctttcttttaaatgcgtatagaaatctaagctaaagaaaaggcaagggttctgtatgaaccgtagtattcatattggagtagcatattagcgacacacaaaacgaggtgactcactagcgtatgattaatcgagtattaattattataaagttgaaaaatagatttatttgaccttttcagaatcttccatatagaatttttttttgcgcaaaacacaccatttagcagttcgggaagcatgctaacggaaaacgcctaaattgtagtttggagttgtagaaaagaacgcataacaacttgatgatgtgtttgaagtatttttaaattttaactactttaccaagtagttcgtcaagtctaattatccccaaatctaaattactgtaagattgaacacaagtaaccaaacttaccaaagggggtgaattacgtcagggaaagtaaaaaaattgaactttaatagatcaaaacacatcccagccttgaaagccaatggaacacacttttgacagtctgaccggacctgtatgggacttagagctagtctgattgaagtacaattattggtatgacagtccgacaaaaacaacttgacaacgcttctataaaaactcgatatttcttaaactaaccattgaatcgagttgcaaacttgtcaaaataaatcagtgttcgcctagaccatggtctagactgtctagaccgcgtctagatgtgagaccgcaggttttcgtcccgtttagggcctaaactgtgccctagaccattttttttgtctatagggtcaaatcgtctagttcaagtaattagatcatgctgagccaagtctagacaaaaaatgacgtgtagaaccgtgattagaagaaagaaggtattatgtaataaaacgttaaaaatgatgaaacctgagggagtagtatggttagaagaaagaagagggttcctataagggggtgtttagatttagggggtaaagttttgacatatcacatcaagtattatataggatgtgttttatggggtgttcgggtactaataaaaaaactagttacagtatccgtcagtaaactacgagacgaatttattaaacctaattaatccgttattagcacatgtttattgtagcaccacattgtcaaatcatggcgcaattagaattaaaagatccgtcttacaaaatagtcgcaatctgtgtaattagttatttttagcataaatttaatattttatgcaagtgttaaacattcgatgtgactagggtgtaaaatcttgggtgggatgtaaataggccgaggttatccatacctttcccatgatcccatctcttgcactagtagtaggcgcctagtagtacattccgttccgtgcaaatgtgcaggtgcaaagccgtccgtcgcacgcacgacgcgtcacccgccccagtgcccacccgtaaccacctccaatcttattattatcatcgcttaataatccaaccccgcgggaagtcgcgacacgagccagcagcggcgggaggaagcacgacgacgacgcgagccaccgaagcggaggaatcccaggcggggcccaccccgccgcggcgccggccatgccgttcctctcgacgccgtcgttcgacctctccgccggcgccgagcccaccctcggcccgcgctctccccctcctccccctgacgccgttcacccgccgaccccgcagcaggccgcgccggcgtcggaggcggcggcgcggaggctgcgggaggcggaggagcggctgcgggaggccatccaggagctccaccgccaccagcacgggggaggaggggatggggatggggacgggaagggggtggatggagatgaggagggcggcggtggtggtggtggtgggtggggttgcgggcacgagggggagtcgtgcgcggcgcacgcggcggggaacctgtgccagagcttcctgctctcctacggcgtccgggtcggcatcggcatcctcctccgcgccttcaagctcgcccgccgcagatcctactcctccctcctcgacctcaaggtcctccttgctcctctcctcctacctgaatttgcaaatttctttcggttagtgctcaactgcgccccatattagattagtttagtttggacggaattattcggagaatttggccgggaactgggattcggctgtgcgaatttacttcatcttgtttcggttggctaattggagtggaattgggggttttggtgcttaactgttggagcttggacacacgcacattagggcgtgcaaatgtgttagcaaaggacagggtcacatattatgctggtcttgattgtgatgttacatctattgctctatgttcatttacttgaatagttagtggtgaactggtaatgagctggtactagtagtacttgtgtaggaccagctggtagtgtttgaagcacatcaaataacctgttggagggatgtttcttgctatgcattaaatggttcgatccctgttgtgaggctatccagtatgatttttttttcttaaaaaaagttttgaaccttttgttaataatgtttgaaaaataacctctgccacaccgagataatagcatatggtgtagcatgtgttttcactgttttgccttgccatcagccgtgacatggccgaaaggttcatttaaaacaaaatactggatggtttatttttaaaatattactaagaaaaggttaaaaaataaaataattggtccagttcccaaacttccctttctgacaaatatttactgttctactactagtatactacaaagttcaaataagatgtcattgatataactttcttttctaatttgcagcaactggtttcggagaaagatctaatagtgagggaggaagcttgccgggtaggattactttttggaggattcactggatcatatcatgcacttcgatgtttccttcggagatttcggaaaaaggaaacaccatttaatgcgtaagtaactctatgcttatgctgttttgtgtctatttatcttgtctgattcactacaacacatctgcaacgcatgtgtacctctaaccagttcttgaatctgagatggtccctaaaaagtagataggtccaaagcatgttaattttttattataagattacctcgaataatgttcatggactcaactgaaggcgtgatggagcagaatattagcaggttcggtggcaggcttggcgatagtagcgctagatgattcaagtaggaggcgcaccctttctctatatcttctggcaaggcttgcccaggtcaccaactgctaaactgttgcattttatatggtgaagatgcatgtatggcccttttcctcatgtattgatgcttggtttttacagtgtgcatataattctgcaaagtctaagaacagatttcacttttggggaagccattggaggcatggagatgcattacttttttcacttgcgtctgcccaggtaacaagatgaagttgaccgatttgctttgggattattatcctgttatggagataagatctatataatcatatgaaatatccttccaggttatgtattctttcgttatgaggcctgaaagcttacctaaatcgtaccaagacttcatccaaaagactggaccagttgcggaacctgtttacaaggctgtaagagattgctgcagaggtggtcatgtggatctcattggtctctcagcctatttagctaacaagaagaattcaaatttgataaatttaacaaaaagtccacccattattccatgttctgtgatacatcctgacagagcatcgtgcttggctcataatgtcagtgtctcttcatcaacgttcaagaaaacattccctctgtatttctcattgacatttgtcccatttgttgttctacgccttcaaaaggtaactttctaatcttgtttcccacttatgctattgcttgatcgaaatatttttctttcaaataaaatttgatgcctcaagtataagccaattgtacaagccttcaaattatagcacatctctatctttgtactcttcatgcacagtgcacagacactttaattttgcttaatgcaaaatgcatgcattgctttttagttatatatgttgccagtgaaacaaaatattgagcaacatcccgagcactcaacaagattagcacaatgaatcttcttactttttcattatcctgtagttcatacatatccatcttctatgttaattacctaatgatggaatctctgtatcaaaaatatcagttcttggaatcaccagctgcaacttgttggcgagctcttgtgggtgcagttcgctctacgacctttttgtctgcttttgttacattcttccaggtaattgtcgaggacagtccttaacaaatactagtaaatgtttcatgatcataatatccttctggtttcattgctaggctgccatctgtttgcatcgtaaagttgcaaccaaagaccacaagtttgtgtactggtttgctggtctgatgtctggtctttctattcttttggaaaagaaagccagaagagctgagctagctctctatgtacttccccgcgcaggggattctttgtggtatatattaatcaaccgccatctgctcccaaatattaaaaacgctgaggtatttttcttcattgttcagtttgtttttctactttggacaaaaactacatgaggattacttgcaatactctagcttatttcaaagtaatctggtgtcgaagagcagtgtaaaccaacattagtcctaagttcttaattctacacaatttgcctattgccttgataactggaagggatcatgtttgaagtcagtgtgccccttggttagtagatgatcatatttttcagatccgctgacagttacccggcaaacattgcaggtggctcttttctgcatgtgcatggggggaatcatgtatttcctggagtatgagccagataccatggctccattcctcagaggactcatcagacggttcctggcaagcaaaataagcaacccgagcccaccgccaaatcccaatgcctcctactcctaccttcagaagctgaacgtgctggagcaaccaagaacacagcagggcccagagaatggcctgacatcatcagagaagtacaacctggaagcaattcccggactttgagtagagacgtcgcattcgtggcagtttgagctttctttgcttgtacactttgaaaaccaacaaatcctaaccgtaaagcatccaatatgtcaggatttagcatccttttgcacggctggtgtggtgttaatatctatacacaaggagtatatatagtgttctattgtgtcccttgcagaagaaaaggttaaatagagcgcaccaatttgttgggtgcggaatgattagaagttcttgaattgctcttatctaggcgtttttgtgcatgttgagtgtaagatactcgcaacaaaaggagctatcgtaataaacacaggcattcgttgctaatttgctctcgatagacatctaaaacagcacaaacgatgtgagataatactcagcgtctaagtttgtacaattgataaatcatttacaatcgacagtgcagttcacgaaaacacggtctctacatcagaactcaatatcacagttaccatctggcgcaatatctcgaaacgttgcaattgccaaaccggataacattccagaaaacaagaaccaaggtctctccaaggtcgcgagggttgtttgtgttgggtaaaactgtttttttatattattatttttgacacgggggtaaaactggatatcagtactacaccaaaacataatcttggacaaaaactggattatcgtccaaagcacttcgaacagcttttatattagtatcatagtgcattcgaactgtgcctccaagacttgcgcgaatcgtagtagaaaaccgcagcaacaatattatcactgtctaagttgactggcaaacatataatatactgtaacatttaagtcacagttactggcaacttggagtgacttccgatatcacaattctggagttatgagccacttgtcagcctgaaattacattgcaaactaaggtcctttttgtttgttttatctcattattaatttggctgttctaaagcctaagccgaaacaaagggcctaatgcattgacttgcaggggcaagggcaa

SEQ ID NO: 52620 - DNA, 2739 bp, Oryza sativa
cacatcgtgttccttagtcatgagcccagttattaggaagtgtggatccttgtaatgtatgttctctgttagaaatcttgcatactgagccttgtccaaggaaaggagctttgttgttccaaaaccagcaatctttgccggaaatgtactagttctaggcatttcgagcttagatccagaaaaaacatccactattacattggcagttctgacatcgccatgaaccatgtcaaatgagtgaaggtgagcaaggccttctgcagcatcagtagcaatttgtagacgtacataggaagtgaaaggatgttcaatactctgccacgccttaccaaaaagagcgtcatgcaagcccatctcaccatactcatagactaatactggggcatcgacatgatctaggcagcagccgaaaagcttggcaacattccaatgcttaattctagattgcatgatcatctcataaaaaaatgtctgtttccaatcctcatcaacttccacagacatctttatcacaatcaatggagtgtttttcaaacgtcccatgtaaaccttgcccatggcaacatcactttttcctgaaaatgtctctgaggttgattcctgttctgggtcacctatgatggaatctatgtcgcttttgtaacaaatctttcaaagccagatccacgcaacatgacctttatttcccttaatgtcatgatccttctctctctcaactctgcaagccttctctcctgtctcaatatctctgaccttttgatactccaaagctgtttcaaaacttctttcatttgcggccgatcttctatttcagactttaaacaatcaagtgcaagatttgcaatttcctctataaagtctatattctcatcggctgcaatttccttgtcaaatagttcatgtcttttatctctacttgagcgagcaaacattcccgctagatttctgctctggtcatcaatccctttctttctggtgatgagctccaaaagaacaaccccaaaactgtagacatcacattttgggcttagtcgtccagtctcacagtacactggatccatgtatcctttacttcctataacaaagcccgtgtgttcatcattgtccatacagagaagcctagatattccaaagtcacatagcttcgccacatgcttgtcacctagaagtatgtttgatggtttgatgtctccatgaaggattggatgattttgggagcaatgcatatatacaagtgcttctgctacatccaatgcaatctggaagcgtgtctctaatgagacaggaagctggccactcttcccatgcagaagttcagaaaggttcccattggggacaaactcagtgaccagcattggagcatctgcctccacacaacaacccaataacctaacaatgttcctatggctacactgggactgtatgatcgcttcttttgtgaactccttttcctgtgttctccaattatattgtttcactgccactgaacggccattatcaagttttcccttgtacaccacagaaaaacctccttttcccaggacagtgccgtagttgtttgtgatgtgcttcatctgccttcttgtgaagcacctaacatttggatcaatatctgcttttgccaatacttcatttgcagtatccctaaaagattgtgaaagtttctcataccagtctcccatatgagtggcacagaatatgttgttatattgtgcctgcagattcatgaagatggtagattagtcaaagcaacatattcattgtttttctgtaatttatagtgtggagagccaataaaacgcatggaatacttttccgaggagatcatgtgtacgatttccagtttactctgaattttatcgaaaatagtagttgaaagccctactggagcaacaacaattcaatgctattttgaagatacaaatgtgtcaagacagctaatcttagcatgttgtctcaaaaatatactatatgttagaaattatttatggcagtacagatctaaaaaaatccttatatatatgaaagaatgatggccttgtatgcataaacattcctctcacagttggcctctgttttaagatcatagtacctttttttcattcttctcctaatcattatacgtatatgcatggcaaatatttttcacgttctcttaaaccaaattttattgcttttgaaaatatgtgagaatggttccgaaacagcactggacatcaagatgaaggaaaagaaatgatgtgggtccaggatgaagggtgacaggggattttgttttcatctaatagtcaaaattattgggtccaccactttatataaggccatccatttagcgtagcttcatgtgccccctcccccaaaaaaatctttcaattaatgaacaagatcaacctatattagtcttagctacttacagaaaaaagcaattggattctttctaaaaagaaaagttgactcatgaggtggaaccggtggatctcagattttttctatccttcctttagttttgatgtgctaattctaaagaaagagagagagttgaggagaagatagccccaaaatatttttgtacaagggaggattcgaatgtgggcgggctagtgttggagttgttccaaattcacttcaagatattggccgggcttctgacgaagcggagcggaggcccaagccggaggcttgggccggagcgtagcggagtctgaagcccggcccatccggccgcgccccatgcacaca

SEQ ID NO: 52621 - DNA, 13520 bp, Oryza sativa
  unsure (1)..(13520): unsure at all n locations
cgcggtacggtacggtatatatgccctttgctagggtttcgtggagacttgattctcttgtaagccgccataggcgtgtaacccaaaactcttgagatagtgagattgttgctggctggtgcccgtggttttttcccctttcgcattaaaggggtttccacgttaaatcgtgtgtctccgctgtgattgtttttcgtttactttgtatttctatacgtcgttcataacaggctagcacaccacccgtgttgctagccactagaccccaagagtctcctcaatgtgctagttctgaataatgaattagagtttttttacggtcctttgttcctcctggtacgtacctagtatctcgtatgtccattaagctggatgcaaagacccaggtacttgccggtacagcttttaacaggaagtcacaggtggagggtataaccacacaaaggctaaaaaggtaacttcatgtaaagaatagatcaaggatttgactacatggaaagagattgcggcgttgatagacaagcgtgctgttcatcgtaagccctctccagtctccagtattgtttcacatcttttccaacagtgcccttgttgattgaacggttggatctcatttcatacttggtggtaccagtatggcagtagctagaggtaccaccttctggagcataacaaacctcaatgaattaagatactagtctgttggtagtaacaagtttggagaagatgtagtcttcgaatagcatcagttctctttcaagtttcaacaacctgttcaacttcaagattaagcgtgtcctaaagctacagccgcacacacattggacattgtacatttgtactctgtcgtgtttttgcaaaacaaatggtggggaaattgaactgaaatcgaaccctcgcaacctggagtgactgtgtgaatttccatgcgcatgtgctacatcttaaatccttgtaatgcgccattccattatgtaagaagaagaagcatatgatctagttcctaaagaaattaacatgatctcgctcttctgtcatgcaaaatgtgcaaataaatcaaaaatcaagctgcaacaagaaggtagaagagagtgaaatagcctgtgcacctgtagctgtagcttagtacttcacggacagtcggttcgccaggattgaagaaaccgtgttcttgaagaagagaaccaggcagatctgatgacgggagaaagagtgggcggacaaagaagtagggcgcacgtggtggttggggggagccgactagtcaaccatcaggtcaacccaaagcatttccctttctaaaaaaatatattgaaaaatcaacatctgcagctttctgagggctgaggcttggccgtacatttttttttccaggaagccgcaatcggcggcgggagggagcagggccgctccggccgccggcggccgctcggggccgtcgcgctggtgcgaccttcctgcctggcttgtcgatgcgccctcgaacggcacgtgtcccgggggcaagcaatctccgacgcgcggggacgagggagagaaaatgggcatttagccacttttaaaacacggttttgctataatactattctgaaaatgcgtttcgctaaaatgccaatatgaaatacgcactcaccaccactttgtcattttggccattttgtgcattttcgaaatcattttctctcctccaccggatgatgagatgaaattgcccttcctcgtgagcgcggcgagcaggggacaaaacaccatggcctcgccggcgtattgagtggcggcagtggcggcagctatggtcttctcccaactccgtcgccccatctcactctccaccctactgctgaccacatcgagagaacaagcatgggctgcctctttggtctcaatcccatcgccggacgagatgaagacgatgatcatattcaccaccaagccacggtcgtccttgtcccttttgcgttccatacttaactcatcttgccgaacaaactttcttttgacgccatcgcgtttgatccattgtagcaacgggaacaccgccgtgccatcgtcatgctggagcacgctctgaagtgccgccgcttcggcagcgtcgatgtccggttcctcatccatcctggagcaagccaccgcgccatcagctcctccttgaggtcctctttaaaacccctcaagaaccgagaagattggagcatcaaggagggagatcgacattgtcttctccaactttggctgccggcgtcaatcttcgattccctccgctccggtgaccccctcgttgattctttgcgcatgcaccatccctgggacctaaccaacctcatggatgcacatgcatggcttcacatcgaatggaatgagttgacgtcgtctcgccgaagctcggagccgccactgagacgttttcttgatcgctgccatcaaccaagccccatggcctttgctcggcctcgccctgtccaacaccgtcgtcgccaacttgttccaccgcatccccgacaggtcgacgcccttgtcagcaacgacgatgaccacctcgctgcgctcgaccatctccaccggcggcacaaaacgaagaaggagagaaagaaagagaagagatggaccttccattggccccaagggcatttatgtctaatcaccataaagaagaggcaaaatgattttggaattaagagaaaatgagaaaatggcaatccggcgagttgtgtggccttgatattggcattttatcggatcacgttttaaagatggcattctagcgaaaccgtgttttgaagatggctaaatgtccattttctcgatgagggatccctcgcccacttcggtaatgatgggcaacagaccgcctgatccgatccccggccggccgccggcggctgcttcagagagatcccccgaggcatgcgcgtgctggcaggatcacagccgcaactggcgctcgcccgcgccgcagccacaatcacccgacgaccgccattgctgcctttgaggtaaaggcaaaaccttgtttaccctcgccgctctcctctcccaatttcggtttttgcgcagatgaaagctttatgcacagtatagtgtcaaacttaaaattttgactaaacgacttatcatactctttttatattagaagaagacaaggatggtagcagtgaatctgtcaccactcaccaagtatagttgttttttttatttaccacctactttatcatattttctaccaactatccatgtactttaatgttataaaataattcctctaaatatatgattctatcatatttcacctgtacaatatagcacacatgggtacaaaattatcccaaaaatatcactattaatttgttttaatctattgcaaagcaggagtatttggctagtaatatgaaatagagggagtaacttactccgttgcattgtaggttctttttatcatcacttcatttagttcgactccgttgttgtatgttttttatgaacggcgtatatgtcatgctcacctagttaaatgtcatggagtgcttgctacatgtaactcaacatgcctgtaattttatatggcagcacaaagcaaataagattgagagagtgcattttagttagtcttaggaatataatggttaattttactgttatagcttatttagtgctactgtcgatcatttctacaagggtttatgttgagtgtacaaggcttatttggttccaccttttgagccttagactgatcgaactgttaaaacgggaagttaccacgtcaacgagatggctctcagtgttcgttgaggtgtagttacacaatttatcatgtttccctacctttcgaacttacattaatttttagtttatccaaattatttttttcctcgagtatcataaatcgacaatcatacatgagagtattcaataattattggtggactaaatttgttttttgatgtcatggtcggcatcacgtatgagcgcagacagcgtgcggcgaagaaggactagcagcgtgtcggatcagaaacagtaccgcgcgaattgctagagattggtttaagttgttttgctgttttgttatccctttgttttagcaagattagttcaatgtaaggctatttagagccacaaatttatggttaatctaaccaagattcaatcacacttctcatcccattttctctgctcccttcctctgttctcccacttgccgtcacgggcagggtaaagtggttgccgaagcctcgccctccagtgacccattcatatccaatccgttcccttgccggtgctcgtaacaacttggtatcagagaccatggcaccagatcaatcctcctcctccacgcagccatcaccagatcaatcctcctccacgcagccatccactgatgccgacgcactggcaaagcttcaggaatccatggcgacggtgttgagcggcatttcgcttttggcctccaaaagtgacctcgccgatctcagtcgttctgtcgctgtcgcgacctcccgcatcaccgccttggagtagtcctcctccacttcctctggtccacgtctgaccggcggtggcctccttaaatcaccaccaccaccacccccccaccacctcccccaccacccccaccaccacctccgccgccacatgctagacacggcgcacagcacgacgccaactccggcaacgcagttcctcgcttttacaagctcgaatttccaaagttcgatggctctgacgatcatctcaattggcttaatcactgtgaacagttctttcatgcacagcgttcgccggatggggatcgcgtttggttggccacataccatctcactggtgccgctcaggagtggtatttccactacgagcaacacaaagggccgcctgattgggacacgttcaaggagctatgctacacccaatatggtccaccaatccgcaacaacccgctgggtgaactcaagcgcctctcacagtcgaccacggtggccacctaccagcagcgcttcctcgccttgtccagccgtgtgacggatctcctcaccgaacggcagcaagtccaactgttcacggcgggcctccgtgatgacatctgcatcgacgtggagctccatcagcctgaagatcttcgggaagccatggggttggcacgtgcatatgaacacaaagccaacttcagcccatcgcgcactatcagcaagcagttcgcgcgcacggttgcgtcatctccggccgctagcgcctccccggctccgacggcagtggccgccgtgcccgatgtgaactctcgccagtttcgtcatctgacaccggcggaactcgcagagcaccgcaaacaagggctctgttacaactgtgacaagaaatttgtccgcggccaccggtgcgcacggctctcctacatcgagtacgacgacacggcggatgatcccgatgacgactcggccgacaaagatgaggacaccgagccacacatatcgctgaacgcgatctcgggtgttgatggcgccaacacaatgcgcttggcaacctacctcgcggatgaagaggtggtggccctcgtcgactccggctccacccacaacttcatccacgctgaccttgcgttccacctcggcattccgctgtcgccggtccgcgatggtgtccgtgtggtggtggcaaacggagatcgcctcaccagccccggcattgcgcatggcctgcacctgcgtgttgccgacgaggtattcgacgtcgactgctacgcgctccaccttggatgcgtcgacatcatcctgggcacacagtggctacgcactctcagaccgatactgtgggacttcgtcaacatgcggatggcaatttgtcgcggctgccgggaggtcacgctatacggcgtcctcgacgaacgccccgcgtccacatgcgctgcgatccacactgacgatctccttccgtccctattggcggaattcgacgacctcttcgcgcttccaaccggtttgccgccggcccggaccgtcgaccaccgcattcacctcaagactggtgtgtcccctgtcgcggttcggccgtaccgctatccccagctacagaaggacgagctggagaagcaatgtgctgagatgctggcccagggcatcatccgtcccagcacatccccgttctcgtcgcagtcctactcgtccgcaagcacgacggttcttggcgcttctgcgtggactactgcgcgctcaacacggtcaccgccaaggacaaatttcccattccagtcgtcgacgagttacttgacgagctccacggcgcgcccttcttctccaagttggaccttcgttcggggtaccatcaagtcctcatgcacgccgatgatgtccacaagacggtgttccgcactcaccagggccacttcaagttcttggtcatgccattcggcctgacgaacgaacctgcgacgttccaggccctgatgaacactgtcctcacgccgttcttacgaaggttcgtccttgtgtttttcgacgacattctaatttacagcaggacatgggccgaacaccttcagcacatccggacagtgctcaccgtcgtctgcgccaacaaccttgtcctcaagtgctcgaagtgccacttcggtgaacaccagatcagctacttgggtcacgtcgtctctaccgacggagtggccatggatgcgcagaaggtttgcgcggtggccgactggccgcatccgcgttcgcgccgtacgcgggtttctcggcctcgtcgggtactaccgcaagttcatccgtaactacggcacgatcgcggctcttctgacggccctcctcaagcgcgacgcattccagtggacgccggatgcagcccgcgccttcaccgagctcaagcaggccctatcgacgcgcccgtactgcaactgccggacttcgccctgtcgttcgtcatcaaatgcgacgcgtcggggtccggcatcggcgccgttctgcaccagggggcgggtccgctcgctttcttcagccgggcactcgcgccacgccacgccggactcgccgcctacgagcgggaactgatcggcctcgtccaagcgatccgccattggtgcgcgtacctgtgggggagggcgttcctcgtccgcaccgaccactacagcttgaaatttctcctggatcagcgcctctcgacaattccacaacatcgatgggtaagcaagttgattggctttgatttcactgtggaatatcgcccagggcgcacgaacgttgtggccgacgccctgtcgcgtcgcatagaagacgccgaactcgccgccctggcgctctccggcccaacattctcgacattcgacgaccttcggaatgaggtggctaccgacggcgacctcatcaagatcaccgctgacatcaccagcggcaagctgagcgcgccttgggcactccgcgatggcctcatcctccgggatgaccgtgtctacatctcggcatcttccccgacaccgccggcattgctcgctcatgcccacaccgaccacgaaggagtcgaatgcacactccaccgattccgggcggacttcttcacgccccacgccaagcaagctgtccaggagttcgtacgcacgtgcgccacttgccagcggaacaagaccaaacacctgcacccggcgggcctactccagtcgcttccggtgccgacgcaggtctgggaagacatcgccatggattttatcgaaggtcttcctcgcgtgcacggcaagactgtgatcttcaccgtcgtcgaccgcctctccaagtacgcccatttcattccgctcgggcacccctacacagcgacgactgtggtgcgtgccttcttcgatgaggtggtccgcctccacggcatcccaagctcaatcgtcagcgatcgcgaccaggtcttcaccagctcattctggatggagctcttccgcctagcgaatgtcaagctcaacttgagctcagccttccaccccagagcgacggccagtcggaggcggccaaccgcgtcatcggcatgtatctacggtgcttgaccggtgatcgtccccggcattggctacgttggctgccctgggcggaatattgcttcaacatagcattccagagttccctgcattcgacgctgttccaggttgtctatggcaggccgcctctagcgctgcgggaatataatcgaggcttggcacgcgtccgcatagtcgaccaagccctcatcgagcgtgatgaatttttgggggaaatcagggagcgtctactccaagcacaagactactccaagctgtactacgacgacaagcatcgggacctcgcgttccaggttggcgactgggcgtgcgtgcgccttcttcaccgtcaggctgcgtccctgcccgggttccgtcgtggcaagctggcgccaaaatattacgggccgtactaggtcagcgaccgcataggtgatgtggcttatcgtctcaagctaccggccggcgcacggatccacgacgtcttccacattggcctgctcaaggaattcaaggctacaccgccggaccaaccgcctgctctgcctgcattgtccaatggcggtgttttgccaatgctggcgaaagctgttcgtgctcatttggcacgcggtgtgcgtcaggttctcatccagtgggaaggcaagccggctgcagacgcgacatgggaagacgaggcagaattcaggcacatgtatcctgcgttctagcttgaggacgagctgtttgcgaaggaggggagagatgtcatggtcggcatcacgtatgagcgcagacgtcgcgcggcgaagaaggacgagcagcgtgtcggatgagaaacagtaccgcgcgaattgctagcgattggtttcagtttgttttgctattttgttatccctttgttttagcaagattagttcaatgtaaggctatttagagccacgaatttatggttaatctaagcaagattcaatctacacttctcatcccattttctctgctcccttcctctgttcttcccactcgccgtcacgggcagggtaaagaggctgccgaagcctcgccctccagtgacccattcatatccaatccgttcccttgccagtgctcgtaacatttcatgtttgtgttcttggcagttcatgactttcaccaatttaattcatatatagtaccagttggttatttaacttgctttcgttgtattacgcaaccttttttcaactggtgaataagaccgcgaatcatagtaaagtgtttagcaagctagttagcgtgtggattggatgtgtcatgcgtgcatctaaatttacttaacacgagcgtgagattgaaaatcatgcaaataaaaccatttgcaattgcacatctacatctcggttgaaactacaaataatagatcggagggatcaattaaataaatagccaggaagagtatgccatagattctgaagtacaacttgcagtattattgcgcagaatctcaactagaatttgttactgcgcatgcagtacaaatttggtgttagattaatgggctaggcccaattaaatcttaataaattccaatggcccacatttaatgcaataggtaataataccaccttgaaaatctgaagtagtagagaggctctgttgaccggttgagatggagctagtagagagtctctgttcaccagttgagatggtgggcggacagccacacgcatgcgcgcgcgctccgagccggctaggccgaggtaggctgcttctctctctcataaattttgcaatggaggagaattgaatccaaggcaattgatacgatatcaatatgggcgcgattactcctgtaactcgtaaattctgcaacggatgagaattgagtccatcgcaattgatactatttcaatcaattgatacgatttcaatacatgtgtgattactcctataactcgtaaattttgcaatggactctcgtaaattttgcaacggacgagaattgaatccagcgcaattgatacgatttcaatacgggtgtgattactcctgtaactcgtaaattttgcaatggacgagaattgaatccagcacaattgatatgatttcaatacgggcgtgattactcctataacaaacaaatcaatctcgacttaaatcggattgattccgttgttactgcagtaacgattctccctcccgtacgctataaaaggcgaccaccaaggcagacagaagacacagcttgctggcctctgctctcctcctctcgcactcagatcttcctcagatcttccttggaaactccttgtgcctctattcctgtgctagctattgattccccggttctgtccacctgcgtgcacaagtgacaggatgagcgggcctccggaactccgtccgcttgtgtacctgcacgggtaggcggactatcaagtttttggggagcgtgcctgctctgcttctattcttctgcatcgcgatggcttccattggcaatggcgcaccaggagctggagcctggagggaacaatgccactcctggaggagggaacggcggcgctgcaggagacaacaacaatgaaggcaatacaaatgccttaatctccactgcaccgttttttgggtatatggttctatctctaattgatgttcttcttgttatttacatattgatcatgctatccttaggattacaatcctatgtgaatgttgatgatgcttatgttataaaaagcatgcccatatttctgttaagcaccaccactagatcacttactatttgtgaatgtcatgtttattatcttcttattttggattaaaatatgcctaattatgaccaaataaccaacaattgggtggaacctggtgtaaatttaaatcgtttttttaaaagatgctgcaagatctggcattctaactagatctcagcatctcggaggttcctggaatttatgcggatggagagcctggacaaaagcagcatggcttaatcgtatacacagtagacagccaaagaacattccatccaaaagatttacattgcaatgttcatcggtaactagcatttctgtaatcgagacacacttggtgatgcgtggatttgttgttggctacaaaaattggtcacaccattgagagatcccaagctgccacacgagttcccaaccaagagacacacgatgaagtgttcaagggtaggaatttcatggtagtagaagaatccgttgataatgagttggatgatgatgttggggtgacgatggtcatcacacaattgatgatgtcgatgatggtcatgtcacggtagatgatgccgatggaagagatattgcgtcatgctgaacctgaanttgtggctgggtctgctcntggtttggataatttcaatgtattacaaaaggcagcaaaaaaacttttggcatgatgaggcaaagggttgtggcaatgatttcacattattgcatacaatgcttgaacctaagattgaaagccagaaacggttggtccgacaatagttttaacaatttattggtcctgttgaaagaattgtttccggagcccaactctgccaaccaacacctatgaagcgaagaggctgcatctttattggcctttaatctctggcgggcccttggaccaccagtgaaaacctgttttggccgccataaaaaaacctttttttagtagtgatacaatccttagctattgtccaacagagcatattagtgaaaccgataagcataatataacgcccaggacccaaaaaggtactggttcagcttatccagttaaaccacacctacactattaactctctcacgttttcatcctcgcttcacaaaaaggttcgaaccggagttaatagtcctcaggctcccatatttataagctagtgctgctctagctgaactagcgaggtgggtctaaattttctacagtaccgcgatgttacagtgcagcacagtactgggctgctgctttgctatttttctttttcctctaattatttgcggggcttcacacataacataataaattctcacaaagcgatatgaggcttggttttgcggcggaaaactctatacgtacgaacaaatttgttatgaaataggtacgaagagcgaccatgggctgcttccttagcctgtatgttgtaatcttctcattagtatttaagcccataactaataaaggccacaacttcaggttcagcatgatgcaatatctctttcatcatgacgcaatatctcttcaggttcagcatgcctcattcttcatatcctcctcctcctgatcctcctgcacaattttcgcctaggagcaaacatgtatgttagagacacgcacaacaacactaaacaagatggaaagtagaatgaactcgatgtggattgggctccggagcacccattacggagacacggactcaccgggagactcatcccagctgactgttgcgcccgaagcatagtacctgatcaccttgccctcatgctccagcacaaagccgccatttccaacggggcacacatgctggaagaacacacggtagtcttctttgatgttggggccgtgacagtgcaatgcaggctccctagacgagctctccaccttcatccggcagcacttgcgcatccagccccgccatgggaggagatggaggcgctgtcgtttgtcgggggcttctcatactgtaggttgtaggaagggttggcgctgtcggcagggatgcggacactgtaggaatggccttcctcgcggacgttgggcagccggcagctgcggcggtggctggtagagcaggcacaacggattgacatttggcatcactaagggcatgagcaatgtatatggcccaagttgtccttaaggtgggccctgttgatgcgaaaaacacacactggtctaggagatctgcttagcttcagtgcaggtccaaatcttgatgagatacgggcgtgccagtcagtttgaccctgcaactgacaagatatacaaattgaagatcaatgagccgatcggctgacaagctgatggagtaattttagccgatgtcgataccagccgatgtcgatagggttttgatcagtcagctatatgtccaatacagataatgatataaaggcgatcggctgatgataatcaatataacaataatataatccagtataaaccaattggctagcaatataatataataaaagaaatactaatccgaaggttaaagcatacatcggctggaggtccgatgtcataaaatccacaagattagattaaacagtaaaacctttgttgccatcggctaaatccaatatgtatgcaatcccactacatgtttcatagcatacccgaaaactacttttataactacccaattacggagtagcgtttagcagtccctaagtaagctactacacatgttgggaaccatgataatatcaggtctaaggattcaacaccaatactaaatgagatcactgatgacacaacacatatggctcttacaatgtctcatgttgggtctatccaacaacatgttcaccaacatgtgtccacattattaatttggtatctctataccatg

SEQ ID NO: 52622 - DNA, 2157 bp, Oryza sativa
atcctaaccgtaaagcatccaatatgtcaagatctacacccttttgcacggctgttgcggtgttaatgtctatacatgaggagtatatagtgttccattgtgtcccttgcagaagaaaaggttaaatagcgcgcaccagtttattgcgtgcagattagaatttcttgaattgctcctatctcggcatttttttgtgcaattcgagtgtaagatactcacaataaaggagctaccgtaatagccacatgcgttaagtatagaccaatatgccttttgaatgtcagttttaaaatcataacaaaagtgatgatgaataggatcaatgacattatggcttacatcatctccaaatatcaaactgccttcttgaagagtcgtttcatcatgaagggtgttgttattttacatgagattcttaactcagtgcatcaaaacaaacaaattggattttattcaaagtagactttgaaaagcatatgacaaggtgaattggaccttcatttatagaatgcttcatgctaagggatttcctgataaatggtgtgattggaccatgaatgtgatcacaggagggtaagtggctgttaaggttaatgatcaaattgggccttatttcaagacataaaggattgagacaaggggatcctttatcccctttgcttttcaatctagctgctgaagctttgacagtgctggttcagagagctgtgaataatgagttgatagaggggttggggataaatgatgataacaaggttgcaattttgcaatacactgatgacacgattttcttgctgtcagatgatcttgaacaagctaaacatcttaaatactagctgtgtctgtttgaacagctctctggtctcaaaataaatttcaacaaaagtgaagtgttttgttttggggaggctaaggagaagcaatccctgtacagttagattttcacctgtaaaggtggagagcttcccatgacctatttaggtatccccattgacaaaaaaaagaattctgaacaaagactggaagatggctgaaaataaaatggaacacaagttaggatgttggcaaggcaaaatccagtctattggggggagactggtgctaatcaattcaagcctaaccaatatccctttgtatatgatctctttctacagacttccacagggtgttagggataggatggactattttaaaaggaggctcttgtggcaagaagattagggtattggaaagtttcaccttgttcagtggcttctggtttgctcacctagagatcgggggggggggggtatctgggggtactggatctagatataatgaataaagccatgttaggaaaatgggtgtggagaattgaaaatgaggatgtgtggtggcaagatattctaagagagaaatacctgaaaggaaaacctttgtctgcagtaaaacagaaacctggtatctcacatttttggcagggcatcatggagattaaagatctgttttacaaacatgttacacaaattttgggcaatgggaaagatactctcttctgggaggacagctggataggagtagacctttgtgtgaccaatttcctgacctttataatatgagcaattctacggtccttgagtaggtaccatgaggtaccaaaattttagtaaattttggtacctcatggtacctcatagtacttagataccatgaggtaccaaatttataatagaaaaaatggtacttcatagtacctcctcaaggaccataaaattgctcttataatatagttgtgaaaaaaaatggtgacaattgcaaatattaaccaaaaggggattgatagcattagcatagtgaaaaacttagggactagaacaaaatcaaggctggttgggactccctggttatcaatgcacattgtagagataaagtttggtgggaacttagtattagtaaagatggcaagttcagtgtgagaactttttataaagctctcaaaatgaaacaggtggtgttcccttttaagaaagtctggaaattcaaaatacctttgaaattaagatttttatttggttgtttgctaagaacaagattctgactaaagataacttgtttaaaaaaggttggaggaagggtgataaaaaatgccaattctgtcatttggaagaattgttatgg

SEQ ID NO: 52623 - DNA, 1572 bp, Oryza sativa
agaagatcttttttttttggccaaaacacacatccacctggagcccacgagagaggtaaaacctggaaagtgtgaaatcactgtcatgattaatatttgtgatgaacaattggctatgcaaatgatttaatcaatgaattggtttgaaaagatgtgtgaatgttggtgtgagtgcgtgtgactaatgtgggtcaggttgtgatatctatgcccagaaacggttgttttgtctgattgtgtgcaggtgacttgaggtcagccttggtcaatggtgaggaccaggactatgttcagggaggaacagaggtctagtgcgatcgggataccatgtgagaaggtgactagagtcaggattcttggaggtcaacttcggtcaacggtggggatcggaactaaactcagggaggagttgaggtccagacggtcaaggataccgggtgacgaagttgaatacgagatggcacacggcggatggacatagtgtgggaaagatcttcgcaacgggcttcacgaggtgtgtgtgcaagcgttggtgttcgcgaagaggaatgagagaagatagagatgttcatgtatggtggagtgcatggttgctacagtacttgatgtactgtagcgtgtatgatacatgtacgtgtgttgtacgtgtgtgatcagtacatgcatgtgtgtgtatgtgctgagattggttgggcacgtgtgtgtggccgattggatggaaggctgtcatgcatatgggcttgggtgtgcgcaggtgctgtgcacgtggtccaaaagcagcagcaattggtctggcctgggcgaccgagttgggctcggtggtgacaagccgactcggctcaggcggcaagcagcagcagcagctagggaaggaggagtctgacttgggtgcggctgcggattttggagaaaaaggaaattgaagtatcgagtcatattgtgtataggagttcttcacctactttgaatagagggtttttgtggtataaatagagagggagcgtgaggtttcctgtatcgcttttcagagcatggagttgataatttagttagttttaagtttagtcgagatttttgtaaggagtgatgttgttgcactttgtaaacacagagagaagcaataaagttgtcatttattttaagagttcttcgatttgtgttttatcgggttcggtggtctaaccggtgacataccgacggttcaaccggctacaaagcggcggttagaccggcggcgtacgagcagtccgaccggcggcgacaggactacgtcgagatttccatcgatttgagggtaacttttatttccgctaaaagtttttgggtttttggttttccttaccattcaccccccctcgtaggcttgattatttatgttcgatcctacataaagtttcacaaaaaaacatgaaaacaagaaacagtaccaatccaagcaacatccaaagtaaactgatgcggcttaatttcttctgttacacaaaaatttgaccgagcaaaatcggccacaagaaagaaaggccaaagggccagatgtagacaaatgcactgaattatactccattatcttaa

SEQ ID NO: 52624 - DNA, 11211 bp, Oryza sativa
  unsure (1)..(11211): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccagccaaggcgaggcccacgcgcgtgcaaggatattcagaacaagttcagttaactttttatgttttcgtctgaattcagatccgcgcgacggaatcagaatttctcggtcaccccgcatgtgtatcatatggttgggcgacgcgagcacgcagatctaatgacattctctgttgcattatcttattcgttcaaagagacattgcaagactgacactattaaagaaagagagaaaagaataggaggaaatggaaaaggaggaagaggtggagagtaactaaatgttaaccatatatcccctctatgatacgatgtctgtggcatgcaggctaatactataatcaagcgtgattaattaattagtagtattgctcgccttgataatttttggttgttaatctgatcgtctcacgatttcctcgatcggcttgcttttggacgcagggatgaggaggcccggaacagccaaggaaagctcgtaattccacatgcgcgacacgcatgcatatcgatcagtggtggaggcccaggcgaggagcgaccagagcagcatgtgggtggtgcatgatgtatgcatggtccatgcatgcacggattatgatagatgatggtatctgcatgttcgtcgttacgactggaacactcgatcgatatacgctttataatacatgaaactcgcacttcactgtcttgtgcggttcgtttttttttaaaaaaaaaagtatatgtgtcctcctatccgctgatgggttgttgctcgtttgtgctacaaagcgtacactcgtacatacttattcttttctaaagaaaggtctatatatgtacatatatacagcaggggttgcatgaaaatgggatattattgtacatgagaataactgtaggatccgagcccacatatcaacatatgatggtttttttaagtccgtcaattttacggtgttaccaagcaaaatgatctggatatatgatatttgatattatttttttgacggtgtttgagatgcaactttaataacaagtttttattagaattaaggataaaaatctgataatttcatgagattgtggaaacccatttcaagatagatctgcagaacacttacaagttttaaattttaaattcattaacagtttaagtgaatattgttaaaggcttgctcaattgtctagtcttcaatttacatgtcgtagctaaaatttaaattttaaaacttattccctctattcaattttaaatgcaatcatgattttccgtgcacaacttttaaccatccgtgcacaacgagacagagggagtataatgatcagatagcagcttagtgctagagtactacttgtagtatcatatatatgtcgcccagtttgatttcatttttccagtgagtctttgtctgatctgaaatggctcatacattttgtgatgctcgtggtcacagaaattttatacttccacgtctcggtagggaaaaacaactttactcaaattttgatgtaatcacggacgttacagaaaaacagcacacactcatatgcactcctggagttacaaaaggaacccagtgacaaaaaaaatcatcaaatttaattacaacgcgaagaggaataaagtactcgcacacatcaaatttaattactactacttcgtattagaaaatcaccaaggcaaagcaacggcatcatatcatttcagtgcagcgttgattagttgttcggtggcttttctcctccagacacattaggatctcttgatctaatctcgacgcgctgcaaaagtaacggaattaatcctgtgagatgagcacaatggtgccagtggatttgcactacgactgtaaaattaatcaggcagtctgagaaattaacaggggcatcctacctgcacagttgacagcttggtgggttccttgacgcccttgtctccggcgccgcggccgcagccggcgacgcgctcgacgaggccgagaaacctgtccttgagctgagcagcgaacttggccatgggagttagcttgcttgcttgcttcgatctggagctcgcaaaattcagtgtttgctgagctagctagctgctgctgatcagtagctggctcgctgcttgctttgcctgcttgctggatgcctggatcgattgccgagcgtcctatttatacagagaacggtcgtgtgtgtcccggtcaccaaacgcgtcagctttcacaggaagaatcgcgtattcagattacgttgctgcgcttggtctgcatttttctgatccacatcattccgatctatgcatgcggtctgctaattctatggtctcatcatgcaaaaatcaaaaatcgattgcatgggatcacaattagttggcgaaatcgcattgttaatttgttgcagcagtagtactcatgtctccccggatctttggggtcacatgagcaacgtcgtattgccgttgttcacagctgcctcgaaacagctaggaatcttcgcgattcctcacgtgtgacacatgcgtacatgcgtttcgcattttcgcccgctgtaaaaaaacacagcccatggacttgtccgaaaagttcggggaggattaggccggggcccacgtactgttccttttcctcccgaactctcaatctgagttagaacacagttttttattcaagaattggggaaattttagaaaagaaactgtgagcttctagatcgaaaatggactttttttttggctaatgatgcgtgttcctttcctaaacaaaggtggatgggttataaggtcaggtcaccctcgaccgacccggccggagtgcttttttttttttgggatccaataaaagtacaataataatttgaaaaagaaagcattgtaattatgtttttcttgcacaattatgaaaagtgcggctgctagctctcttttgtaccagcacagatcgatccaggctattaaaagttaaaacgactggaataattgtatgagatgatgattaattgtttaagatgttgtgtctgtatgaaaaacgagaccattcaacatctttttatagattgtcattatgcaaaatttatttggagagcagttcagttctcatttggtttataccttcctggaaccatatctaatatgtttgatggttggcttttgagggttgacaagaagaagagtaaactcatacttgtaggagcatctgccatatgttggactctgtggttgagtaggaatgatataatatttgacaaatcaccatctatctcatatttgcaggtaattttcagggcaacatattggctccggtgttaggcacagctgcaaaagtatgaagatgatggagagcttatgaaggttgcatgtcgcaggcttgagacgacagttatgcaactttttgcaaactatggatggagatttacaaatagacttgaataaatgtgtactccttatctctgtttggtcttttattttgttgggtgtgtttaatttcattatgaactacactcttcgtttgagtgatacattataataattggctgtagttttgatgagcaaaggccgaaatgttcattccattatctaaaaaaaatgtactagtcactctgccaaaaaagagaggaaataaacaaaaaccccgatcaccgcataggtggcgacggcgaagttaatgggcagaaatcctccaggcccacggctgagacatctatgggctacggcccaatagcccatgtagcgtaggcttgatcggctaagatctggaccgtcaggccatctgatgggccgaataaaaaaaatctgataggctactatactttttctgaaaaaaaaaacgcatggtacacagctcatttcatgtcagtacgtatacagattgggtatctgaatcgatcatgtacgtaccacggagtacacgtactgtacatggtttttctactccacgaaagaaaaatcaaatcagttgctctgaccgtaaggcagttgttgtacatgaagcggcgtcacatcaagtgacattgcactatgagattcattgccgtgcattcggcttttcaagaaaaaaaaacatttatgtggatggagatgcaatatcttctcgatctagaatgtgatgcatacacacatttataattaagaactggctctaccaatttcgttagctttacagcttgcaactactagtaatacatttgggggaaccatgcattcatatgcgttgtgttattattcggtgtgtactaaaagatctagagacataagcgtatgcatgctctcatagatcgagtaatctgatcaagaaagaaacaatacacacaataaatatccaactgagataagaaactttctgaatgacatcagacacagatcagttatgaagctcggctcgtaaacgaagttccatagatttcaacaccgcagagtacgtagttaatgcctgcaactacgtaaggagctgggtacaaccgtacaaattaagtagagaacaatcaaacagcatgaacaaacgaaaaataaataaacagaagctgcttgccacatgacccattttttgttcttctatcctagcttggttcaccgcgtgaaggccagcctctctccagccggcaacaatgccgctcgccggcctctatcagcaatgtacatggctccagccgacactgctagctacctgcccgagcagtagtgagcacttcatctcctgaaacctatatacatcatttgcgcacgcgtgcatgaagtgaaagacataacctgaaaaccataagccgaagtaaattcagaagtacatgcatgtttgctagacaagaacaacaatcgcaggaactgaataattaatcaagaactgtgtgagatcgagattattaccagttgttcaaaacatcaatcaggattgacgaggatgccatgcatgcacctactaattaacaccaatgcatgcagtaatagagctagatatccatgcttgcgcatgaactcacatgatacaagcaagcatgcatatatctctggccttctcaaacttggatagaagagaggagaccaggaggtagcaggccggaacctctccctctctggtcgcccaagggctctcgcactggagttgcaagtgattttatagccggctttgcacagcacacacgcaggcagaagagtgatggggttagtttaatcaggtgaagatgcatgcatggctagctagctatctcgtcgttttctctctagctagccccctgcaggagcatgggcgctgccatgccatattgccatgccctgagctctgactcgtagggagatatcatggatgcatagcagcatagggcttgtccttttgacgcccagaaaagacccaagaatctctccagcgcttgttcaattccatgcaaaaacctcaacttcagtgcaagatgcggcacatcatatactccatatattaataattaatctctcctcgcccaatgtatgtgattagttacacagcaaaaccgcggcagctgatacatgtgcgtatgtgatgctacaaaagtgcgttggcggtatagggttgtgtcgtataggtccctaaactctcaaaatatatatccaggtcccagaagttgtcaaagtgtatcgtctactccagaatcctacgtggcgctgatgtggcaacgccacatggacgtaacatgtccttttctttttctttcttcttttctttttcttttccgttttcttctcattcttcttttttttttctttcttctgtacggatcacagagaaaggagaagaaaggggacaaaagagaagaaaaaaagaaaaagaaaaaaattaaatgtcccatttgtcagttaaaataatgccacgtcatgttcgtgtggcatgccacatcagcgccacgtagaattctgaaggggttgtggcgatttgggatctagatgacacactatgacaagttttaggatttaaatatgcattttgagagtttagagatctaaatgacacctttacaagtttaagaaccgtccgtacactttactcttttgcaaattaagatgccttcatgtgcaggtaatttgtctgcatgatgcacgtagtatatatgcacgtactccacgagagatgtgagatcgatgtcttccaagtacactactttaccgtcagcatcatatcacgaaggaaaatctggagaagcttttgacatttcattttagctgcatcgatcatgcacccgtgtgagtcctgcatggatggatggatggatgggatgctagctgcttgcactttgcagggtacggccggcccagcagacaggcagggagacaggggcagcggccggcaacttaactttgccgtagctagtgcatcgcacgtcgcgtttagtaggctttaatttctgaatctaattaagctttgcataatccaatccagtcaagcacagaaacactaacaaatcgcagtacccaaaagccttcgccgctaactgcgcagtcgtcgagacgaagcgctgtttctctcgttattttcaacccaagctgtatgtgctcatgtgtcccgtctggttgtgttattgctggggatattctagtttatggaactgcgtgacgctgtagaagtaaattaaagagagtggattttaaactcaggaaagaatgttcctttggtgtttacatgtcgctaaaataaatacaaaaatagaaagtgtatgtattaacacgtgacatatcatctcacgaacaaataagttagaattcaacttttacatgttataaaaagaaaaacaaatttaatcacatgttaatatacttttttataagtgtcatataaataacgagtgaacatctccttcagagttttagaatagtttccccgagtaaaatgtaagtaaagcactgaccaaaagcgcgcggcactgtacaccagccagtattatgtgtgcgccagtcaccgtatcagtattcagtatacgccatgcatgcatgcatgcgacctactcctaggtagctagcccatgcgtcatttgcagcagatgagcaggggcagctatagctgctgtcttttggcctctgcatctgcagatgtagctagagcctgcaggttacgtgtcaacggcgaacgatgtggggagccatgcgcggggctcatatgagttgacgcctaggtgttgttagtttctgtactaagatgaaaatgaagttaactcatggaaaacaataaaattattagggtataatcaattattacaaatttaagagaaatggatttatactacaatatgatataacattgtgtggattcagaaaattggttcgatgataacataatataaatatcggcgtcataatatactatttatgcttagctagatatagtgttatcctagtcccttcgtcccataatataagtgattttgatattttgcttgtattgtttgaccactcgtcttatttaattaatttatgcaaatataaaaaataaaaagttgtgcttaaagtactttggataataaagtaagtaaaataataataataattttaaaattttttgaataagacgaatggtcaaacagtgcaagcaaaatgttaaaatcccttatattagaggacggagggagtatataaataaacaggttaatcataagtttttgtccaaaaatgatcggtgtcgcggcgacacctaaacattgtagatctaccctttgtgtctgtggctctgttgcatgcaaaaggataaaattttgaacagttgaaatatctgaattcatacttgacatgtaagagaataccaaaagaatattggatagctttaaaattcgtgtattacccaccaacccaaaccctttctctctttcctcctctgtctcaacattatcacttctccaccgccccctctgctagacccccttctccaccaccatcacttaatcgcgctattggctggcctcatgtcacgccccgaactagtgccgaccggaactagcccgtgacgctccaaattaacctgttaatcgataccagtcccaggaaacagtgctggtatcacagggagacagaatatcacagcaacagaggtctctttattatagagtaaaagtacagtcatgttgggctgcggacagatcccgagctcacaactgcattacaaaagggaaacggaagccacggcttggaccaaacatcacaggcgcgacttgggaactaggccgaaaccctaaaactcttcgtagccggcttgctcctagaagaactcctcatcagccggatccgcttcatcttcttcagcaactgggggggattatttatatagagcaagggtgagtacgggagtactcagcaagccaggggaaataaggtgtttaatgcaggcttcaaagaaaggctggtgtttttgcaattgattttattcgaactcttttctgaaacaactaagtgagtgcttctcaaacgacatggatgagacagtgcgtctcgtccgaacggagtatgtgcaatgtatcagtctttagaattgaaacaaggttggcacccggccaatagcttttcaacggccacccgggccaacaacttttcaaacggccacccgggcctagctgatcccatcagctacagatttttcaaacatcgaacctcttttctcaacagcaatttcacaagcagtagtcaaacaaaactacgctaggaatcacctcacatccgcccatgaccgtgggcacggctgttcgaacagttagttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccatatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcacaagcaccgacctaggtgtcgggttttccaagtcttttgtaaaacccaagttttacccaagttgtttttcagattttaagtttgaaggcgtccgtcgatactcgcactgggtgcacgaatatcgagacgcaactagatggttgcaagggggcatggtatcacaattaacaaaggaaggatcaaatgcaacaaattaggtagatctgccaatctgccttgcagacgggacaacagattaagtgcgatcctatcaatgcataataattttcaagcaacataattaaatttcaaatataggctcaagatgttcaaaggtggcttgccttgctcgagatctggagcttgatcctcgtaatcctcgcactgcgggtcttcgggctccggaactacacgcgaaacgggacaactcaacaaacggcgaaaataaagacctattaatgacctctaagcgtgccattagatagatctcgagatttgaggaattttggaagttgaacggagtcaaacggacttacggttaggaagatattgaatttctaagattattggatttttggtctaaaggaaaaggatttaattaaatcctttttggaaaagaaaagaaaaggaaggagggagggattatagacttttcctcgggcggctagggcgcggcccaagggaaaaaggagcggaccggccgagctaaatgggccggccggcccaaggcggcccaagtgcgcgcgcgcgggaggggaggagagagagggccggtggactgggctcaccacgcgcggtcccgggtgggacccgcttgtcagcggctcggctcaccgtgcggagggagcacgcggcgcacgcgcgcgggcgggggagggacgcggtgcacgcgcgcggtctgcggaggaacggatgcggcgggcccacgcgcagcctcatggctcgcagtggaacgcgcgcacgggaggggctgaccggggtcggcccttcccgtcctcggctgagctggcgacgacgtggcgcctgcgtggctgccacgtgggctggcgggaggtagacgacgacgccggccggaacggacggcggacaacagcggcgagcggcggagcgaaccacggcgatacgggcaatagcgagcacaccgggtggttgcacaggacgagaggagacgagccaacggctcggattcgccggagggagttcgtcggcggcggattgcggcggcgacaaccggcggcggaagaagggggaaacggcggtgaggtcacgaggggctaattcccggcggcgagagcatctacgcggctacgggaatccgatgctagcgtcggattgggcggagctacgccgagcgaggccggcgacgagcgggtgctacggagctcgagcggcggcggcggcgagcactcggcgagcgacggcaagggtcggggcggcaccggctagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcgcccggagtccccttccgcgtcctcgaacgcaccggctcacccggcgcttggcgaaggacggcggaggcgagacagagcttggaagacggcggcaatggcgcggacgagaaacggggaggaatgggggaaaagggaagggagggcgcccggggcttatagggggcggcaatgtcggtttggaaaccga

SEQ ID NO: 52625 - DNA, 1205 bp, Oryza sativa
atgggccgagagaaattcggcccatcgaccccgggggaggcaaactagacttttgcggagggatttgatttggaaggatttggattcggaattgaactcgacgatagatcggggattgagatcttgagagggcacggacactagacaacaagcgaagaaacaaattttgcaattagggtttttaagagataatttttccgctaggcgccacgacagaacgggcgctacacctcaccagcactagaaggcactaacggggctagtgaggcccattagacctccctctataggcctccgtgcctctctccacctcaagctgacgatgacgaggtggcattcctacctcgccgtcttcctcattttcaatagttccccgccattagttttgctagcgcatcacacgtacgatcatccccataagttaggggaactacccccttccaccttgacctcatcctgatacctaactcggatttgctgctgccatcgttggagatcaacgagcttgtcagggtgggagaagaaggccctcatcggtaagccaagagttttggctaatcagacaaagttggacttttcccttaagctaaagaaaaaccattgattggcttaattggcttgatgaggattttctgtggctggtggtcatcagcccaataagcgattcaataggctttagctgaaaagtctcagcccaaacatccatctgacgaggcccgaaatgtatgttttagagaagagtgtacgagtctcggagtatattggatggtctagaatctgtaatataggggcttcgattttctatcaaatggagactattgtaatatcccctcatgtgtactggtgtgttgactgttggctgatctgatctttccgggtgtctcgagttgttaaagatgtttcaaatttagctagtgatcgtgtgattttcatgacatacctgtaaattccattttacgttttttacatactagcattgtgagatgttaattaacagtttaaaattttcaaatgtgtatttgtggccggaggtagcaagagattttaaaaaaataaacagagatggccatgcacgcgcgtggtgtattaatttcatagcctcacgaagaacacggcgagctccgggcagtcgccgccgtgcgggctgatcatgtagagcgactccgagttcctggagccgatgatgtgctcgaagctcccacgca

SEQ ID NO: 52626 - DNA, 16060 bp, Oryza sativa
cagcacggcgatgtcgtcgtcggtcgggtctcgccgcaccgcgtaccccaccttcttgccgttgcaggacatggtccacatggactcctcgagcacccacccgtcctgctgctcgcgctcgcgcctcgagctggcgccggcgccggcgccgtcgccgccgtccgccgcgcgcttctcgctctccagcacgatgcgcgcgccggcggtggtgccgaggtcgcggagcagcgcgtgcgtcgggagcgccagctccaccaccagcgtcggctggcaccgcgggttgtcctgcagggacagcgcgatgcgggcgtcgcggtagccgaacagcgtccccgtcatgcgccggcgcgacgccccggcggcgccggtggaggccgacgccacgagcttcgacatcagggaggcggaaggggacagccgcgacggcgccgcgatccggcacgccgccccggccggctgcagccgcccgcaccccggcgtcagcaccgggagcgaccggcacatggtgtggaacatcctcaccggccgcgacggcctccccggcctccgccgcacgggcggcgccgcctccagcgctcgtcccgccgcccgcaggaactgcttcttgctgccggcgtcgtcgtcttcggcgtccgacgacgacgacagggacgccggcctcatccttcgtgaaccgccgtcgtccaccaccacggcgtgatcggccatatcttccggccgggccggggaagcgagcgagctaccggagttgccgccggcgctgctcgctccctcggcgtcgcgatcgatggatggatcgtcgcgggggcttcgtgatgcgctgcgtgcccatcgggagaaggcgaggggagaggcgcttttgatgcgggcgaagctggagctcgcggcgaggcgaggctggtttgggcagtttggcgagtttggttggcgtggttggcgggcagcaactggcgccaaaacagccggcacggagaccggttcggcggggcagttgcgcgcgcgtgcggtgggagttgctgtttttgcggttcagatctgcattctgcttgagtctgatgggctttagagttagagcccatcatggtttgtgtgtgtacgtgtgcgtgcgtgcgtgcgtgtgtatcagcccaaacgatatcgctgtatcagcccaatccgaagggaaataagcgattcggcggcctaactttcacaatctttaatttgcttcaaattgcagtttgcagagggcaacgtgatcattattaattcgtgactttggcaggacaggacgaggttagtactgtctctggtgcagctgcagtgctatcttaatgtcttatcaaatcagtgatgagcttgaattaatagggaaaaagatttgagaggtcgtattcgtggtagggtcttccgagttaagggggtgtttagatataagggtgtatagttttgacgcgtcacgttgtatgaggtgttcggacattaataaaaaaaaccaattacagaatccgtcagtaaacagcgagaagaatttatcaagcctaattaatccgtaattagcaatgtttactgtagcgtcatattatcaaatcatggagtaattaggcttaaaagatttgtctcataaattagtcgcaatatgtgtaattaattatttttaagtctatatttaatactttatgcaagtgttcaaacgttcaatatgacagggtgtaaaatttctgtgtgtgaactaaacatggcctaatattagtcccagtttctaatgtgtagtttcgggctttcgctggagctgttctcggattgaaaaaggaaaaatcattagcatatactactctctccgtcgtaagatataaaaatcggataaaacattttctaatactacgaatctggataggcgtctgtttagatttgtagggctaaaatatcctatccaatcatagattctaatatattagaaaagaagtaattacttatatagtatgaactattataaatctaaagatttcccaaaaaatacttttatataagttttttttaaaataaaacatactactacatgctaataatggataacaagtaccgtttcgagttgttgaaaaaaacttgatcatgtcttcgttttgcatgaactactaatttcgcaaatggccatggttttgttcccgctgatcatccatgtcttcgttcgcgcttgttagacattattgtagccttctttagctgcttctaaatgtaacgatgcatttctctcacctatcaattatcagggcaacaactagataatttgctgacaacattctcgatcagaaaatcgatttcaggtagctagcatgcttacatcgatcttgtagacctgtactccagattcctcagccagggaactcgacaagtaaacccggacaaactatctgctcggaaggataagaacattacattagattacagaatcccagcagtgttcgttaaacaataattaagaggagatgctgaccgatctgggtaacaaccagaggagagcctgagaccgcataattaagtaggtcatcactcgccagttccctccgggcaaagaggcaaagtcgttcatcatacctccagttcacgttagtctacatggtacataccgctatcaccttcgacgtttttccaaatgaatccatggaagagatcatcgatcgtcggtggcgatagcgatgacaacgagctgtacacgggccattatagctttcgtttaattctttttctcaatgaaactattagattttcttgatgagcatgcatgtgcgctgcagttttcctgtaggaatgttccaatcgagaagaaaattaagtgctccggccggtcatgaaaacataacgttttagatatgctttttaatataaaaaaacgtcaatcttcaaaaaaaaaaaggatgtatgaaaattgtaggggtagattgacaaaaaaaatttcataatactgtatcattttaaaaatatagaatttgggagatgattttaaagattatgccgatgtctgaaatgttctgaaaagcagtatataggccagactagactagaattctagaaaggttatagaaacaaccattacaaaattttcattcatgatttgatcacctcacccaactctgtaaaaacaagaggaaattaattaccggttggtagatgtctgaagaagacgggatcgtcttcgttcaaaaagaagagaacgagatcgtccgtgacgtgggttattgccggccagctgaaatggaatccggctggtaggtgagctggggagatagattcatagatatccttgaatgcctcgcagctgctttggtgcgaccaggcagtcaggcacagagacgctgtgcatgttattaactgctcctgtattcgtccgcatcaacattcctgttcagttttcgcgttgcagtagcaggtgtgccttccagctgcaccggcaaaggtttcattgctcaattgctggttagttacaaggctaaccctagcttttactgataatagcatatatatagctaagtggcagatattactggctcttgtaccttcttcaaaaaccacaacaactgatgagtaatctgcttgcagatatgcagatatgctttgtaaatgatatatttaatgaaattgatttgaaaatatattggatgttggtgtgagtgcatgtgactaatatgggtcaagttgtgatatatgtatctagaaaatttaagctgattcggtaatataatgatatcggtttctctaaaaaaattagttttgtttgattatgtttaggtgacttgagatcaatcttggtcaatagtgatgaggaccgagactaaagctcagaactaaagctcagagagaagctgaggtttgacacggccaggatactatgtgataaaattagactagatttaagataattaaaggtcaacttcgatcaatagtgggatcgaaactagatttagagaaaagttgagatctatttgatgatacatggtgaatagtcatcgcgtgaaaaagttgtttgtgatgggcttcacatgtagatgtgcaagcgccggagaagtcgtggagaaattggttgagaaaaataggagaaagctaagagatgtgcggtgctgcactgctacagtagcttggtgtgcatgcatgggcgtgcggtacaactagttgatttgggggtatgtttagattactgccaaaaccaacctcatcgaaatttggtaatgttaactttttggcaagttagcataattgccaaattttgattggacggaataaatatgctctatcataatttatatgttaccaatatttagtaatataaattaaatacaactatatatttatgaatttaccaaatattgatatggtctagcaccaatctaaacaggcccttggttcggtggcttggctagctgggcctatgcaacgggagcggctgctggccgttcgcaagcgaggcaacaggcaagctcggctcggccaggaagctggtcaggagcgagcgcagcagagcgagtccgaaacggttgtgttggtttccagctttgcagaaagaatttaattttggaaaatgtaatggattttggaaattgagggatagagttaactggaattagaagttctactactactttatatgggagggttttatgtataaataggtgtgaggttgagactcagagcaattaagtagaacacgaagagagaaaagatagggtttactttgaaatttcgattctagtttgtgggttgagagagaggattgcgttcgatacacattgtgttttttttttcggcggtgcggcggcggcacaagcatataatccggcgataaacgtcggacggaccgagggcactagattggacggaccggcatctacattgtatggtcctaacttcattaggtcaaagatttcttttattaatataatggtttttgtgtttttatcattcagcctttctcaatttctctagtaagtttggtttttatatttgtttcttttgatataatagatgaaaacgcccccaatattcagcagtgtagcattcagcaacctaacactgattctacgaaaatgacgctcctatctcatattactatcctgcagatacgccgttttattcttttatcacattcttcatcaacgaaaatactgtgtccaaatagtaattttcccagcaggatcaatcgcgtcaaattgggggcattcttggcaacattttcatcctcgatctgttccagctccacggcaataaatacggctcatttccgaatgaatcggccgcagagtcacagagaggagtaaataaatactcacgaaagaaagagttcagagaaaaaaaaaagttgaaacgaaagcgaaacagtagctctctcgccgagacgacgccgctgtctccagaagctacgagcatctagagcggcaatggatcgggtcgaggaaaaggaggggaaccgattccaagaaccagcatcggatcggtgcgaagacaacgaagataaggagcaggacaactctgaagaatcatcgtcggtggaccagcgcaaggaggaggaagaagaagaaaaggagggctgtgaggaggccacgccagcggcagcggcggcggcggcggcgccgtcattcttcgcgcacccttgctcgctgctgcagtacatagcccgggtctgcgcctgctgcctcggcctcagcgattctttctgcgacccaaaggcaagctctgttcttgtccctgaacctgaacctgcagctgccgacccgtctcaagaaggagaagaggacatgaagagcagtgtaagtagattgctctgcagtttctgcaaagcatttcgtaatagttcagttaattctaacatatgagatgaaattggtgtagtatttctacatgcaggaggcgaccactcgggtgcgggcagcgcggctaaggccgaagccgccgggcaatccgagagaagggagcggcggcaatggaggacaccatcactaggcagcctgcttcgatcgtcgtcttcagtcttcagttgagctgtgtctacttgttctaagcggcgtgcttgtataaaaatgtggccgaacaagttctactagtttacgtggacttttgaggatctgaactttcagtgaaaacttgttcgagtgtttaattaagtcttttctgtatatcttatgtgttcatcttgccagttaactagtgttcagtctgtgtctcatctctcaactttcaactctcaagtatattgctaatgggtgatgctaagttgttcacggaattgaattggtcgcggtgcagatacgccaggaagaaagaagctaaaagtgatgatgtctgaatttgtgtcatggtatcatggatagatcgaaatgcagtgctgcagcttgcatactcacgccgctctagcatctagcaataacaccgcgcgatgggtttaattagtttgtggaattgctaaagaaaatcccagtccataacgatccactttctatatggtagagtactccgtattttttcgaaactcattttccaagatagcaacgaaatgcagcaaccaaaccgaggttaacttatactactctctccgttccaaaatgttcgacatcgttgactttttagcacgtgtttaaccgttcgtcttattaaaaaaaattgtgaaatatgtaaaactatatatgtacatgaaagtatatttaacaatgaatcaaatgatatgaaaagaacaaataattacttaaattttttaaataagacgaatgatcaagtaaaaagtcaacggtgccaaatattttgatacggagggagggagtaatctttttggcacagatcgagattggataggacaaacaacaccaattctcttccccgtgcactcaggttgaccggcatacgaaggcgcagccctgaactattcaaaactggaggacgatccgttcgatccatacttcccgttgcacttgcacagagaattaaactcacctggccaccaccgcgactccgcgaccgtttgccgtacgggaagtcatggctcctgcggctgcctaacctgcgaatgcttcccagatcggcatgcaggccgcccgccgccgccacgacggggagacgttcgtctcccgcatgcaaatatgcaatgagattattatgggctatactcagtatcaatcaagaagtggccccagtcggagagattatgctgcaggggatcggaagccttttttttttaagcaattttacggtaattgaggaggtaccatgaggtaccactttttttttataaatttggtacctcatgttactttacagtactagttattaaaattttacactaaatttcatggtatctctttaagtaccataaaattgctcttttttttttcgcggatacgattttggacctggcctaacaaccataataggccgaaatttccagccttcacgtcaagagatgtaaggcccgggagccgggacgcgatcgcgaggagcgtgccaccaagtctccggcctcaccagcgtgtggcatctgtcgccgcccggccgggtgcctgggccgctgcgacgcgggatgacgctgcggaaaatttttgttccgcgccactggaatactggattgggcagccacacagctgagagcctgagaacctacgggcttcgactttgtttacagtcagaaaccaaacgatcgacttggtgtgctaccgtcacggataagagccataagtcaccagactcagagtctcacagagcagttgaaaacctgcagggtactgttttgtttactgtcaaaaaccaaacagtcgagccaatgtgctaccaaggacaggatcacagaaaccagaatcaaaatattccaacaactatacgactcggaatctatggagtcgaatgcttagccaattcgccggaccagcgaagaccgccgaccagctttataatgagattgagaagtttataaaacagtaacaacaaacaaatgttgcggtgctactagggaacaaattcccccatcgccacaacctacaacatggtacatgcaaacttcgctgacacgaaacagatgaaatcgaaaaggtgcaggaacaccgactcgaacaccggcatcatggctcgatccaggtgagctggaacaccgactcaaacacctcgcggtcatacagcactggacactggagtgtagtggtcgtcgcgcgtgagctcgtcgatggcggagctgacggcgctcaggtagctgtcgcacgctttggtcttgtccccgtacgacacatccgacaccgtcacgttcctctggatgctctggatgtagctggcgagcggggcgcgatccaggcagacgtacacctcgccggcggggaaccggcggccggcggcgtcgaacggcgtggcgtggccgtagagctcggcgatcgtcttcttcgccacgccgggagagtgttcgtcccggagagacaggaaggagagggagcggagggccgggattacggccgtgtagggcgcccagctgtgcgtgcacgccatgtcgatggacatcctggggctgtagcctgggacgggaggcagcgaggcggaggcggcggctgcggtgcggatgacgcgaaggacgtagcggggaacctcgtcgcggctggcgctcggacgacgaggccgatttgcactggaacggatgggcgaggctggctcagcgacataggcgtcgccgccgtcgctgtagccatccagtgagaagtcactcatttcgcggccgctgagaaagataccaatcgatcgtctggataaatagcgcggcggacacgaagtggagtggacgaccttgcacgccgtccgaagtcaaccgtgttgtgtcgctgacaactgagatgtcaaaacctcgtacgtttcgatggcgcacacgtacggcacaccgattttgtggtgtgttcgataatcgatgcacacactttctagtagaagtatttcttttacgacagagagcgcggattaatacttcaacatagtgattacaatcctgacgaacgtacaaggtcataaatctccaaactgcacagtgctgtgcctaggaggactggagtgatggagaggaattcagcgaagagagagaaggggatctcaagttcatgacatattgacatggactgcatcgccgggagtgatcccttcctcgacagcacacgaggagaacaacgaatcaggccagctcgtgagctaaacgggccgccaatatgggccaccttggatgtttcggtacggcccggatttggacgattcgcaacgcggttcacctctatgctagtcaagcacccgcctgccactcgtcgcggttttactcggattttctaatttcatttcgagagatactgcagaacttccaacgaaatagttataatattagcatgatatcatgggtaccggatctgatatttctggtactaaacatgatacaccataggtactagaccagatctgttacctatactgatattatgatttgacattagtgatacccgtttttaaaaggaaaaaaagatgctaagaagaaacttagcatcaattattaagagagaagaaataatgagaaaacccagcgtcgaggggactagaacgtgggccaacgagagcacctggtagctccggatcgagatccggtgcggtcgcagtaacaactgcaactttagcagttgcggttcggtggatggatcaaaaaccaacggctcagatagctgcaaaatactgttcacaaattactgtaggggaatctttactgtagcgattgctgtagcgtcagaggtgcaacagggttgcaagcagatctgagcctttcacttcatcaatccaacgatcaaaacgtacaacgacagctaaagttgcggtagtaatatcaactgcaccggatctcaatccggtagctccctaccaccgggctacaacctcgttctctaatgatacccgtatgtcagttatctcgttggaatgatatatcgttttgtactattatttttttttatgatgtcaatactaaatagttgaattgataaatatgtacagttattgatcggtcgaccatcgttttcgaaaagatgttagcgattccaattgtttccactgtttacaagtccccgtctagataatttcatctgtacccaaaaggtccgaaagtctaaagcattactacctctgtctcaaaatacaataacttttgactatgattctaaacaaaattgttcagatttatagctaaaatgcttacattttgagtgtgagggagtatctatcatcccgccaccgatgggcagtttaagcacacgtgcactaatcaggattcgaagaaatatcacacacgcaaccgcattctcgccacagataaacctgtgctccacgattaattcggagacgaacctaggattcgtcgcactgtccagtagccactgtgtttccaggattcacaagccaacgcatcaaagctcaccgtttgctcagccaaaggcctcatgtcactgatgtcagcagtgaatattgtcgacgtcagctacgtcgctgtgccggcgacggccgcgctgccgccggagccaatcaaactcacggcgatggaagcgctgtggctccctttcccggtgctgcagcacgtcctgttctacgaggccgccggcttgacgccgttcgacagcgtcgtcgattcgctccggtcatccctcggcgcgacgctggcgaccttcgcccctctcgccggcaagctcgtccacctcgaggacaccggcgacgtcgccattgcctgctcggcctcggacgcggtgaggttcgtggaggcggagtgcgacgccgacgtccgccgcgtcgcgggcgacgaggcgcacgacctgcggacgttcgagcagcttgtgccggagctcgacatgagcaagctgccgacgtcggtgctggccgtgcaggccacgcgtctccagggaggcctcgcggtcggcgtgacgttgcaccacggcgtcgccgatgggaagtcgttctggacgttcgtggaggcgtgggcgtcggcatgccggtgccggggcgaggcgccggccgcgacaccgtgcttcgaccgctcggttatcaagtggccaggtggtgaggagatcgccaggagcgtgttgcgtaagtacgcgccaaacttgcctgaggtatgttacttcatgccggaaattattttgatctcgaggtaacgttcttgtcacttaaatagttgaatttttttaaaaaagatatatataaacatgtgatatatcactccacaaatatacaagatcaaatttaacttttacatctcgaaaaaaaaaccaattaaactataactagttgatatatatttatagtcaaatttgttttttttagatgtagaagttgatatcttgttgtttgcatggcacttaagtagttataaaaaaaattaagaagatgtattaatatgtgatatatcacttcacaaaaataattaagaagatgtattaatatgtgatatatcacttcacaaaaatacaaggttaaattcaacttctatatcttgcaacgaaaaaacaagttaaacttgattatttggttaaatttgttttttggtaagttgtagaagttgaatttgagcttgtatatttatggagtgatatattacatattaatatatatatatatatatatatatatatatatatatatatatatatatatatatatatatatattataaccatttaagtgacatgcaagtaaccctttcgtggggggaggttgctcactttttttttcttttcgatgggaaagtcataatgcattggttagcttaaaattaagaacacgtgcaatggcgtcgcaggtgtccgagctggacttgcttgtagaggaacgcaagcgtttcacccgccggacattcaccgtggacgcgcagcaactcgaacgcctaaagcagcgcgcatcacccgcgacggcgaagtccacggcaaaaccctgcatcggcctccatccagcttcgtcgccgtcgtcgcgatggcctcggcattcttcgcccgatgcaagaccaccgccgcggacgaggacgccggcggcgacgtgttccttttcttcttcgccgacgtccgcgagcgcctcgacgacccacccgtcgacgcgggatactacttcggcgcttgtttgacagggtgtctcgcgagactcccggcgcgcgacgtccacggcgacggggcactggcggccgccgcgtcggcgatacaggaagagatcctcgagttggcggaggacccgctcgccgggtggaatttcatgagcctggcgggcaagatcccctcggacagggtgatgaacgtgtccggctcgccgggattccgcccgtacgacgtcggcgacttcgggtgggggaagccgaggcggacggagccgatcaggatgaaccacgacgggcaggtggcgctcgtgcgcgccgccgacggccatggggtgcaggtctcggtctccttgctccaatcggcacacatggaggctttcaagtcacaaatgcgcctgctcgagttaaagtgatcagacagacagatggtacatgcgacaaactacagcgatgaaaaaatagggcattttactggaaaaaagtattaaacaccacatctaaaagtgggagatagttaaatatctaaaaaaaattaagtagttaaatatctgaaaattttaagctgtagaaatcaagtactatcctattccatccaaaatataagtagtacagtttttcaaggggcttttaactatttgccactcttacgagtggtgcttaacgatttgccactaggcccacacgttatagacacggtgtggcaaatcgttaattgccatatcacaagagtggcaaatagttaaatttcccgtttttcaaataatatatctagatatatgatttttaaatatatatgtgtatatttataggagtgagtgtgcatgttttctcaaaaagatatctagatacaatttaaaaaacacgcagaattagaacgaacggattaccttcgtttttggtttttaaatataaagtaaattgtattggtggtaaacaaactcataaggtgggtgtgattcagtatacaaatttgtagagtaattattatggtacacgaacttgtctggtggtgtttttttattttaatcccttcgtttttctaaccggataaggttcaacacatatgtttagcccagattgcattagagccacggcaacttaatttttttgtctatttggaggagcttctgtcagctgcagcttctcttagaatctctggctgatagaagatctatcaaacagtctagattttcacttagattttaaagagttttagtcgtagaacccagaaaataaattagaaatcaaatgatgggttctccagcacctccagattgtcagcggctgcttatcataacttccccgagcaggacctccgtcggcttgctgggactactcgctttcgtgggcctacttttccaggccgaagaacacgcgcccaagtttgctctagggcccaaaatgggacgagacgagccagagtgccacccgtgcttggagaactgcgcatgtctccagtctccgacaatctgcgttcatgcttcatggtatagccgctcgaccggcggtagcagtagctgagctgagtagagagtactctactactatatcttttataactctaatatacagtcaccagtgttttctttcaaacatgtaataccgagactttccctccaaagactggtctgactgatcggtcagactgaacgatgaactgctgtcaaaccacaagcatccggacggcctgaccatcaacaaatagtcagaaaccaatttagagatttcttggatttccttacttagacgagattttagactataattagttttttacacccaattggacatgggaaaaatcctaggaaacaagtccgcatttttataaatataaggggatcacgaccgactaaaagaacaaccaatcaatcgtcaaaatcaatttattaccatagcctctatattccacaccttccttctccttcctatctatgacaacatctattctccttcaattctaaattgctttatcatctctggtctctaggtctctacggcgttaaatgacgtcctagctgatttgtcgagtctaggacaaaccagcatcgcgttccctctaatagggcttttccgtttgttggttcgatattatcttacaacttcttacggtagcatatctcagggtactaccgtgagattgcacataacgtgttcaacgtgtagacacgtgatttggtgccgacagatgccattttcctacatttcgccttcgacaaggacaccccttgcacggagctagtaacgctcgcattaatatttaattccgcaattagccaacgattcacgtatggctaattattgccggctgctagctgctcctccgtggctccagttgctgctgtgtttacacgcaaaaaacagcggaagtgtcgcaggcgggagagaggatcgctgctaccatctcgcatgtgaaaatagaacatttttgcagtcgcctccttggcccgcctgcgaaaataatctcagaaaaattaaaaaaaaccacggggcaccgccgccagcctcaccacgagcgctgccggcttgggctcccctccgtccgttgccgttggcgccgccatcgtcgtcgtcgtcgcgtcgatgaggagagccggcagccggatgcgagccgtcgtcgtcgcccgtcgtggccagtggcggaggtagcgaggaggaaagccgacggtggaggaggcgagccgtcgtcgtcgttcgtcgtggccggcggcggagggggcgaggagggaagacggcggcgcgcggatctggagagccgtcgtcgtcgctcgtcgtggccggcggcggagggagcgaggaggggaagcggctggcgcaggcggcgaggaggaagccggcggcgcgcggatctggagtgccgtcatcgtcgctcgtcgtggccggcggcggagggagccggcggcgcgcggacgtgggagaggagggagccgtcggcgaggagcgagccggcggcgtcgcggtcgtcgtcgtcgtcgtggccggcggcggagggagccggcggtgcgcggacgtgggagaggagggagccgtcggcggagggagccggcggcgtcgtggtcgtcgtcggcgtcgaggagggagccggcggcgcgcggatgtgagagaggagggagccgacgagtttttctaagtgtgtgtgagagagaggagggggagggaaatgagtggtggagaggagaggataaggatgattagattattttagtaggtaggcggaccacatcgcaggcgccacttaagtgatttgcagttcacctcgatttatattttttaggtgattatttggctcaaagagtcatgtgactggaaaaataaaacccacatcggggaaaatgcctttttctagtagtgtgcgataaaccagcgcctgcgtagtgcagagtccaaagcctcatgtctgcagtgagcatcgtcgacgtcagctatgtcgctgtgccggcgactgccgcgctgccgccggagccgatcaagctcacggcgatggaagcactgtggctccctttccccgtgcttcaacacgtcctgttctacgaggtcgccggctcgccgccgttcgacagcgtcgtccggtccctccggtcctccctcggcgccacgctggcgagcttcgcgccgctcgccggcaagctcgtctacctcgagggcaccggcgacgtcgccatcgcctgctccgcgtcggacgcggtcaagttcgtcgctgcggaatccgacgccgacgtccgccgcctcgccggagacgagctgcacgacctggcgacgtttcagaagcttgtgccggagctcgacatgggcaagctgccgacgtcggtgctggccgtgcaggccacgcgcctggagggagggctggcggtcggcgtcacggtgcatcacggcgtcgccgatgggaagtctctctggatgttcctggaggcgtgggcggcggcgtgccgcggcgaggcgacgccggtcgcgacaccgtgcttcgaccgctccgct

SEQ ID NO: 52627 - DNA, 13961 bp, Oryza sativa
atttaagaacacgtcgaccaccatttgcgtcgtctcaggtagccgagctggaaattttcgtcgaacaacggaatcggttcacccgccggacgttcaccgtggacgcgcagcaaatcgagcgcctcaagcagcgcatcgcccgcgacggtgaagcccgcggcgcgccactgcgtcggcctccgtccaccttcgtcgccgtcgtcgcgacggcatggacgtgcttcgcccgatgcaagaccaccgccgcggacgacggagaagtgttccttgtgttcatcgccgacgtccgcgagcgcctcgaccctcccgtcggcgcgggatacttcggcagttgcctgaccgtgcgcgtcgcgaggctcccggtgcgcgacatccacggcgacggcgcgctggcggccgcggcgtcggcgatccaggaggagatcgccaaggtggccgaagacccgctcgccgggtgggatttcttgaggctgatggagacgctggtccccgtcacggagagggcgatgaacgtgtctggctcgccggcgttccggccgtacgacgtcggcgactttggttgggggaagccgaggcggacggagccgatcaggatgaaccacgacggacaggtggcgctggtgcgcgccaaggacggccgcgcggtgcaggtctcggtctccttgctccgatctgcacacatgcaaggtttcaagtcacaattacttgagttattgggatgacagatacattcgattaattatacttcctactcctcattttaagtgcaactatgagtttctgtacccaactttgacagtccgtcttattcaaaaaaaatttataattagtatttttattgttatgagatgataaaatataaatagtactttatacgtgacttattttttttatttttttttcaaaaaagacgtgcgttcaaagtttggcacggaaaatcatggttgcacttaaatggaacggagggagtagtaattttcgctgccatatggacgagagagagagagagagcatgtttaatgaacagtgctaaatgatgtgtttcgtaaaaatgtaagaagtactccttccgttttaggttataatacgttttgactttggtcaaagttaaactgttttaaatttaactaagtttatagacaaatatagtactagtttcaaatttataatacgttttgactttggtcaaagtcaaactgttttaaatttataatattaaactagtttcatcaaatcgataattgaatatattttcataataaatttgtcttaggttaaaaatgttactacttttctctacaaatttggtcaaagttaaagtaatttgactttgaccaaagtcaacatgtcttataacctgaaatggaggaagtataaaagttttttttaaaaaaaatctattttttcaagtttacaatagttgatagttaatatatactgtatagtaacccactaactttaaagcttaacatacaaacatgccatatcatcacccactagcaataattatatattcaacctcatacaagcatgcaacatcaggtacaatttatttaattatacgaatcaacgtcatgcaaacatatccaattatcactcccttacatcatttccacaacatttttataaatctatctatcatttttataatatttaaattaaattaacttatcaatatgttccatattaaagcgggttttatttgtttgtttcaagataaatattaataagctctgttatttcatgtattttctttttacccctagcttgattgtaacaagaaaatatatattgaaaattacttagtaatttccgtagtaaagcgcggggaatcatctagttgattactactgtgttaatgacccgtcatgttttcaatgctccaataagctcaagcccaacctcgcaattaaacggtggaaaactgcgctaagcttttgcagagatgttctcaatgataggaaactatcttaatcttttgatggaatgtcccctagcccatttgtttaaataccatctaaatagtttgaaaaaactcaataaattgacaatattcatacgacacagtacgtatatcactttataaaatctaaagtttagacttgacccacacatccagaaatcagagtatgaaacagtacagatagtatttacatctggattatcttttatgtttctttggaatgagtttggtttaactttttttttcgaggtggtttaactttttttaagcgatagatgtcgctatatatagactctacattataaagaaaaagagtttcacaaccatttgtgttaagtttaattgaaaaaagtaaataagtgattagaatccatttccgctgaacttacggccgaaagcatgtttgtttgtgcgcgtcacgttttattctgttcgatcacgcgcgccaatcacaaacattctttcgcattatagtacaaaattctgagacttaatagtattgaattctctttaggacgaagtagtttaggagttgttgagtttagggatggcaattgcccatgggtacgggtatccgcggataccgacccagtgggcaggggtggagccaggtgtggggcagcttgggtctgggccctacacctgatagaaaaaataccaaggaatttgctaattttcctattaaaattcgttcaagaagttcatactatagtgattaagccctactcttgacatgatcttggctctgcccctgggcgtaggtgtgattttttacccatgggcacgcccgcccgaaacccgtagacatgtgggcaacagccaggtttcatttttgcttgtgggtaacccatgcccgacccgatacatatgtattagctaatttcgacttatctcttaattcttatacccatttctcttggttcatttgtgatactaactaataataagttgtgatgtaattcaaattattgttgataactaataatttggtaaattgttgattttatttctctttgttaaattatatatctttcgagttattattcatgtgagatccattgggtacccgccaggtatatccatgcccgtcgggcatgggtacgggtatagagttttgcccactaaccttagtgggtagggtttgggcgggcaacgacgggcatgggttcgagcatggttttgctctacccatgcccgacccgacccgttgccttccctagttgagttgcagggacctaatcacaaacacgtcgtcccaaaataatttgtcgaggtttgttggtaggattgaattcttttcagaacgagtagttcagttgcaggggcctaatcacaaacacgtcgcccctactctcgctgtcgtctcgcccattgattttctgatacgcttcagcatcgtgaacgtacctgctgagtgttactacttcttaaaatatatataaaaaacctggttgaacaataaatataaatttcttttggttgaaaaagacacgttccagcattataaatctaaacataaaaatcttaatagtataaatctaaacagattttctacgcagagattagcagtactatatgttcctaatatctcttatattttgattaatcgctctcgcggcagctgatacagccctgctcactcaccaccattgtccattgtgctagtacagcaggggagaggacggatgtcggctgctgtgactgtgcgtgtcgtgggagtcagccatgtcgctgtaccggcgaaggctgcgctgccgacggagccgatgaagctcaccgcgacggaggcgctgtggctacgcatcccgctcctgcaacacgtcctattctacgagagcgccggcagcagctggccgccgttcgacggcatcgtcgactcgctccggtcctccctcggcgcgacgctggcgaccttcgccccgctcgccggcaggctcgtccacctcgaggacaccggcgacgtcgccatcgtctgctcggcctcggacgcggtgaggttcgtggaggcggagtgcgacgccgacgtccgcagcgtcgcgggcggcggcggcgacgcgcccgacgacgacctgcggttgctggagcagctcgccccggagctcgacatgggcgagctgccgacgtcggtgatggccgtgcagtccacgcctctggtgggaggggtggcggttcgcgtgacggtgcaccacggcgtcgccgacgggaagtccttctagatgttcgtgaaggcgtgggcggcgtcgtgccgcggcgagacgccggccgcgacgccgtgcttcgaccgctcggttatcaagttgccggatggagaggcgttggccaggagcgtcttaaggaagtacacgccgaacttgcctgtggtatgtcgggaaatcattttacggatttgctaaataacatgcgagaaatttgaggatgaaatctcgtagattttagatcgtcggattcatgccaagatttgtaaatggacttctttatttctaatcttggtgagcttttttttgtttttttttttgggtaccggcgacatcccaactctttagacgacatacagataacgggttgggttgtgataagatgaggagagaggagggggatgatgatgaacatctaaccgtgcgtgggtgtacccgtggagtcgtcccctccacacacccttccccacgtcctcctatatacgtgcatgtatgtatacgcatatatatatatatgtacaaagtttatacgtatatatataaactttaaagaaaaaatatttcgtgtgtccggaaactgatcgcccatgcccttccctgtgtggctgatcaccacttagcagtttcagaggggaggaggaagacagggtttacatgcgtttaaaggaattgttgtgggtaacagaagatcgattggaaatatacaggaaaatgaaaaatatagaaagagtggcatggctattccaattctacaggaaataaaaacacataaatttaaaagaggtataggtgtttggctactccataagaaaatcacaagaattaattgtgaagaaaacgtttggctataatagataaataggcatttgccttgggcttaaggggattgtaaataggcatttgccttgggcttaagggaattggaaaacatgatcttttatcaaatgttttcagttttccaaaaaaaaataaataaaggaagtaggaattttggaatccatttcttaccatcaaaaggctccaaagaaaaaaaaatgggatttcaattatttcaaattcgttaaaaaaattctttgccttcaaaggagcctaatctgaacgatcattgcacattagtccgaagattttggaatgtttaaatggcaatatcagttgttaacaatctattgtttcgctgcttatacttattagctaaaatttaattttagatttgtttttcaatcactcaagatacttaaatagttttactaataaattgttttattattctttggttgctatttgctagtaagttataaggataagcataacaaagtataagcgaaccaataaagttgttaaagtctactaataccaattattgcatcccaataagatatgcgaatggggtgctaccgttttctagagatttttttaatcctttttattttctaatttcaaaaataaacccattcaaaacttatttacaagatttggaacttattgaccatgccagccggactaacgtagcaaaataatactgacacactggtctaaatagcgtgaagacattgtcttacattgacatgttaggataaaactatcacgctcgttgtagatgatatgtcagtgttgtcttgccatgccaggtaggttgatatggacaaaatgtttaactttaaaataaatttttgatgaatttatttttaaaataaaaaaggtttaaaagtgaaaaaaaaatatcgtttttggatgttgccttgataagaatacgtcgacatgacaaagcaggtatcgccgtcggcggcgccgccatcgagtggagaagaaagcaagtggtactcccgccggacgttcactgtgggcgcggagcagctcgaacgcctcaagaaaccactggtggagaaaccatctttggtcggtcgaccaaatctcacaatagtcccggttccactaaaaaccgggactaaaaacgatttttagtcccggttaaaaaatttttgatctttaccaaccgggactaaagatgatttttagtcccggttcatcccctgtcagatgtatgtcatggggtcgaggatttttagtcccggtttatactaccaaccgggactaaagattaccactttagtcccggttggtaatactaaccgggagtaaagatctcttgtcacgccccgaactagtaccgaccggaactagcccgtgacgctccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaagggaaacggaagccatgacttggaccaaacatcacaggcgcgacttgggaactaggccgaaaccctaaaactcatcgaagccggcttgctcctggaagaactcctcatcagcgggatccgcttcatcttcttcagcaactgggggggagattatttatatagagcatgtcacaccccaatctgataccgccgtataacggcacctgataggagcgtgtcgtagggaaaacggcgcgaaccgcttcctacgaaaccgcgatctcggtaccagtcccaggacatagtgctggtacccacggtgacaaatatgaatcatagcaaatccttaaaatagatagaggacttatttaccttaacttaggttgcagctcagaacaacccgagaatgcaaccgacgacacggacgaggaaacaccaacaacagcagcagcagcggaaccaacgaactaacacccaacaccacaggcgacggctgggaaccaggacgaaaccctaatcttcacttcaccttatcttctcttcagggcggaggaactatgtatatatttatatagagcaagggtgagtactttcgcactcagcaagtcacgggaacttaggtgtttaatgcaagcttggaagagaggcaaggttgttttgcaaatcttttatttgaagacattttgaaatcactaagtgatttatttctttctatgtttgggcgaaaagagacttgcgtctcgattcgactttaagagatgcttttcaacaactcatttagcaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactctagacactggccggtgtcagaggttcgcgacaaagcctttccccagccgacccagggttacctcatgccacatagaaggatcaaatcctctcataaacataggcctttttaggcgtgcacaaatcaaactccaaccaccttgatcggtaagtgagcaagcttctcgttcttgccttaccaggaacccggtttgtccgaccccgccccggcgttcccaactattggcatgcgaggtttccctgaaccgtctagttacttagccagggtgtcccattccaccttgtggttgcacttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacgaataccgaggtaccacaagggtggagcgacaaggaatcagggtagtacgacctacggaaattagtgtgactactgggtaggtccgtcggtctggcacgcaaaccgaggccaagcaagttaagtgtgtgattccactaatgcaagttgcaaacaaaataataatgacttttcaattataggggcaattgatcaaagggtgacttgccttgctcaaggtcttcacgaagcttcacgaatcttcaagaaaacccgcgatcgacgaaaatccgataaccgcaactatacgcaaacaatcgaaaacctaaacaaaagaccaaaggaaagatcctatttagactaattattagtgccattaaatagatctcaattttacggaattactggaagtggaacggagtcaatcggatgagcggttgggaagatatggattttctaaggtttaaggattttctaatcaaagaagaaaggatttaataatttattaaacccctttctggaaagagaattgaaggagggatgtaaactagacttgtttcggtggcattggcgcggcccaagggtcgaaggaggctcggccaagccattgggccgacgcgggcgcaaacaggcggcccattagggcgcgcgggagggagagggggcggtccggtggaccgagcccaccacgcggggtcccgggtggggcccacttgtcggtgatacggcccacggtgggatgggcgcacgcgagggcggcgctagggttcgggggaaggcggtccacgcgcggcgcgcgggtggacgcggtgtgcggtgggcccacgcgcagcgtgtcggctctccgtggaccgcgcgcgagggtgggggacggagggaggcggctgaccgaggtcagcttttgacccggtcgcgtcgaggtggcgccgacgtggcagccacgtcggatggggaggcagaggaggccgggcaggctgatccgacggcttacggcgtgcggcgggatccggcgaacggcggcgagccggaaggggcggctagcactggcggcaggaggaggagaaggggaactcattccacggctcggatcaggaagaggacgtgcgacgacggccggcggcggcggccaatctcgctggcatgccgacgtggccgcgcgcgaggagagcgaagggtgcgcgggctcgggcttagccgaaccggtacggtgttgcgacgcgcacgcggtgacgcgggacccgatggtcaccggcggcgcacgcacggcggtgttatgcggcggcggaagcggcgacacggcgcggagacaaaggagaaggccgacggccttggggcagccagggggaagtcaaggggatccccgggggcgtggcggcgagaggaatcgacgcgagagaagccgacgatggcggattgcggcggcggcaatcaccggagagcaaaaggggaaaacacgacgagacgacgagggttcgattcaaagggatgggagcatctccggggttcaaggaatccgttcccggcgtcggattggacggagcggcaccgaggttggctggcgacgagagacggcctccgggacagagcatggcggccggcgagctagcgtgcggtgcaagggcgacgagcggcgattcggcggcgagacctggggcagtgtccatgcgtgttcggggggctagccgagctaccacgtgagctagggagggagaggatgagcaagaagggagaacggagggtggcattaccaagccgagacgggcgcagtgacgagcggccgacggctcgggagcgagctctccggcctcgggccgaggaaggggaggaaggagggtgcccggagtcccgcgtcacgcgtcctcgcacgcaccggtctcccggtgctcggcggcggacggcgacggcgagagcagaggaagggcgacaatggcgcggtggagtaggagtgtgaagtgggagggattgagatgggatggtgagctcggcttcgggttttataggcgcggggtgaggcgatgtcggtttggggcggaaagaaccgaccttggtggtcaagcgctcggctggcggcagcggcggtttcgtgggcgatgcgaaagtggcgacggcgtggatgctttgggcggcgaaggcggtggatcggacggccgaatccgaaccacgggagcgcaggctggcgcggtcaaggtgggggcggcgagctggcggtcatcgacgcgtgcggccaagtcggcgacaggtgatgacgccggcggtgtcgggcaaaaggaaaaaggtgggggaaaagggagctctgctccttgctgtttcgggataaaggaaagggagagggagcgaggccgagggctctgcctccctcccttggacgcatgcgcacaggcggggctgggcgacgcgcggtcacgggcggcgtcagggctgacgcggcggcgaccgagcagctggcctcgagagagcgcgcgcgcgcgagaacgagcagcacggccgaaaatcgaatggcggcagcgggaaaaatcggtgatggcggcagcgctggcgttggcggcgaccggccggtcggccacctcgcgaggcgcgcgcgggaaagggcgaaggcggtggaggttttgggcgacgacggcgggaagcggtgtcggcgcgagagagaacagagagggagcgagaaaacgagagagaaagaagagaggcgatgcctctctctctcggcgcgtgcagcgcacgtgcggggaggaggaggagcagctgagaggagatgggccgaggagaaaacggcccacaaaaatccgagggaggcaaaaatagactttttcagaggagattgatttggagagaaatggagagatttagggtttgggttcgaattcaaatttgatattcaaactcgagggtttagggatgtatcaaggggaattcaaggagaagtcatgggaaagattcaaaaggaatacttgggtatttgttctcgggaacataggggagtcaaggaaggaaacaaaacgggggtttggacattttgggatttggaaatgtgtttggcgaggattcaaaggaagggattgactttcggatttagatttcggagacttgaattgggagaggagatttgaggcggaggattttgatttcgatgagagggaacaacaggatttgaattgagatcttggcacaacttagactcgcacacaaagaacgaaaattttcgcaattaggattttgccgaaatagtttttaacgactcacgaaaagcggagcgttacagagcaagggtgagtacgggagtactcagcaagccaggggaaataagtgtttaatgcaggcttcaaagaaaggctggtgtttttgcaattgattttattcgaactcttttctgaaacaactaagtgagtgcttctcaaacgacacggatgagacagtgcgtctcgtccggtcggagtatgtgcaatgtatcagtctttagaattgaaacaaggttggcacccggccaacagcttttcaacggccacccgggccaacaacttttcaaacggccacccgggccaacaacttttcaaacggccacccgggcctagctgatcccatcagctacagatttttcaaacatcgaaccccttttctcaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggaaatcagccacgtcgggggacctccaagctttcatgacaagacatttcgaaaaccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctggtaaactagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaatttcatttagttcacaagcaccgacccaggtgtcgggttttccaaatcttttgtaaaacccaagttttacccaagatgtttatcatattttaagtttgagggcgaccgtcgatactcgcacagagtgctcgagtatcgaggcgcaactggatggttacaaggggacatggtataacaattagcaatggaggggtcagatgcaacaagttaggtaggtccgccaaactgtcatgcggacggaacaagcagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactacacgcaaaacgggacaactcaacaaacggcgaaaataaagccttattaatgacctctaagcgtgccattagatagatctcgggatttgaggaattttgggagttgaacggagtcaatcggatttacggttgggaagatattgaatttctaagattattggatttttggtctaaaggaaaaggatttaattaaatcctttttggaaaagaaaataaaagaaaagaaaggagggagggaatacagacttttctcgggcggctagggcgcagcccgagagaaagagcggctcggccgagcttaacgggccggccggcccaagaaggcggcccagagcggcccaagatgcgcgcacgcggaggaaggagagagagagagccggtggaccgggctcacctcgcgcggtcccgggtgggacccgcttgtcagcggctcggctcaccgtgcggagggagcacgcggcgcggcgctagggtggaggatggacgtgatgcacgcgcgcggttcgcggtggacgtgggtgcggcgggtccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacgctggccggaacgaacggcggtcgacagcggcgagcgacggagcgaaccacggcgatacgggcaaaagcgagcacaccgggcggttgcacgtgacgaggggagacgaaccaacggctcggatttgccgggggttgctcgacggcggcggcaaccggcggcgggagaagggggaaacggcgacgaggtcactaggggctaattcccggcggcgagagcatctatgcggttacgggaatccgatgctagcgtcggattgggcggaactacgccgagcgaggccggcgacgagcggcgcttccgagctcgggcggcgacggcggcgagcacacggcgagcgacggcaacggtcggggcggcgccggctaacttcggggaggctactcgagctactaccgaaagctaagggggggagatggagcgaggaggaagaacggagggaggcactaccgtgcgggacgggcgcggtgacaagaggccgacggcgcgggagtgatctctccggcctcgggccgaggaagaggaagaagagggcgcgcccggagtccccttccgcgtccacaaacacaccggctctcccggtgcttgccaatggacggcgga

SEQ ID NO: 52628 - DNA, 5668 bp, Oryza sativa
tcggcccatcgaacccgggggaggcaaactaaacttttgcggagggatttgatttggaaggatttggattcggaattgaactcgacgatagatcggggattgagatcttgagatggcacggacactagacaacaagcaaagaaacaaatttcgcaattaggatttttaggagataattttcccgctaggcgccacgacggaacgggcgctacatctttagtcccggttggtattaccaaccgggactaaagatcgatctttagtcccggttggagttatcaaccgggagtaaatatttctctcccacatctgatcggttaagtcccagacagatatttagataagattggaacatccggatcccctctcttcctcttctcagatccaatcctcttcctcctcccatcccctctcttctcctcctccccttcctcttctcctcctcccctctcctccctcccatcagccggcccttcctcttcccctcaactccctcttccatcagccggccggcggcggggaggcgggcggcgggtggcgacggcgcggccgcgcgcggggaggcgggcggcggcacgcgcggccgcgggcgtggaggcgggcggcggcgcggccgcgcgtgtggaggtgggcgcgcgcaggcggccgacgggcggcggctcagtttgcttctttttttttttgtaatttgtgtttcactagatgtatatttttttagattttgtgattcattgcatagatgtataatttgtataatctgtgatgtatttaatttgtgtgtagttttttaggatctgtgatgtatttgatctgtgtgtagaatttgtggtgtatttaatctgtgtatacaagtaacttaatatttgggatgttgatttggggatgtgcatcccatttaattcgggagaaaatatagggattaaccctagccattagcaaatcaacaataaaataaaaaaagtatctcgaggaactgtcgcttcccaccaaccgggactaaagattccctctctttactcctccatcttatcgatttttagtcccggattcgtagtgaggttctaaaccgggagtaaaaaatattttttcaccagtgaacgcatcgtccgagacggcgaagcccacggcgcaccaccgcgtcggccaccgtccagcttcgtcgccctcgtcgcgacggtctggacgctcctcgtccggtccaagtccaagacatccgccgcggacgacgccgaggcgttcctcttcttcttcgccgacttccgcgagcggctcgaccctcccgtcgacgccaggtacttcggcacgtgcctcaccgggtgcttcgtggcgctcccagcgcgcgacctcctccacggcgacggcgcactggcggccgccgcgtcggcgatccaggaggagatccggaggatggcggatgacccgctggccttgtgggatttctttagcctgaacagcagggcggcctaagagaaggtggcgaccgtgtccggatcgccggggttctgcccgtacgacgtcgctgactttgggtgggggaagccgagatggacggtgccggcgaggatgaaccacgacggccagatggcgctggcccgcgccggcgacggccgcggggtgcaggtgtcggtgtcgttgctgcaaccgaaacagatggacgctttcaagtcgcgtttcctcgagctactgggataagatgaccgatagttcatgccatctaggcatctagtactagactcatattatgcatatcttattttcctctactgcatggactcaagacaatatttggctggctggctggctcaccctgtttgttatcctttcatggacgtagtataataatgagataatctcatgtttgccgatgtcttaagtatataatactacgtctgttttttaatatatgatgccgtcgattttttataaacatttggccattcgttttattcaatttttttacaaatataaaattaagtcatgattaaataacatttgacgataaatcaagtaaaaaaaagataattacataatttttttttgggaaattacataaatttttttaataacataaatggtcaaacgtataaaaaaatcaacggtatcatatattaaaaaaatgtaaagaatagtaatcagtaaacctgtttttcccggtgaatataagggcaaactactgtcacggttcgcacttcgcaggctggggaaatgcgaggaacgccgattggaaggccgcgtgaactacttttaataaaggcccacttaaaacaaagttggcacaacactattcatttactctgggtgttggatgcgggccaaagttagcccaaccaaacagcttgaagtggatcttgtacttttgtggataggaataagttcatctgagatcccttaaatcgattcctcaccacggacgtccgtcctggaatccatggcgctgcggcgtttcgccgtcgccggccgcgtcctcctccaccgtgtggaatcccttccacctccgcgcccgccgctcgcgttcctctcctccgaatcccgcggccacctcgtccgccgcttctccaccccctcttccaccccaccgcacttcatggtccagtacctcgtctccaagtgcggcctctcgccggcggccgccgccaaggccgccccgcggttcgcccacctcgactcggcgtccaggcccgacgccgcgctcgccttcctccggtctcagggcctcacccgcgcgcaggtccgcgaggtcgtgtcgtggaagccggagctgctgctcagcgacgtcgacgccaccctcgaccccaagttccgcgccgtccgcgcgctcggcctcggccgcgccgacgtcgcgcgcctcttcgccctctacccgccggcgctcacctacggcatccacaccaacctcctcccgcgcgtcctcttctggatcgacttcctggggtccgccaagttactgatgaaatggctcgccaagacgtggctgctccggtacagcgtcgacgccctcctccgcaacctctccacgctccgatccctcggcgtccagcagagccgcatcaccaccacggtgcggatgcagccgacgctgatcacgcagacgccggccaggttccagaagctggtcggccgcgtcgaggcgtgcggcgtcccgccaagctccgggatgtacatgtgggccttcttcgcgctgcacaacgtcagcgagggcagcttccgtgccaagaaggcggccgtggtgggagccgcgggctgcacggaggaggagttcgacgccatgttccgccgcgcgccgtgcctcgtgttcgtgcccgcggcgctgctgcggcggaaggtggagttcctgatggcggaggccgggtgcgacgcgacgcacatcgtcaccaaccccgtgctgctgacgctgagcctcggcaagcggatggcgccgcggtgccgcgtcgtggaggcgttgcggtccaggggcgtgggcatcgggaagaaggcgaacctggggagcgtgatgagatatccggaggacaagttcgtggagcggtacgtactcaggtacaaggaagaggtacctgaactcctcgagctgtatcctccccgactttgcaagggaagctcgcagacacggtgacatttctgcgaggttgtgttgtgttacatccataggttgagcttgttgttaagggtacattattattgaagaagtgtaaaacattcgattctgaaatatctacccatttcgtgtttcacatattgggtctgtaaaacattcgattctaaaatttctgcccgtttcttcgggttaattctaaaataattaacccttcttcttttgggggagatagcaggtgtgagtgtgtgactgaccagtttcatgtcatttgtttcaaattcatgatcaatcttagataatttaatctttttcatcataggttcattgttaccgtcgcttttacacttttcgatttgaggttgctcttcggactttgtgggccatgtggcatccggccattttaaggatggagttccccctggctatattcaggtattcattcagctaaccacaatatgtccaaataatgtagagtaacaggttgaggaacgttcatcaaacaagctgcggtgtgtagtagcagagtcagacataagcagaattggtcagctaacctaatactacatcagcatgctaaacaaatcttataaacaacgcatgcctagtttttcctacttccctccaagagtccagtctccagattactacacgtgacacaaaaatgacattcctacttggaagaatgtggaagtcaagctattcagcctacattgtacagtgccttcgctgcagactgctcattgccctggttagccgaatggttatgcatgcctcccggacaccagggcaaacctctgttctggcagctcataccagctgagaacatatttcatcgttgagtttgaagcactcccgagatgcaactatgcagccttaggagttaattggggaagagtatggcaacctacttggctgcataccaattctgcgcacacttggcatcaacagccagttcaacattcaagatgttggtgccgtagaagggcttggacatgcattcaaccacaatcgacttggccagatcggcagattccgtaggcccttccagtatcacttcatcgtgcacctgaaagacggagctatcagttctgcaaggtgttacacctaacggataaagggaaaccagataatactgcgaacctatcaagaaacaatttaagatccacaactagccattaatcatgcctaattgttttgtacctgcaagagaagcctccaaccgagttccttaagacgagcattccgatctatctcgagcatagcacacatagcaacatctgctgcgctgccctgtgaagttacaaaacactacaatttcagcatagaagagacactaccaagcacaacttttgagttgtcatagacggtaatgacctgtactggtgcattgatagcagctcgctcaatgtgacccctttgaccagaagttgcatgagccatgttaggaaagcggcgcgaccgcccgagcaaagtgtaaacttcacacttctcctgcgctaattcttttgtttcatttgccaagctaaaacctcttttctatccctgtaccagagtttcagggtatcctttgcttccttgacagagacctgccaagggaagaaattatagatgtgcagtgatctttgaaaacagcgacggaaagtacaggggactgcatctttttacattaataggagagcagttgtacaatgcttcaacagtaaatctaacaagtatgactaatggtcatgtgcaagctgtttatggttcccagatggtcagtcaaagcgggtaacaagtgaagtgcgtacttaagctagtaaagaatcaggtatgttcataacaagttcataccttccaatctcgagcaagcccaacaggtgtttttccatatgcaatggagaaattaagcattttagctttccgcctctcagcaccaaaggcatcctaaatcacaaatagaacatataactttatttgattctgcataaatacatgactcttaaaaatactattggagctgtggtaccttcaacaagggcacaggaggtttctcttggccaggttgaggatgccattcaagaagtactttctttt

SEQ ID NO: 52629 - DNA, 8280 bp, Oryza sativa
cctgtaaatttggtgttcttgctgacagacgccctgtttctgtatttatatttaatgaacagtggatccgcccctcgtcacatgatatatgattcccctatcaaaaagtaataggagataaataacattaagaactggacatatagcttaaggttatggtagttgatggtagccactcaagcctaactgctacagatggggtcagctcactgctcacctgtaagggaagaataaagttggatatcaacgagtcaatagaacaaatctcacagagagccgcaatggcatggcatgcttcctttcctttctttcctcctccaaatgcttcatatgcagttccataagaggcagtgtcgtttagatcatgctcagaaatttctgaatcaccactgtcatcatcctctacatcatctgttgtgtaaacaagatcagttggcagtttaccagccaaacttctcaatgcatctccacttactgaaggccagccacttgcagtaaatagatcagttttcagatcttccacaatgctgaaaagttcaatagtacaatactttggagttttcttgccctctgcaataaggcttccatcatttggtactttaatagttctactctttggcaaagtttcaccaggtttgcatctgcacatatattaagagcatcaaaacttctgtgcaagaaatgtctacaagagataaaaaagaaaaggacagaaggttccatttaactcttttgtttcattgatacatggaaacacatattatacctagttacaatccaagacccaaaacatatgaactacaaaagtttctactttctacaaaagtttctactttctagaatagtaggtgaactgaaatctgctccctttttttttttgttctgcattcagtaaacacaacacagggtactgttttattttaaaatagaaggaattattcatgcaagctcaatatatgaagttgatttgctaagcaaggtcaccttctcaataagacatatttagagtttgctatcataattaccatctaacctagtggatgtcctggataagaatgcatagaattatgtatacaaggaccaaaaacatgtatttagtaagagactgcagcagactgagggttgtacctattctctataccaccaaagaacagttggcgaatctgagtatcactgttcacgttcatgtattttgcatcaggacaatatttagatgcccatttccgaaatttatccgcagctagttttcgctgtgcaacagcaaccttttcaatttctgaaaggtaaccacggtcgactagcattccagctgtttccatcttgacaagaagggcaccaaaaggacgccaatactcctcgtagaaatcatacattgaacctctagggcaaccatcaaaagtccagtgctttttttccagcttgcttttcaaactttcataaagtcgtaaggtactcattgaatctaatgaagaataacagatccacatttctctgtcatccctttgtaatacttcgacaggctccatagagataattttccctgcagatccatcctttttaatctttttccaaccaaagatggttttcattgatctctttccaatcttttgtaattcctttggtacaacacccatgaccctgtgatcatttgtaagtccttcaagtgaatatcctccatcaattcttcttgaagagtcccaaagtcgtgcaagatgcatcgtatcagcatgaaacccagcaactttgattccatagttctctatgacatggctatcaaaactatagttgtgccaaacctacatgagaaaatcaggacatctgtttagaaaacttgcaaagatgctagcggtagtagagatgcaatcctataattcctagaagttcaaagaagtatcaaaactttagtcagggattcagaaaaaaacatagcatcaacctaagctgtagtagaaaattaacatgcaagtctgcattaaatgtgtaatataaacattccactgtattgtaaacaatattctagttcacggttccatttatattgtttgtctgtattagtaacacaaaagaagggaaagcagacaaccctagatagtagattcgctacttcccacataagaaaaacaaggacacaaagccacaccttcctgattgaggggtcctcaaaaaatggagcaaactccatgaggacatctcgcccaccatccagcacgtccacccaaatgcatgtttttccatttccaaaatcagcttctgcatcagagttgccagagtagatgctaaagcaaatgacctctccatggctaactggtgtctcttgtttaacatcaatattagctacctgcataacagtgtgctctcctgaattataataaactaacaagaagtcaattggcacaaaatacagaacattttacataatttgattgccaggtaactattgaatcaagatggtaaaagagatcatcattgcgatttcattatttgtgagacctattttgcccttaagttgtcattgatattgtattcactcataacaaagagtaagagcagcaaaacaaacaggcatgcaacacaatgcttcacagcttaagacctaagattggcaaacttgcagaaaaagcaaaacaaacttgcactaaacagaactagatttctcaaagagaagcataagtagtactatttcaactatgaaagatgggatgtggggtggtggagccatgtgttgatcatctcacagaaaagcgggtagacaggtagatacaggtaaactttttagagttagtgcctaactgaaaatgttagtacacgtcatacgatgacaggtgatgcgaattagccactttatacagacataaaaaaatcaatcaatgaggggttttcattccatacctctgtgtcacatgcatgaataaagtttttgtactttgaagtaagcaattgaacaacactcctagctgacttcacattgtcaaccaccagaactttgtcgtacacagtagcaagtgccttcctcgcatctttagactccttggacatgggtgccttagctggagaatcttgtactgtattcttggctgtgcattcatgttcatctccatcataaccatccctagctttgtcatcaaactgcaggcttgtctcgactttagagatcttcagaacggaagcatcagtcttagaatctggttgccattgagtcttcagttcagagccactagacctgttgagtggtttaatgtcatcgttaacaacactggtcagtgctgacacagcacttgcagcttgattcctcgtgttatgctttgccaactccatgttagcatgcctatttgcaagagaattaggagtcattctttctcttacattgtacaatgaagaatagttggaacttttgtgatcttccaaaggttcgtgatgaagaattcctgttcgtagatgagtagaacctttataaatagtgtttcccacgttattcctggttttgatcgaggatatcctcttgctctcctcaagccattcttgtgcattactttgcacattgaagttggtatacactccaattttgaaagcactgttgtctgtaactccaaggcccgagctactatgcgagtagtcctgcctaacaataagaacattcctaatgtgagagatggaaccagaatgccacatgcttaataaccatttgactactatgaacattttatgaacacactatcatttgacaggaagtagcaaagtttagccaaacactactaggtgcaattgttcaagttcctaaaaggcataggacgttcacagcaaggaatacttactcactcatccctggattagttcattattaatccagaacacagcacaaggtttgaaaaacaaatagtatcaacagcacaacgaccaggagcattgggctgaacctaaaccggcatccaaaccatcgcgcgtgaacctcgaatcgaatgagtagtaccactaccaacactcaaccacgcatccaatacgcacgaaactcaccgaacaaatcacaaaatcagcaaccaaccaacacaggaacacagctaccttccgcctccgatgaacggcgagcggccgcggcggccgccgcagcagcggaagggcgacggcgcggcccagagaggcgcggagcacgggcaccgccgcagctgcgcgggcgccggcgccggggccggagcggccatcgctatggagctcaccagccgcctcagcctcccccctcccctccctcctccccctccccctcccgctagcccaccgcacccacacccgaagccaccgggcgccgtcttgggcgactccgacgcggctaccgctcggagcagcagcaggcggcggcggcggcgcacgcgggcatcagggccactcgactcgacgaggaggaggcgggcggcgcggcgcggcgagaggagggagacgaagcgaggagagctcgggttcgcagagtttggagaggagtgggagggggatagaggaagggtttacggcagcaacggcgcggctggaaagcggaagtggaaggggattttcgttctttttcgctacgcgcacacggtggcggccaccaaaacgtttcacaatcttgttgttttgcgtgtctgtgagtggtacacgtcggcaggcagaggtaggtgcctctgtcactgacatgtgggtccgacgaatcatggacccacttgtcagtgacaaaggcacgatgtcttttaaagcagagagtatctcaatcccggcaagcgtgggcgttactggttttttggtgggcttaacgaaagatgttggagcgttagtttagttttgtggactgtctttcgctggagtcggagtcaagcttagctgattggtcgatcagtttcttcatgtcttcaacatgcatgcatgtgctgaaagattattcaacaacaaagggcgcaaggaattataggagtgtaattttttttggaagcttgtgcttttgttcgtacaccatctgtcccaaaaatacatatggagtctatccacgattcaaggtatgaaccacctaggatattcttttcagcttgacagtttcttatcgaaattcacaaagcttcttatctaaaatgaaatttgatcgatccttcttcagctgcccggaaaagaaaaaaaaaacacgatgcatttttacttggcgatctccaattttataggaagagggtggcatctcaatccctaattcaattcgtacgaagaaagtgacccttgaacaaattgagatgctgattgaaagtaaaataaaattgcaggcttataacttaacctgaacaatccttcgaaagctgatttatccgtgcaatacatgcgtagaagaaaaaggaactcttactaaatcaatctagaagcacacagcttttgttagagcgcgcgcgtctccgatacattcctactgaaaaagaaaaaaaaatctgacctgacatcccaaaattctctagctaatgaaccctgcacttctgcagtacacataagtactagctaagctagctaattaacgacgacgacgacgactcttaatttacaaacacgtagcctagctagctcgtaaataacaccagcgtcacggctttgcatgcaagcgatcgaggtatcagctgaaatgcatcgcacgacactgctcgttggtgtctctcatgagattgatcgaggtagctagctggagggcacagggtagcacttgcccttgcacatgcagcggtacaccatcgggcacggctccgcgatggagcacttgaagctcaccatgacgcggttgcacggcgagcaggcgccgcacgcgtgcgagcagtccggcaggctcgaccccgtcgcgcgcacctcctcctgcaggacgccgcggccgacgttgtccccagctgtggcctgctgcgcatgcacgaggcatggatcaaagagaagatcaatatattggttagtttttatatacatgggtgatatgggcgatcgacgacatgcatatatacctgtggtgagatcacaagtgtcgcagtagcgctgatcttttcgtcttgtgcaccatgcaccggtgttactacatcatctgtggaaactaatttaggagatatcaagcaagcacattcggtaagtgcaaattaaccaattgtgcttataaacatacagtcactgagtcgcatactactagattgagaaatgcccagaggtcttctggctagctccacaaggtggtgggctagacgacctgggttcaaagcctcacccctcctaattatttgatattaggtccttccctaatattctagtttttttttttttttttgcatactactagatatctcaacttacaggggggcgatctgatgccatcgccggtggcagcaagaagcaggacgactgcgagtatgagaaggatgcggtggtgacctcgggcgtcagcaagagtagcgtgcctcctcatctcggcttctcaagcagaagatcgagctagctagcacagctacgcacaaagggcatgcaagctgaaggctcgaaggaatcagaggaggacgcaagaacacacgcatatatatatacacacgaacgaacgcgatcgagtatatgtgtgtgcagccattgatgagcgacgcagcggcggcagcgcgcgtctttgattgtgcttcacatgatccccggcacggatcacatggattcaatgacgggccccctgcgtgagcgtgacgcgcccggccgcctcctgcatatgccccctgccgctgccgggttcgcaggcgactagcggcagctcgaggcctcgagactaattaacaccatcgggttcgcctcgcctgcgcccgctcgctctgcatgcacgggaccagtgcgcgcccactcgcccagcaaaccagatacacgcgcgcgtacggcgccgcgacgtgcgcgacccctcgctagtttatccgcgggcacggcgcatggcggtggggggcgcagcgcgcgggagttcgaatcgcacacctgcgggaccggcggaacggtgacactgcgcgcgcatgcatgcgtatgcgtcgtgcagacaggcggttcgtgatcgagcggatcgggcggtggggcggtgtggagtgcgggggagcgggagcatatgctgttgccatgaatgaagtaggtcatttattctttctacgtactgcatcgtgcgagtacgtgatgcgagctagtgctacagttggtgagttggagtactcactgccgacgcatgagagctccgcctgtcgtgtagctcagctctagtcagctcgtcacggcatgagatcagcgtgagacgcagacgagaccagctgcctgtgcgccgctgcctgcccgctgcgcgcggccgggcggcaaattctgcggcagtcttctgccgtctggtctcgcgctggcttctgcggaggaagtggggggtgactaaagtgtgacgttgtagggccaggatttcggaccattcggtggactgaagtttcgcttttcctaatctattcctaggtgagttggggagctggttccatcgaccgtgacgacccaacgaactcacgtaggcccgagctaatcaattagcaaaggttgttgcttagtattggtttgcgttaatcggaagacctaaaacatattttggcaattgttttgaaccatatcaccattggatccgtggcgcaatggtagcgcgtctgactccagatcagaaggttgcgtgttcgattcacgtcgggttcaatatcccgatccaagcggatttcctttttaattttttttctatatgttcctgcgtttctaaaattttctatatttcgttcctcgtgtaagtttcaaaatttcttttccattttctatatttctatgttccctgcgtttctaaagttttctacatttccttcatcgtattaccctataagtttcaaaatcgtataccctataagtttcaaagtttcttttccattttctatatttctatgttccctgcgtttctaaagttttctacatttccttcatcgcattacactagaagtttcaaaaagagtaaagtccatcaccggtccctaaatttgtaccgctgtgtcatcccggtccctaaactcttaaatcgaccgttcagatcctcaacttattcaactgtgtcatcccggtccctaaacttgtggatcactcgtttagatcctccaaattgttcagttgtgtcaccccggtccctaaacttggatttgaatatcatattggtcaaataggacggtctaaagactttatatatttaaaaataattcataacttttttatgtgaactctaatgaa

SEQ ID NO: 52630 - DNA, 2144 bp, Oryza sativa
cttcattagagttcacatgaaaaaaatatgaattatttttaatataaaatttttagaccgtcctgtttagggaccgaggtgacataactgaacaagttagatgacctaaacgagtgatctgctaagtttagggaccgggatgacacaatcgaacaagtttgagaacatgaacggtcgatttgcgagtttagagaccgggatgacatagcggtacaagtttagggaccggtgatggactttactctttcaaaaatttcattttcattttctatatttccttgtattacctataagtgtgaaacccttatttttattttttctatttccttatattatcctataagtatgaaagtatccttttcattttttatattttcttctatgtactactcccttagtctcaaaatataaatacttttagcaatgaatctgaacaactgtttgtccgaaatcatagctaaaatgcttatattttaagacgggaggggtatatacaaactatctaaaaagataatattagaactaacatgtaccatagtttatcatcacctcaattgtaccatagtttatcatcatctcaattgtttagctatttttaccatcctctctctttttctcactttaccagtattaatataaatctcttggagcacttgcgcaggacaccatgtgttcacccacgcactagtaagccatgctacgtaatacggttagccatgttagcagagaccaaatctcaaggtaagttttgtggtggcagaaactacttcaacttcagcaaaacatcactgcatgtttttctagttctcaagtgaactaatttgttctcccatacaatacaatggcagtatgtcacctatgtctgccgtactagggaggaggaaccgagcaacactagttacagataattacatcacatgtctataaaaccagctgtagaggcctctggcaatgatacccaaaacatgtatatatttacatattatattacatcttctcttgtgcccacatcagaaagaccaaagttaattttggttatttcttcatctcagcaggcgaacatacaccattccttggattgcagttgcagcggcgctgcagaaagtcgatcacgagttgttcttcttcgacgaagcacaggtagaaagatctcttcatccttcactggccattgacctgacactgaagtagcgaactaacacgacgaattgctactgatatctgtagcttctaccgtgaccatattacggtgtttagcttatccctgaatcgcgcgggcgagctgcccatagcgagctcagcgctcggaagcgctggaagtagtcccccagcgcgaggagccccctcgccgcctgccgcgtcgtcaggatcctgtgcatctcctgcagcgtctgctgccggagatgatctgcctgcacacacaagtcccagatgccatgatgaatgagacaatgaggcgatcggagtttttggcggttggttttggtttggtttggttacctgggtaacgaactggacgagggatctgagctgctccacggcgttggccatgtgcaccatgtaggcctcgggggagtcgaacgggtcggccgccgtcagggagtccgcgatcgtctgcttcagcttgtccatgccctgcgagagggcgtcctcgacctgcatcgaggtttgctgcaggccgcccacttccacgacctgcttgtccgtcagaggctccagctgcggtctcaaattctgatagcagaagcaacaacgagagagagagagagagttgccatcatgtcatgtaaaaaaaatcaactggcactagtggttttgaagctctggagtacatgtgtgcagtgcagatcgattagctaccttgagaacctccgatggccggaacccaccgatccacaggaagaaccgctcggtgggggtcttccacatgcccgacatgatgtagaacacgtcggagttggcggcttcctctttcatctcgaagaggcggttgtagttgtcgagcccagcctcgacgagcaacttgagctccaggtcctggtccgtcgtctgcccctgcagcagcgcattcctcagctcaccagtgttgcgattctgctcgtccacccaatggctgtacttaatctcaaaacctaaggcacctg

SEQ ID NO: 52631 - DNA, 23153 bp, Oryza sativa
ggttgcgattctgctcgtccacccaatggctgtacttaatctcaaaacctaaggcacctgcatgtacgtaatatgatgaaaccacataagctggtaattagaatgaacaaaaatgttaaatctgtgctgaacattgtgatcagaaagagcggcacaacaaaaaacctaacctggatcgatcggtcctgtaaatccaagatttggttctcgaaggctcccatttgcatacacagcctgcatcagagcagttgcaaatttgcaatggagtcagtgacacaagtgtaagctgaagtggctgcacaacaaattgttatccgtgtacctgctgcctggcccgttgaagctcttgctctaactgcgctagtttcaaccggcttgtctccagctgttggatataagcctatggaacaccataatcatgccgataatgaggattttgtttttcaaaaatgggaaagctacaatctagcatggtgacagcatgttagtagttaagtacttgtcattttacctttttccgcaggcggcttttccgtgcagcctctctgttttgtgcaagtcttctgaggacctgaataaataagcagaaaattattttatctcgcaagaccaaactgaatttaacatatgaaatggactgtgagttttgggaatttctctactgcatcttttaagaaaaggaaaagagtaataattacacggtttcatataatggagcagagcagagatggttggattgtactgtgtgatgctcaccttgtctggcggcttgcttgcctcctgatcaacatttctcccttcctccagaactacttggggaatttcttctagctgcaaatctcatcaaaatgagtattaaacacccgatcattcaacaggcaattagtagaagccacagctcatagctactcaaaatactagaggaaacaaaattaaatcaaagcggatgtgttcctcaccctattctcaaatttcatctctgcctccatgatcgtggatgcactcgtggcctggccgttgtcaaccttgaactgctcgtgactccacatgccaactggcggaggccggtcgtacgcccccattctgaccggtgccgcgaactgcgtcgacgccgaggtcatgtactccggaggagaggcgctgctgatactgaaccaagtaaaagaggatcagcagagtgcaccctccctaagtgcaaaaaactaaggatcgccacacactacttggagcagcagctgcaacaagctagggaggaaaggaagaagaaaaaaaaggtgattcttttaaactgggaaatggaatgtgctcagcacagcacaaaggttagagatagctagctgtatgcaaaggcaaatatgctctccccaagtgcggccgcatgcatctccacaaaagcttgggggatcaaaaggcgccattttcactggggattagagcactttgccaaagtggcatgcagaggttgacaacatgcgcaacaaatgatgatgaatcaagcttgatctgaaggctgagatgacgttcactttgcgagcgcacttccatcagggaagaaaaaaaattcttatcatgtgtacgagtctaattgtcagaatgatcactaactcaacagcccaggtccgatcagtagcacagtcatcttcagcccaacagtaacagtaacagtctctctcactacaaagaggctgtgatcagagggataattaatactccctctatcccaaaaaaacttaacctaggcaaggatgtgacatctaatatttcttagtacaataaatctggacaaccatttatccagattcgttgtactagaaaatgtcacattctcttctaggtttagtttttttttttgggacggagggagtacgaatcagttgccagcttcaagctagttgcagctagattgttagaaatgatgcgggaacctgtgcctagtcctagtagagacgagaagaatctgagtactagctagcagcctggactgcgtgtgcctgcccgcgagtggctggatgcttgcttgagttcgagtggaacctggaatctggaatcccagcctcccaggcagtgcagtgccggcagtgtgacgaaggaagcaaagcagagtgcgagtggtggcggcgctgccgctgcgagctttagcttttgcaaaggcgcggtgcgtgacgctgagagtgactcgctcgcttcccttgctgctccacggacaagttgccacctggtagctgctgcttctcctcagtgactcagatttgcttcgtgggtcccactctttttttgtggggtcggctgtctgtctcagtcatcatcctcatatactactactaagctattccctctgtttcatagtgcaagtcattatagcattttctatattcatattgatgttaatgaatctagacatatatatcattctagatttattaatatcattataaatgtggtaaatgctacaatgacttacattgtgaaacggatgaagtatagtcaatcctgtgccttcgatgtcaaccaagtcctgaaccagtgaacctgaactgaactccatgggatgtctgtaattgtaactaagattctggtgatctaatcccaagcacagaaagcatgatgacgcagcatctatgatcaatcgatcatgatccatcgtccatggaacccatctttgtctttgtgaggatgatgttacgtgctgcacgaacgggcaaagcagcagcagcaggagaagaagctcactcactcccacacgtagtgggggatttgccgggccagcacactggagggaccttggtaatgtgtcgctcaattattggcggctccactttgcttttgcgctaaaagcgagtgaggttggcctatccagcgcccacgaaaatgcaaaaccggtgggcttcgttttgtctgctcaccctgcaacacctccgaccaccgtggatagctcaaaccccactatgtgtatgtcccaacttatcaggaatagcagtgtgcattgctgtataatggtcgcctcattttgtcgcattcactcccgcatatatgggcatcatatatgtatttactacctatatgttattctaaccaatttggagggattggctctaatctctaatggcacagaaataagctcaagtttctggttagactgaagcctgaaataactatgtaacattttttttagaggaatttaaggaaactgtgtttgctgtagacagtagtgcacagtgcactgctggggaacatgaaaggacagatgatgtcaaggaagaaaaaaggaatgctagattggctaatctttttttctttttcttatgaaactttgattggttagttagtggtgaatggtgatgcattggtcatcgctcaccactttcttcagacccgcaacatcacttggggagggccaagcagtagcctctcctttgccctaaactgggttggagatgatgcaaaatgccttttttttctctagtgcccctgcactattttgccaaattaggacctcgtcttttatttttccgttgaggagtcaactatcaggatcctctacaacaaggatctgacgcatagttcatggctattgccgtgccctatttagaaacagctatgtgcaagacgcagagttcacggctattgccgtgccctatttagaaacagctatgtgcagtgtaaattcgcagtaacctacgggctatgaggaaaccttttgatttgttccaaatgggtggatgtggttgtctaaacaagagaacaaagcagagcatctatgttatactttcagagaattagcacaaggtatcagttgatgtcgcacttctatcttaattggtgattctgaaatctggtagccagcgtattattattgtaggcttcacctttgtctgtcctagctgacatgatctcactttcgctgcaccacagcactagtccacttgctgtaataaatatctattcggtttacatcatgttgtgccacaactaatgaaaatctaatgcaaattgcaatactagaatgcgtaaatggcatcataggtgctaactctctttcgtttgacagcttgttcaacttcaacgtaaaaatgcagcaattctaattgtcattttccatttgctaaatattaaatagagaaaattcagaaataataagggattcggttataggaatacacacctaagcttgtggatgttaaaatggtcttcaagatagccagggtaaagctccattatatcattcttgaattggtctcctccaataataatactgcataaattcatgtgccagagtgggaatattagctgcataattcataaacaatactgaaagttatgcagttgctctagagtgtccagtgtcgcatgaacatggaagaagatatggtcttagaaaatactctaagaaagatatgttctcagggaaaaaaaaagttttcgctcaaggaactttattccaacagtgtaaagattataatgaacatatggtttacgagtgctattccagacttactggagaagcgaatatgatcagttttagtaccactccagcactttgcagtcccattcaaataagaaaagaaacaacgatagacatgacgagacaaaatcaaaaacccttagctatgatgtcttggaagaactaaagaattatcagatagcccacttattcagaagctaaaatttttcagagtccccaagaaaaatcatgtccttctttcactaaacgagtcatcaccgaaggagaaaatcccacctgatgactctgctggttaggttaacaggaaacatattttcctacttcctctctactaggaatgaaaagataaacaagatatgaaaggcaagctgtggtttgatgttttttctttgtcaatcaggtaataaaccctatagaaatgcaagttatcattaattctagcacaacagcacatatagtgaaagccaaagagtaggacttaacttgttcttcaccaagatgacacacataataaaaacagaatcagtgaatcaaatatccagagaaacttagtacctgataaagttcttccgtctaatatggatggcctacaaagtagagcactggaacggtaaattgcttagcacaagagactccacggatgtgctatgtagctcagctccaaaggacaccagttagccagaagaagtgatgcagggttatataaagagccacagctgccctcccttcaaaagaagaagccaagtatgaagagcttttagtatctaatattatcacctgggcctcatgcttaggatgcactaattattcttttcgtaaactagttggatatgtgagaagttgcttgcacacaggaatacatacacacatccctcaccacctaactagtagagccagaaaaagtctgcacatgattctgacagagaagaaagatggtaactttcaggtgtaaaaaagtagcacgcttttaagtctgaggcacagccttggttacttcgatagatcgacacactagcaaaaatcgatagtttcagataacccaggtgattgacagtgccctacaaaagcatgccaggaagcagtttccacacacatttttattacgaaaccgccaagcaaagatggttaaatacaccacatccactgtcaaatactgattaggcagaaagctgcatgcaaggagatttggtttcagaaaaggaagtctcgtcagacaaggcaacactaactcatatgccataactgagcatagttaagagatttagtttgtcacccaaggggacataataaagttgtaaacactactagttagtactccagttattacaggcacagtacaaataccacacaagtaaactgaacttatcaggacttaatcccattgctagagtgcccctgttgcctcatgaaggcaagcaggatttaactaatattcagattgttagctaggcagccgaaaagatcatccaaccaattttattaagagcgaggtaatacgatgaccctataatggggctcatgttagattccatgatgcaattaggggacatcactagattcagcaacttggctgctcggtggaacttcccatttctggggtatccctccttgatcactaaacctcctcaaccttcccaaaaagatgccccctttacacctttcttttttttccctcatcctatgctacttgccttccttcctggttgcttttttggtggtgtgcccatatcatgccctttaattagctatatgatcttgagggtttctgttctcaagaggaacagatcatgctaagcatctagctatttcatttctcaacacaagtaagtagacacgcctagcaagaacttacacaagtaaacatggaggtgaagtaccatgaaattcagtcaatatcaaagtatacacctcaaagaaacaatcgattttcgcataacagtgtctgacaactaactactaggtctaagtcgttacactatttggcaatcattgtccatgatccatatctttcccaaaagcagcaagaaattacaccacacatataatactctgaactaacacaaattaaataaaacaccgaggaatatataatagaagtatgagtgcagtggggcacctcctcttttgcgaattgcgtaacgcttggtgcgtgacgacgaagaattcccctttgccataaaggcgcaaaagaagaagaacctttcgaccccggctaacctaaagttagaagaagagataagataaagcactataagagaaattaattagtgtggtaatcaggcaggggcagcaatgatgcgttattgttaatgttgcaaattcgcaaacccccaaacctcaagatcaaggtcgtggccatggccatggccatgctctctgatggaagcattattaaagaggcccccccgatgtcgccgtcgcgatgcggttttttcttcccctcggcgaggaggagatgaaatgcgccgcaacagtcatggtgggctagggctaaacccgctaacccctcggctgtggctgcggatggctaaccctagccgattccttcgtggcattgccttccttttggcttgattggtcttgcgcccttctttccccaccccctctcgcttttgcagcacccaaccttttcaatcctcatcatccgctgtacgaaattcagcgaattttttttttcgcgaacgcaattcagcgaaattttccgatgaaaaagccagcagatctctattcccctgaatctcactataaatctgatcaggataagaaattagagaaaattacttacctggaattccggacatttttcctggatgattgaacggattcagaaccgggaaaattacttgttcagcatcgagatgagattctctctctcgctcgtaggcaggaacagcgacagcatttcgcagatggcgattggagtatcggagcaataattgtgggggagcttgcattgcacttgctggctgcatcgattctgggccgagacgaacactggctaccacccaggtggtggagtggtgggccaagcttgtgtgtgtttttaccttcggatcaaagtaaacggcagatctctccaccatctgcctcacgattcccaaacaagaaaaaggtcaaccgtctaagagcaggtacaatagcaggctataagccagctgcaaacatattctaagaagatcagcaggctacagatttatagtcagctgtagcacggactccaagacgcggtgtgtgtatgacaggtggaccatgtattaatagtgtagtatgtaactattgtatgaatgagctactagattggctatagataaattggcactagtagttggctatactattaaacttgctcatgggaaaaattgttccttgaattaatttgcaaagtggttttggaatctagtagtacaactttttattgtttttgctagtgtattatgaccgaaagttatatttgtccacgggatgaaatgccggtttgaaaatcatattaaaaactccctctattttttatttgatgtttgaaccaaccaacgtcggataaaaaaacaaaggtcttaatagagacattgtagtttaaaaatattaatggtcaaagtgaaaacagtaaaaaaaaatattgctaaatatctgcaaatggatgttggcggatccaccatagggctttgaggtctcgagcccctattattggtgttgcaaccataggagcccccatagagcctcactgaaattttgtcatacgtccattaaaagaggtgctatagtattgtatagttttttttcagactctctagctaactgaaggatccgcctcggatgtagtatcagaaatcgccaaaattataagctaaccaagaaacaaatcacttgtccggtagcatctcccgatcacagcaaatcttacttctttagctagcatgagttagtgttaggaacttaggggggcaagcgtgcaataataatcttgatcagtagcttagcttgtgacgttagctaactcgctctcgctcggaaccaaggaaaaaaacaactaaagttgctagaccactactaaaggcagacgaaaaggagaggttgggtctccatgcatgaggcattccgtttcaactttttaatttaccaagtgagcagaaggaattagtggtgtatgaccaagactctcacgtgagcagtgcatgaacaaattcatttttttctctaaggatcagaagattcatgtggaatgaggggctgggcaggcgcatggtgataagatattcaattacaaagttagtggttaaaaaatagtatttgggtctcaaaataaggattgatctaatttgctttttgcgtcattgagtatttctagatgagtagatgtggcttaaacgtggatttttttatactttgtaccctttagataacatattttacagatagaccatcacgaaaacttattgcaaatacagatccttaactcgcgccaattggtgccgagatctaatgtgttagaaccagacaccatggcatcgagacccaggcacctggagcatctgcattgggggcggatgtttccaagcgttgacctcgacggtccatgtaagtcctaaacattagaatttacttataaatacttagtttttttgttagctcgataattttactatgttgtacccatatcaaatcgaagacttgtaacttcttacatttaatcctaccaaggattggtgccaaagtaattgacactaaggtataacgtatcgccgctaatatccatggtacctcctgccacaccaggcgccgtcatggctgggctgccagcctgccacgggtggcaaggggtcagctccaacttccttggcactgacacattaggccttggcgtggagttagggtttatatctgcaataaatttgataggttctatttgtaaaataaacgtttgaaatggttgaaaggttaaaaatccagtggcttgagctgatggatagtgatgcctttacttccacttgatatgatctttgtgtagggaaagtgcaggggttaaggagaataatagaatataatggaacccgactattggtttgtaccatgggacgattcctcgatactctcaaagttgctcaacattagattaagtcatgcatgacatcttctgaactaggtgaacaataaacaggctagccagagatgatccccaatgcttgtgcttttgctcattattttttttcacctctattttttctttagaaaatgcttttgtacctctttttgcaaggaaaaaaatattccatacggccggcatgagcaatccattcatattcctaaacctgaaagttgaaagggcagtatagtgttgatatgtctcttacccaatgcatacctgtacattttgttcaaaatttgcatgtaaactcctagccagtgaaattcagatgcttaaaacagtttgatcaacatggaagaaacatcatatgttcagtgccttgtatctgatctgaagaactttacttcaccccggcaacttacagcaatataatacaccgtaccgatttcagataaccattccctggcgaagtatgaaaaacgtgcttgccactatctctctttcagactttcagataatttagtcgtgttttacagagcaccgaaacgcctttgcactatgtgccaagctgatagctggtcgatacacttcagtcaagcacgtaagtctactcagaagggatgctataagaattcagacctcaagaaggagacggaagttcattgcctttaacccatttgttaaaggaaaaagctataatccattgcacgtatcttctttatactaaagagtatatatgtatactgtatctttgctagctacagagttgatcgatacacgcttcgtgtcgacataagaatgcatatcttttgacttcgctgttgcttatgtgagtggtgcatctggagttctcaactgtgctggagcctctcttgaatagacaaggttatcaattagttaagaaattttcaggttatttaaataaaaagattaagagaatccaatatggtgcatgaacctcttggatgttgaaatcagttaggtatgcctacaaaatatttatggacgacactgacaatatgcaaggtccagtatgatcaatccaggttaatagccatacctttggttatacatacaaaatggtcttgacactgacatatcaatatgggctgtgccaacaattatcgggatagcagcagctagccagctagtggcttgagataaattagttgtaccaagtcttcttatattagcaaactttcgtgttaaacatttttttctcacaagttcaaccttttgtctgaataaaagactgtctatcggtttgttcagtcccatttttcctctctaaatttacatggttcttcgtggtcgatacgtcgaggaatcatgaaagataacatatattctgaaggataaaagaaaaaaagaaagaaagaaaggatgacagaagagggaggttctatgtccaacaaagtgtgaattggtgggggcaaccttcctccaagtatgagagagccttttgttccacatttccactcaacagctaagacaataatgccctaaaaaaatatgaggtgccaagacaataatttggataacctatgcaacaaatggagcagtcaatgtcatctcagcctcacatgttctttaatctttatttggacaagcacaaggcaaggtagaggaagtaggtgtcagcaaaacaccttgtacacacgcgagatcgtagctatcctagcttaactgacgcttgcaggatgatgaacagtgtactgacgaacacagaaacacagcaaagcagagttttggcgctgctcaacaaccaccgcagctttttctgattctttctattcatactcctcatcttgtgaggttgttacatgcataacaaacaccagctttgccggatctaactaccgaacgcgccatcccacgctccagacccagctcggccactacaaccgaaaaaaactgcaactacttgaccaactctgaacaaactcaggccagccacaatacaaatggaatccaacgcctatatgctattataatgcaaagaattgactaaaacatgcatgctaacgacaactttattcttggcactcaagattatctatcattctcccccctaatcttgaagtgtcctatccaaacccatcttccttcgcaattccttgaaacgaactcgtccgacaggcttagttaacaaatcagcaagctgatcttcagaacagacatactccactgcaatttgcttcttctccacacactccctgataaaatggtagcgggtatcaatatgtttgcttctgtcatggaatacagggttcttgcaaagattaatcgctgacttgttgtcaatcataagtgttgtttggccgggttctgcatcaagcagctcagcaatcagccgactcagccaaataccttgacaggcagcagtagtggcagctatgtactctgcctcacatgatgatagagcaacaactttttgcttctgagattgccaactgatcaggcttccaccatacctgaacaatacacctgtggtgctctttctatcatcaagatcacctgccatatcactatcactgaacccaaccaactttgcatttccaacttcttctcttccataccagcaacctgtcttgatagtccctgagatgtatctcagtatatgcttgactgctgcccaatgttcacttgttggtttttccatgaatctactgacataaccaacagaatatgccagatcaggtctagtgtttaccaagtacctcaagctgccaactatacttctatactctgttggatcaacacattctccagtgccttctttactcagcttgagccttgcctccatgggtacttgagtgggattgcagccctccatgcccgttttctccagaatttttcctgcataggcactttgtgacagaaaaatcccttctcctttctgaacaacttccattcccaaatagtagctcagaaaacccaaatcactcatgttaaacctctgcttcatctgcaacttgaatgcatcaatctcctttttctgagacccagtgataataagatcatccacatacactcccactatcagctttgagtccccaactcccctcacataaacagcactttcagttgcagatttattgaacttcaaagacagcagtgtgttgtccaacttggcattccaagccctaggagcctgcctcaacccatacaaagcctttctcagtttcaaaaccttgcttgcattggtcttgtcatcaaatccaggaggttgcactacataaacttcttcctcaagctctccattcaagaatgcagacttcacatccatgtggtgtatctcccaccctttctgtgcagctagtgcaaccaacaatctcactgtctccattcttgccacaggtgcaaacacttcatcgaagtcaacaccctgctgctgcacataacctttggcaactagtcttgccttgtgcttcacaatcgcaccagatggatccttcttcaatttatagacccacttaagcccaatggctttgtgccctgccggcaactcagcaagtgaccaagtctgattttcctcaactgatctcaattcttccaccattgccctcctccagcattcatgcttctctgcttccacaaagcttgttggttcttcagtagcaatcaaacactgatcactgtagtcgaaatccaaaacaggttcagtagtggagagaatgtcttgcactcggcgatacctaacagggcctccatctgtttctggcgtcactgaagttggtggtgtgcaaaactccccatttggcgctcgcggtggtgaggacagaacgcccgtcgacaccggagacacgcctgcctgcaccggcgttcctgtctgctcgcccgcatcagcaacagagggcgccacagggctcacaaagaaatccaccgtgaactcttcttcttcagtcgccgcatcctcaggatcacgccacgcccatgtcgccgtctcatcaaaaacgacatcccgcgacacgcagacgcgctgcgccacaggatcatacatgcggtatgccttcgacccctgttcatagccaataaagaccatcctcgtacctcgatcgtcaagcttgcgcaggttcggcttcaccgtcttgacgtagccgacacagccaaacaccctaaggtgttcgaccgagggacgtcgcccatgccacgcctcatatggggtcacaccatccagcgccttcgttggcgagcgattcagaacgtacaccgccgccacaacagcctccccccagaaccgcgccggcagcccagccgccttgagcatggagcgcgccgccgcgacgacggtctgattgcgccgctccacgactctgttttgctgcggggagtaaggagcagtgagctctcgccgcatcccgcgatcggtgcagtagtccatgaactccacggaggtaaattcccccccacgatctgtcctcagagcccgcagctttcgcccggactccagctcaacgccggcttggaactgtttgatcgccgtcgccgcttcatgcttgccggagaggagccgtatccacatatgccggctcatatcgtcgacgaggagcaggaaatacttcctgccgcctggggtcgcaggcgtgatcggcccacacaagtcgccgtgcaccagttcgagcgcctcctgtgctctaaacttggcctcctccgggaacgggagtcgtcgttgcttgcccgcgagacaaccgtcgcacagttgatcagtgtgatcaatggtcggaagcccgcggaccatgttcccctgggccagcctccggagtgactggaagttcaagtgtccgaaacgcgcatgccaccgccatgccgtgtcgccaccgctcgccgccatgcagactggatttgcaatatgcagcttgagtatgtagagataatttatgtctcgttttacctttgcgaggagaagaccattgggatcacggagtgtgcagaccccgccccagatatgtgcgtcgtagccgcgcgcgtcgagacggccgacgctgatgatgttcttgcgcagcttcgggatgtagtacaccgcgtcgagagaccggtgatcaccattcttgcatcggaacaccacggtcccgcgcccctggatttcaatcacagagccgtcgccaaacttcaccgtcccaacaacgccggtgtcgagctcggcgaacgccgaacgcactccagtcatgtggttggtggcgccggtatccagaaaccaatctcctgtcacctcctcctctccaccatcctcgtggtccaggatcaccttcttctccgtgaggtgtacctcctgtccactaggtgttcgtccgagtgtcgcctcgccagcaagtgacacccctacgacatgtgccataagcaacgtcggttcttcctcggcggcttgcaccaggttcgcctctccccggcgttggcgacgtggcttgcggcactgccttgcatagtgaccaaattcatcacaattgaagcactttacccttgagatgtcgcggctgctgttcgcaccagtggccgcctctttgccctttggtgacccaccgggcttgcctcggtgattctgcgcgccgggcgcgccgcggcccttattgccgctgttgccagagccctcctgctcccgctgcttcacacgtgcctgccattgttcctccgtgaggtacaatttgccgccattgcttccctcctcatcatcgctgtaagaatccactgttgacagccgcccaactagctcctccagcgccatggtcttcacatcgagcagctgctcgagagagatagccaccggcttatacttcttgggaacaacgcgcagcagcttcttgttgacgtgttcatcttccatgactccacccatgtcgcgaatgtctgcgacgacagcagtgagccgcatcgcaaactcctccggcgtctccctctccttgaatcgcatcgactcaaattgacgacggaagccctgctccttcgcctcacgcacacggtcgacgccgacccgcatggtcttgatggcgtcccacgccgccttcgccgtgtcatgctttgccagcccgcgcaacatctcacgcggcaccgcctgaaggattgccgagagagccgcccgatcttcacgaaactccgcgtagccgggatcgatcgccgtccacagcccctgtgcctgcaggttgacgcgcatcaggagcgcccaatccgggtagttcgtcctcgagaggactgggaggcgagcggtgtgcgatgcgtctctcccctgagacacgagcggaagtaatgcgccgtctgcgccattccccccgccgctgccgcttgcgccaccgcggccgttgccgctccccccgccgccaccgccaccacgacggccaggcggtgtgtatgacatcgccggatcgttccagtaccgctctgataccaattgtcagcaaaacaccctgtacacacgcgagatcgtagctatcctagcttaactgacgcttgcaggatgatgaacagtgtactgacgaacacagaaacacagcaaagcagagttttggcgctgctcaacaaccaccgcagctttttctgattctttctattcatactcctcatcttgtgaggttgttacatgcataacaaacaccagctttgccggatctaactaccgaacgcgccatcccacgctccagacccagctcggccactacaaccgaaaaaaactgcaactacttgaccaactctgaacaaactcaggccagccacaatacaaatggaatccaacgcctatatgctattataatgcaaagaattgactaaaacatgcatgctaacgacaactttattcttggcactcaagattatctatcagtaggcgctgttttcagaagctgggacagagaagagaacctcaacttgtggagaggaacactaagtgcgtcaccatggctggccttcaattgttcaagccctttaggctggctgtagctgtggctgacgaccaacgcagtccacgagtagattctctgtgcttttgactatgcagggatgcacattattctcttgtgtcttagaggtgctttgaccaggtgcttagctgaagtttggtataagcttagctttgtattattttacacttgcaggttagatacctttcaccttttttacaaattcagtaaagtgaaagtaactatgagaactaagacaaacagaaaaggcatacagaccgctatagactggccgactgggatgttctgaatttctgacaggccatatattgtctgcatttctgataactgaattctgagtcttcaacactaaatttatatgaccatatatctcctgactccattcttatactactaactcaactacgttagtgtctgcttgatttggtatcatattttgccctaccaaaactttcgcaaaatctaattcgagagcactctcgatttagtcataactagcgacgcctatccagaatccagatatgtgttagctggaataatcttactttactatagtactaatccattaagtaagtaggagaaatattcctatcatctatgcttcaaataaaattttctctcaaattactcatccgatttacaattcgattacaccgttgtgttcgtaataattaaatctttacgacaagatctcacatgattatattttgatgaaaaatcacaaattacttttatgatatgtctaaattacttttagatttcactgagttacttcatagacatataaaagtaaatttagtaaagcctaaaagtaatttacatatattatagaagtaacttataacaaaaagaaagtaactttaattaatgtcttttttcattgaacaaattatcatatatataaattacttttatatttgattaaaatacctcctatacattcataatgctctgaggggattacttttattattgtttttagttaattccataatttgtgctgattaatttaatttctagatagagtcatgtttttatctctacaacggatttacttcaaatgacatgccaaagttactttcgttttgttataagttacttctataatatatgtaaattactttttgactttactgaatttacttttatatatctaagaagtaacttagtgaaatctaaaagtaatttagacataatataaaagtaatttatgattttttatcaaaatataatgatgtgagatcttgttgtaaagatttaattgttacgaacacaacgatgtaatcggatcgtagatcggatgagtagtttaagagaaaattgtatttgaagtatatgtgaatggtgtctcttatagatagagtggtagctggtttagacaaaccagctaccactagctgtgtagttacgtcccaaaactttggtagtaccaaaattttaacgagttttggcactaccagatttgatagtatagaatttaaactagcgtgggtaaaagttagtaccaaatcaaacattactttatactaatgaagttgccaacattctggtatggtaaaaattgatctcaatccaacccgcaaagcagatatgcagagagccagaaacatcgtggaattgtgggctgttgggctagcagaatatgcaggccgtcaccaatcaacaagcccagcattgctttttatccatgggccttcagttgcaaaacggcccagtttctcatggaccacgcgccgccgctaatccagccctactattaattcagccacatctcctcgcctccggctctctctctctctctctctctctctctcccgtgtccgcaaccgcaaatccccatttggtctcacctaaaaccctagctcgctcacccatggctccgaagaagcgaaaggcggatccggcggagtccccggtagcctcgtcggaggccggcgccggcaccaaccaccaccaggagacgccctcctcggagctcaagccccgggggaccatctacttccccatcaccgacgaccccccggagccgagcgcagagggcggcgccgagggggaggacggcgccggaggggacgacgatgaggaggacatcgcgaagctgctcgagcccctgtcgcgggagcagctggtggcgctgctccgcacggccgcggagactacccccgcgacgatggcggccgtgcggcgcgcggcggaggccgaccccgcgagcaggaagctcttcgtccacggcctcggctggggcgccggagccgacgacctccgctccgcgttctcccgcttcggcgagctcgaggactgccgtgtcatctccgacaagcaatctggcagatctaagggctacggcttcgtcctcttccgctcccgccgctccgcgctccgcgccctccgccgcccccagctccaaatcggcggccgccttgctttctgccatctcgctgcctcgggtcctgcccctccgacctcccagtcccagaaccctagctccaacaccaacgccaactccggtgcggccaataacgctggttctgcgtcgtcttcacaacctgacaacatgcaacgcaaaatctttgttggtaacgtgcatgctgatgtcgatgttgaccgcctgtatgagtacttctcgcaatttggtgagattgaggaggggccattgggatttgacaagaccactggcaagcctaaggggtttgcgctgttcgtctacaagtcagtggagagcgcccgccgtgcgctggaggagccaacaaggaactttgatggcaaaatgctcaatgtgcagaaggctatagatggcaggaccaagaacacacctgggatgaatgcaaattctaaccctagtggtaccgctgcctcggcagcagctgctgctgcagctgcacagatgactgctcctgctactgctgcaattacaccgtatgatgcatcagcttatggtgctactgccgttcctgacttgggttatgcgcagcaagcggctatgttgggattgggtgcacagcagcaggcgtttgcacaacccaatgctgcaatgcttgccatgatggcagcagctatgcaaaacccagctatgctcgcaacgctgaaccctgcttttgctgctgctgcattgggtgctgggggccagcaggtgcacgcggctggtattccaggttttggagctcagggttttgggacacagggctttgcagcaggtgccgccgcttttccaaatgcagcgggtgttcaagctcctcctggttttcagggtccgcctgggttccagacttctgctgggtttcaggttggccaagcagcttcacaagcgggtactgctgcggctgctgccgccggtgctgctggttatcaggctgctgctgctgggcagggccaagtgcccggaacgcaaattgggggtgctggttttcagggtggattttgaaatcactaggtataacaattcacatcctgcttaatcgcttcaagtcctcatttaccactaatgatttgagttagcttatcctccaaatattattcgcaacttggtgatttgggctaaaaatttctgattgtttctctatatcttagtttggcatctgctggtcgtgattcgttcgtgtggttttgcattcggatggattttgaatctatgttggtgccaaagtattgcgaaagggttcctgctgttggcttttacaatcagatggcttttgaatcaggcaactttgtggcagtatttacagaaggcgctttcttgaagaatttatgttgtttttattgcctactatgtagctttgtccttgcaacttcatcatgtacgttatggtttctgtaatggggtttaatgtactgaaatatctgtattttgacttgttgggatgttatccggtcttattgattatgtcaaatggtttctgggcacttgaaggctttttcttttttgcagttgcagtgggatttggaagaatgtgatattcatagcttttgcgttcaccttggaaatttctggtttgaggctgagttcagctgctatgaccttaagaccttgattgccattgagctttatttctaaatctgcatagtgatctcctgtagccaactagccatgggaaataggtgaaagttcactttgcgtttataatctcttgaaagagtataaattaatggataatgcctcatcagcaaacactgcatctccattggagattttggaatgtgcttttgtttttctgataaagtaagtatctagaacatttctataggattcaagcatagtaatggtactggcgccctgtggacactgcataggcttgactctttctagtgcgatgtgctgattgaaaagtgcatactagggtgtaggtaatgttcatcctgtcataaactcatgcggactttttagcttgtgcttgctgtcagaatgtggtccctctaaatatgagctgttttagcagaaggttatggtctgctgacagtgatctttgctttgtgctgaggaaggatagcattcaaaacattcatacagcccataaccatatgtgttctatttcttatatgcaccataagcgcaatcattaagtacggcagttgaaacctttgctttagagttcttatcctattgtctatagagtcgcaacaactatgcccatccatcagatgtagatctgattttcaaagttgcccccctttccaaatttgtcacaaaaccatctagtttcaaggcttacaacagtagatcaagcacaccaaatggctttacattgctaaatgtcgtgaagttattgtcactagctagaatttgcgcatgatgaagttacagagactattgaggtctccgtaagtttgctacatatcatttccctgttattttccatgtcatggaagaaatctccatctaattgatcaactttcacgttttgtctggtacaactaaatttttgttgtgagaactcgattagtcaattataggcatcattcttgttacaaatgaacataatctttcatatgtggtggtaaaaatctttacaatataatcattactgctgaattgttgtttatattgttggatttccttagtatcatctttcttgaaatggatttttttttgtttcttctagttgtgtatactggcagcagagacgaccagttattatttgatgatgattacatacttcatgtatccaatgggtatattgctttatatctggcagtcactatgattattacagtcttgtgtctatttgccatcatgttctatctccagttctctttaccatatcactgcgtttgcattcttatctttgaacgtgatgtcttgctaatttgagttcttaagcgaacttttcatattttccatgggaccatttcagtataaagactgcattgtggaatctggaaactgttatttcataggggtccgtgattatgaaactttttcttggatgcaatttagcagttctttaacctttttccacacaattctcacacttgtaatattagtggatttgggtatagtagctatgtgggaggtttggattctttatcaattcgtttgcgctgcaaaaatggctagtgaacttaatcaccttttggggccagacgagtttctacaccgtctgattttgtctctatatgtttggtttttaagctgctgttctgcttattgaagcaccttttcactaagagactccaattggacgagggcaccttttctagagcgttcatgcgaattattttttgtggtgatcatggggaatttgtttgtcacttaccatgcacagcatattaatgctctgaaagctgctgtaactcgggtgatgacaggcgaaggagctgtatatgccgtaacatattaaacatgcagtggtatgggctcgatgcgccctctattgaaggaccagacaaaactagagaggtagggactctcttaagcataaaatgttccggacttgaacgtttatcaactgctgctgaaagttcttagcctggtagaacaaagaatcctattctcagttgctccactaatttgccctcctttttgtccaagcatccagcatgcaagtagcctcatactctctgattgaagaaatgcaagtagtctcatactctctgattgaagctttcttcttgatgctaatctgcacttttattttctttcttgctgttcaccttatgtcaccagtgaaccttgtttcctcccctttgtcaattatatccaaccctcctcttatttgttttcttttcaagttccattggtgagcgatgcgtatattttggtggtttcctcggctaactgcaatcgtctaactctgaagtctgaacgagcggagcgggcgaagatgagacttcagttttgtcacagcttgagatttgatactggaactggtggtgctcctgagaaaacaggtgggtgcccacaatgacgttacatagatttttcagattatttttcttttgcaagtactctttactctgcttttcctcggtgaaagcttaacggtcctgtgtctcagctgctactgtagagatactgtagagagtatgtttcatctcaggagaaaaggctgctagtattcaatgtttttcgcattgaattttccctcgagtatgtacgtgtcctgggcaaacgtagtacgtgtcgtgggcaaacgtagtacttatgtgtagagggattatgctgacaggcgcaggagacttgctttgctttggatgtgtccagtga

SEQ ID NO: 52632 - DNA, 974 bp, Oryza sativa
tttaaggtttccttgctgctgctgcttccaacggtaataaacccaaactgacggtctccctttctcgtgcctgtccacgtgttcacctttgcagccgtccagatggcgtccctgacacccgaagctgaagctcccggaggaggagccctgctcgccgccggcgacgacgtcaccgccgcgaatctgctcgccgccgccgtagccaccgaggtgagtaaatctgtccagctcaaagcccacagctccgtactgatgatctcttccttgtcgttttactactcatttgtgattagttttttttcctttgtcattctgtgtttgtttactataggcaaaaagaaaaaaaaagtactagtactagctcgacgctgctctgcaccgttgagcgagatttttttattttttttgggtgagatattgtctcttggttttgaaggacttgccgggtgcggattcgtggggtgggttttagggtgcggttttcagctcgggatttgagttccgtggaggtgggcccgggggggggcatagtgtaaaaaagcgcccctttgtttcttgcttaccattccagcccgaatattcgcttcttctcaaggacatagagcgaatattcccctctttagatatttctttgtaaaaaaaaatctggtgaacaaaagtaagtgtgatttgagttgcttaacttgtactcactccggacccatcctgtcataggttttaatatattgtgtcctagttttaatatattgggacggagagagtaagcagcatgattagtaggtgatttggttagtctagcgatgtatggtacgcatctagttttttttttcacataacttttttttaagcttgggaaagacttgagcgcgaagggtgtcgtctcacctgcttgcgtcggtgtatatggctgtactttttttttctccaagtgtgtcgttttagctgtatatgcctgtactattgtactagtatct

SEQ ID NO: 52633 - DNA, 8049 bp, Oryza sativa
ggtagttcttttatccttgaattactggataggtacatcaggagctgtcacatttgatctttctagttttcggaatcagatcctagagaaacctggtaagaattgaactaataagcgtgtgatgtagtatgtagaatatctgctgagtagatgtagaaatctggtatatttgggactttgggtatttgaaggtgtgtgattgcccaacagttgatcatggaaaagaaaagggctccattttatcctaggattatacctttttcagctttttggctttgtcctggatgttgtgaccagttcaccaccactaatttatgtttgcttgatccattgtacagggtcctgtatttgatatgcctgacttcaagatgggtgggaagaagagtgatgatgctgctcccactgatgccggggatgaagatggtggtgatgatgacggggacgaggatggtgactttggggaaggcgaagaggacgtttcagaaggtgagggatatgataatccaaaaggcatcgataacaacaagaaaagaggtgagcctgaggaaaatggtgaggaggatgaggaagagcctgaaggccaggagggtggtggaggtgatgacgacgatgacgatgatgatgacaatgaggatgacgacgacgatgatgatggtggtgaagatgatgatggagtagatgaggaagaggaagatcaggacaatgaggatgatgaggaagatgatgatgaagactcacttcagcccccaaagaagaggaagaagtgaatatcttcatgcggctatagttaccaacttaccatgcgctgagctgtgcttggttttcgtcatgttctcggaatcgaacttgcattagggagttaagaaaaaagggctccacacgttcagtaagtgtggatttgtaggagctttatgatttcaagcaattagacagaactctgttgtcattgttgcttgcttctgtggagttgaacagatgtttcgctaacataattcgacctgaatggtgaaagcctgaagattgaatatgtcacaagttatttttacttctttcatgcaactcaaaataaaaaagttagtgagaaaagagtgacgttaaaattaggaataacagcaacacggcccgtagccatttgtgccctgagtgcctgaatgtgagtaactgagtatgtgaccgggttcttcagatctacttctagcgatgtgataatgtcatccggataatttcagaaatatgtttcgtttagatggaaattttaggagtattaatagcatgatgaatatgtattcgggcggtcagaccttcaacacagagtttgagtccaatttaattatttctcgtgcttccttattttagactgggatttctcgagtactaattaatttctaagtctaattggacatggaaagatcctaggaagcaagtccatccctactatgaatacaagggggctaaacccgattgaaacaaaaactaaacaattgccaaattcaattaagtatcaaaccctctatattctacgtctccctctttcttgctacctattttaagtctatttttctcaaatctccaattgcttatcatgtctcatctctacagcattagaggacgtcctaattggcttgatgagcctacgacaaaccggtatgtgtttactctaacagggtcccacttgggtgctcgttaagcggcatctatcactccctatgacgcgtgcgtctccaggttcaaggtgttcaaggtgtggctgcacatttctacgtcaacccttccatcttcattaagttcttttacgaagttatcatttggcttgtacttatgatattcataccgcttattagtaaccaaatactccctccatttcaaaatgtttgacaccgttgactttttagcatatgtttgaccgttcgtcttattcaaaaaaatttgtgtatgtaaaactatatgtgtatatgaaagtttatttaacgatgaatcaaatgatatgaaaagaataaataattacttaaattttttgaataaaacgaatggtcacatacatactaaaaagtcaacggcgtcaaacattttgaaacggagggagtaataatttatcggtataacttttatatatgtatcttagcgatttaaaagcaaatgctataaaaataaggcatgattaaaaatcacaaaattgactaacaaaaaagtttttaaaattaaattccggcttataagcgtaagtataaacggaaagatggggttgtcactctctactaaaagtctaaaaccttggctcgattgtggtgagatataattgttcagaatgcaagtctatctactgttacattcatgtaaaaaacttaacatacgaattaccttttgtttcaggcggagaggtgtatttatatgtttttttgtagcggttagataactccaattagaaagacatttatttatatccgttatgtaatgaaatactccacgtaggttgttacgccacgagtagcgacaaatttctccaacactactgggcaatgcttaatggaagacgactctaacacttttctatatataacaaaaacaacatatttcttatccactatcctttcctacgtggtgttcgtttagtgacgtgtacgtttactattggaggaatagtacgattttgaaatggaatattactagattcctacatcatattagattcttttcgaggccactttgttaccatctctctagtactaacatataacgtgaaagtatataccatatttctcaatcgagttctctaatacacgattttaagggttttctggggctaatcttttttttttctcttaactcttcgatttttttacgtccaaatgagtaataataaatgacgtgtaataacactttttttcctctaaaaaggcaaaataaaaaaaagaaaagaaaaagaaatagcgacgaaaacacaacacaaacgaaacgctctcgagccagagtcaccccctcttctttcttacctcccccaaaccctagccatcccgatccatccactcctcgagatttcggcggaatgcctccgccgccgccgcggtctcctcgctccctttccagctagggctctccctgcccacaccctcccccgcccgcgagatttgcgcgcccccgcccagcgccgattcgagctgctcctgctttgctgtttcggtgggggaggccatgaacaacagcgcgttcagcgaggagatactcgccgagaagctcgccaagctcaacaacacgcagcaatgcatcgagagtatcctttacccacccagctttcctcgtgctaaatcttcgcgagaatttgggtgtttctttaggggtgtgtgtcgatgtttcgtgtaaagttgcaatttttttttacacttcatatcttgcgccctttcacgattactgttgggaatcaagtctcccttcttcatttttccctcctgagactgtgtatcatacttgtatcatactatcgtgttatgtttgtcaatagctagcaacttccttcaactttaagtggatatatctacgagttgcagatgtgcgggtagcacgcaagaaagcatcttgtagcttgaacaagtgcgggttcttgtgtgtcctttttacaccattggtagagagggttcttgtgttgttagtagctctctgattgctatactgtttattagtaaacctaccgaaaataggtacatgttgacttagaatcctgtgacatatttaggtggcgcaaatccatggttttgtttgtctgaacatgtctttccatgatctaatttgttcccttgactttaattcttcgcgactactagctctttcgcattggtgcatataccatcggaagaatgcagagcaaattgtccagacatgggcgaagcagtttcacagctctggaaatgaacagaagaccccttttctctatcttgctaatgatatcttacagaacagtaagcgcaacggtacagagtttgtagaagaattctggaaggttctccctggtgcgttgaaagatgtaactgaaaacggtgatgagcgcgggaagaaggtggtcagtaggctggtgagtataatttgtctactgataggaatttattatatctagttggagatattggtgataagagctatttgatgattactgctgtatatttaatatattcttttataaaatcctccaatatctaatacgaataaccgtgaaaactgcaatcatttaatactgcagtaatatgtgctgtaggttgaaatatggcaagaaaggagagtttttggttcacgtgcggggggcatcaaggatgtgatgcttggaactgttcccctgcctgtattagatatgaccaaaaaacggtctcacggttcctcaataaagatcgtcaaaagagactctcgttctgtaaaacttgtaagctttttttttcctaccccatctgctaaattatgttcttcagcattggaaagtgttatgaaaattctcttaaactcttatcattttgttttcagagactaggtgttgggggaccgctgagaagattgtatctgcactgcacactgttctcagtgaacaagcagatgaagactctgatctggagaaatgcaaaacctcaatgcggcgtgttggaaagatgcagaaggatgttagcagtgcttgtagtaaaggtgctttatattatttgttattgacatgaatcctccatcttagctgtcttagtacatattctcaagttattccttatctgtaggtgatgatcctcgtcgtgaaaccctttgcacagaactaaaggaagaggaggatagcatgacagaatgcattgaaaagcttaaagtagttgaagcaaatagagcaactgttgtgtctgaactgaaggaggcattgcaggaacaggtcagaaacaactgttgtgattatttatagtaatgcatttccattttccgtatgcaattgagttggtatttgcaaaagcttacttgtaatgttatttcaggaatctgagctggagaaagtccgtactcagttacaggtaatgttgtctaaacatcacaaattttattaaagactgatgttgtagcatgtattgatgtaaaatatattattcctatgttttgattaacagctggctgaagctatggtagaagaagcagccgacatgcaacggaaactcaagaacgagccagtcattccttcgtccaagcacttatcctcagtagaaccaggaaagccactttctaatgggcaggcgaaggatcagcagaagacagctgctgctatcctcgcagacaagattgcagcatcatcaaactctcagcagatactgcaatctgcactttccaagtttgctgctgaggaagccaaaaattcatccgaaactcaccaggataagaggctgaaaattgaacattcctcacaggtcccaagtgtcgcgaatgctgccgcttttgttccaatgccacaaatgaccaccacaacagcacagcagccccaggcaatcttagttcagcagactcctatgcaaaaccagcctcctgcacctcaaccccaatacaatatctaccaggcccctccccatcagtttgtccagcagcctggtggtgtaatgatgggcatggcgtacaatatgagcaccatggctccaccaccgcctccaccgccacagatgatgaacctagcaaggccctcaccttcaacaccccagccaccaatgggtataatgccacagactcagccgccaccgcccgcaccaacgatgcttcagcaacaaatgccgatgaacgtcggaccaccaatgcagttcgcccttcagcagtccggcgcgccgtctttcaggcctttgcagccgcccccggggatgcaattcttccacccccaatctcagtgacatttttggtagtccagctcctgttaaaactgtcgcgttttcggtgttagtattgactggtagacaaaaggttctgactgttgtagggtatactgtttggttgttctttacctggagatgttgtacatgtaatgcgaggaaactaacaggaagattcagttaagtgttgagcctttgctcaatcctgcagagaagggcagaagacgtcacctgtttgtgagctccagattggttgatgggctgacgaactgggcaagttcgcgtcaaaatcggcccgttgttttctttttctttctgggaaatgggaataacgcggtcgagattcgagatgattgtagtttgtatatgctgcccatttctgttgttctttttttgtaagcagcaggacaagttctagtaaagaggaaaaaaaaaaccccagaactttggattatgatgattcgcgaaataccttttcgattcgaactggaagtggccaatctacaaatgcgagtatcagccaaggtgatgtttggtacacattcatgtatcgaccgtattttcatgtcctccgtagctaataatctctaccatcctcactattcttctatttacaaaaaaaaaaaacataactttcaccaaatgaacttcaaatttttgatttgaaaaacatggtagtacatttcatttttttatagaatatcaaactgctgcatcttccatctttctgacatttttatgggaaacatttcgagtggcttttcttgtaaaagaattgcgtaataggcgtggacgctctgaatgggatagacacgtgactgggccgtgcggtgaattttacattttacccctcagattagtttaccttaagcactccgctaccccacctctccggaagctttcattcgcgaagccgcacaacacaacgcaacgccgcgcttccgcctctccacccgccgccgcctccctcgccggcttgccgccgccgccgcggtcgcgaggcggagaccttgcgggacgatcggagcgacgtccctctacacccctccccctccgcagcggcgagaagaacaagggggccgcccgccatgctgcgccggtaagggcacacccacaccctgtagatgtttgtcccatccgagttagggtttcctggcctaatgctcgttcctccccgcctctattgcaggtgcgtgcgggatctgtacccgctgcggcctcttaggaggatccctaggccgatctccagcgaggttagcatttccgtttccgtttgtttgcggtcgatcaagttgtttgttctgtgaggcgcttgctgtgtaggcaaatcggtagttttctgagggagctttacttggggcactcttgaattggcatgcttactcattaaattgatggaatgtgtactgatgcgcgaatagatagaaaatgctgctaatgtttacagttgtattaacataggaccttagtgtctctgtgttttgatatgggcctagcaaatcaaggactatttggagcataatgctgttacattgaaccagttttctgcttgatttgtctaaggtcttatgatgatattggggacctaagctaataaccatatctatttgtatcttgcatagctgctatgctgaattttgtaccagttttacacattgtaggtattacgtatttaatgttgtggaacatcacatgaactaaggaattgttgtgtgcgattttcttttatctatattagattgatcaattgactagtgcaatcaaatggccctcctagagtatagaaagcttgatttatttattgattaaaaaaaacttctgctgtgattctgtgaaactttctagttgatgcgagacacagttctgcagtagttgttccgactataataatgtttggaaggcagttgtttggattcaaagaatttaacttgatgtggtaccaaaagataaacaaaatccacttagactgcccttgcttgaactatgatatttgtaacttgatttaatatttttctttatttagctgtatatgcagtttgtttacttctctgtgtaaaatgctgattatcacataaagaagcgaaaaacacagaaaagtccatggtgaattcttgtatcggaaaaaaaataaccatactatcttctcatgataatatgtaatgctacttattctgctgggagcagtattgacgca

SEQ ID NO: 52634 - DNA, 1593 bp, Oryza sativa
tggacttgagagatcctttagaatgtaaaatttgaaatgaattcctatggtgcttcatttaaaacaaatttgtgttgttatggactacacaatatgcagatcaaatggcacaatcggttggtgccaatctatgttttagttcttatgattactctttagcaacacccccaccaatatgtgcatttagcatcatcttgccaaagtcttatgctttcatattatttgatgatgcagtttctgaatactgaataatgacactggcacaacaatctcatcgaactaatcgttgtctgcaggatccatcaagcgctggtgcagttgaacataaatctctggctgagacatatttactacaagaacctgataattctaaagacatggtacgctctcctctttagtcattgttgtggtactaatatcgatgaaatactttctaattacaaggttgatagaaataatttaatggtaccttttcaatgttaatatatctgatgttttctgttatcagggtgctaaggaaagtaaacacgatggtgttattagtacgggaacttctgatgatgggaaaattgtacttgatatcatagaggctattcatgctgctgaaagaaagcaggcagatgcagatgcttacatgtattcagaagagaaaaggaagttgaaggtttgctttcgatttcatattatgactgcttcgttatttactgcattgagtttcaacactagcatgcctttgtgatttacagtattatgttccctcttttcttctgttgaactgatgttttgtggatttgtagcagttccaaatttgacaaatgacgtttataattgattcttttgattttatactattacattttataatggtcagtactctgcttatgttttctcaggagaaatatgaaaaggagctgaaggacaccagggctcgggagctcatgtatgctgaagaggcagcaattctggacaaggtctgtgacattttatattttattatcgctagtctctttgatcatgtttccataaacattgtattctgctggatgcgaacaatgtttctcaccgaaaaaagacctgctcagctatataaatatacacagcttgacgcatacctatatctcaagatttaggtcctttttacttttcatcctctatctttaagactttgaccataggttttttaataataatatcatgaaaaaaattacataaatattcagatgccatgtggctaatatacatatatggagttttaaagttcgaagtgtttgactgcacgaataccatgacaacctacatttggagagggaaggaggagttaaaccttttcattttttctgtggatatgtaatttaaatttacacaaaaagcaaaatttttttgctctatatgccttcgcttcacttcactagacctgtatataatctctctttcctatagaatgcagatcgtgtctcttgtttatattttaatttcagattgattatttttttgtggtggttttaatcttcttttctccttttgttttgttttaggagctgaagaaagagaaattgaagtcagctgctgtgattaaggaactgcaagaaaatg

SEQ ID NO: 52635 - DNA, 1365 bp, Oryza sativa
  unsure (1)..(1365): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggtagtcaactgattcagtagcaggttttgtaaaactaagcggttaacacgtccttaaggtaaccgtacagttttcacggtaaccgtgatcattttcatccaaaacagtttgctgtaccctgttgatggattcataaatttctatttgatattagtccttttttttccctcactcaccagatctccttttttaatattacaaacagatattgaggatggagtagatattatttggggggaattttgtagtaggcgagactggcgagtacaccagcacctccgaagtctcagtctccatttaatcctgggaagcatgcgaaggcactagtagtaaatgtacgcatttgccctccacggctccacgcctccacccatcactagcctcaccgatcaccacaccgcggcgcggcccggtctatcctgcgcccaccacctgccctgcccgtcctgcccgcgctgcccgcctctctatcctcctctctctctctctagagtgtgaaaagtcttctcctttctctgctccccccttcctcctctgcacctcacctctcctctcatggagttcgcctagttgtgtgctctgctcctccttgaagaagccttcagatctgtggttcctagcctttctcagcttcctcaacacaggtacccccttctcgtccccctctctccctctcttgaaacctccttactcctgcacatctgggaggattacctccttgttctttgttcttgccggtaagcacaatcagttaatcatgcccgttgtctctcttaacacactttaccatacgtatgtcgtgttcagagttcatatgcctgaaaaactctgaaaacttttcttctcttgtgagaactgggataactctcttcttctcgttctgttttttttttatcctgctgttacctgacagagtgacaggtagctgttcgtttgtctcgtcagtatgccttgagttccgacctttctgttatctctgacagttgtagttgttcgtccctagagtggatctttgctaaaattagtttcacgaaatatcggacgcgagcgctttttttgcttgaccttgggaaggaaaaaaaggaaaagaaaaaaaaaactg

SEQ ID NO: 52636 - DNA, 2429 bp, Oryza sativa
aatgaaaaaggctgtgggggccgattaatcaagtggaatggtctgggagccgagaagtaatgatctgacccgggaggtcggtacattgctaaatgagttgttgaaaagcatctcttaaagtcgaatcgagacgcaagtctcttttcgcccaaacatagaaagaaataaatcacttagtgatttcaaaatgtcttcaaataaaagatttgcaaaacaaccttgcctctcttccaagcttgcattaaacacctaagttcccgtgacttgctgagtgcgaaagtactcacccttgctctatataaatatatacatagttcctccgccctgaagagaagataaggtgaagtgaagattagggtttcgtcctggttcccagccgtcgcctgtggtgttgggtgttagttcgttggttccgctgctgctgctgttgttggtgtttcctcgtccgtgtcgtcggttgcattctcgggttgttctgagctgcaacctaagttaaggtaaataagtcctctatctattttaaggatttgctatgattcatatttgtcaccgtgggtaccagcactatgtcctgggactggtaccgagatcgcggtttcgtaggaagcggttcgcgccgttttccctacgacacgctcctatcaggtgccgttatacggcggtatcagattggggtgtgacaagagatggtatcagagcattagttggccctaggatcgaaacccctaaataggatggcattatctgaatacaaaaactatttgtgaaagctaaggtgtcgttgtcccctttagctctagttttgcgaaaaatcttttgtgtccaaaagtagaagctagtcgttgttttgacttttatcctagagcaaacctgtcttcacgcccagttaaagaaaggtgagctcaagcctctaggagtcttagttaagcccttgttggtaggctaaccttagtaccgtcacccgctcggtaggagttgtggtgaactagtgcgtgtgtgagttttgtttggtagtccgtgttcaggtgttagaccagttgggttaccggctgggacacaccacctatgtcttctgtgatttcgaaaaccgttttgatgtagtgtttttgtttcctccttttcttatctactttctgcgttggtcagttctcagttcctctgaagcaaatggcacctcaaccaacctgtcagacttgtgtccgcaactaccttggttctgaggaagacccagctttgtcagaaaatccaaatcaactagctgaacaagtcaccaaccaagtcgccaagactggtaatgctgttcctggaccaaacaaggaagttgcaaccagaaaccaacactcctcaatggatatttatcagattctagccaatcagactcagatgctacaagaaatagctcaaaatttggcttctatacaacaacaactgctactaccacagcccaaggtgaatccagacaagagtaagaatgaggccgcagaaatacaaggaacacaatcagtagaaggcactgatacccataaagagaagaacaaagaattcttaaatgtgatgattacagggatgaaaaccccacttcgagctaataattgccccaaccttcagaactcaatcaatgaatccgtatcgcaagaaaatagcatggttaaagaaggaagttgtcacaaaagaaagaccttgccatcagaagttgacatgcaagatgtcccacaatgtcagacactgcaatcttgccaaaacttatccaagacccccaccctcaaatcaaagaagatcagacacgttcccggattcatatgcttcatttgccacgaaattggccattacatgagacactgcccccaaaaaccctatatggatgcactactacaagctaatatgagcatctcaaggatgcccttctatccccaaggaagcccgaattcgccaaatgttaatgcagtacgtccaaccttccctgatgacaaaagagcaaaagcatcctgcgacatgtgccaagacatccaagaaaagaaagagatgcaagaatacaagagacgcaaagtaatgtccctagagattcaagcaaaagaagatttgtgtcgaaaaaacaaactcgccagcacaatactatcagaaagcatctcattcaactagttccggttctacgtctcgttcgactatgtcagaacctggtcagcaagccacaatgatcaacagtagtagccatgaaggaagcaactccgaaccatgccctacaccttcaaaaagacgtggttataaggcaggagtcgaatgtttcatctgccatgggatgggacactattcatggtgctgccctcagaaagtcaagtcaaaacgagtccaaccaacaacaagccttcccaacgtatctggaccaaagagttcaaagtcaccaaacagtggttctgcctcgttgacctcac

SEQ ID NO: 52637 - DNA, 711 bp, Oryza sativa
agtagaaacaaatggaaaagttgtgaatctcgagcaagttgaaggagcaggagaagaacaggttccacaggcaagagcaaagccacagtaagatgaagaatgctaagtgaatcaagttaccagaccgttttgtggcaagtacgcaacaataagttgaagaaagactagcagagtctgaagctgcgaagaagtctgaagatcccttttggtttcgtgtgtgtggtccaccttcgaatctcggggtcgagattcttgtaaggggggtggatctgtaacgctccgcttttcgtgagtcgttaaaaactatttcggcaaaatcctaattgcgaaaattttcgttctttgtgtgcgagtctaagttgtgccaagatctcaattcaaatcctgttgttccctctcatcgaaatcaaaatcctccgcctcaaatctcctctcccaattcaagtctccgaaatctaaatccgaaagtcaatcccttcctttgaatcctcgccaaacacatttccaaatcccaaaatgtccaaacccccgttttgtttccttccttgactcccctatgttcccgagaacaaatacccaagtattccttttgaatctttcccatgacttctccttgaattccccttgatacatccctaaaccctcgagtttgaatatcaaatttgaattcgaacccaaaccctaaatctctccatttctctccaaatcaat

SEQ ID NO: 52638 - DNA, 5415 bp, Oryza sativa
  unsure (1)..(5415): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctatgtcggcttattataattcagcttacagtaatctggcttaataatatatattacaataattttaacctgaaacaaacagaggcttagtttatttattgagagaatacggtagtgcagaaggtggagaacggctccgcttttacactagtagacacaaggaagacatacgtgttaccgtttgcgcataataccatatatttcaacagctgaaacacacttgtgtttacgtaaatgcagtggcggagctagaaacaataaattttatctgccatgaaggtgactatcagtaaattatttgaattttgcttaaattcaaattaatctaatttttttttgtcaaatggagggaggttatggtggttattcttctttatgtactccagtaggaaataaaacaataaatgcatgactaagattgaacaataatgaatctgttggatcagttggcaagtgtaaatgattgtactaaccgggaaattggtattagctattaatttatgaagttatgtatttatttttcttcatgcagacatgtgctcctacgtatcaaaaccatgtttcattttttacttcccccagccacagatccttgttggtatcctttccaaaacagttaaaaccagcttatcatactagtaaaaatattattattgtcacaaccatctatcaacttcctaattaatggctacctgtagtaaacaaatcaaaatgggtaaaccaaaccataactaattaaaaaacaatttacacttgtctgcatatttttttaaaaaatattcgataatattgagtttgttatagtttatcactatacttttatatactccatccatcccataaagatttcattttttttctttttccaacacttgactacccatcttacttaaattttttatggattttttatatagtcgcatataaagtgctatttatattttatcatctaataaaaatagaaatactgatgatagaaaaattttaaataagatgaaaagttaaatgttatataaagactgaaaaatagagtttttatgggagagagggagtaatacggagtaataatacacaagtttatcaattcttttacgacgtgctattgggatggtatagaatggacttccttttcttttcctacctcacctaacatttgatgaagagaacggtgaaccgggaaaagccctgtgaattttcaaacttacccagtcagtggatgggatgctatgcgatcatgtgagcgacaagttacaagatccaaaccagtcgtggagcagtcaagccgcgcacgcagagagaggcaggcaaggcaacgcaacgaaggcgaagctgcctgcctctgccgcgccgcgccgcgcgagatctgggcggaagggaaggcgcggcgcgacgcgacgcacgagagaaacaaaaggaaaagggaggggcgggggggacaaaaaccttcgccgcacaaagcggttaccgcgtccccccagatctcgtcgccgtgccgtgccgtgccctgcccttgccccgctggataccggcggcgcaccggcgcggccgcgcgatccgatgaggcggcggccgttcctcgaccagcggcggccgtcgtcgttcaagcgccggtggcagcagcgcccgtggtggttccgcctcgcggtcaccctcctcctcgccctcgcctgcctcttcctcctgctcgcgctccggggctcgcccgaccccgacccggtggtgctcccctccaccgactcgtccagatccgcggccaccacctcccctctcctccatcaggtgagcgaatcgcgtctcatatctactttgcttcacatttcgttagctcatttgcatttggcttttgagttgatccggttttaattagttcatgatcatgagtagcgtttgaaattcgtggctcctgtaatgtgcagagatcttacctcgatggcgttacggatgcgttcaacatgaccgacgaaatgctgagtgctcactcgttttcaaggcagcttatggaccagatttcccttgcaaaaacctacctcgtcgttgcgaaggaagccaataacctgcagtttgcagcagagcttagctcgcagatacggcgggcgcagagcatccttgcgcatgctgcagcccatggtggcacggtgacggagcaggatgcggagaaggcaattagggacatgtcggtgttgttcttccaggcgcagcagttccgctatgatagtgcagttacaatcatgaagttgaagggtcagattcaatccctagaggagaaatcgaaagctgaggcggaaaagagcaccaagtatgggcagattgctgccgaggagcttccaaaggggctttactgccttggagtccggttaaccatggaatggttcaagacaactgagctccagaggaagtttactgagaggagcccagcagtacagagcaacctaagggataacagcctttaccattactgtgttttctcggacaacatccttgctgtttctgttgtcgtcaattctacaactctaaattcaatgcgccctgaaaagattgtttttcacttggtgactgacgaggtgaattatgctcccatgagggcgtggttcgccctgaatgattacagaggagccactgtggagattcaaaaggtagaggatttcacttggctcaattcatcgtatgttcctgttcttaaacagctccaggatgctgccacccagaactactacttctctggcagtggtaatcgtggaacaccagtcaaattcaggaaccctaagtacttatcaatgcttaaccacctgaggttctatatcccagaaatctatccagaattgcgtaaggtcgtatttcttgatgatgacattgttgtccaaaaggacttgtcggaattgtttaccatcaacctcaatggaaatgttatgggagctgtagagacttgcatggagacatttcacaggttccataagtatcttaaccattcccatcctctaatccgtgctcattttgatcctgatgcctgtggctgggcatttggtatgaatgttcttgatcttgtgatgtggaggaataagaatgtgacaggtatatatcattactggcaagagcgcaatgctgatcataccctatggaagcttggatctttaccacctggtcttcttgctttctatggcttggttgagccattggaccccaaatggcatgtcttgggactgggctacacaacagtggatcccgctactatcaaagaaggtgcagtgttgcattacaatggaaatatgaagccatggctaaaaattgggatggagaagtacaagggcttctgggataactatgtagactattcacaccctctgcttcagcggtgcttcacgcactaatgaatgtgtatcaacattagaattttttgtgaacttcctagtggaaatgcttcaatgccttactcaacagccacacgtgaacacagtaacagaactgattaactttgtcctgaaattacatcctcagattagacatgggcggccgtttatactacctgtagttgatgaagtacagcaaccacagatgtgactggcacaggtaaacatcagaaagagccaagattgccatggattaggctgttatttgagcagcgtccattatatacattcataactcgcaaccaccaatgtaattttttcaattttgattttttgggtgagaaaattgagggcataattgtagatttgatttaaaattcttgtggtgtcacagcaagttttgagatatatatatttattggatgttcagagtaaagcttattgtttaaatgtctcacaaagcataattatcgtatatattttctaaatgttgttttgcactttgcatgccctttatgaggccatgcaatgttagtataaagtataaacaaagttagctcatccaggaaatgtgactttatgacatgatgtcgtagtaatcataaggattatcatgtttaacctcagagagaaatttagtgcttacagaacttttgatgaattgtcgtgcaagaaagtgtttacacaaaacaaagtgtaatattcagaacagaaatattatttgtgctgccatcggctacaaactggtaactgcagctgcttagctattattttctttccttctcttcagggctatttagcatatggcagctatctgggtcatctcttttgaattgtttttgcagttttcctatctataccttttatgattcatcattgcattgcagtcattttccaaatccaagtatctttttggttttgctgtggctaccttactttggtgacttctccatcaacattggtagaaggagcattggtcctctttttccttctggatctaaactttctccgcctacgtctcttgcttgtctcttttgtttcatcattatatatgggcatacggggcttcacatctgcaggatcagccacaggttcaacagcctgtgtactgttttggttggcttcactcaagctatccttcgaagtctccagctcagtctcaggactggtttccttcattggttcaacttcgttgctggcttccacctctttctccagcagattactgcctctgctttcatagttggcctcaccttgtgagttctccaactgtctagtgctatctagttcttctgtgctattatcttgactatctgccaatttggggctccactgaggaagttcagatttccccaagtggcttccctctagagcatcatttgaattatcattggcatcacctgttgttttgtcttgtggttcatcatcttccctgttagttctaagctttataaagtgttgttctggggaactattttcttgagggttgctctctgatgcagtggtgttgtagggatgcggttcttctgtagtagcaggtgtggaatcactagagtttgcatacttatcgaccaccacagtatcaacagttgcattttcgttgtttgtgcttgctccagtgctctcatcttggttactctctgacgcactattgtcgtaagaatgatgttcttctgctggagcagagtcaccagggtttgcagaattctcaggtaccgctgtgtcagaagttgtattctcattgtttgtgccaaccaaaatgctctcgctgatatttgtatctgatttctgtagtcgtgcaacttggtcttgatctcttcaagctcagcttctttttgctgcagaagttcctttatagctgccatttgttcagggcctgaagcagccgc

SEQ ID NO: 52639 - DNA, 2031 bp, Oryza sativa
atgattatagaacccagtaactgaaaggcatacattcttaagttttacatatctagagtgcttgtatctattatctaaaaaaaaatctagaatgctactggtattgcagtgtttacctttcggaatgattatagattgaactaagaggatgttcagttgagtatatatctctgtctatttgaaagtaatactccggatttctgatatgatgtatctagctcgaagtttctctggaacgctgtcagtatggaagtctttggcaagtttgaattttagttccagattacacagcttgggctttacataacttttgtgagtgcagtagtgcagggtgaggtgtatacttcatctactacctccatattttaatgtatgacgtcgttgattttttgtccaacgtttgaccattcgtcttattcaaaaaatttatgtaattatcatttattttattatgacttgatttgtcatcaaatgttcttaagcatgacataaatattttcatatttgcacaaaaattttgaataaaacgaatggtcaaacgttggtcgaaaagtcaacggcgtcatacattaaaatacggagggaatattaatatgcacagggataccgagtacacattcacattctccgggagtacagcttctagcctcttaggggagcttgaatttatttcagtacttgtattatgtgaacatgatgtgttgattaaaaaatatataatgctagactattttttggctacaacttcctggatggccaatgtataagaattcgatgcatgatattccagaaatatatccatacctgcaggagggcttgaagggagataagctgctgatcgcgttcctggaggaggatggagaagacgcggcgctccctcatcttgtgcaggatgcccacgctcagcgccgcagcgccgagtgccagcagcagcaggaggaggtaaggaggtggcctcttgttgttgctgcttgccatcgtgtagcctcttgatctgtacttgcttgaatccatgccccctcttattgacacccttccagtatcttgtgctgtttactgcagaatgaggctactactatggcagcaatatgaagaaactgaacttgtctttttggttgcttggattctggaaagaaaagtaacttgcttagtgatggagaaacatggcactgggaggtgcaggctgttagctagcgtatactgctatgcttcacttacttcaaggtgaggcacatgctcttcaaaatttgattatttagtccttatagagattaggagcataaagtttggcacttgacttttgttagtgtctcgtaagacgctggcaatagctaggatgcctgcacttgtatctgatcccagagtaggatgtcttggatcacaaatttattccttggacaaacccacaactttgcatacagtccattgaactcttctttctataggaaagtggtccgtatctttgggatttctaccaaataagcaaataagcaattcatgacaataattttgacaaacgaactgtttacaaaaatggcttcatgagaagaattgttacaaacgaactcaggaagccataatcctcagcaaaaaatatttcgtagagaaacgtggaaaagcatactctaaaatttgatctcaatcgcaaacgagtcctggcaggctggcactctaagcaatatgaattcattatacacaaatatcctccagaatgatgcactgtgagagccatcttggccctatctcttctgaagctacaagctcgtagaactagtgcatcgcttccaagtaagaagtttctaactagtaaaccatacaactcagttctagcccaaatgaactggcaagtcaatggctgaagctagctgtccttgtgaattgtgatgctttggctatctgtccttgggattctttagttcgaagttactctaatcaatgcagcctgctgacctcttcacaactgtgaatatctcgatttctttaaaattttaatactattcatcagttcaaccaaagacgtgcgccatgttt

SEQ ID NO: 52640 - DNA, 9441 bp, Oryza sativa
  unsure (1)..(9441): unsure at all n locations
atgaatgtcccatcagcaaaaatgacctgattcaatttgattaaccattcttgtatcatagcacactaatgaaaggtctttttagaacataaaagaaaagaacaatgtgtagtactccctctgtcccaaaatataagggattttgggtcggagggagtcctccaccttgatctctgcttttatgggcaaggaggacctttattagtgtgctttgatacaagaatggtcaatcaaatggaatcaggtcatctttgctgatgggacattcatnnnnnnnnnnnnnnnnnnnnnnnnnnnnnnnnnnnnnnnctctcaagcataaccaggagtttccccagcagttggtttaataaatgatcctactgggcaagtttgttggactatttcgcagaatgctatgagtctctccctgttgccaagctctactgcctgagaaaatgaagagataatttatcactgaaatgcctagactgcagtgttctaaactcttttaaggcttggttggccttctgtcagtactcaaaatcaaacttctaattggatggttccttcagccatatatgccgcactatcatggctgtatgaatatttttgtgctggtgaagtgatgtttaaacatgtagatccaacctgcacaatatcatggcgaggaacccttggaagtggctgaactctatagcccttggttgacatgacttctgcaataagcatgcctccctgtggatggtataagactgtcacttgatatcttgcatgctgttttattttttcattttattggttaaagatgtggaaatttataaataacttaccttgacagcttctccaaccatttgcggagcaagaaacaagccttgaaacagtgcccgcatcacatgtccaggtgtagacccaaactctaccccaagtccaggtgcagacaggcgagctgctgctgccgcaaccaaatctttcttccctgcgacatagccaccacaaggtgcaattgtcccacctggattctttatcaaactacccgcaatcaaatctgctccctgccatgaaagtacccaatcaggtaactaaaatctaatgcttaaggtggctacaagcatgaacataccaccattggaggctctgacgtctcaacaaattcaccatagcaattgtcaaccataaccatgcagtttggattttgcatctgcaatgagttccaaaacatgactccatgagcaaatatcaccatatgcattagttaatgcacatacagaacatgctggtccatgaattcacaacatatcatcttgcctttatcaaatctatagctcgctggatatccgatatgcttaggctcttgcgccacgaataaccacaagatctttgtatgaaggcgcatccggtctcaggtctgacagcatttgcaagagcatcccaatcaaggccaccatctgctgcaagctacaactgaagccacatcagtaactcacaaatagcacaatgtaaagcattcctggtgtttgtaaggtgaagaaatcaacaaaccggaacttctcggtatgccactccaaaatccttgagcgatcccacattggccgaccccctgatcccaatcacctcctccaaggtgtcatagggaggaccagcgacagccaggagctacacattttctaaattttcatcagctcccagtttctaagctagcagaagcaatgcgaaaactcagttcatccaggtgttctctaatctcttacctcgtgtccaggcctcagaagagcaaacagagcacaggcaatggcgtgcgtcccggagaagaactggaaccgattaacaaagagctcatcactagtacaagaagctcagtttttcacgaacgcgcaaaaggattgcgcgtcaatatattacggtgtaggtacaagaagctcagtggagctcagcaatggaagcagtggagagagtggagtggaatgtatggagaaatggggggagtcagagagaaatggtagcgcgtgtggacatggaacctgggggcggacaatggcggcctcggcgccgacgatctgggcgaagacggagtcgagcacctccctgccgcccccgtcgtcgtggccgtaccccgtcgagccaccgaaatgctgaaattcgcggatgccgcgtgcgcgtcataccctgaacctgacagcgagccgcatacggcggaggaggagagaagacgagggaggtttacgtgcggcgcgacgtgggcggcgtggaaggcggcggagacgcgggcggagttgagggcgagcgcgcggtccacctcccggaactccgcctgcagcgactccaccgcgcgggacacgtccgggtggaacgccgacgcgcgcgccgcacgcctgccgccccgcgaggcgggcgcggagcggggccacgcgacgagcggggagacggcggcggcggcgcccgtcatccctttcgctccgcttgggcagacgttatcctcgtccccgcgaaatgtttcgcctcccttaagcccagcctaatgcggccatgtgaagcgagaaatgggccgtggccgtctgatgaggcccattacgagagaatctgcttcggcccaggcccagcaacctagtagctctttcaaaaaggcgaaaccacccccaacggcgattggttgatggtgcgaagcaaagcatgcggggtaacacgccacacaatgcttgcactcaacgaaggctagctaagctaagcttaaatcattgcctcccactgctccgcttgctgcatgctgctctatatcacttgctgtgtcccggtgttttctctcatcaggatcaagctcgtctcgttgatcaatggcatcagacaagtgctcatcgtttctactagcagcggcagcggctgcagtgctcgtcctcgcgtcggcgccggtggctcattcgtggagcaaggagggtcacatgctcacatgccgaatcgcgcaggtgaatgatcactatcaatcgaaccattcctgaacatttaggctgaatgactgatgattatgatgccgtgttggatgcaggatctgctggagccagccgcggcgcacgcggtgaggaacctgctgacggaggaggcggacggcgacctgtcggcgctgtgcgtgtggccggatcaggtcaggcactggtacaagtacaggtggacgagccctctccacttcatcgacacccctgacaaagcctgcagcttcgtctactcaagtacgcttaggcaactcttctcctccatcagtttctgaattatgctatactctgaatctgctgtgataatggtgtatatgttgatctgtctgtcgcgtttgggttttcaggggattgccatggcgcggatggtgcggaggatatgtgcgtcgctggcgcgatcgcgaacttcacctctcagcttatgcactataatcacggcagcgccgatcgcaaatgtgagaactacgcagttgtagtatatcatatcaaccaatatagtttagttgtcatgtatctcttgtctgactgttcattttctttcatattgttgtaactgcttgtaacgcagataacatgactgaagcactgctattcttgtcacacttcatgggagatgttcatcaggtaaccttaccaattagtctactctcatgcactccctgcaacagttcatacacatcaacatactaactattttatctgtccatccagccaatgcatgttgggttcacgagcgaccaagggggcaatacgattaatctacgctggttcaggcacaaatccaatctccatcatgtaatcaacttccttgatccttgcacataattccttccatgtgaaaaacctgccgttaagctcaatttacttacttttcaagtctgtctggtgttttttcaggtgtgggatagggagatgatactcacagctattgctgaattctacggcaaggacatggatgcgtttcaaaaggaccttgtgcacaacttcaccacggtaagagaactgcctgaaaacaactcttccaagcaaagaaacatgagaaaaattcctgcaaaattattttgaacgaacgaatttctgcaatttttcatctccagggaacgtggtctgatgacgtatcctcttggggagactgcgaggatctcctgtcttgctcaaccaagtcagtacaatccaaaattctgaaaccacaattctgtattgtttaacaaagaaagaatcgccttggttttttgcattcgaatcatatttttctatcatacaacaggtacgctacagagagcataaatttggcttgcaaatgggcgtacaacgatgtccgtgaaggcgaaactctgtcaggtaatgctgcctttgctagaacaagcacacatctctgaagtctgaacctagctgatgtcatgggattgtcaatttgttatttccagatgactacttcggctcacggctcccgatcgtgacacgacgaatcgcgcaggggggagttaggctggccatgttcttgaatcggctcttcggggagcacaaccgtgacgtcgcatcaccagcctgaactgatagctgcttcagaattcagaaaattcagaagttaaccacacgtgtaatctaacggccgcatccatttcattttatttttacgtgatacgtgactctatttttacgatgaatagttgatgccaacaatgctgattaattaaccacatagtaatacaagtaagcaacgcttgaaatcaacaggacatagcaaaccaattccattcttttctgatcataaagagatgtacatccacatgtatgattaattgtatctagacaagattcaatgactatactactctcattgcaccaagctgtttctgctttatagcctactagaattttttttaaaaaaaaattgctagtatgccccaaagttgggttgcatactcagttttgctacaaacgtgagtggctttgcagatttcatttgccacagagttctggccgatattctctctttatcgtgattttctgcttgatgccgcgatggtgaattatcccatgggctgcatgcatgggccaaattactcgcgttacagattcttttggaaataataatgatagaggtacgttgcaatttttttaacgcagtcatgacaaatttagacattctttatttctaattttactgaattttgttgtttttgtaaaggaacaatataaataagcccgaaatgctcttgagtcttgacaccataattttggccaggattttttgttatctctagtgaaatgactatccatgatcatcatcagatgaataattaaacagaagacatgtgcatgcaacacacgcgttttccagcgcataaatctgactgttccctatcgagatagtagttcgacactgaccaaaacggggagtttgtttcactaatcacggcgcggttttagaggccccacaccacgcacgcagcagctaggtgctaatctaacgtagtttttttttttttgacgcaaatctaacgtagttttttagcgaagcgaactgctggattccacggtgttcgtctcgccaccttccatttctgtttgatgatttaatcctctgcccagttcttcactgacgaacgaacaagctcgccgccattgccaaaccaccttcttcttcttcttcttcgcctcctcatcatccacgatcaggtccatttgggagatcaatgcgaaattgtgcagttgctgcgtcgttctggggcggaattgattgtgttcttcagtctatctaatccctattaatcgatcgttgagggtttgagatcggatttggcgatggcgattacgaaggttctcggatcgaaacctgccgactgcttccaatttcaagatcctaattcctggtacttcttcacctgtcgctcgtcctatcccctatcgtatctatccccaatcatctccttgttcatgtttgagacgctttgcgtgtgttcatctcctaaacgattcgttaacttctatatatatgtatatatatatttgccttcgttagggttcaatgtgatcctaacatatgacttgttgattgtgtccctgtagcgcacagactgcatggattttcttccatgaaaattcttcatttcaggttttttttttccaaaaaaaatatcgctatctttgatcaggttaagatgacagtaactcgatcataatacacctgtaagatgaacttaactttcagttttgaccgaatgtagcacataacagagaaaataaactgagatgtaaactttgacacattaacagaatagatgagcatatttgagatgaacagtgcagaatcttttgggtctctttcctgcactctgctagtggaattgcatgttatcctggttttttttttgacaaaatcaaaatttctcaatcttgcaggacttgcatgactgagcttgtaagcgatgtggtcgttgaggttggagatttctccttccatctccacaaggtacatctgctacactgatctctctttcaatctcctatctttttctagtgcaaattcactattgagtcttgaagtacaaatgcgcaataaattgaactcattacacatgcgtcaacaatttggtttcttgatgaaaagatatcatctgtcatcctgttttcttgttccatgtcctgtttgaggtagctgaaatcgatatattgatggattatctgatttttgtgacagctatttgagggtttaaatgaatgaattaactactacaaagattaaaaagaaatgttcaagaacagggacagaagccttaaattctgcataatctgaacattttaagatttttctctactgacgtgtgtcaaattgctcttccatttccagttcccattgatgagccgaagtggcacgctgcaaaagctgataagcgaagcagccgccggcgccgacgacggcgagccgtgcagcgtcaagctccacgacgtccccggcggcgccgcggcgttcgagctggcggccaggttctgctacgacgtcagggcggagctcgacgccgggaacgtggtcgcgctgcggtgcgcggcggagcacctcggcatgaccgaggaccacggcggcgagggcaacctcgtcgagcaggcggaggcgttcctccgcgacgtgctcggcagctgggacgacgccttgcgcgcgctgcggtcgtgcgacggcgcgctcctcccgctcgccgaggagctcctcgtcgtgccgcgctgcatcgacgcgctggcgagcaaggcctgcgccgacccgaccctcttcggctggccgatggtggagtactacacggcgaggggcctcgaggagacggtgatgtggaacggcatcgccaccgccggcaagccgaggtcgccgggcccggactggtggtacaagcaggcgtcgtcgctgaagctgccggtgtacaagaggctcatcacggcgatgaggtccaagggcatgagccccgaggacatcgccggctcgctgacgcactacgccaagcgccacctctccggtctgacccgccactccggttacgtcggcggcggcggcgcgtcggggaccgtgctctcggacgtggagcagagggcgctcctggaggagatcgtcgcgctgctccccgtcgagaggggcgtcgccacgacgaggttcctgctcgggctcctccgcaccgccacgatcctgaacgccggcgcggcgtgccgcgacgcgctggagaggatggccgggaaccagctcgaggaggcggcgctggaggacctcctgatccccaacaccggctacgccgtcgagacgctctacgacgtcgactgcgtgcagcggatgctggagcagttcgtcgccgcgaacacgtcggcgttcgccgcctcgccggagatcacggacgaagcccagctggtcgacggcccctccggtgagctcatgccgatcagcacggtggccaagcttgtcgacggctacctcgcggaggtcgcgacggacaccaacgtcaagctctccaagttccagagcatcgccgagctcgtcccggactacgcaagggccatcgacgacggcatctaccgcgccattgacatctacctcaaggtaagcaaacgctcggagagacagagtcttgaactggacatttttctatggaaaaaatattaaaaaaattagtcaaattaattgagataacataagtctataaaaaaacatgtgagaataaggccatatttagatctcatggtaaaaaattaatttgttcctgtaacgacccgcctctcccaggtcgggcccacttacatctggcagctttcatagcctctcccaggccgggccagataggtgccctcacagaccaacacatctgcacactttgtgctcattcgtcgttctttggaaattggcttccggaaaagaagttgcaacttattgatatgagtattctattaatcttattaagccctaggccgggatgttacagttccccctatcacatcgaatgtttgaacacatatatggagtattaaatataaatgaaaaaaataactaattatacagatgacgtgtaaattgcgagacgaatcttttaagcctaattgctccatgatctgacaatgtggtgctacagtaaacatttgctaatgacggattaattaggcttaataaattcgtctcgcagtttacagacggattctgtaatttgttttgttattagtctacgttaaatacttcaaatgtgtgttcgtatattcgatgtgacacgccgaaactttacaccactgatctaaacacagcctaaatttgatgtacaattagaaaaaaaaattctaacaattaataatacatgtacaacagatataatttgttttttttcctcttgtatagattgaatttaaacttccatgtttgtgtagtgtcccatattaaccctaatctatattatcaaattttatgaatattttttatataactttcatgtctcgaactgcattagagcagcaacgtggtgatgctctggctgtggacgcaggcgcactcgtggctgacggcgtcggagagggagcagctgtgcaggctgatgaactgccagaagctgtcgctggaggcgtgcacgcacgcggcgcagaacgagcggctgccgctgcgggtggtggtgcaggtgctcttcttcgagcagctccggctgcgcaccacggtggccgggtggttcttcgtcgccgacaacgtcgaccagggctcccccatcgccgccggccggtacgcgccggagaggagcggcgagctggacttcggggcggggccgccggaggaggaggatggcgacgacgacgacgacgaggcccggaacaacgtgcggtcgtcgtcgtcggcgacgatgagcgtggacgacatcaggcagcgggtggtggagctcgaggaggagtgctcgagcatgagggaggagatccaccggatcgggaagcccaagggcgcgctgagtaggctgttccggaagctcgggct

SEQ ID NO: 52641 - DNA, 2258 bp, Oryza sativa
taaggttcaaacagtatgcaatagatgagtactccctccatcccaaaaataaaaagacaaaccctgatttccgtgtccaacgtttgactatccgtcctatttgaaaaaattaaaaaaataagtcacgcataaagtattaatcatgttttatatctaacaacaatgaaaataataattataaaattttttatggacagtcaaacgttggcacgaaaacccacggtttgcctttttttttggaacggagggagtaatgactaagctaggtttattttatctataactttctttttaggtacccatgcggccatgcaacatttgcattacaggtgcaatcttgaaggtttgtcttaaggagaaatttttagcaaaaaccatgagcagaagcggaaacactaacattccactctaaaaaacgaaagccaagctcgctcacttctctgtaaatatgtactcctactagccagcatcaggatttctgatttcataaactcgacccccgaaaatcatcatcattgtacagaagaaaatttacatccgcagcaaaatcggcaattctatccaaattgtgcctcaactggcgactaaaacatcaagaatgccaagtagcttgtagctacatgccaaaaattattagctctgttaaaaggaggaaagttcagcagccgcctgacaggaatggctctggctcctatatattcaggtatttgcaatatggtcttaagatatttgtgattggactgagtaacgtaagtctgtaactcgcagatcttgttgaatactacattgatgaacaaaatcacgagaatgtgatggaagaagcataagaatggaggagagtaagcgtctgctctgctattgcacgtttccttgcctgcttcacccactcgctagctatttctgctgcttcactcccttgtaaccctctttccaaggcctccgctgctgcactcaagtctccatgtataatcaagttctccactctgtttagaagagactcaattccgtctccagattggtcctctttgatctgaaaaccatttacacaaaatttagaaatccagtttgatgttatatgacagaccactgttagtgtttatcatgcaagagggaatttttgagatcacttgactgccaaacaaattaagaacaagaaaacggaagcttgatagccagctagctgaagaaacttattctattcaatggacggttcagtgtcaggcaacaatgcaatagggaaatctaaaaaaaagtgctcaaatcaaagctggtaaagatccctagggcaaatagggccactacaagtcaaaagtggtaaggaaatacaatgcctggaatagacactactaataggtagttgaccagaaaattcagaaccagcacacaaaatatttcagtcacatcaatataaaaaagctaattgatgatcagtaagaaaacaacgtcaatttattttcaccttaatggatgaagccacatgagcaacagcatgagtcagcataccaccaccacccgctggtataaggctgaaatgcctgactgtttccttcaaggaattaaactgcaacaagaaataatgatatatcatttattctggactaattattgggtagccaagccagtttttctcagcgagcattcatgattaacaacagttaatatttggagcaggtatttaggagcaaaacaagcaagaaggtggaggcatcattagaattctcacacaatgatgaattaataatgtcgagcggtgtggcacactaagtaataaggctatgagctgtaatcatttattgcaacacaaggaacttaccttttgtttcaaatccataggggtatctgatccgtactcgagaacacttctggaattgatgaaagagccaattctaacagtgagtccttatcaataccttcaagagatttgcgcaattgatccacctctgtccggattggtgatccagtggatagagcatcttccaaagcaagagtaccctgcaagaagagttacacgttcagttgacatgaacttaggaagcctgaaagaaaaaagtgagatgataactaagcttgaaatacttggatggcatcaaagtgaggattttaccagagccagcttatgaaccgaatgacttgccgagtttcttcagatcgtgcataaaacgccatgcacaaagcatctatttgaaaaatatgcaaaaagaaaaaaagcgaaattaaaaaaatacaagcaatctgaacttccatgtattgcacaaatt

SEQ ID NO: 52642 - DNA, 705 bp, Oryza sativa
acatcagtacgctcatgctcaccatcatcagtaaccacaacaatttcatcatcggagtagatgccttcatcatcaacaccaacatgttcattttgtttaaatggatttgctaagtacttatcaacaagttgtgtgctactgctaggctgagatatagtagcctgagatggcactgcaagagatggagtggatggcacctcatgtatgtcagccgcattatgtactgtcccactagctatcttttcaggtgttggccaatcagcaagtggaagagctacaactggctcattgttgctatgaacttgaatcaacatagatatttccttggtggtggcattcttgacaaacatttctagcatacattggtctgagcacacttgaggatagtttttgtttactgaatcatagtagttcactgttataaattcattcaccccccatgggtacttctccctaatgtcatcaataaagtccttgaagtttgtcctgtcactgtctaccacctcctctgttttataggtgaagttctctctactatgatgcccttggagcctgattttcaacaaatatgttgtaccaggatccatcctatacacgatgcatgcaacaagattactgtatgccacaaaactacacctaaccagtgctaccaccatatgcaaaaatctgaacaatcacaagaaggggaaaaattgatacataccc

SEQ ID NO: 52643 - DNA, 865 bp, Oryza sativa
catatatatacacacatatatatacacacatatatatatacacatatatatatacacatatatatacacatatatacatatacatacatacatacatacatacattatacacatatatacatatacatatatacacatatatatatatatacatatatacatacatacatatgtatatacatacatacatacatatgtatatacatacatacatacatacatacatacatacatatatatatacatacatacatatacatatatatacatacatatatatacatatacatatatatacatatacatatatatatatatacatatacatatatatatatatatatatatatatatatatatatatatatatatatatatacgtatatatatatacatacatacatatatatatatatatatatatatatatatatatatatatatatatatatatatatatatatatatatatatatatatatacatacatatatatatatatatatacatacatactgtcggtgatatgggaccgggagtatcatgaccagaggcttgaggcagacacaatcgcccacgtggcctggcaccttcggggacgtcgggcccgagggtgaggtgtccgccctccttctgattccccccgagggggggtcgggttgcgcttgccccgaccccgagggccgaggcaccccgaccccttaaggaagtctgccccgcatatatgggataagtgagccaagctgtgctcacctaacagcatttattgcggtctgttcaagcgtgtcacgctgcatgcaacccagtcagcgcgttcctttatccggtctgtgaccagtcacagcccggtcagatcacgggttag

SEQ ID NO: 52644 - DNA, 4175 bp, Oryza sativa
  unsure (1)..(4175): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaataaagattggaaacttattgaagagagaatagagaaaaagcttagtagttggaaaggcaagcattatcggttgggggtagattggtgttgattaattcagttctttcaagtttagccatgtttatgatatcttttttgaggtgccgaaaggggttcttcataaaattgatttttatagatcgcgattcttttggcaaggagatgatcataagaaaaaatacaggctcactaggtgggatgttgtctgtcaacccaaggaccaggggggtcttgggattcataatctggaggtacaaaataaatgtcttttaagtaaatggttgtttaagttaattaatgaggaagggatttggcatgacttattgaagaggaaatatctttataataagtctataacccaagttgacaagaaacaaggtgattcccatttttggtctggtcttatgaatgtcaaaagtaccttcttaaatatgggttcttggattgtcaataatggggaacaaattagattttgggaggacaagtggctaggtaactgggcttttaaggacaagtatccatctttgtacgcaattgttcgtaggaaaacatcttctattgctactgtaatgggttctgttccacttaatgtttctttcagaagagctttagttggtcagaatcttgattgttggcatgagttatgttcctctatagtacatattcaattgaatgattcgtctgatacttttagatggaatttccatcagaatgggttgttctcggtgaggtctatgtacctagctttaattaataatggttatattgacaggaataagtgcatttggaagcttaagatgccacttaagattaaaatttttatgtggtacttgcttaaaggggttgtgttaactaaggataacttggcaaggcgtaattggaatggtagcttgaggtgttcgttttgtttgaagaatgagtctattcaacatctctttttcgattgtcatttggcgaagtttctgtggagagcagttcagttttcttttggatttaatcttccagttagcgtatctcatatttttgatgggtggcttttgggagttgataagaaaatgagtaaactgatacttgttggagcttctgccatttattgggcaatatggctgagtaggaacaatatagtttttgacaaatcaccatcattttcctatatgcaggtcattttcagagcaacccattggcttcggttttgggcacaactataaaggtgtgaagatgatgaagagtttctgaaagttgcatgtcggaagctggagactacggttatgcaactttttgccaattatgggtggagatttacaaatagacttgaataattgtaatctcctttgttagactggattctttattgttgcttgcggtgtgttctattcaattagatctacactatgttcgtcaaacgcttctatgtaataattggctgtagctcttttaagtaaaggccgggatatttatttattccattatctaaaaaaagatgatgctgcaccctggcattttggatgaacagcagcctcctcctcatcaggtagctttccctcaacatcagtggcctcagcaacttgcccacttctgccatcgtcgctgttcgaatcgctgcatcgacatgtcagcattagtgaacagaaagaacagctgtgatggtctaatttagaagatggatttttttagatagtggaatttattcctgcctttatttttcagtcgctcattataaagtttgcaggacgaataaccgctaattacaaaattacagcttgattaaaaacatgtaattaatgttccaatgattaacgtcaaacttcagaatgccttgtgtcttgcaactaataaagctagagtattgagttttttcatggagaaggataacagaaagtaaaacaggtgagtaccctgagtaaataaccagcccaattgcaactacaccgaatgccacatagtacatccagtcgacctggaaagcgaaagtgcattcaattgctggttacatgtaagacaataaactgcagtatgctttatgcagaattgcagattgagggcccgatgatcagaccttttcatggtaggcaaacacacggatgagaatagcccacatgtctgaggctagcaatgaaaggtttagcattgttgaaccactgatctgcacaagttaatatagatatgagaaacttaaagagcaaaaaccatgtgcttaatgtggcagtgccatttcgtagtacaacaatatcccttttgtcggttttcttttttttttccatttttaaggagatggacaaggaacagtaggtaaacttgggatgtaagaactgagaaatcatgactaaggaaattagtagatacacacttgcacaaaggaaacattgtttgctaatataccttcagtaaaattggaactagagagtaaaacatgaacattgcgactgcaaacccaataaatggtaccacctgacaagtggtaagaaagtaatattagatgtgtttggtgtaaaaaaaacggataccaatgtcacaatgaggggatttttagaaggaaaataaaagaggaggacagaggaggacttacagcaccaacactccattgtatagattttttctcgttgtgttcaaatatgcttctgaataagcaaataaagaaaaaaaacagcttatgaactgtttgaatgaataagaacatgttgcaggaggtaaaaaggccacaatacgattttaacaaaatagcaaaaaactcttctgtaaacaagagaagtctactaaactgcctaaagcactttggtccgtctgttaatccccttaagtacgggtattcaccctcaaaggtatgaaagttgtttgaaataaccacttggaatggttttgtagtgattttgctgtgtacaagatgacacggcaagcacaatagggcaaaattacccaacccaacccaacccaaccactccttttctctctccaatcagcaggcccaagaatcactttataagcactaatgtgcttcttttccaaccgtcccaataattaaaatgttatttaaccgaatacatcggcatgtcacagtgtccatgtaagccaaccatttataaaaccactatttgcacttatttgaactggttttcatattttagagggtagaatacctagtttcatacttgaggggttgcaggacaaccataacattttagggggttaactttgattttttccttaaacattctagagtaaatttcacattgggctaggttttttttacccaagttttacattggaccaggtcccactcaagtttttcacttaacaccacatgtttttacatttgattgcactttggactaggattggcgatttggggtgctttgctggctttggcccattcatgcaagcaagcaatactttgattctcttctccaacaccggaggtcttgcccagtcggagttgccgcaagcaaaaatggagtttctgcaagattcagggtcctgccgtgcgggtgcaaagcttgggaggtgttcttcgtgcatcatgaccaagagcgagtgcgtgcagggagaaaagaacagctccggccagaccagcctccgagagcaaggtcattgaggtggtgagagaaaattgatctcccattgacggggatgtgatagaaatagcaaggttgtgtagagatcagcggcgacggctgagtcgcagacggtagctcgtgcctccttcctcatggatgggctggcccaaataatagaccccacccaaagtgaaatcaagtgtagaaatatgtggtgttaagtgaaaaggaaaaagtataaattaccccccctccccggggaactatcgcggtcgtctgaattatctccctgaaccacaaaaccggacatttttcacctgaactatacaaaccgaacgaattacccccctcgacccaatccgcggtggttttggtctacgtggcgtacgcgtggcagtccagtcagcattctatatttaaaaaatatggggcccacatcgtcatacgctcttctctctcactctcctcactcttct

SEQ ID NO: 52645 - DNA, 11985 bp, Oryza sativa
agagagaggaagagtgagaagagtgaggagagtgagagagagaagagagagaagagcgtatgacatgtaggccccacaattttttatatatatagaatgctgactggactgccacatgtacgtcacgtagaccaaaaccaccgcagattgggtcgaggggagtaattcgtccggtttgtatagttcgggatgaaaaatgtccggttttgtggttcagggggtaattcatacgccgcgatagttcgaggggtaattcgtactttttactaagtgaaaactttaagttagatatggtccaatgtgaaacttaggtaagaaaaagtagtccaatgtggaatttactcaaaattctattataataagagaaacaaaaatggttaaacacggttaaaacaaaggagcattttacatctgacaagcattctagatggatttttttagatagtggaatttattcctgacaatgtggtgcctttatttgttcctcgtagcggtcggacaagccatcggaggaagccgaagaggaccgggacgggaacgggaaccgccggctgtggctgcagcgacgttgttgttgtccccctggtcggacgccgcggcggcggcggcggcggggagaagccgcagcggcggcattgcttggtggccgcggagtggtccccgtcgcccctcggcatgttgacgccggcgctagccatcaccatcaccaatcatgtcatgcgagcagcagcagaagcagcatccaccatgggaagagagatgcgttggaggaggcgagaggaagaagaagaggtggccgtgtggctaaggcccaaacacaagggcccatgagcataaccagttccttccgttacattaaaccctagacgctcctcctctcctgcccgcgcgcagttctgctgcttgctgctccggcgctggccctctcttctcccttctccgaccttgcgcctccctcaggttccccgcttgttgatctgcctcatcttcttcctatttgatcgaaagccaatttgcttatctgtgaatttatttcgctagccttttctgatgccatctttggctcttggatttgaaggctgaagatcgattacatcgcaggacaggacgcgcaatcgactttgcaggtactcttccttccttcctcacaattgtctcctggatcttggtatgtactactgcttaaatcgcctctcgacaaacggatcccctcgtttccttctgctctgcaaataatccacccgctttttttttaattatttccctagctttgaagatattttaagtatgtctccgtcgacgattgatttctcgcggcggtttcttaatctgatcgtgggcaaccgcacccctggtgtcaaatcgctatggtgcttcgacctgatgcgccagcagctgttctatccggcaacacctccaccgccacacaaggttgaggaattctggcaaaagtttagaccgccgggcacaatgatggacagcatggggcttcccttctcctgcttcaccttccgagcttcagctctcaacgtcaacggccaatcgaggatggactgtttcccgcttgctggcggcgaggtgatttgcatggatcagtctggccgcgcgttcctcgtcgacgctgatgcgtgccaggtaggaaccatgcccagtcttcacaagcccaagtcgatgcccttggccgtcttcgtccccaatgccaaggctgacaatgactatgaccatgatggctatggcagcagcctctttgtcatggagaggattcccaaaccggagttgggcttcaacagcgatcagtttgaggccttcatataccgcaagcctacaatatccaactacacaaaggcctggcactgccatcaactcccacccccgccttttgtccgtgaacccaagcactggcacagctgcagcaacccagagatcagctcctacgctgtgcttggcggtggctcacacatttgcttatctgtcaatggcatcggcacctactgcctggagacagcaagccacacatggagccaagttggcaagtggacactgccgttccatggcaggattgattatgtgcctgagttcaacctctggtttggcctctctgctgaggcccgtcgcttggctgcggctgacctctctgccatggactcctagccacagctagtgggcccttggaaggaactcaacctgccagaggaatggagggaatgcaaggatcctcaacttgttaaccttggctcaggcaggttctgcatcgctaggttcttccgcagcaacagtgactttggggatgaacaaattaccgtgtttacaggtgtggaggtagtgccacacgtcggcgatgccaatggctatgcaaataagggcagcaatgggaaagtgcaactccaaatgatccctcactgatcaaaatgtcacatatctaatgctactaccatcgatgttgtgttctgactaatattagtgctggcatccttttttatttgtttatattttatctgaataagagatgacttagaatattgttgtaagagatggtctccctatgatctctatttactagtagtgcggtattgtatcctgcaatggtagattctaaaattaactgaatttagtcccctttcctaagctcaacgagtggccaggagggctgaggtagaagaacccgactgaaggggtatattggtcaacccaagtgaaaaaatggtggaaatccagtgaattggcaaatatggcaaagaaaaggtttggtatcgcctagggatggccttttaacgaatccaatccgtggaatggcatttgagcgaaaccctcttttggtagtggcagaatgtccaatttctcgtttcgttcaacacaattgtgtgttactgaaaacatgtgtgatgtttggaatttcagttcaaggtgttgataatcacctcctaccctgttgctattgtgacctgtctggctgacagataattaatctgtcatgccacaaattacatgatgttcctgtcaacgattgagaaacccctaagttgctgatatgctgcaatttataaatgccaaccttatggtcaatttttttaaaaaagaaaatttataggaaatgaacacttcccctatgtaaggttcgtatgtgtggcaatttggttatgcagccctctaaagttatggctgttaaagaaacagtttgctcatctatgctttcagtcttcaagtatgaaaaaataaaatgagaaaaatcataataatatgcttgtttatcacctgatacatcaaatcttcggtacccagttacatggcagagaatttccccaatacaacattttgcactcaaatactttctggctaactggaacttcctttagaagcaccaaagagaagacaagaatacattgcaaaattacattacagcaaattgcatgaatatgctgacctaccacacatgtttattccaatactatgattctataatcctaatttctagtcattcccgagataactctcagctcagctcctcgttgctgagggcatgataggggccatttccttcaacacaaacataattatccgcgttaacaaaatctctccttgttcgattttcttttttgtttccactatgttctgtagtccatagttactttcatgtttgagcatgtggctcgttaggtctaatagtgggaggagttttaccatcatcgaattttcggatgccagatgatgctgcaccctggcattttggatgaacagcagcctcctcctcatcaggtagctttccctcaacatcagtggcctcagcaacttgcccccttctgccatcgtcgctgttggaatcgctgcatcaacatgtcagcattagtgaacagaaagaacagctgtgatagtgtaatttggaagatggatttttttacatagtggaatttattcctgccttatttttcagtcgctcattataaagtttgcaggacgaataaccgctaattacaaaattacagcttgattaaaaacatataattaatgttccaatgattaacgtcaaacttcagaatgccttgtgtcttgcaactaataaagctagagtattgagttttttcatggagaaggacaacagaaagtaaaacaggtgagtaccctgagtaaataaccagcccaattgcaactgcaccgaatgccacatagtacatccagtcgacctggaaagcgaaagcgcattcaattgctggttacatgtaagacaataaactgcagtatgcttgatgcagaattgcagattgagggcccgatgatcagaccttttcatggtaggcaaacaaacggatgagaatagcccacatgtctgaggttagcaatgaaaggtttagcattgttgaaccactgatctgcacaagttaatatagatatgagaaacttaaagagcaaaaaccatgtgcttaatgtggcagtgccatttcgtagtacaacaatatcccttttgtcgggttttccttttttccatttttaaggagatgggcaaggaacagtaagtgaacttgggatgtaagaactgagaaatcatgaataaggaaattagtaggtacacacttgcacaaaggaaacattgtttgctgatataccttcagtaaaattggaactagagagtaaaacatgaacattgcgactgcaaacccaataaacggtaccacctgagaagtggcaagaaagtaatattaggtgtgtttggtgtcacaaaaacagataaagccaatgtcacaatgaggggatttttagaaggaaaataaaagagggaggacttacagcaccaacactccattgtatagattttatctcattgcgttcaaatatgcttctgcataagcaaataaagaaaaaaaaagctcacaaactttttgaatgaataaaaacacgttgcgggaggtaaaaaggctacagtacaattttaacaaactagcaacaaactcttctggaaacaagagaattctaaagaactgcctaaagcacattggttcgcctacttaatccccttaagtatgggtattcacccctcaaaggttttaaaactggttgaaataaccacttggaatggttttgtagtgattttactgtgtacaagatgacgtggcaggcacaatagggcatattactcaagccaacccaaccgctctttttctctctccaatcagcaggcccaagaatcacttataagcactaatgtgcttcttttccaaacgtcccaagaattaaaaaatatttagctgaatacatcaccatgtcacagtgtccacgtaagccaaccacttataaaaccactaccggcagttatttgaactggttttcatatttttgagggtagaatacttagtttcatacttgaggggttaagcaggacaaccacaacattttagggggttaactttgatatttgcttaaaaattctatgataataagcttatgaaacaaaaaatgtttaaacatggttaaaacaaaggatcattttacatctgacaagcactgatgatagctccaaatagtcccagcatccccatcaactcaactcgatcaccgactttcacaaggaactcctgaaatgcaaaagataaatatattgagggatttggtctcttagtgaagctagttttacaccttacaccacaaagcttgcacttattaagcccgaaggatgagaaacatatggaaacaggtgatacgtgagagtcattttcaccatttctttggattagtcttttttgacaataaagaagtgaaatatgaatagcttttggcacagactattaacaaagtttttttaatatgtattaaaaataatatctcaaaataatgtgtttcctgtgcagttgagatcaatgctttacctcactaacgttactgatggcataaagagtagcaccagcaattacaagtatatcacctttaactgggcttgtaccccctgcatagaacaacatgaccatgaacatttcagttgtacttcatttaggatttaactggtcataaagatgacttccaaaattccacgcaaaacttaaattattctccacatattcgtcaagcatgactggagtactgtatttttttaaaaaaaaatccattaatctagcaacatattaaactgtggaatagtctttactccttacttcagaaaacagactagttatttttgctaatgtgaactcaaggttcattttgttaccataattataaatggtctgcaatacaaaaggttttattgcacttttttgtggtaagtgaagaagaaatgaaacaacaaagacatatataaatactaatcaccgaactattacctgccctatcacctgcatggacatcagaaaatacaactagcacaagtcctgagacacaaatcgccacaccactatattttctgaatctgtagttggtcttcaaaaacatccatgtaaggaatatcacagcaggaatagcccagcaatcaagaagcataacgcttgtcagagatgtgtactggtaagccttgacaactagaaaagaatagagggagttagtataacattgtaacaccatctgtctattcagtagacaggaaggactgtcttgttatttcagcatagatgaccaggaacttttggtcaacacgctgctgaattatccaacaaataaccaacaaagtattgcacatacctagataatttgcctctacatcgaccaaggctagtactaagtagtagtaccatttcatctgcaagagttagttcatgcataaatcagttccacagtagaatacaaattgaaatactacagcatcagtaggaaattatataaagttatggatattacgttccacaaaatatatgtaattgcttatttaaaattttgagaacagtttatgtacaaatagatgtatttttcaaaaggaagcaaactgttgttacaagtgaatagagcagtaacactaaggcactaggcacgtgtgcttttgaagttataaacgctaatttaactaaataacaataaccccctccgttttaaaatgtttttaaatgcatgatgctgttggcttttgaacattacgtttaaccaattttcttattcaaaactttagtaccttatcttatcttatccttcttatatagtgaaagcagcaagctttcttgcacgaggatgtgccacatcatcagaaatattttagccgtcggataaagagttcggataaataatggtcattggattgaaagagtgcatgtattaaaaaaaatcacaaatgggctaaacatatggaaatttacggaggtttttggtatctattgccctagctaagtatagatactttgtaaacaaattaacttatatcaaaaccttattaagagctaaggtaaattaatagaccatatataaaagttcttaaacaggatcaaaagtcgcgctttggctagtaaatatgaaaaaaaatataagtagtatcttcaatgacaaaacaagtcacaacaaaataaataatatttacatagtttattttttccaataagacgagtgatcaaacataaaatccaaaatccaacagcatcatatattttaaaacagaggtactgctgaaccaaaataagtagtatctaaaatgacaaaacaagtcacaacaaaataaatgatatttacatagtttattttttccaataagacgaatggtcaaacatcatatccaaatgccaacagcatcatatattttaaaacagaggtactgctgaaccaaatgaacttgaattcttgatgcccaaacatagatatgcctctggttcactatatacggcactcacgatgggtagctttttggtaaggccattgaccaagtttcactcaaacattttgccaacccaacatttctttaattgccatactccaaagattcggcgattaaacctaaaaattgtgaaattgatatgaaaatgcaaagattgctgaacctgcaaagacttccttctgtatagcagtatgctcccgtacacgaccccaagcagcacgtagttgagcagcgactgtgacgttggcacattgatacctgcaagtgtaaacaagtagcaccaccgttacattgagaattgtgttaattaatttctctgggcgataacacggcaagaaagcttgcgaacggcacgcaagatcagcctgtacattgactgattgacagcagaagagagcagttccaacaagcaagtgattaaggaaaactacaaccaccaaaatagcagaaaaagggagaagaaacattgcgtgatcgaataaaaatttaaagaaatggccaaggaaatgactgctcaatctccacaaaaatccaccaaaaaaaaacagagagagaagaaattgaactgcagtgaagtagtctgaaaaggatcagaagaagaacacacgcctctagaaaaagaaagaagcagagaatcggaaaagaaaaggaaaacaatagagcagatagaagaagatgaatcgcggaaagaatcagagcaaagaaagaaacagcgattggggggcaaggcaacggggcggacctcggcgggagagctcggaggaggcgaagccggtggcggtgacgaggagggagacgagttggcccagccccagcccgaccagggtcttccgggaccgccaccacccgccgccaaccgaccgcgccattgctccgccgccgccgccgccgccgccgcgagcagagcaggcgaggaagaggagggagagtgggggcgtggactcgtctggttcggttacaatttgtagccagcggtgaattgcagtaacatccctattgttttccgatatttttcactctgattcaggggttgttgtgtaactttgttttttttttaagtaaattgcatcggcggtacaccaacttatcaggtgggtgtaatctagtacataaacttgtaaaacgctcgttttggtgcacgaacttgtttggtgcgtgcgaacaagattaaaatcgcattgcaaggttaatcttattaattctgttgttgatttaaactctatgtaaacattagtctaagaaggataaacatataataaggcataatgattgcataaaaaataaaaatatgagtaatgatgcaagggacaaacaaagaaagataaagtggattctaagtttacaaatataacatttctactatgtacatgcaagtcatctactaatttgtaatttataatgttgaacatagaaaaatcggacttgtcgcgccattttagtcttagtttgcacgtaccaaacaaattcatgtatcaaaacgagcattttataaattcatacactaaatcgcacacacctgataagtttatgtaccgctaatacaatttactctctttttttctagtaaagtttttgttccatactgtgaaagatgatgttgttttgtcatgagtcaaatttctctaagaatgcgtttgtttctccggttggaggaagctactccctgtttttcgttagcacgattttttaaatattaaaagttttctatatagaagttgttttaaaaattaaataaatctatatttcaagtttgtaatagacaatactcaattaatacatactaatggattatctcgttttacatgctataaaaattttcagccaaaatgctttctctgaaatgcggcctaagtgtgaccaactttataaaagagttgaatcaacacgtataatattaaattaatttcattaaacttcatcataaattatatcttcatattttatttattggtattgttgatgataattattttttctatgaacttgatgaaagttagaaaattttgacttgcaacaaaactaaaacatcttatgatatgagagagaaagtactcgcaaaccttcatgaactccttaaaaatattaaaacataaagatataactaagtactcataaaaatttactcaaaataaaagcgcacaacaaataattaacaagaaataagtattgaaatggccatttggatatactccatatcaaaggtacatgaatacaaggagagaaaaatatccaaaataattttttgcatgatgctgaacaatactttaaatttcctatagattaaggtcccctttaatccctttgatttgtagaaaaaatataggaaatttggaagatttcaatcttatacaacaaaatttctatgaagacctttgaaacaaatgattaaatcctttcatttactttggaatggacatcccgatagagattttggagaaaatttatgaaaggcttcaacctcttgaaaaaatttctttgatccgattcctatgtttttagtgtgttatgcacttatatttctatcaaaatcctttttttttctatccttcctttttttttcaatgctatctttcaaaggagccctaataagtcatgtatgaattttatacgattcaaagaagcccaatcctttatttcatatgattatttatgaaaattcctatagtatatatttctatataaaacctcttcacagttcaaaaggaggtctacctcttgatttcactagggcacattataattttatagttagtttcttaaaacaaatagtttgatatcacaatatctgaagcagaaaactcaagtgttccgacaaagcctaaattggcaataatagtgatgtacttcacaaatttcatgattcatatacaaatctgctaatttgtttgtatgcctgagttcatttggcgttaccaactcgctgatacactctcctatggattgttgctaccgtgtgttgacgaaaaaaatcaaacacaccggcatgggagatctgcttagctcctgtgcaagtccaaatcttgatgagatgcgggcatgccagtcagtttgatcctgcaactgacaagatatgcaaacaacagataaaacggccgattggctgataagccgatggagtagttccagccgataactgataatagccgatgccgataccagccgatagcgatagggtttaagcaatcggctgatataaaggcaatcggctgatgatgatgtaatgaaataacaatataatccagtagaaaccaatcggctagaaacaagatataataagcactgatctgaaggttaaagcatacatcggctagaggtccgatgtcattaaatccacaggattagataaacaatgaaacctttgttgcgatcggctaagtccaacttatatgtaatctctataagccgatgcaacatccagataacttatcggctagcactccgataaaacatcagcatgaacctatcggcttaacaagacttatattatcaacaacaatctagtaggtcgaacctaaccgatgcagcacgagattgtatatgataatctaatactcgatgagccgatagatctgtctaatatgatggatataacaaatctatttataacagcattgtgattgtagagatatatcggctaagatagaagatcggacctaactgagacagtcccaactaaaccgatgcgtctctaaacacaatgcaactagagatagaattgaaatattaggtaggcaaatatatcaaccaaaccagagcgatccaagagatcgaatcgatgcagccttgaataacaccaacgtagccgataaattcaccagggccggcggaacgtaggacttaccccttcgccagagatcgaaagccgatgcagcccagcgtcaggtgccaaattccgccggttgataaagaaaaatctcaggaaagagggtggcgatgcgccgagaatagttacattgatcgagagattgataaattacatagaccctgggtgtacatatttatacacatgggttgatacaagtccttgtcggacaagaaagaaactatcctaaagataaaaggaaaacataaagtccttatcggacactaaacatactttcctaaagataaaagggaactaacaaactattcctaattaatagataacttgccatgccgcatccttcttgaactcggtctcttctagataagcttccttgaatagatcaatt

SEQ ID NO: 52646 - DNA, 21208 bp, Oryza sativa
tgctccattttcgtgcgggcacttagtgttgggaaccaggggttccgaacacaccctaaattcgtttatggtttctatggttttgactttgtcaggtaaagtcatacacacacagaaactacattaagtcacattgttataacttatgttgcaatgtaacccccatagcctgagtttctgttcctttggtatgtgtaactaagttctaactcataccaatgtcgcttctcttaatacatatttcctccgtccctaaaagagtattattgacgggctatacctgacaacggtattttttttaaatataggggacgttaataccaggatatacgcgagatagcggtaaagtagatgggagacagtgatttttatacttgttcaggcccctgaggtgggtaatatccttaatccaaattatatgaatggctcttaaatgtatctcacatcaattacaatgggggagaaagctagctaatctagcctaccaactagtattcgtcgagaactaatccgatgacttaagagtcagtgactagctattggcttcatcctagcttgtattcgatgtggtttgtggctatggatcatgattcgatgccctcttcctgagggctatatatttatacgtgtaggcaatttcttgtccaagtagaaatcgaacagttcatgtaggatacgagcatatatgacattgccttccctaggccgaaagcacttcctcctgcactcctgatggtggttgtgggtggttaccgacaaacaaacatcataagcaatcgtcatcaggtgctattaaaggaggagagcttcttcacttgcaacacacatttcaaggagtaattctctcatttcatacgttatattctctctattagtagtggagtttggcttataaatagtcttcagtcctatggtcttctctgagattccggtacgtttttagtactttacttttcttgtaagataatagttgcaataattgaattatcttctttattatattgtgttcatagttcattaattatgtgctctatgaatatattatacttcatttatatgcttcacacgactaagctagtcaatctatgctacagtaatggtttaatgatcttaatggattgcactagttctaacttatccatgcgaagggtgggagtctcgggggaattagtgacattatttattaatataagcatggtgattaggttaggtaaatgttgttggatgtgggtatgccttatgaaaagtgaggtaggtggcaagtagtgacagctctgtccgtcttttgtattcctccatgtccgggtattacgtaagagttcatacaatgacataactatattggcataccagcactgagtggtctctcgatagtacctgggtgcctagaactaagtcctagccttaagtatgtgtgtgctaaatgtaaacaaacattacaaatatagacatacatatgaatcttagctttctatagttcttctccattgcctagtgtatcattattaaagatgaatctcctgtgtgtcatgctatcccattatcatttatgaattaacccatgtcaaaccatggtgaaataattatagtctgattaaggaatatatgaactctatctttacaccgttgttttccctacggaaatataaatacgatatccttggaatactcttgggtaaaatgctacacagtatccgtgcgctcgtgtatttacgtgtgaccataagaaataccaacaaggacattttcaaaaaactaataatttactagatgataccgcaactcttattttattatttccaatccaatgaaaaagagaaaccatgttaaatgatgattttgcctcacgggccagcacatgttattcggcttgtttggtcgaaccaggctttctccccgtctcccctcaaaaaccctagagccgcagtgacaactatattttacaacttgtccaaattctacctcaaaaaccctagagccgcagtaataactacattttgcaacttgtccaaattctaaaccagatcaaaaattttgttttcttccccaaattttcaaactacatatgatgcaactcccaatataccgttgacgctccaagtattgttattatacatcatttctacacattacacattagtacagttgagcgctaggtcagaagcttgtggcctaaggggtattcttgtctttttgaaaactttacctctatattattttagaccaaatagagaggtaaaatttgtctctaagaatggttgtaatatcttgcaacaaattatcagtttttggaagtgttattattcaatagcgacacattaagtgtcatatagcaaaatttaccttattaatgcggagaaaaagaggaggagagaatactactggttgagtggctaaaaagatctactgcatcactctaaactacgttgttttgtggacagattttaggctaaaaccacgctagtatatggaaatgcatttgtccattatttatctaagatacataaattgattgccctacttgatttatgtatgtagttgacttcgctttggatgggttctgtaacggtggtacctaaatacagctgtcaactaaccatgtgactacgtagcaggatgcaagcgggcctacctgcgagtctacttatagatcaaataagtggtaacccgtgggttttcgcgtcgtggtccggcttgctgcaagatataaatatgttaactcataaacttatttatagatcaaattaataggtaactcacgggtcaatccgcgacttaccactaattttacctatatacaggttcacgggttagcctacttacatttcttctatgttggctcgagcttgaaatgctctcgagcctcggctttgttgacaaccttatacctaagtatgtatataagtgagttggagcatctccaagacagataacaaaaattataaacaatggattaggaaaaaaaaagtaggcccaaaaacctttctcatcttcaagagaggcaaaaggaaatttagatccaaaattagtttatggggcacgtaggcaaacatggtgggaccggtagttatcatttttctttcgttggtgtgatctttttctttttctgttttcttgtacacagccgatcaattttcccctcaatttcaccaattggaagtgaagcgccggttggaaatatgatcataaatcggtatattttaatccaaaatattaagataataaacataacttgcacagtgtgaaatgatctagtgataaaactaaaactaaacataaccatgagtatgcttaaggtaaaataagtatcaactataagacaacgcaataacattgcgactaacatatttaaccgaatgaaaggtagcagaaggatgttataccctgtgaaagtctctctgctggattatgaggcagaattgtctccgttggtgttgtcgatcggtgcgccacctcctgctcctggcgcaccacctcctgctgcaccggaaacgccaccaccagtagacatcgcgatgcagtgcctccgttggtgttatcgatcggcgcgccacctcctgctcctggcgcaccacttcctgccacaccggaaacgccaccaccagtagacatcgtgatgcagaacatagacgaagaaaacgagcggagcaatcgtgcggaagcactccccaaaaacacagaggaagatgaaccaagcggtggaaagaatgcacggaggaggattcgcttccgttaccgcagtaacgacgcaatcaatgagtattgaatcgcctgcccgtgcccgttacagaggtaatctcgtggagttgaattctgaaccgatgcaaaaggagagagagacgagacgccacaccacggctcggcgcgcgcgcggggctttccgatccccatctcaaccggtcaatatggagcctccaataactccctatttaagttgagttactccacttttaattcccaaggtggtattattatctttaatatttattatgggcccttgagatttaatagaaataaatcgggcctaacccatttattctaacagcgcctattacatgctatagatttacgagcatatttaagtacagtatggtttttttgaaaaaatatatcagtttcttataatagtattttaaattaactttcaactttgtagtatttaattcatttatttgtgcccacaaaatgtattaattaaaaagtcagatgatcagataaaaagactacacaccgagtcaattcaggttgaagaattagtgcttaaggactacctttaaccgcctttgagcttttgaaatatgacccttttttgctggaaagcacagtgagcatgacacgagagatgctcggcgaagggagaacaaaacctttgttcaaaaccattttcggtaggattccatagtagaggattttctctaatctcttactcttcttacaagaagacgggttttaaaaagaagaggctattcgcttatacgatacctttttttcttacaaaactttcatttggtatgccgtgactaaatatagattttattttcttttagaaacacagacattcacaacgtgttacgctcatcactgtgaacatgtgcatgtacatgtacctaccctcaagagtaacttcggaagactgagttggtaacttgagattgataaagtctgatatatatctcgctgtggatgaatatctagttgatcaaatgattgtgaactttgtttgtgttatggagtataagatttttattaaaagttcatgtagcagttctctttttttaaaaaaaaatgcgacatacatattgtcctttcttcttgtcctaaaatagaaactccattagtgtttgtgaatactccggatgccagttatacctgatcgatgttgattaaagttttgaccgtttcattataagcacaaaataccgtaactgtagaatattagtattttagttttctttatgagaaaattaagctgtcctaaacacttagaactttcaaacaccatcgatcaaagcttgttaattgagtcaagataaataaatcatcaagaaagcaaagtattagggcaatccaacccaaaaaatagagtaaattgcatcgccggtgtatcaacttggcatgtgggtgcaaaatagtgcaagaacttgagaaatgagcaatctagtgtaacaacttggtagataggtgtaatttagtataaaaattttataagtgatcacataaatgcaccaacttgcaaggtaggtacgattttgatacaataattaagaagttatgtggcaacttaattatttgaagcttatttatatttttatcatagtaactagtaactgaatttcaattaaactgaatgtagaaattattatatttggttgatatttgagaaggtgaagaaaacaaaaaattcttaaaaggtaattgtgtcgacggtgggtacccgtagaccggatatagagggtattggggtacactggtacgaggatctacgtagtacgacatcaaggaaacaagagacaaagattatactggttcaggccccttagcaggtaatagccctaatccagttgatgtgggattatattgagagaaccacagattacaaagggaataatagaactcggtggtaccgacgagatcgtagtcgagttgattcgactagatcacccggcgacttggctcctgtagtctccggcttcgtaggctgtggtcgttgtgtaggctatgagattcgatcccctaagttccctcggggggttccttttatatcgctggtcaggcggtctccaggtaggaactcggagacatcagaccctgtacgatatagtaacgacccagtcctacacgggtaggaacctttccattggtagactccgtgatggatttccttagcgtgtccagataacgtccgtatatgcaccgctatatcgtatttccgtatagcatacatccaagggtagagggtataccttatccgtaaccctgacaaattggatgtaaattatatgtgcagtataatttttaaagattaaattcaatattataaggtaatatccgtaggattactatgtaatggcgtattgacatcgtgaaaaaaaatcacctagcgtatgcttagccaaattaatgcaccaaaattctaaattatcaagttcttatactagaacgcacctatttgtcaagttgttgcactcggacgttcaattctcaacttcttatactatatcgcacccacttgtaaagttggtgtaccatgagtgcaatttactccaaaaaatattataattttcatacttgccatatcatatagatattatgcatgagaactatttgcccaatgggtggtttattcaaaataaattctcgtccaatcaccttcttctctctccttttacccacctatcctttattttcatttttcgtttacgtgtagagcagtttttttcctaagaattagtttcctcatatttttccctctctcttcattaactctcttgccatctttgctctttacttatgtggcagtgtaattagggtgaataagtatagtttcttatacaatacaagattatttagagatcgtatctttacaacagtaagatgacaaaagctctaaccattacctcaaaaaatattcttttgattctattctttccattttttcccctcatgcagccatgctttcatattatagaggctaagagttattgttacccgcaacaatgatgttttatctattctctttctctctattttatgtcaacaagcatttttaattaggaaagctaagacattgttataaataatcattgtacatgtccttaatgctatagaaattagctaaggtggagggttaagagtgcccttaacagttacgtgtccccgagaaatagaaagttagaaacgatcacgttgttcttctatcaagttctgttcatttttctctttaggaaaaagaaactgagtgctgtaactttgtttttgggtagaaatgatgcggtcggggaatcaacggctgccgtgagcgaatagcctcaaaacattgtcgtccgtccgccgcggcgggccctacgcgctgaactccctaaaggcatcgcgtccggcgagtagcggcgctgaccagatcagccgagtgcctgcctaatgtggctgtctatgtggccgaattttgattattgtgtctctgactctatcgttttttatttttcgggtggtgagtgtgttcgctagcaggagttaccaactccccccccccccccctctcctttttctccttttccgtgtgcacgcttttcaaactacttattttttaaaaaaatacttccttcgtttcatattataagactttctagcattacacacattcatatatatgctaatgaatctagacatatatgtgtgcctagattcattaacatctatatgaatacgagcaatgctagaaaatcttataacctgaaacagaggtagtagctaatacttaattaatcacgcgttaatggactactccgtttttcgtacgtgggtgatgggttcccaacacccacaccgaacacagccaaataacacgctgttaacgacgaaatttggtaagcccaaagtcatcatcggcttagagtcagtatcggcttcagagttatggaattagccgatgggagtcatcaaatcgccagcaaccgtgttcttgatggagtcggatcaactaaagggaatttatccagaagagtccgagttcaagaaggatgtggcatgtcagtttatctattaattaggaatagtttattagtttcctttatctttaggaaggtgtgtttagtgtccgatagggactttatgttttccttttatctttaggaaagtttctttcttgtccgacaaggacttgtatcaacccacaggtataaatatgtacactcgtggtctatgtaatttatcttcacgatcaatacaattcggcgcatcgccaccttttatcttttctactttattttatcgtccgacgggacttggcacctgacatggggctgcatcggtgttcgatctctggctaaggggtaagtccaatgatccgccggcccaggcaattgtatcatttacgttgacgtcgttcaaggctgcatcagtacattcgacctcttggattgctctggtttggatgatatatttgcctacctatttatcatatgtctctgttaatctagtcttagcatatcaatttagctttatcggctgcttctcgttttaggatttctgccggtatcgactaaatcgcgttgctagattagattagcttagacatctaccactctgaaaactcagtcaacggcttgattatctagatattatgtttcttttcatatttagtgctgcatcagttaagtttgatctactaagtcgtgcttagaaccataatctctagcctgcttcttgattgccaataagggtttcatcggggtttcagccggtgagttatctcgacgttgcatcggctcataaggattacatatacatataagttggatttagccgatgacaataaaggtttcactgtttaatctaatcttgtggattttatgacatcggacatccagccgatttgtgctttaaccttcggatcgatgcttatttatcatatcattatttgccgattggtttatactggattatattgttattttattacatcatcatcatcatccgattgcctttatatcattatctacattggacatatagccgattgcttgaaccctatcgctatcggctggtattggcatcggctattatcggttatcggcttgaactactccatcggcttgtcagccaatcggctgttttgatatactatttgcatatcttgtcagttgcaggatcaaactaactagcacgtccgcatctcatcaagatttgggcctacacaggagctaagcaaatctcccaggccggtgtgttcgatttttttcgtcaacacacgccgttgctcaaactggcttcagtcgacagaggagccgtcggatgaaattagggctactaaaatagctcgaggctacctcaaaatcaacattggtagctaaacgtaagaatgtcataagagattcaagcaggatgacgatagcgatgtatgatactccctccgtttcatcttataagatattttgactttggttaaagtcaaattgtttgaagtttgactaagtttatagtaaaatataatactccctccatctacttttgatagtcatatttccaaatctgaaaattttatttttgataggcatatttcaatccaacaacttatcatcttaatgactttcttggatttaatgcatgactcttcgttcttccacacatgattggctacatgggcattgagaaatgtaaatattaatgaatcgcttatttacgaggaatgactagtagcatatttaaatggatgataagtagaattacttatccttggtctatgtgccaagataaaatatgactatcaaaagtagatggagggagtaatatttacattaccaaattagttttattaaattaataattaattatatttttataataagtttatcttgggttgacaatattacacttggttaaacttaaagtagtttgactttgaccaaagtcaaaacatcttataacctgaaaaggagggagtatttactaacgaaatttagtcgaaacctacatctgcaaggtactaattatgagtgctcctcccggatcctgaataattataatgtatcagagttataaacgaccctcggtcggacgacgttggcaaccgctacctttcgcctatactaaattaccatgcggttataacaggtatgcctctctatttaagggagggtctaggggcctatttgagagagcttaagattctgagaagcagctggttggaagccagcttctaagaatctggaaaagctgggtttctcagcttcatctcaaaatgtttctcgacagttgtcgatggtttccttgaaaatgttcaaatcagctactcatcacaaatcccgttttgaaaagcagtgagaacgatctcatccttactttcaggatcatgttgcgtgcctccgagaaacactaggggtatgtttagttcacgttaaaattagtaaactaaaagtttaattgaaattgaaacaatgtgacggaaaagttgaaatttatgtatatagaaaagttttgatgtgatgaaaattaaaagtttgaagaaaaattttggaactgaactcggccctgatgtagtccttcaatgactcgttttttcgttgttgaatgagaacctgacctgacgagacgtaaatgccttggaagttggcaatgaaccgctcccgaacctcgcccccggaacgaaatggattcccgcggaagccccgaaagccagctccctgcagagtcggcgagtgccacaggaaggcagtttgcccaagttgagtacacgtgatttgcgaccgaggatgtggtttaacgaagagaatagggaggttaaatagacttacgttttttttggtttcagctggtccactagtcggccgatccaagaccaagctagagaaaaagcccatacttggcccatgactccttgcaccatagtcgcaatcacccacccctcggactcgactcccggagttggcccgccgccgccgccgccgccgcctcgcctgcgtcgatctccatcccgcgaccggagctccacctgtgccggcgtctgctgcttccaccgcatcctcgctagcctgccccgccggtgagcatccatccatccgttccgcacaaaaatcctccttctcatctctttctgctcgattttgagttagccctagcagcttgtcttccaggagtagatctggaagctgcttctctcgttgccttatgccttagctctagtactaatacccagtttagtttgttcccaagaaaatttggtctaggtccacccatgccaatttaggcttcactgcttgcagatacatatagtattgatcgttggttgcaaatcacatgctccagcgagaggaagcaacgatggcagttgcattagcttcatttcgcgcttttactctttgtcctatttttgaacggttttcctcctattttttcagtgaaactggacaagaatggagaacatgcagtatgctgaagaactagtcaaggaatttcttgtgttcagaggcttcacgagtactctgcaatcgtacgagtcggaattgtctaccgagatcgggaggaactttcaagtagacaagatcctagatttggttttctcggtgtatataccaaagtaccaattggataggttgcaaggtctgtttaccttttttaagcagtgcttcacttcacctgcggatgcggagcttttctcggctctcattaaattggagctgtcggtgttacggtattatgttgtcaatgcattgaaatctggaagacaagacaaagtagttgaattcttcggtgctaatggcaattatctgctgcagaagcgtgaagactggcaagcatggtttggtgcgtattcttagttccttttgctatattccatcaagtgtcaacctcattcttatcttcttgttcttaattgtgatacacagctatgccatatatcacgagcccaagcttggatccacaattccgtgtatatttctccaaagaatggtcggacactttgattctttcattccgaaattttttgagcgggatatttaatggtcttcatatccttgaacaacatgttatttgttttattcttctattcttcctcaagttggtagtaaacatgtttgctttctataatatgcaagaactccctaaatgggatacaacataagtgcataacacctttatccacattctagttgatcatcaagtaaattgtattgtatgtttgttaatgtgattgttacctatatttgggttaacaaacatattatgttttgctcaacaatgttttctccttaatttttccacgaattccagctcttctcaaaattagcactgaaaagaataccattaaatgcctaaagaacgacataaagcaactgaataacaaattatcagagctacaagcattgttagagatgaaggagactgaaatatctcagttgagaaggtaaatctatgctctttatacattacactgcagcataactaatctgtttgcacatgcatgcgtagcttttgtggagattggatgaaactaggaaaattatgttcactaattaatctaacagtaccttcatttcttattacgttcagtatccagttaatgtaaagcatgaagtaaaatatgatttctaacctccacccacatacatacacagcctcacactcggaaactagaaactgctgtgtttcatttgttttcatgccctcgcttgccttaccaagttagtttcgcagtggctgaacagttcaaactcgatattcaagcgtcaagcatttagattcagagcacttcaaactcatttcttggatttcacataaatgtcaacattacgctaccttctgcccaaaggaatttatgtctcaattgataaatacaggaatagtactggtgttgatttgggcaacatgaatgttcccaacactagtgcagctgactcttctcttgaaggacaagatatgccaggagttttcgaagaatcctcagcttcgagaagcgctgcacagggttttgattcacagtcttcgagctcagtgaaatcttctacaagagatgagaaattgcacaaatcttttcaaataagcaatgcaggttacgtcttagttctatattctttcaatggcacatataagtctctttaccattggttatgcaaaatgagcaatgttctgttgttatttcacttacaccaaaacttactcccattttcataatcctttctgatgcccttatggtttggattgttttttttgcattatccaaaaatattgccacactttaatattcttcagtactttggatgcctttattcatatttacaatactaaatttattcttacatgtggcaacactgaagcatcacatgtttctttgttgcagagaacgagcagattttggtgacagaggatgactttccagaagtgaaagtggattttcaggtaacaataatcaattcctagtagtatatcatcctttttaattccctatatgactaatcaaacctgctaacaggaaacatttttaggccataacagttcaattagctgctgtcgattttctgcatctggatcaaatgttgcaagttcttccgttgatggtacagtgaggtaattgtgccatctccattttcctttggttgcctaactgatgtttctagattttgatccattggttttacaattcttaaaaagaatctggacatatgattcctcaacaccatcatccaaaaatgccactatatactgtgggtctgaagtcagtgctctttcttgggaatgcagatctgaccgcttggtatgtgatgtctatattggattttttttgttatatcattttttacagcatttgacctttgaaaaaacatatttaagacatttcattttatcacccatttctcttgacaatagctgctcataggcacagctaatggtggcattaaagcttggaatgctgatgcaaagagagttgtttgcgacctcagtacatcaaaagactttcccaggttacaactgttactttcttgcttatcacttaagtttatgctaatggagcttcttgatctcttgcagtgtgttagatttgaagtgtagccctgtagaacctgtgtttgtctctgcagctgcatctagacggtactttttgaatccttattttcataagaaatccatttccagttatttcaaattgatagcttccttttcctacaatagcagggaccactgcatttctgttttgtgacaaaagctttggttatattttcattgtacatgccatttaactttataaaagcttttatcatgttgtatcttctagatttcctacaccactgtatgattaaaatctaagtggcatttgcattattttgagcttggaattactttcaggcctggatcaactatatttgacagaacaggatttgcttccttgactgtatggcatatgaaaacatggaaacctctggtacttctattgcttatccccttgtcttaaacctatgtgtggattcggctagtaagctcttcctccatgataatatctttttcttctattatgaagacagttctaccacttggggaggacccacctgctattacttcagtttgcttcaatcataatggaaaaatcttgcagcttctgcaacagatgggatgattcacatgtttggtatccttttttattttaattattttattaatagtcattcagcatcatacgtatatattaagttatttgcttttgatctggaatatggtatcactacctggtgcattgtttgtatgagatcccatatcaatagtttacttaactgcacaaagacatgtctgctggtcttcagatcactggatggcctgcccatgattcccctgtcagctctgttcttttcgggcctgctgaaactagtatatttagtttgggctcagatggaaaggtatgtagccccttttagtaatcacgttgattctaacattgtatagcactgtggtacgttcttatgaaggactggactctttggttataaaaacaattttcttattttttcaatacttaatcagtgtaagaaaattaactgctctagcgtttgttaaggttaatgttgacgtcacaagtccatgaattcattttttacttgtacaattatttcttttgttatttttcatagtcccattattttatctaatgttaactatatggttcttagatatttgagtggagcctgcacaatcaaggccagattctttggtcaagagattgcagtaggtaagaatatgtggcacttggtataaatcattgctgattctcaaatggcaactaatgctaataaggtttactcattaggggctattagaattggtacaaatatttttcaaacttgatatgattcagggagttgtgggggttgagattttataaattaaacgtgtttactgtagccactctagaatcctggcaagatctctatgctaatctattcattctctctgttctcttgagcaaccaattattgcattattgcttggcacatggacatcacaccatttctttaaatttgtgtggaggaaacccagtagtcccagaagtatttgtggacatattttggtttaattgcttgaaactctcatatactggtgatgaatttagatatagtttagatacagcgtgtggataattaagattgtcccttttttatagtaatcttgagatctccacttgaatacaaagattctaatatctgatatgatggtaaatttcttgatactggatgaaaatttggaagtttatcacattgtatgttttatcagttaagagagttgtatttgtctacgcaatatacattattatttggaaagaaacattgtttacacatcagattgagctgcattttatcaatcctgattggagatgctgtatttaacggactgcaaacacagtatattttgcaaagtgaacttatcagaccatttcctcatttttcctaattgcatttctatcaccaggttttgcagtccagagagctttagcaaacgcatgcatgagatatcattggattctgatggcaagaggctgttggttacatcgggtcttgtccgggctcctatatatcaggtctccacaatcacccaaacttccaggttcattttgcagaagtgataccaatgcaaatcatctataatttttcctcaggtacaaggccatgaaagtgggctgaggacacttgctcatagtgcatctattacaagtgtggattggcacccgacgctaccaatgtacattactgggtctgcagacaactctgtccgggtcacatccattgtatgaatcaatctgtgagtgtgacaggcagattgctctcgaggccttgttgatttctcgatgcaaccacatacgccattccatgaggtgaccagtggtgcgccaaatgattatccattttcctaaataggcctggcctctgggtttcaaatccccaatacgtgcttcttttcctaccatataccgactcagttgtcatgtccagattagtggcctttggttcaggatacatttttgcgttgaaggtgtcctgcgatggtgagcttctataacctttttgctgtagaactgcatgagttatgcaatctttacaacagggtttgggaattaaaatcgtagcagcaggtttcgtcctaaagcaaaacagttttgtaatccttgtaacggcagctggtgatgaacagtatcagtgtgtgtggtgtcagccatttgtttattgcaacaacattgtagcctagcatttgaaccaaacaagtacagggcccaagtattactacatttgttgcatcgacatgagcattgtttgtgtggttgggaccaaattgacctctaaaaaggtgtcctgttcttccctgctgcttttattgtgtgtaaaactatatatctcaacattgtgagtttatatacatgaatgcgtgtagtctccatgtgggccaatggttatctctaacatgcggagatatcctgtctgaataaatcagaaccacaggttgctgctctatcctttgttccttttggcctgttaagattgaaactgaggtggatagtcaaacattacgagaagcaatactactcataagacgttttgactccagtaaaagttaaactactctaagtttgactaattttatagaaaaaaatagtaatatttttaaccaaagacaaatatattatgaaaatttattcaattatagatttaatgaaattatgctggtgttgtaaatattactacttttttttctacagagttagtcaaatttagagtagtttgactttgactaaagttaaaacgtcttgtaacctgaaacggagggagtatttcggtggattgaaattctgcaattggacccataacctgcactattgaagttagctacccaaaattccttacattatggagggagtaatgtcgaggcccttttctgtattggctctacggtcctttcggtgttttcagcctatgcaacttatatactccatccatttgaccaagcttgtttaaaaaagtagtaacatttttaacccaagacaaatatattatgaaatatattcaattatagatttaataaacttacttggtgaagtcaaacgacttcaagtttgatcaagtttgtagataaatgtagtaatatttgcaacactaaataagttcattaaatctataattgaatatatttcataatatatttgtcttgagttaaaaatattactactttttttaacaagcttggtcaaattagagtagtttgactttgaccaaagtccaaaacaacttctaatctgaaacggagggagtagaatatcaaggcaccgtgttaatttcaattcggagtttcggggtgtggcaccatgttaaactagttgatgcccgcgctttactgcgggatatgtggatgaatgtatattatacattataaaaaatgatagacgtatatatgtttagataatgtgaagatggtgatttaacattgcttgcgtgataagttcaaacaaaattttttcgtcaaaaaaagttcaaactaaattacaaatgatatatcatgttggcatgaaatctagaatactctgtataataattgctagtgagtgatgatatggcacacttgcatgttaaactttaaaagttagtgggtatcagctatatataaagtatagttgtctttggtataagagcaggtacaataagatccttttgccggtgacaacggctccacgttggttttgattgtgcgctggaggagaagaacgcgtcagcgagcgactaattagtcaccgagctatatgcgtgttccgagaaattgtgggcccaagcatatgagagttgcgggagccgggaggataggatgatcgatgcagcatcacgatcatgcggaatacaattaatatatgatgcattcatgattatagcccatttattgtactatatttgcctcttaagtttgatgaaaatgatgtggaagaaattggagtaagcaatgggctacactattaaacttcctctaagtatgattaacatgttaaatgtgtttgcacacgagacacgactaaccatgtaacgagtaatcttttgacctgtgccacgtcatctcaatctttggcccccctgctctcgcaagctcatgccatggccgccgtcgctgccaccgcgccggcgacctccgtgaccgccgctaccttctcgccatccctcccattgctctctcgctaccaactcccccgcgcccaccgggccgcgtccaccgtggcgttcgccgcgcgccgcttcgcggcgtaaaccctagcagcgaccgcccccgcgggaggcgcgcctccgtcccggccgctcccaccacctccgccgcccgcgacgacggcggcggcggcggcggcatcgatgccctcgaggcggagctctggcgcctccatcgccgggcggagctgcgccttcaccgcctcgccgccgaggccgacgaggcctaccgcgacctccgctactccgcccgcgtcgtcggcggggaccgcgtcgtcctcaccttccgccgctcgtccctgcgcttcgccgccgccgcgctcctctggtcgctcgcgctctccgccgcggcgtgggcgctgctggggtgggccgtccgcgcctggcagcggcggggcctggggtggcgcggaggggaaggcgcggccgtagtgcggaggagggaccgcagcctgggtggcaaggaggtggtggtcgctgtgtcgtcgtccccggtggcggctccagtcagccgtgtgcctgagccggcaagagaggtaagaggagggaaccaaaggcaaggcttccggaatggtggccggattgagagaggaggtggtggtggatcaggggccagggatggaaaagtgggcgagattagcgaatagattggtccgaggtgaatgcctgttttatattagctagtctttcattggatgcaccttggttgaaaattaaatacgcgtaacatatgggaaactgagaacaaatccataattcatttgtggtggtaacatttgggatactgagggtggtgttaacatctttttatttgttatgatcatcactcatgctaagttactaatagatgataacaatgcaaaaactgcaaaaaggttttgttttggatcccattcaattcatcattattaggagcatagtctttgaattttcagaaatatgagaatggatcaggtcatgagagcttgttagtaataacttttccaattgctatgcttcagtaccgattcaagaccaaatcgtggtataatcttcaaaagtcaatctttattgttttatggcatcgagcctaaccaattctaagatttctatcaaaatggaaatgtgaattcttctgctattgtattgtcatatgtgaagtttggcaatagtttgtttttagctactagcttattttttggcattttatagaatataagaacactcatcgttagtatgatgatccaaatagaaaatattcatccttaagatttgttatgatcatttgaataatctcctacaatacctctttcccctgtcttttgaacaaatatggttttatgtggtaggttatacaaaatagtaaatacctaataatcttaccttttttgttggcaggtaatttataccatctttcaccatattcatgagaaacttgctgcttcatttctcagacctttcaatatttccttgtgccagcaatcattgataatagaatcacggggaaggattacaaatatgatgatgcaattcaagttagtattcattttacctgtagtccatagaggatatagtgttatgatatttcatttctgtataatttctatgcttgcaattgagaggcattggcatcctcttcatactatgttctatggattagaaccagactattttaggtcatccatcttatcctgactcttgcgtggatgttgtttgtcatggcagcatgtagttccacttaagcacctattcagccaacaaaatgaattatcttgcttggggcactaacagaaatttgtggacttacctcgtttctgagatcagtgacatatctgaaccatcggaatatgatggctattaatgcaatttattcttgttttgttccctactgttatagaactttcgagctttggagaaagcatcacaaccctgatctgttgtatgaatttatggaatgatacaaatgttaggcattaacatgtcaataaatgaaccctgaatattctagtaatatggtttataggcatgatcttaagatccttggctattctgttctaaatgttgttaaacggatgatttaagatatttttggcagaacactccaaagttatccaatcttaggtgcaccagagatgttatttgaatattgctacagtttatctaatgatagggctttccactcttgcctaattatatctttcttttgaatgtagctaaggcaattatgcaagatatcaggtgtaaaggtctcttttgacacagagaatgctcgtgattctttctatagggcggcaataaactttgttctggatgattgcagcaggtgtatttttgtttttgcttcaacctttgttgctattacctccttttgttttactattgattttattatcatctccattgatctgcactgtgctgataatttctgcttaataaagagcagcacaagacattggagcagcacaaatcatggggagaatccaaggaattttcttgctggtcttgctagcaatattggattggataaattccgtgctgccacacttgtttgtgcatcagttgctgctcgcacacgttctttgttcttgcaatgctgggtacggatttacctcgattttcaaacctgattgtgtttttacccatctcatggtcatgctgatgttatgtgttcaccgcatgcaggcactagagatgcaaggaaaacggtcagaggctctagatgagctctcaaagatttgtagaattcataacatgttccctccagaggaaaattctgtatgtatttggtttttgttttc

SEQ ID NO: 52647 - DNA, 19559 bp, Oryza sativa
  unsure (1)..(19559): unsure at all n locations
agttttttttagggaatgctttaaaaatttaattcaacctgggtactacacagttatctttgttcttactggttatttgtctctagcatgaacttagccttttttttggctagtttcatgatcagttgtgtcataatgttatttccctcagtcatatctgtctacctgagcataactgagcttattttatagagtaaatttcacaaaaccacagggttctataatttttttttaataaaaccccagctgttgaggcatgagtataacaaaacccctatttctgtcagctgtaaacatgggccgtacctctcagcttcacctttttttcctcatccctttctccgttcctttctagcagatcggatctgagcaaacagcaggtggtggtcagcgcatcgctcctcttccttcctccccctccctctcttctgccacctgccactatgcacacttgcccttctccatcactgcaaacatcagcagcaagaaattagccccgacagcaactggtatacagagctagcagctcgtgcaatatgaactcccaaaaaggcaatttatggaatttctccaggaaaaccaacaagaagcgaatcattgagcaatcaaccattatatatgaattagctatcacatttttaggggaattaaatcaactgttgtcatttgcaaggaaaaaaaaatcagttacaaagacaccctcttcctaatcttcagagcagtgaggcaagcaatggagtcattccttgatgcacagcgacagcgaggaggacgagagcagtaaggaagtcatcggcggcgctggcagtagtgctttcttggaatggaggtagagctcacggggcaaattcaccagatagtagtccaacatgagaattgatgggagaggcttgagcttgggcaatctgcagatgccatgtcgttgatgaagctgtccagctcccaatttcctgccgtgcaaccaccctgtgttcgacctcacttcacatgacaccttagctctcaccatgctgccacaggtaggaatggggaagaaagtgggggctttggggctaatgaacagggaccaccaccacctgttagttgacgggaattggtggaagtgggttctgtgttacaatttgccccccagtctgttgtattgtgaaataaaatgtataacctgtggttttgtgatatgtgtgcctcaaaacctgtgatttgtgaaatttactttcagaaagatatatatgcttctgagattgtcattgctattatatgaacagattctaactgaatttttttgagtgaatgagaccattttttgtgctgtatgcatatgcatgcaaataaccttaatataacaaaaaaaacaggttttatatttttcgcaattttcaatgttatttctgcatattatcctcttaatggaaacatatttatgcaactttttgtttctttgtcccctacaggcggaaatggaaatggttgctggtggacttaagaagaatttacaagttgcggaaagggttcatctcttatctctatataggagcatctgtactgctggtaatatcagaactgctgcagaagctcttggcctggtaagtaatagccatgacccatgatttattttggagtagaacaatatatctgctatattatagctcaataaagtgaaaattctacacctgagtgtaaagtgtgctgttgtttgtctgtttagggcaaattaaagctccctgatacaactaattgttatgggtggggagtgggccttcaacgggatgatgaggtctagcctcgccaccctggagccgggttgaggaacagagaagggggaggctagcgatagggtttaatttctttcttgattgattccaattgactgccatgccactccttgtatagagctggctcctaacaaacctccgaacaaccttatctaataaagcctaacaaactaaccaaatgcgtgaggatacataagataagcgacatttatacattaataagcagatgacgtcaggatacataacgccaatacttcaaggaaaaagtttactttgggtcccttaactcttttgaaagtatacctatcaccctcaacttcaaaacttttcttccccgcaataacaaaaaataataataataaaaaaactgtttaagttttgtcctcaattcttaaaccagatcaaacaaacccaccttttaacacacctggttttcaactatgtggcatctgaatacaacaaacatgctcaatcagcaaccgaaagtgaaatggacaataaatgcctataatttccacaccccatttctcctttcccaagttccaacttccaaggcagcaatgcttatgcctgtggacacttccccggtctagggcaaggctccttccagtgggctttgtgggcttctgtgagggaaacggatcctcttgactttggtagcaaactcatagtgtgcagttgggcttcaaatatttgtccactgcatccaacatccatcctgaattgctgcatttttagcttacctaaatatacatccattgtagcaagcaagccaaaagactcattactaagatgacctttgctgttgcttgctacttaatgctatgtacgggaaccaactgcgatactttatactgcaagcagaagtgcagtattgaagtactactaaaatggtaatataacaccatccagtacaaaacaaaggttcatttccataaagtgaaacatccccaaaatgaatatgttttttttaagaaaatgaatatgccattttgagtagttgttttgtacattgctaaaaatataggtacatgctatgctcaagaatttgtgacctcgtttcatgattgatgaataagctacacaattattttgttttaaccggtgccaaaactgagcaatgatttctgttctctctgcaccattgctatgaactttgtcttttccctccatgctgtcatgtgctgtgctgttgggccgaactgggctacacttaggcaagccaagaaagcagcaactcaggacggatgttggatgcagtggacagtgtatttacataagctaaccgcatgccttgactttgctaccgaagtcacgatgttcttccgtttatggtcggttggctaggatgccatatggctaccaccatggcataattgacagaactggagcttattgaccttatgatgttatccaatctgactggatttttttttcttttcgggaagagagactgggtttgatatttggaggatgtagtaaatggtttccaaattggaggtgaaaattagaatatgggatgatctgggctgctaaaagtgaatttattcctattaaaatagtaattatttgaagagaaaattgttactttgccatataagagagtggcatgctcacattttccacagttcattgtcattgctaaaataacacaaaatgtccggtgaaaatttgctctttaacaccatggaatgaaaattttgcaccaatcatctcccctcactcatccattctggccatggctgtggcctagctagccactaccttgtgcgtcaactccagatgctgtcctgtgcaccctagcctccagagcataaactcattcgtcatattcctggtttagcatccaatgtggcaaaggagcaaattcacacttactttgtggcatattagttatatttaagtaactttgtggcaaatgcaagtatgctactcaactatttggctgaagagttcctagggtagttaaagggtatatgaagtatgtagatctgcacatatgttttccagatatatagggtgtgctaaacaatctttggatgaactaaaccagcatagattgatccaattacatatcaagaacaaatagtagcaagagagtgttaaggaatatagagtcctttacatgtatagtactatagtttatctctttacatatttgggcctctttttagttctatatgttgccttagggctattattacaagctatattcataacaaggtatcagagcatctgatccgtgctgcccccaggagattgatctcttgggggtggccccattttcgttttttcctctcgtcgtcgatggctcttcccattattggccgctcatccttgccgccaggtctctgacatcgccgctgtgcttctccaccgtgtatggctgtcgtgcgtcgctgctgtctctgcgtcactttctcatcaaaccagcgtcgctgcttcctccgctggttcctggttttgttgcttccattcctagtttgctgctttgagcagatcgattaggatgtgtagggctgttgtcttctctggttagggtgcacctttttgatctgctgctcctcgccttttggtttgcactgctttacatgtctgtcatctctgctagatcgatcaggataatgaaaaagaaaatccaccttccacgtattttgtcaggctctattcctcgttgcctgatgatttttgatggttccaatttcttttgtttctgctgtgtccacatactcaaatctttttatctttgaattttcttccgttgtgtcctcattctattttctgtttgagttcatatttgccctgtgcgtccacatactcctgtcatctgctgtcttcctccagtgttagccaattttattgtttggttaatctccttgtcgttttttatgcaacaagatcatctaggtctttttgtagctttagtggatcatttttctttgtcatcttgctgctcttcgccgcttttgcttgctgctcttgaccaaggatacttttcattgccattgtcacgactttatcttcggcttcattcgacaggtcttcaaggattcacgcttcgacgacattttacagagttggatgtattagctttatattgtctaagttttagtacttagtgtaatctctttcaattgcaatgctattgcatacgctttgcatttaagggaggatgttaagaaatagagtcctttacatgtatagtttatctctatacatattttggcctcttgtagccctatatatttgcctccttagggctattattcaatacacaagctattcataacagagagtttgcaggagtcaggaggaacagcatctccttatttttttttataggttaatgggcagtcaagctagagttatcaacaatcatgaacttacgctacatatgctctttaattggctcaccagagtcctacctttgctcacaagaatcctattcctgttgttttacttgaacacgtttctctattttctagaagggctatttatctggttgttttttcatgcagagcttaccagatcaatgagaatgcagatgctgctggaggactcattctgtccatatttttctagttccaacttctaattgcgacaactctattcggagtctcgaagccaccaaaaaagattggtagtgggagattttggcatcctcagccatcaggtctccagaagatgctgattcaggagcgaagcaaaccacaggaacagttccaggcggaacatgttgtccccaagaaagaatgataccgacacatcatttgttctccgtggcatccgattttgatacaacattagcttacacatttgacagtttcacaggatgtaagatgttgcattgagcagcttctttttgtaagattttgcagtgcagaagcacaaaggtgcttggtcgtggtacgagatgtttctttaaactcgcagatagtacttgccaagttgccattgtccttcaaggttgaaaattgcgatccattttacagtacggcctgaggggactttctgtccctgtcggtgtcctctctccaggcgataaaggaggtccctctccgtccggcccctttcctttatcaattccggtggttccggttgccggcaatggggaagggggtatagttcttcccgtaccctaattgttttctcttcttctttggtgcttttgtgtagttcatcagcatcgtgtttctcttgtcccagttcttttccatggattctggccaaatccatccatggagtggtctttgggttttgccatgaacgctccccgactggaagtaaagcaagtttgcttcacaaacggttgcgccgggcattttgttcatctccggcgaggcaaccttggatgcaagcctaggagagaagctgagagtttttattgttttacaatggaagcctcaaccttcaagtggaggtctcttttgggtatgcttccttgcactttcatctgtagctactcatagtttcttcatcaccgtcctcgtcatgatcaagcttgcaagttgcaacctagtggaaaagagaaggacttggttgttttttctagtttctttagaagtccatagcaattttcatgagcttatgtcaatttgacaatcttcaaggggcctttatgcaaaactgcttgtacttgcagttgactctccactagggataactcatgtgatatgtacttagttatctataatcaataaaatacatgagttttcaaaacaaaatttacactatggcctgccatgcccacttttgggcgaggtcggaatgtgacgtttgcatgggtgtacttaggggtgaatagcgagctggctcggttcggctcgtttgaaagctcgagctagctcgttaggctcacgagccaaaccatctaggcggccaggcctctcctcttctcagcgggtgcggcgcaggggtggatgcgggcggcgagcgagcggcagttcagcgccgccgcaacctcctccgtcaggcctcaggactctagcacggcggcgagctcggcgccgacgtgctgccgcgcgtcgccgacgggccacacgctccaccctacagccatctcggcggcgatgaggctgtgcaccttggtgagctccgcttcgagctgctcctcctcccagtagcgtgaggcagcggcggcggaggatgaggaggagcttgtcgacggcgccggcgccggcgccgttgccgatcagattcacgccgaaagcaacctcctgagtgcaagccattgcagcaagctacagagagcaaagtgatcgacgagctaagagttcaagaagagtgagctcgctcgatggcttgcttgctgtctagcttgcagtggtggtgagtgcactggatcactgagatggctgcgtatttataggggatatccggcatggttgcggcggccagcgccgtcaaatcttggacgggtagatatgtgctagattgtgggtgaagcgtacgtatccaaaggccaaaaagtttgttctgtgcatcaacttgcctgaagcaaccgcagtgaatctagcttgagtagcagtaaagatttggcaatctttatatacgatttctgggtccaatcccggacctctcattgggccacgtggcacatgcgctgtgctccgttcgtattatcggctggagaagcatgccacgtattcgcacactcccgcaaccgtccgatgacaaatcaatggtgaaaaatatatccaacagacctaaatataaattgcacgagagtttatttttttaaaaaaatgcacgacctcatctagaacagtcgggagcagaggaaaaactcctagaaaaaaaaagcaaaaaaaaaaagagcgagaaaaatccagcgaaaacaacagattgtatattcccctcgcctgatctccatgccgggacgatgacctcgagctcgatgtaccaccggaagaaggccccgcccagccttaatccgctgcattgacccagagcttgccggcccgcatggtgccttgtcgtgcgtcggccccggagctcaccggccagcgccgcctcggagcgaggagtaggggcggcgggggtccacgccatcgccatatccatggggaacagctcggctcgacaccatccttctcgtcgccagcctcaaccgcctctgcgacagatagatcgctcacatcgcctcctcgacaacctcctcgccggctcgccgcttccgccaccaccgtgacctcacatgatcttacctagtcgcccagatcaaggcgtcgccgggagagggtagaagcggggcgccggggagatagaggggatagacggcgctgctggcagagacgacaaccgagttggtgatggcaggctggccggcggtgagcacgacgggattggcgagggtgtcgggccttcagctactcctactaacccgccgttgttgatcgccggttcgccgccacctctgctgcctccgacatgcatgcagagctggccatctccgctgcctccctcacgcagaaaagactgagtgttcgttaggtggagataggagagattgtctctcgttttccgcgcgcacgcttttcaaactactaaacggtgtgttttttgcaaaaaatttcaataggaaagttgctttaaaaaatcatattaatctatttttgaaatttaaaatagttaatactcaattaatcatgacctaatggcttacctcgttttgcgtatcttcccaatctcctcaatccccttctcttcaaacactccctaagtgaactgatagattgaaggggaaaggcagagatggataatgaaggatggagcagcaggtcaccgctcccaaaggccacctgcactgcacgtggcatcatactctaggaatttttcattttcacccctaacattatttttattctatacttcactaagtactaaatatttttaaggacgcccctatattagtactcacatattgatgtccaggaccttgaaagtttcaactttccaaaaccgatctcatgtacaaagagtaaagagtaaacttttatgtctctgtatattgagttgaccataggagtcatttacctaaaataatattcaatacataaatttcgaaattttctaataatttgacaaattttgtaaatcctactaattcaaaagacacatctttcaaagtacttggtaaaggcatacagagaagcttaaacaagtaaattgcccattcacaaatcatatcttgaaatattgaagtataattatattactctaattgttaacaatattgctctcacaattgtacctatgattagctaatcaaccgatgatcgttatattttaagatgacggaatatcatatataagaccagagatgtgagtaggtcacatgggtagattagcacaagaaatttctcatagagagacttgaaaaaaaaaacttagttttcagtcctctaaccgtatagtcataccaattgttaataggtgtcaattactctgttaatggaagagaaaagggttgaattttttttttgaaaaaagcattctaaagtactacatttggaactctaaacatgaataacattaattatgttaaatatatgtcatagcggtaagttagtacgctaaccgacgcacctattttttagaaataggtaagcatggatttggaaaaggatagggaggggagattttaggatgctcagtataaaatattgactacgttttaaattagaaagaaaatgttaggattgaattaagaaacatgacagctgacatgaactttgtattgtgggataaacaattttcaaacatgttacctcatcatacaagacactttgaggctccttatagaagggttttgtactgcgaatgatctaagagatgatagagctatataattttctatcatctaaatgggctattacttaccataaaagattagcatcattttaactggatggaatggcttggcatacaaagagactcttgtgtagtgtgttcttcattgcacatcggtagttagaatagaaatcagtgaatcttaatcatcgattgttgatctaatggccatataatttgaggtgatgtgacacattgtgggatgagattaagttaatgggaatgaactatgtaagtatataaaatacatatggaggcgccccccccctcggcgccaacccacatgtggctcttagcatgtgcaccacgtggccctctcgcgatcatgacgatttttgctaagtaataagcagataagcatatattggaagagaaaacgagaaagtgatagatatacaaatgataacattttcaaccatcaaaataatggatttaatactctaaaagtaaaataaataaatagaatgaaaaggttatataggctgaaataaaaaaaatatgggaaggaggaaaggaacaaaataatttccattttcccataaagtatgaccaattaaaaaagcatgtcaattgttagggttattatataaatctctaatttatgaaagtcccaagcaatttgtttacttcatttttttagcttgattttattaataacaatcaaatcgaccatcagccaacataaattaatatcgccctttgttttgctttatctgctatgtaatttaaatgtttacaaacataatgtttttctcggacttgctgacataaaatttaaaaactgctaaaagatttttcttaagatataactcttttacaaataaacaatattaaattcactatacacgctatatggatagtgcgccaacggcgcaaacgctttctagttaattctgattggtagattgggctcctgtccttacgttcagaaaacagttatctctccatcctattttaagtgggtttctatgtttaacatttgactgcccgttttatttaaaatattttaatgattagtatttttattattattagatggtaaaacatgaatagtactctatgcgtaacttttttataaattttcgaaataagttggacggttaaacgttgtacatggaaactaataactgcatttaaaatggaatggagggagtactccttatccaaaaaaaaaataaattatgcataatagtttgtgctcatgtgagtgtcctaaaattaagggtcctcatgagtgttcgtctcatgagcctggtagttggaggaactgtatgttggtccggcgacggtcattgtgtggattgattttgtatgtaactcgagtagaatcaacggtgaaaaccttgccgagccaatggccaacttaaagatgaatgcccaaaggcggcgtttccctctttgcaggcgttttttatggcccctgtcctctcgaaccaaatcttttatgatgaaatcttgctacaatatacggacgaatgatgggggtgtttcacgttgcatcctccgtgggggctccgcttaagacaatcttcctcgtgcaatggtggccgttggtggtctcttgtgccggctgcaaagctctttaggcctatgacaaggttatctcctacttggttccacttgtttcacgatggatgactagacatcttcgtttgatattggtagctggagttggacctgctttactgttggggtgcaacgaagttgagcaacaatgacacatgtagtattttcttgatgtgttggtactggctatgtggaggaagtggcacttggctttgtctgatgtccgccagggaaaactggagttgcttgatcattttagtagttggtacctatgacgtgtttgatatgaggtaggggttgctgtgtcattaaggtgacaagctcaacaacgataacatatatatgtgtgtgtttgtgaagccaaaactgatgtgtcgtttttttgacaagctgtgcataacaataccctgtgtcgttgggctccgtatccttgtttagttgatgagagccactacagtgctctatactaataatattattacactaccagtagaaacgaccttaaacatcgatttataaggacatatcataactttacaacctctatgattaagggtaatttataaaattatttttttcctttcgttaatccgacgtggccggtgactcacagcataaccacgctaatgctgacgccctcggcacatggagccaccggagaccggaccattcgccagccaacacagttgatgaccaagaaacgtcacccggtgtcaatgccatcggcgcctaaagccagcggaccagcctgttgtcgtttcgctggccgtagctagcgaacttgcacaaagtacacgataatgacgacaagtttgggatgtcgacggtaaccatgggatcgacgaccatacacacgcatcgacacattgaaatgatttggaaattgtatccatgttcttttgcattgaacgatttcaatcataccatggttaatgaacacacatatatggcctactagaaatgccactactacgaaaatcatctttcgtgacggtcattttaggttttcactgacgaaatttgaagccgccataaagtaaaggccagtgaagatataagattttcgctggcggttagatttttgcaagcggacacacgatattcgctagcggtttcggtccgcttgcgaaaatcgatttttgtaagcggacaaatgatttttttctagcggttgacgtctgcttgcgaaaactcattttccctggcggttgcttaaagataagcgttagtgaaaatcaacccagcccgccaaaaaccccctaccccaaattcaaaattaatacataatattggcatcaatccaaatacagagaatcaacattggcatcatcaacaacacataaacagattaacaacacataatctgatttacacccacaaagtcatcagcagataatcacatctagttaagctcttcactgaaaccatccatgcatgcagcagcagtgttctctctctctaggattcatgcctcaggatgcctcggcggcggcgaccgccctggcctgcacaagcccgtctccgccgcggacaggagcaggagcaccgcggagggccggtcgaaccgcacggcggaggcgggcacgcgacggcgggtggtggtggtgcggcccagaagacgaggttggaggcggcggtggaggcgccctccctgcggcggcggcagatccgccctccccgcggcccaacggtgatggatccgccctccccatggcacggcggcggcggatccgccctcctcacccgcgtccgagctcgtggccacccgtggcggattcggcggctgagggagaggccgagagggaggaaggaggaggagacggacgtaccggtggtggtggatggcgcggcccgaaagacgaggttggaggcgcccttcccgcggcccggcagcggcggatctgccctccccgcggctcgacggtggcagatccgccctccccgcccacgcccgagctcctccgcccgcgctcgtgctcgtggtcacctgtggcggattcggtgactgagggagagggaggaaggaggagacggggcgcgccggcgactgagagggaggaggaagatgaagaggacttagctgcgcaaaaaaaaaaaaaagaagacagagggagagggaggaagaaaaggagaggactagctaggttgcgagtttggacggttttaatatggggaatttagttttcctggcggtcctcttatcggccgcctttgaaaataaccgccaacgaaaatcctattttcgcaagcggttgtttaagtgagccgctagcgaaaataggtatatttttgctagcggtcctcttaatctggccgccagtaaaaatctattttcgctggcggttcgtagcctcccacccctcgtaatatttatgctagcggtttccacgtataaccactagagaaaaaaaaatagggtgatgtcatgaaaaatcaattttctagaagtgtgctagcatgttgatatctaggattttcaagaactcatcgcaatacatacaggacaaaccggaattttcagtgttcattagtcattaatgcatgcttcattgtcaaggcgccatggttgttggcaaggttctgccggagtttgcattcatagttgtttctacggtacgaggcctcgaaggatcatctgcgtcgacgacggatgggtaggtggcagtgcggcaccacaagcgaagatgctgcgagatgcatcgcttgtgtcaatggcgcgaaatggcagcgaactatcgcgtttgtcgactgcggaagtacgaacgacgacatcctagaacagtggatgagaacatcataactaggggatacgtgtatcacggaaatacaaagccaatacgctgatctgcaaaattacgagtgtgaccgtccacgcttatatttctatggacgattatgctctctcatatttatactactattattgattaaggtggtggtataattaaatccggtcccttaaataaaaacagatcaacggtttggatttatttatcctactaatagagagcaccttaccagggcttttagttgatagttaactggtgttgtaggatgtggtgtgtgatgcgttgtcacaccctgaaaattcaaaatatataaattgttgtttaaatggaatttttagaaataattttaaaagtcttgaaaagaaaatctaagtttaattaataaattccaatataaaattgggccagataaaatttcattaaatactttgcttaattctttaattcctagatttttctgggatttatttgagataaggaagtatttttaataaatggaattgcatttaaggaataatttaaattgaaaaaggtcttaaaaagtctcttttggctttgggccgaaagtcggcccaaaacctctcttctctctcctcggcccagccggcccagtccgccgcgcgcgagcgcgcgtccgcccgctgacaggtggggcccacctgtcagtcgtcgtctaccttcggccgccgccgcccgaaaccctagtttcgcgccgccgccgtttcctttccaaatccggccgttcctttccttctccggccgatttgttagaggggaaatgatctccgggatctcctctaccttttctcctttggaatcttcggttaaatcgttttggaaagctttggaatcgagttcgactcggatcggtttccctctctccaagccgaaggtttccttcgccgttgccgtcgccgtgggccttcgccgccgcctccgagcccctttaaaaggacccccggtgtctcctctacccgtcgccaccctcgccttcgcctctcgtcgccggaagagctctagcgccgtgtgccctagcttttgccgtcgccgccgccgctccagccgtgtgccgccgtcgtttcagccgtcgccgtcgctcgggaagaccgccgtcgtgctcgccaagtcgccgccgtcctcgtccgccccttcgctgccgtcggagaccgccggagcatcgtcgccgtcgtcgagccgaagagcgccgccgtttcaacctcgtcgctgtcaccgtccgttggtcctccgccgtcgctttggtcgccggtgagttcgccgtgccgtccgctacccgttggtgccttccgtccgcgtcgctgtgccgtcgttcgccggcgagcatgcaagcccgagccgccgagccgccgccgccggtgatgacgtcatcgctgacgtcatcggggccgttcgctgtgagccggtcgtagaccgatcgatctcggccgtccatcttggatcggttaaatctcggccgtccgttcgcgtgaaccgccgcccatgcgccggtccacccaaaccctagccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtccctaaatttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactggttgaactttatttatattggttcaactagatattagatataattgcttagccctgcttagaaacattagcacatttatgggataactaatgatttactattatttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgttttataagggggtgattatgatccaggatggtgcgctgcagtggattgtgttatgcgaggggtattgtcacaactcctttccgagataccgtggtggtattgaggcacatggtaacatgatgtgggttgtgtcttgtgggtacagtggtacacctctggccagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagatagaactgtgcagccggggtggttgttcagaaatggttgggcctatacaacagggtatgttgtatagcgttggattaatattgtttaattattacttaactgttttgttaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttactgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccaggcgtgacatgcgtgctatcaagctgaccatgtttttttatctgagatgtttggcgagattcttcaggtcgagaggttattttctttttcttttttccttatagcccgtatgggtatttacttatgtttattgaaataaaattgacatttcttttagtacactaagatatttgttacttactccctctgtaaaaaaaactcaacctatcccctcttagttaataaatatggataaccttatgtccagattcgttgtaataggagagattacatcccctcctagattaagtttctatttttagagacggagggaatatatgctaaaaccccaatttttctctaaattttgaaccatggtacttgtggtactatggaatttactcaaagtcaaaaaatacaaagccttcaaagttatggaataaaaaaggatatgtatgttccctagatatttccaaaaaaaaaatatctcccatatttctagacgtaattacatatttttaataaatattaattgattaaatctttacgtggtcaattcaaaaatagttgaaggaaactatatgcccatgcatcgagacatgtggcctactagctagctagcccagtgggtggactctcttgaagtctctccgtgtcagtacttccccagaaagatgttcttgaggtgatacttttctctttgccagatcccctctcctctccattggttgccggggcaaggaagtgggcttgtcgagcttgtttcgtagtcgggtaaatctcgttgtgggtctttccttttccttctcttgctcaaataaaaagagatagtggcatctaccttctttgtcctggagttcttcggccatgaatggacctactgaagcttactttagcatatgccacatggctggtgaccatcgggtgagttacgtatgccttactactcttctgcatacgcaactcgaagttctccagtttctattgcaaagatgttgtgccagccgttcaactttcttccagcaaccactcacacaagagcgccgatctgcaaggggcaactttgatttattggtttgaccatggtagcttcaacctccatagcggagaggccccaactgggattgctcctgctctatgttttgaagcttgccatactatcatcttcaccatcgccgtcaacacaagcaggatcgctggtccggtggaagaagcagacagagaatccgattgatttttcccattctttttaagtcattttctgcaaaattcccaatgtatgctcaataatttgaccgtttctgaggagcctttctgcaaactggatgttctttccgttgctgtgctttctcatgtaccatgcatctaaactttatattaaataaagtgcatgagtcttaaaaaaaaggaaaagcagaagctaagcccagtgctgggcttgtccgcgaaggatgacggcgcggggcgtgcccaactgggcaacttgcagccgccgcgcgcatgatgccattgcactgcacgcagcacactacacacacatgagcgagcacgcgcgtagtgcacgaacatgtacaggaacacagagttagttgaggcgtagtacgtttgcaaatacatggcttcaagacatgaacaacggctgaaaagcagaacaggtaaataaatgtactctatagtaatgcactaagtatccccgaaaaaaaaagaataataatgcactaagtaaatgtaatgacaatgataattatctctggaagatgatggatcagttaattataaataatgcccccgcaaaaaaaatataaataatgcatgcagatcgttcgagctagacaggtagagtgtgtaagagcaggtttaataatatcgtcaacttgcttgctataaaacatcatctatatatagtctgttagtataggctatttatataagaatggtcgttattatcatttatggtaacagcaaatatactttttaattgatatgggtcccactaattactgcattctttactattgttttaagcatgaaccaatcttcatcaggcttatttctctttcttcattgtattgcgtgctgcagccggcgataattctatcgtcgactcgtgttctctctcaaccattccctccgctagcacagcactgagggtgacgtggtcacgctatcgccggtcaggttgacctattagacatatatatatatatatatatgtgtatatatatatatgtgtananggacaccccgaccggcgatagcgtgaccacgtcaccctcagagctgtgctcgcgcagggagagatagagagagagctcgagacgacgatagatatatagccg

SEQ ID NO: 52648 - DNA, 16640 bp, Oryza sativa
ttgttaaactgacgcgtggtggacaagaatgaccggtctgacactggtcgcgtcagcaacgggcagccacgatcccacgttgcgcccgtctccgccgggagtggaggtaggtgtgggctgtcccatcgaagtgtcattcggacggcaaccataccaatctccgttcataaagagaagaaaagtccagtttggaaagggaagggtgcatgtggtatccccttgaagtataaaaggaggaccttgcccatagagaaggggttggttgattcttgccagattcagagcttagaacgggggagaggtgggctcacactttgtagctcattcatacacagatccaccaaaacacaggagtagggtattacgcttctcagcggcccgaacctgtatacatcgccggtgtctcgcgtttcttgctagcagacgatctttccacacacagagagagagagagcttgagatctcaccctaagcccccggccgaaccggcaaaggggggcctgcgcggtctcccggtgaggagccacgagctccgtcatctggcgcaccaggtagggggctcagcgtgtgttttctgagctctcatactcttccgtgtgcgccaagtttcccttgttcagcctaatggccgagcaagcaaaggcgcacgacctctctccgagtgtgagcggcgacgacggggagccaaacccgcgccgtcgagctcgtactcccccacctcctcctcgccaaagccctaagcagggggaggcgctcgagagggtagataaatccgcagcatcaccggtcgtgggtgatgcaggagaacggcgagatggggagcgtcgcctcctcgtctacggcgacggcagcacgcctcagggcgcgcttcaggctgccggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgccaccaccggttccgtgtcatcaaggcggagggcgcggcgagcggcggcggctgcacgtcattcggctgccactccctcgtcgacacctccaactcgggaggatcagcatggggagccggatgcccgcctcgacatcgagcgccggcgtaataaccggcgtactccccgcgcaacggagggcgcctcttcgtccagagtgtcacctcgacatggacgtgaggatcagccctccgtgcccccggtcggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcgccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagattgcttccaaagagccccagactaccgcggagctttttcagctcgcggaccgagtggctcgtaaggaggaagcgtggacatggaactcctccggttccggagtggcagcttcggccgcccccggatccgccgctcagacagggcggcgtgacaggaggaggaagaagaggtcggaccgttccggcgacgagagtcatgtcctcgccgtcgagggcgctccgcgggccactcgaaaggggaggcctgcgagcgataaaaagaaagaggctggtactcccagcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggcggttccttccggcaaacggcgaagtgaggccaagcagaagggccccgctgttgacatcgatgatggagatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcattttcgaccagaccgaccacccaccgtgcattgcccggggagggcaggttgcgatggtggtttcccccaccatctgcaacgtgaagttgggacgtgtcctcatagatggaggagcggccctcaacatcctttcccccgcggcctttgatgccatcaaggccccggggatggtgctccgaccgtcccagccgattatcggtgtgacgccggggcatacgtggccattaggtcacatcgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctccgtccgtggcgaccttaaagtcgcgctcgcttgcatggagcagcgcgcggaccacctcgctgctgcgaccaagcccgagggtggtgacgagaggcttggcacctctgcccccaccgccccgaggcagcggatcgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcagacatgcccggggtccccagggaggtgattgagcaccgtctcgccgtgcggccgggcgcaaggccggtccggcagaaagtgcggcggcaggccccagaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccacagcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgttgatgacttggttgtaaaaacgcgcaaccaagaaactttactttcggatctagcggaaacttttgagaacctccgctccgcccgcataaagctgaaccctgataagtgtgtgtttggtgtacctgcgggcaagcttctcgggttcttggtctctgcccgaggcattgaggccaaccccgagaagattcgagctatcgagcggatgcgcccccccggcaaacttagggatgtgcaatgcgtcaccggttgcatggccgccctaagtcgtttcatatcaaggctgggagagaaggcgctacccttgtttaagctcctcaagcgctccgggccgtttacttggacggaggaagctgaacatgcccttactcagttaaaggcatatctcagctctcccccggttctagtcgccccggagccaaatgagcccctgctactttacttagcggcgaccccccaagtagttagtgcagcgttggttgtggagcgcgatgaggacaatcctcattctgcgcacccccattctgtgccgactcggcccgggagcaggcagggaggagaggcccccgagtcgaacggtggcctaaggcccccgacgaccggagtcggccctctgcccgcttgtcagacggtgccggatgcccccgaccctcaggaaggccccgaggccactgcgggaaggccgcacctaccaccctttgaccccgaggctaaccctgtgctgattcgacccgggagagggcagggagaagaggcccccgagccgaacggaggcctgaggcccctgacgaccggagctggccctttgcccgcttgtctgacgacgccaggagcccccgacccccaggacggccccgaggccactgtgggaaggccgctcctgtcgtcctccgaccccgaggtcatcggcacagaagacgagtgcgccccgaggggccacttggacgaagaacgccccgggggtacggcccttagcgaagaggatcggccccgccgaaaggtgcagcggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgggttcgatctgcactttgaaccacgccacgctatcaagagccaggccctcgccgattttgtggcagagtggaccccggctccagagaccgtctcaatacccgaggccagcacgaacccctctcagctgcctcacaccgcccactgggtgatgcaatttgacggttctctgtctcttcagggcgccggtgcaggggtcacgttgacctctccaagcggagacatcctcagatacttggtccgtctcgactttcgagcgactaataatatggcagagtacgagggactccttgccggactcagggtggcagccgggctggggatccgccgcctcctggtgttaggcgactctcagctggtcgttaaccaagtctgtaaggagtaccggtgctctgacccgcagatggacgcctacgtgcgccaagtacggcgtatggagcgccattttgacgggatagagcttcggcatgtgcccagacgggataatatgattgccgacgaactctcacggctcgcgtcttcgcgagcccagaccccaccgggcgcctttgaagaaaggcttacccagccgtcggcgcgacccgaccccttaggggagacggatgcacctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgttggtagaagggaccctctatcggcgcgcggctaacggaatcctcctgaagtgcattcctcaggaacaaggcgttgagcttcttgctgacatccatgaaggcgaatgcggagcccattccgcctcgcgtaccctggttggcaaggcctttcgtcaagggttttattggccgacagctctcaatgatgcagtcgatctggtccggcgatgcagagcgtgtcagttccacgccaagcaaatccatcagccggcccaggccctgcagatcataccactgtcatggccatttgcggtctgggggcttgatatcctgggaccgttcaaacgggccccaggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccatcccagaagcaatggccaagtggagcgcgccaatgcagagatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgagggagggtccgtatcgagtgatcggtgtcccccggccgggctcggtacggctggccacgggcgacggcacggagctgcctaacccatggaacatcgaacaccttcgtcgcttctacccctgatgaggggggggtcgggtgtcaggttttggctcaggccaaccccgcacccccctcgggtgtgcagggttggccgggggctaccacacatgcattacattcttatttctcttttttcaacatttcaatagaagcagtttcaatttcctaaaggttgtgtctgtgctgttctttccttttgaagaatcttgacttgaaataaggtcactcgtactcaaccttgccctcgggggttcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagccccgacccgagccattcgaggactgggacttgggcacgagcccttatttcaagctaaggcgcaaaaggaccatggcacagatcatcctcatctcgtatgtatagcaaaataaaactaacacaaaaattttttcatcatttctgattgcagattaagttaatttgtacaaaaaagaggcatgaaggccttagaagaaagaaaaagaaaaaagattggcgggggcctgggggctcattctgacgcgcccgggtcgccggcctcgtcgccaccgtcgtcctcaccgctggcatcgccctcctcgtcggagctgggggcgaacgcgagccgaggggccgagccctcgaagccgttgacgatgtggtcggcggcatcccggacgcgcgcgcgcgcatcgtcctcggtcccgggagggaactcctccagcgccatccatggggagaagttggggtcccgggcctggtaactcgctagcacgagttcgaccgccccccgggcgaggtccctcgaggatgacttgatggtcttctcgagctcctcggggagttgttcgaggacccaggccatcctgttgaggtgcggagcgaggccttccaggttggcggggcgcatcctcgtctggcctttccagaggcccgcttgccgaccggcgcgatccatgcgggagaccgagtcccaaagcatgtcgggccccatctcgcccgccaagcggagggcctcggcctccccgatggaggaatctagtgcgcgctgcatgtcagcgacggtgtgttcggcagccgcgaggcgagcggctaagtcgctttcgcccgcagccgccccaccgacgcgcgcccttgcgtccagctctttttcccgcgcctcgaggtcggcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagaacagcggcggcctcgcggtccgtcaagcccctctccacggcgccggcgtgttcttccagcgccatggcacgggcctcaagggcctcctcgcgccgccgagacgccgcttcagtctccgttacccgccgctctcgggcagcggcggagtcaaggaccccttgggcggcgtcgagctttttcttcagctccgcctcccagcttgcgtgctgaaggcggagggtgtcttgcgcctcgatcatcgcggtggtggcgatgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcaacgcgtgcccatgcggcctcgagctccgctcgttccgcgcgcagggcctccacttgggcgctaaacccatccagcaccgcggtgtttgcggcggccaaggcctgcagaatgggctcggcgctcagcggggcgacggaagatgaggagaagagccgccttggagagaaggcgatgcggctcggccccccggaggacgtgctgggctcagggatgtcccccggacccgtttgatcctgggcgtcgcccggggaggtgggcccaggcgatgtgcccgcggccacgtcgcgtgcctccccggaggctgtcgcctgagggttgcccgagggagtgggcccagttgacgcgccagcagcagctgttgcctcagcctggcgagcccgggcggcctcctccttagcggcttcctcagcccgggcggctgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaagactagggcgacgaccacaggcacttgacggcaggcacgagctagacaccgaagccttcatcttcaaggaactcctcatctgggcttggaaaaattaagcaagactgagtacaaccaccgtactcaacaagacacacccacaaatgcagaataaatgcaagggagtacaagggaattatgacataaagggttagggttgcagtaaacagcatttaaagacatttagttgctcaaggccattttgtaaacacgatcctagaactatccaatattattaatcaaggccgtgaacccacacgaacctgccttaacccaaggcctatgatgattcagaccgaactggcaacccgaccctgggtcccagctcgtcctaagccaacccaggccaaccattccacattttagttgttgagcaaattttaagaattagaacactgacttgggtacattgctcggcttgcccatatccgagggctcggctattcgaatagatttactctgatcagaggtgtacatctttacccacaagacacatcttcctcacgtgttaccacgtgccacataccaccacggtatacagacggaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccaaagtgtccaaatgatatgagaatttcccaaagtctatagttataaaaccacctaatgttgcctaattaaattgcgaagcatctacctagaattatactagggataccatgagtagagtgtccactagttggggttttgtttaatctagggtgaacaaggtaataataataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccaatcgacggcttcgacttcaacgagatcgggatgggctgccttcagctcgtcttcgcgctcccaagtagcttcttcttcggcgtggttgctccactggaccttgcaaaaacggattacacggttcctggtcctgcgctccatggtgtccaggattttcactggcttctccacatacgtcaggtcttcgcgaacttcaatttgctctgagtcggcctgctcggatggcactcgaagacatttcttgagttgcgacacatggaacacatcatgcacgttgcccaaggaggcgggcaactccagctggtaagcaacttctccacgtcgagcgatgatacggaagggacccacataccgaggtgcgagcttcccttttgtctgaaacctgtgcacacctcgcaatggcgtgacccgaaggtacacaaaatcatccactgcgaattccagatcacggcgacggttatctgcataacttttctgccgagactgtgccacctttagattatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttggtagctgttattgtaggagaactcggcataggggagactcttatcccaagtcttcccgaaatctaggacacatgcgcggagcatatcttctaagatctgatttagacgctcggtctgtccatctgtctgcgggtgatacgcggtgctgaaatttagtcgggtaccaagctcttcttggagcttcttccaaaagtgagaggtgaattggcttcccctatcagatacgattttcttgggaacgccatggagactcacgatcctagcgaagtagagctccgctagtttgttccctccataggtggtcttcacaggaatgaatcgagctaccttggttaatcgatccactattacccatatagagtcatatccaccttgggtttttgggaggccggtgatgaaatccatcccaatttcatcccatttccattccggcacttggagaggttggagaagtccggccggtcgttggtgttctgccttgacacgctggcacacatcacatagggccacaaactctgcaatttcccgcttcatgctgacccaccagtatttctccttcaagtctaagtacatcttggtactgcccgggtgaatggagtaaggactttcgtgagcttcctgaagtatcagctgtttaagttctctgctatctggaacgcatacccgctttccgttccataaggttccgtgttcatcctctgtgaaaccagcggccttaccctgtttcatattcttgaggagtccatgcatgtccggatcattcttctgagcctcgcggatttgatcgagcaaggtgggcttggcttctaacgcagccaagaatccgcgaccaactatgcttaggttcagggcttccatctgttgactaagttcgggtggaatgccacggacgttaagagtgttgcaatggctctttcgacttagagcgtcggcaaccacgttggccttaccagggtgatagtgaattcccacatcatagtccttgatgagttctaaccatctcctttgccgaagattcagatctgactgagtgaagatgtatttcaaacttttatgatcagtatatatttcacagcggttcccaatgagatagtgccgccagatttttagagcatgaaccactgcggctaattccaagtcatgcgtagggtagttgccctcatgaggtcgtagctgacgtgaagcataggctaccacatgaccgtcctgcatgagcacgcaccccaatccttggcgcgaagcatcacagtacaccatgaaatccttgcgagtatccggcaagattaacactggcgaggaaaccagcttttctttgagagtttggaacgccttctcgcattgcgggctccacacaaacttttcttctttcttcaacaactgtgtcatgggtcgagcgattttggagaagttctcgatgaatctccgatagtatcctgccaaacctaagaaactgcgaatctgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacgaatttatccaagtattccatgaacactttgttcatcaagttcatgaagaaggcaggagcattggttaagccgaacgacatcaccgtgaattcatacagtccatatcgcgtagtgaatgcggtcttcggaatatcttcttcacgaatacgtaattggtgatatccggaacggagatcaatcttggagaatacggtggcacctttaagctgatcgaacagatcatcgatccggggaagagggtacttgtttttgatggtgacttcattgagagctctgtagtcgacgcacatccttttcgtcttgtctttcttctccacaaaaatcacaggagcaccccatggggaagtactcggacgtatgtaccccttttctttcaactcttccaactgtttctttacttcggccagttcatttgctgccatacggtagggtcgcttgtacagaggagtggttcctggagcaagatctatccggaactcaatctctcgcttgggcggcataccaggtagttcttccggaaacacgtctccgaactctctgactatggggatttctgacagttctatctgatgcagttctgaacttctgacagaggttgggggtgcaaagaaaacaaccggttgttctggtcctcggtacagagtaacagtgcgtctcgcgcagtccactactccttggaattgagccaaccaattcatcccaaggatcacatccaagttctttgtgtctagcagaatcagatccgagggaaaaggaatcccctggatttctataggaacggcagggctataatactttgctgtcataaccccgccaggggtggtgatgagcagagggtttctaagcctttctacccccaactgatttctccccacgaatggcacagatatgaacgagtgggaagctccagagtcgaacaaaatagtagcagggatggattggacgaggaacgtaccaacgatgacgtctggagttgtcagcacgtcctcggccgtcacgtgattcacacgacctcgaatgacatccttcccgccgttgttggagcggggaggcgcttggccttgctgacgccttggcttcgggcatttatccgcaaagtgcccgggctcgaaacagttgaagcacagacgctgctgaccttgagcgtccctgcggccttgaacgggctgcacggctggcgtaggaggacggggtgcacgagtcccttgctgattctgctgctgctgcggctgtgggacgcgcaccacgaattgaggtcgaggcgcggagcgaggttgctgctgctgctgctgctgctgcgaggaggatccccctgggtagggattggtgtagcgaaccctctggttagcaccctgttgattgcggaaattcgccaagcggcgcttgtgcgattccagctccttgtgcttggcttccaagcggatgctcttgtccaccagtcgttggaagtcaggatagtccccagagactagacgaacggacagctcagggtccattcctgccaagaacttctcttgcttctcctcatcttcccgcacatcctccggagcgtaccgggccagattgttgaactcgtgcaaatactccatcacggagcggttgccttgcttcaactaccgaaattcccttttcttgagagccacgactccggcgggcacatgggttctccggaaagcggaggtgaagcgagcccaagtgatcggttgtcccgctggctgcgtagcctggaagtggtcccaccagatagatgcgggcccctgcagctggtgggcggcgaagatgactttctcttcatcactgcactgcaccgtgtctagcttcttccccacggcatgcaaccaatccaacgcatccacggggttgttggagctagagaaggtaggtgggcggatgcggaggaactcggcgagtttggagtgttggggaggtggtggtggagcattctgttgtggcgggttttggaggtggtggaggaaagcattcatcatgttggcttgttgggcgaggatctgggtgagaatggcgttggtgtctggtggtggtggtggaggtggattgccttgggggttggggttgctgccctcgggttggttgccttcaccggtgttaacatttctcctggtcgtcaccatctggaaaccccacacagaacagcaaacagagaaggagagctgacgattaaaactaaccacccacgactaccattattcttaaatttatcactgctattaaattggttcattaaggttcaagttgcttaggcaaacaaaataagacaggctccgacatagttacaccacacaccggcgtaaccatgccccacacaactcaaaaaagaacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacgaacaagctcgggcctggaggtgctcttgcgggcggtgatcttctggctgcggcagacgcggcgacgcttgggacggctgatctctccctgggcgatcttgagctggtgcagctgcgcctccaacgcgtcgaggtccttcttgagctgcagattctcctgacgcagctccaggatcttcatgttgttctccaccatgccacgacgcaccatctggtggaagtcgatacgagccgcgtcgtacgcctccaccatgcgtgccagatgcacgacggtagcgtcatcctccgagctggcgtctcggaaggtggcgaagtcgcgggctcctccgcgacgagggtggtagcggtaggacgagtgctgcaactcgtccgggtagcgctggtgaagggtgccgatggcgaggagagcggcgttctggcaagcggcggggaaggagtccccacccgctgtgactgccagcgaagtccgctcgggagagccggagaggatcactgcagtgacctcccaaccagcgtgaggctctgcatcctcaccctcctgctccgggagcggcctggcctggtaatccactccatgtggatattccaagaccacgcacatgcctcgcagctccaagacgaagccggtcatgtccaaaccacgacgggtaacgctgccggccatctacaagcaaaaacaaaaagaaaagccacattttcaaaggtcagattttgacgataaatgaagcagcaagacagagagagaatagcggttttcacaaataacaaaggatttttatttttgaaaatattgctaaggcttgggatctacggctcgtcctagggtcaaggaaggctctgataccaacttgtcacgaccggaaatcacccaacaggcgttcctgacgtgcgtgtattattccttgtcccaggaggcaaggtacaccaaaagttgaatcaattcagagtttaacaagcggaagcgtaaatataattattacacgggcaacaacggcccagcacacaaagacacgaaaaacagcggaagactagggcgacgaccacaggcacttgacggcaggcacgaggtagacaccgaagccttcatcttcaaggaactcctcat

SEQ ID NO: 52649 - DNA, 19815 bp, Oryza sativa
aatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccaaagtgtccaaatgatatgagaatttcccaaagtctatagttataaaaccacctaatgttgcctaattaaattgcgaagcatctacctagaattatactagggataccatgagtagagtgtccactagttggggttttgtttaatctagggtgaacaaggtaataataataacaataacaataataatatggtcataacaaaggtaaataggcatggctaagtaaaacagtgataacgcggggatttaaataaagcgataatgcaataatttaaatcaacataattttataaactgggattcaatatgatcaagatgatgtgtcttgccttgctcgttttcccaatcgacggcttcgacttcaatgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaattttcaattaaaaattcggattattgcgtcagccgaggggcgggcgcgcggaccgggtccacaggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcacccgcgccccgatggtcgccgccggcgaccaacggcgcggcggagtggcacccgagagagaggagggaagggggaaacgaaggggacggtccacggctcaccccgagacggcgaaggcggcggaaacggcggacggagcggaggaagacggcggcgcggctcgggatgacgagggcgacggtgctccggcggtcggcgagcgaaacggaggcgcggacgaggtcgacggcgatgcggcgatgccgagggaggtggcgccgagccgggaggaagaccggagcgacggcggcggcgaaccgaaggtcgacggcgacggcggagagagaggagcacggcgctagcacgattccgacggcgagagcgagcggcgagcggcggaaacggaagagcggagctcgggcaacgaatatatagcaacgggagggggagagcgcggccggggaggaaggaaaccggccgcgaagatctcggccgccattgattgcgccggcgatgaatgcgggcacgattcgaacgaatccgagggagagagagagggaaaagagggggaatcgggagagggaaacgcggggaataatttccccctcttgattgcacgcggggcggacgggagcggcgggattcgcggcggcggcggcgctagggcacggacgcggcggcgggcgcggcgggaggagggcgatgacaggtgggccccacccgtcagcgagagtggcgggcgggcccgcctgtcagcggcgcgcgcgcgcgcggggagccgatgggccgagggggggaagagagagagagagggagggaatgggccgagccggcccaagaaggaagggggagggggaaaagacttcttttaggattttctttttataaacctttttaactttgttcatttcttttcaattattatttgtgctctgaaaattccactaaaatttatttaagcattttaggcttttaggaaatatacaaaaatcctccaagcctcatttgacttttatctttgcacattttaattgttggaggctttcacattgaattttacttattcttttgcacaattttgaggatagattttagagtcgatttgggacgcgacagcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggagtggcgggaggaatgcgacgggacatcgctgaagcagaagaaaaaaccagaagacgaacaaaatgagtaagaaaaaacttctttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgtgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagttaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctgacttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaaagtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgatcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgtgcgttaattacgctcgccgaccgaagcggcgttaccgtatctccgggcgagacaaatctgctcacccagattcgcgcgctgctcaagtggtgtggcggtcttgaatagaccgcccattatggacaaccagagttaccaataccaaggtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacacaatcgcccacgtggcctggcaccttcggggacgtcgggcccgagggtgaggtgtccgccctccttctgattccccccgagggggggtcgggttgcgcttgccccgaccccgagggccgaggcaccccgaccccttaaggaagtctgcgccgcatatatgggataagtgagcacaagctgtgctcacctaacagcatttattgcggtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctgattagatgaataccaggcttcatcctaaccattacaggcaaggtgttacacgaagaagggcaaacatgcacgttgttaaactgacgcgtggtggacaagaatgaccggtctgacactggtcgcgtcagcaacgggcagccacgatcccacgttgcgcccgtctccgccgggagtggaggtaggtgtgggctgtcccatcgaagtgtcattcggacggcaaccataccaatctccgttcataaagagaagaaaagtccagtttggaaagggaagggtgcatgtggtatccccttgaagtataaaaggaggaccttgcccatagagaaggggttggttgattcttgccagattcagagcttagaacgggggagaggtgggctcacactttgtagctcattcatacacagatccaccaaaacacaggagtagggtattacgcttctcagcggcccgaacctgtatacatcgccggtgtctcgcgtttcttgctagcagacgatctttccacacacagagagagagagcttgagatctcaccctaagcccccggccgaaccggcaaagaggggcctgcgcggtctcccggtgaggagccacgagctccgtcacatacatatgtatatatatatatacatacatacatacatatgtatatatatatacatacatacatacatatgtatatatatatatacatacatacatatgtatatgtatatatatatatatatatacatatgtacacatacacacgcgcgtatacgtatacacgtacgtacgtgtgtgtacacacgtatcaggacatggagatgttctctttattccgttcgaatattctagctgatcggatcggctcgatcgatcgattctcgcgtacgcaactgggcaatttggcggcggtcgttacgactataggtgcccgcttgtgttcactatacagttagtaaaacattcattttgttaatccactctttagtacgtcttgaccgttgacgattgcccaagcaagccgcaccagtacgttcagtgcatacaaggactgtttgaggaaccttttgctagatgcatccgtttttggcagacaagttagccaatgagactcagcgagaaattttatattggctcaggcacttctgaaagcgggttttataaaatggtaccaacaaagtgcgtgttctataatatatcatcaacaaagcttgattcttacaataccttcgaacaacttgtctctttttcttatatgccatcatcattaagtcaacaattactcaaccgttaagggagaaaaaaagattacttttcacaaatctcaattttgcacaatgccatatcgcactaaactgtcttggatgatagaaaaacaagtggtcctatttttcatcgatgagaaaaaatagtggatcatggcaaatgaaattcatgggtacctattataccctatgggtaaaatggataaaattgagattttatcgtgcgacgtggataaaattgagattttgcacaatgccatgtcgcactaaattttcttggataacagaaaaacaagtggtcctatttttcatcgatgagaaaaaatagtggatcatggcaaatgaaattcatgggtacccattataccctatgggtaaaatggatattttctcgcccttaatggatggtatataagcaagaaaacaagttattcgatgttatataatataactcggtttttccactggtatattataaaatccataccttctaaatgatataaaatttattatctctaaaagaatataatatatttatgttatatcaatgactgaacaggaaatactatagaacggtatacctttccaacgaaataaatattgcatgctgatgtcagcacgatatcgtaggtatcagataggtacctaatccggtacctccagtacaagacataatatccataggtaccatgctgatattagcatgataccataggtaggtatcggatttggtacttgggatatcagacatgataccctctaagtatcagctagggcgttgaaaagtgcagcaatggctagggcaacaacgagtgaggcggcagctacaattgcagcagtgggagagctagtcagatccgccagcggcaatgacaggagggacagatacggcaggctctcctcctatgcggatcccgccgcctcccccaccctcacacatggatctagcaggccgggctctcctccacgcggatcctaccacctctccctcccctccctcatgcatagattcaatggtggcggcaatgggaggggcagatccggcatggctctccccctctggtttggatcccaccgtctccccctccctcatgcatggaacgtctcccacctccctcgcatatggatctagcagtagcgacaacgggagggacagatctagtgggctctcccctacccacgtggatcctatcgtctctccacttcctcgtgtgagggtctgttagcggggggaggccgggaagggcgtcggtgatgacagtgatgacggtcatcgggaatgggagcagtgtggtgacgacggccgcagagcacaggagcggcatccatccctttttattctaggtttttggaatctttgttttttggaattttgatttttttttcaaaaattccttttgcaggcaaacgacataacgtgctcacttgggaaaatcccttttcgcacgaggttgtgctgctgcccgcaaaaattcctattttcacatacaccttggagcaagcagttgctatatatacccccgcctacgaaaatacactttagctttttggaaaaactttattttagtagtgtcgggtatatagtgacccggccccgaacttctaaaatcgtgcaaattgtgtcccacgatagtattgtaggcgattttaaccgacgtagcgcctacatatgttgtttgatttggtcttcatcccatataatgcttatgtggcactagaagaaaaataataaatgaaaacaatagtgtgacccatatatcaggtgatagccaacaaatatcttgggccaatatatcatcaccgaccttctatctctcccccatcttctctaccacctgcacactaagctgaggtggccgtcaagctccttgcgcaatattggcttggtctccagaacggtcaacagtatcggcagtggctccacgttgtcgacaaggtagctctccttgtcccctgaccacctgtctaaaccatgtcctcctccccttccccttcttctcctatgcaccctccttggccctgacgtgcatgcagggatctcgggcaatgatgcggccgctagatgttgatagattcacatcaggcggtgctctaggttggaatcagtctagcatagaggttatgccggtggatagtgatgctgatagctgctggcgggaacagtagtggatggggagggaatggttggggcacggggaggagcaggctagggttcgtaggagtcatggagatgggagtagggttcgtgttcgggatacaaagattgtcgctctctggcgatgagtggaaatagtgggagtgaaggggaagcaagcgatgtggcgttcagcacgaggaaggtcggtgatgatatgtggactccacataattgttatactttttctagctggtcacccactggacatatgggtccaactgatatttttttattatttttcatctagtgcaacgtatgcgccatgtgagatgaaaaccaagtcaagtcatttaataacatccacaatacttccgaatgatgtaatttacattagttttagaagttaggggatactttatacatggttttgtaattgagtgatatgaaatggaactcaacccatatttgagggacctaatgtgaacttttgaccaaccttaatttgtactagctcttgtgggcttttatttccaggcttcgcctggctcaagtgagcctagagctttgagtccacgttgaaacgcttgatattacaacttgcatgcgtcaagctaccaaaatcagctcctgagaacgtgagagccattttgatgtcgaatcatgctgtggatatctttgacgtcccatcattcttagacggcacaaacaaacttgatggatggaccgaccagtcgaagcaagcaacatttcaattggcgttggaacacgtcagttcggcaagttgccaaatttatgaccaactatcctgaaaatagcccagtaaactattcctagcacctgagcaccatgtccttatctaggtagtatgttttttcttccttgtgagaatttgcaggctattatatttgcaataaaatgaaggaatactaagctttaagatttattgttgtgttttgcgaatatgttatagtagaatttatagtcaaagtgtccgtgtctaattcaaatatggaaaaggatgtgatggctcgtcttattagatttcttgtggtgaaatttgttcacatgggtttaagttttagacttgagacatgtacttgtatttatagaattattttttcgatgataagtgaagtactcatcaatcagtaaggcatccgttataactttcattaatgaaggtggtcgtagaagtaggatgtgtatgtatgtttatatgaataagtgtggctcgtgtatatgagctttcacgtttgtgttgtatttcgcgaggatctatacttataaattggaggcgcaagatgtgctttaacatgttatgaggcattctgtttagtaattaaatattatgaagaaacaataagtagatttcactttggactataaccacttttactaaattaatttcacgtaatttacaaattcattgtaaatagtatatatacattcactatcgctatgctttgctcattcatgctgctgccggttatattctatcctcatcagacgaactatatatcaatagaatatactccatttttagctatgtcaaactaaacaagaaagaatactgcgcagctaatgacggatggaattatacaggagaataaaacatataagttatggatggccgacaaaattaccaagatgcagcagttgtgacgcttttgtttaaacttcggaaattcattgtgtcctgatgcaatgattttgttttctttaaaaagtataaaaatgcatgaaaacgtccagcgatggaaatgaatgttcacacactatcgtcatgagctagggggtatagctatatgttttttttttttttttggcggggaagctatatgggtatttgagatgtccaagatcatcattgaacatttatcaaagcaaaaaaaaaaaaaagaaaacgcccattctaactagatcaagaaagagggagaagaggaacttaaaagaaatacactgatgtgagctaagtgcgcaggagatgagaattaagcggatcagctcgagagtatagcgtcaaaaaggtacgggatgagttagcgatggtttggctaaataagtagtaaactacccctatttacattgaactttttccagattatccctctgtacggtagactgggaggtaccaggcatacctcccaagcattgttaaaggtctcatttagccaaggctctgttggtttgttctggtttgactctatgtactgttagaattaaatgaaatatgcccaatataattctagtaattctagaaccacgtagccagcccatctgatgggtgggcccacttacacaaaccaaatcatttacacttttgtcctcgcttcgggtaaaagggtaatccgggagtggcatggttggagggacaagcccttataagttggttccatccttgataaactagtaaggtggtatactaaacatgcgtatacaactcacatgggtcgcacaggcctcatcctaattgggccaggatgtcatagttttcatctcccatctccgagatagacatagaactctctattctgttcattttcctgatactctggttctcatcaagtttttggcaagtgcttctttggcgcgattgctctgctacgtctccactgcttcctatgcgccaagtgttttttgtttccttttcatcattgtgactgggaatggcaacggaggggagaacgacgggaacggtgacaccaacatcaaccccaacaccaacaccgcctctggatcccgggtatgtcactctattcactttagtgttaaacatgttactctatcatctttttattcacatctcatgtttagtattttgtttttctagtttaaaatacttccaacatatgaattatgactatacttccaacaggtactatgagcggagagcaagatgcttagaaagatgaacatccagcttggcccaaaaactggcaaggcatgttttcatgtttcttgcggggattaaacttttcatataaatcggtgcaaaaacttagttccgatcaaaaatttgaaaaatgacctaaaaagagaatttcttggtccacatgaatatgacgaaacaatgaaccatagccgaagtttcttatatccattccttcttcctctcatcacttcctagtttcctactatgtgccactaacaagaagacatgaacactataagcgtccaccaaaagagaaacaaatagaagagccttcagcccttcgtgctgccaacgcttttaacccatagtggatatatgtcgtcccagatcgattgatcgagtaacgaacagcaagtagccaagctgacattccccggtttcagagttcagaccgacgacgatgccaaaacgacgtgtgcatcaattactgcatttcgcccatgtcagctcagctcgatccgatccattcatgccacaagtcagagcggcatctgaacccaacaagtcagaatttgttgcgtcgcccaagctacacagttgctcataaatacacgcagagtcgcacagggaatgagatttgagatatcatcgatctggtagttgcttccagtctctactctctactccttgctattgcattccaccagttcagttcggcacgacttatcgacgacaagatatatggttaatccggcgacgatgatttcacctataaatacagggcagccaccgtgcatgatagatcatcgctagctgcagtcagtcaccacgtcaagccagtggacacgacaggcaagacgagagagctagcatggctttagctcacgaggtcgctttcgaggtgaacctgatcgaggacgacggcggcctcgccggctgggcgccggtgggcacgcgcacggcgctgtcctcgcacgccgagcgcgacacggccatgctgatctcgggcgccgtgtcggccgcggagccgaatgagcgtattagacgatcaagcggacggtacatcgtcgcgtcgcgccgcgccgacgaggaggacgggctgcggcgcgcggttccggcgggcgcgctcgtgccacgggtcacgtaccgtgtcgtcgggtgggtcagcgtgcagggccagggcgacgggaggcaccatgcggtgcgcgtcggcctccgcgtggacggcgacggcggcgacgacgagcgcggcagctggctagactgcggcgcggcacgcgtcgaggtgggcggcgggtgggcggagatcaacggcgcgttccggctcagggcgagcccacgcgtcgcggctgttcacgtccatggcgcgcctgccggtgttgatgttaaggtgatggatctgcaggtctacgcgacggaccgcaaggcgcggttgacgcagctcaaagagcagactgacaaggtgagtgagcaatcatcagctcactccgactccgcgcgcacgtttgcatgatcaacttcttcgttactgctttacgtgctaaattaatatttcctccagtcatatatagacaagtgtcgtttaacaatccatgtaggcaatataaattacatttgatcacaatttctgaaaagaacaaaatcattcgtaacatgtcacttatttggatttttaattcgcggtaagaagtcaaatgactttttggaaaaaacctctaaatgaaatggccgtttaagaaagtgactgatatttagggggaaaaaaatactccagttaagtgatgaattagcaagcccaaagtaaaatgacattccctggatgcgctcatgcaggttcgcaagcgagacgtgattctcaacttgggcggcggcgcgaccatggccggcgcgtcaatccgcgtggcgcagctgctggagaatcgcttcccgttcggatcctgcatcaacaagacggccatccgaaaccccaagttcgtcgacttcttctgcgagaacttcgactgggccgtcttcgagaacggctcaagtggtactcgacggagccgcagcgcgggcagatcaactaccgcgacgccgacgagctgctcgacttctgccaccgctacggcaagtcggcgcgcggccactgcattttttgggccgtcgacggcgacgtgcagcagtgggtcaaggccctcggccgcgacgacctcgccgccgcggtgcagggccgcctccacggcctcctgtcccgctacgcccgccggttccgccactacgacgtcaacaacgagatgctgcacggccgcttctaccgcgaccggctgggagacggcgtcgcgccgctcatgttccgcgaggccgcgcggctggacccggccgcgcggctcttcgtcaacgactacaacgtcctgcgtgggaacgaccccaacgcgacgccggagaagtacgtcgagctggtggacgcgctgcggcgcggcggcgcggcggtgggcgggatcggggtgcaggggcacatggacagcccggtggccgggcaggtcatccgcgccgcgctggacaagctcgccgcggcgggcggcgcgcccatctggatcaccgagctggacgtgagcgagcccgacgtggggctccgcgccgacgacctggaggtggtgctgcgcgaggcgtacgcgcacccggccgtggagggcgtcgtgctctgggggttcatggaggggcagatgtggcgccgggacgcctacctcgtcgacgccgacggcaccgtcaacgaggccgggcagaggttcctccagctccagagggagtggaggtcggacgcgcgcggcattgtcgacggcgatggccgtttcaagttcaggggcttccacggcacgtacgtcgcgcaggtgacgacggcgacggggaagatgctcaagacgttcaccgtggagaaaggggataattctctcgagttggatttggatatcgaaatttgaaggtttaatgtgatgatatcgtcctagtcgtaatgtactgtgagcttaaagttcatctccatcgtgctggactactgaataatgacgtgcatgcatatactactgcgcttgatacattattgtgaaggaacaatggaacatggattaattagttcagtaaataaaaatgatacgattggatataaaatttataaacgagaagttgttggtcgcttttgacttgtttttcctacttaaatttctttaaatttgatcaaatttatagaaaaatatagcaatacttttaacacaaacaaacatattatcaaaatatattaaatgttagttttaatgaaattaatttgttgttgtagatattgttaatcttttctataaacttaggttctgtttctttcagcttgggattattataatccagattattgggagtaagctgaaagaaacagacaacttattgaagtaacttattataatctggagtccaacttattataatctgataaactcatttaggtgagctttttccagattattgggtgaaaaattacccaccatgccaccccactccctctttagggcctgtttggtatagctccaactcctaaatttaactccaggagttgagtctggagtggagttgtggagctgcctaaacccagctccacaactctagttcattttgtgagagggctccacccagctccactcccagttttggtggagccgaaactgtttggctgagctccagctccagaaggggtgaagctggagctggagctgtgccaaacaggcccttagacttgcaaacccaataatctaggctctaataatctagaaaagaaacaactaaccgcttattctactacagattataacaatctagcttatagtaatctgactcaataatctagattataataatcccaagctgaaaaaaacagggccttagtaaggaaaagtaaaaacaactgataatatgaaacggatagagtatgatatatttcaaacgataagttattatattttaacatacatatcaaagaccgaataaattcaacatctactatattaaagtatgaatggagtagatgtttatcatggatggaaattacacgtaatagctataatagggttatcttcgccttctccgatcccatccttcacctcaccgctgcccgagcacaccattggagttttgcgtgggcgcatgaatggtggtgacggggctcgttcaggtccctcttggcgcttaggatggttttggccaaggtatctctcgttggacctagagttgtgtctggatccgatgacagcaagtgcggcagctgccagccactccatgttaggcatggtgttggcacaataggactttgctggggaaatcgagggccgcatctaagtagatctaaggtgatatcgatggttgtgcattagtagtgttttggaatgattggggcagcgacaggatggcatggcatagaggagcagtggctacaacggcggcagggcgggctagactcgcatctccgctagtgaactgcggctagccgttgatggtgtacaacttgttagccttcttcttgtggctggtgagcatcagcggtggtgtgatgagactgtagtgccgacagcactggcatcatcgtgcatcggcatgttaccgagcagatcattgagagcaaaggggccaacaaggaggtaaccatgcactaggctgaccttgatgcccttgagcagtgggctcatggcagtggcaaggatggaggattagctaggcggagctggtggcatccgaggtggatggatacaatctaatggctagatcaagtaactttttggcgagcaacgagaggatgagggcgggctcctttagtggtgccaactacgaccggggtgtctggatctatctctctggcgagcaaggtagctaagtgaggagcaacatcggcgagttgatggtgaaggcggtggagagggtgtgacgataaatctagggcctaactctcactggatccaaggtgtctgtgtttgaagttgttcgtgcaatgtgaattgcgttggagaggtctcttctttcttctctgcctccaataaatgacgttgtcgagcaaacgcactagagtcaggagttgtcgaacctaggccgatttgatccgggcaacggtaggggtagtggtgacgaaggaggtaatcaaaggtggtggatggaatgcagatggggatggggagtataggaccttaggttgtgaatcaagatcgactcagtgtggttgtttggcgcggtagtactcatcaagcagcatgaagatcgaagcttagttttctagttctttttttgtcgttgttttgcctcagttatgagaggtggaatctaagtattcctataaaatttagctgtatatatccatttgtagaatagaagctagatttttatccattattaaaatatatatatatctaaacttgagcagtaactattcccttgggttgagaagcattgtatatacaaatggggagtattgtatcttgtgctcaacttgatatgggcttgaatctcaccgtcgatggcaattaaattaaccatgttttcatctaagggagttgtatagcctaattggcagccaaaatgggttgttgaaaatcaaggagtctataggcgtatttctcaacagcaggtagtacacgtgaaacagtggaccacatttttgctttcatcaggaaaacacaggtaaatctcgttcctttaggtcatcccagccctccatctcagctagtgtctacaacattaaatccactgtcatataagcaaaaatctaatgtggcaatagagttaatgaggagaaagggtaaaaagataaagaaatcatttctcatgcaagaaactgtctctacacaggaactaaggattaaaacaaggggatatgtgaatgaatggatacacaataaatgccattggatgatattctatttactacgcctccattaggcatatactccctccatctacttttgatagtcatatttccaaatccgataaatttatttttgatagtcatatttcaatccaacaacctatcctcttaatagctttctcggatttaatgcgtgactctccattcttccatataagattggctgcgtgggcatcgagaaatgtaaatattaatgaatcgcttgtttacgaggaataactagtagcatgtttaaatggatgataaatagaattacttatacttagtctgtgtgccaagatgaaatatgatgatcaaaagtagatggagggagtagtttcttatatgacatgaccagtatggaaactacttgatagtttctgggttgatattggccttggaaaatggaaatgcaagcatatttactgtgaagaaatgattggtgcaactgcattttcctatggacttatgccagattgacatgcaatacatcgagatgaatgctaaacacagctaatctaataacaaaatgagactcactgttatcccccagaatagcaaatcggaagtctaagggcattctcaacccatggtatccatgggtagtgtctagagcagtgagaaatcaataaatgcatatatggacactagatccccattgcatcgtttctataccagtttccatgggggaagaaaatttaatagttctttgcatgtaacattaacacaggaggatcagctgtggcaagcaaacaacctacaccgttttggtagagtaattcaaatgttacataccaaatgagcagatatatgaatgtgtcaaaaacaaaccaaatatataacctctgacctaggcaattaatttgatcaatcatgcaattcatacagatgacaatccatccatctcattaaaataaaaaagagatcatgtgcacatgagcaggttatgctgacaccaattaacttaaagataaataggtacccataaataacaaagtagcagcactcaaactggtagtctttcataacatcagtttgtcagggttatggataacacatacctaatagtagttgactaaatctcggcatgacccaccacataccatgtcttatacggaaataaccttcggagataggaggagttccgcataaggaaggatgaatagagttctacatggaaacgacaatgactactcggattgtatccatattggtttccctagttctacttggacaaggggacacctatgggtataaatataaggccccctaggaggagaggggacacggaacaatagatcaagacacaagatcaatatacaagccaacatgcgccaagacaagatgtcggatatcgacttcagagataagcatggctagtcccctacggtgtctacggatactgtcaggagagacatatcgttgtctttgatatcgccggatgcggattcgaggaggaaggttaccctgttgtcgactacgagtcagcacttgagatcgccaagtcgacaacagttagatagactaccacaaatattgtactggtgtgattatggtgaataagagcaacgaccggcttcgaccaacaggtgtatggttattacccgacaattttggggtctgaacctgtataaaaatcctcgtccccatctcttttattacaatctcgcatatatcctagtaccaacgatccccataatatgcaaataccggaatcgcgacatcaaacgttgatagtggcgcgccaggtagggggattttggtgcttcaggattttgacgagatgggttcaagagatggattcttcgccagcaaactactcaacgacttcgtatattgggtgatacgacctgagcgaagtgcgttctccgatggatcgggatcttcgtcaagcttcaccaagtcatcgtcactatggatattttgacgagggatacttcaactactttggatccgagaagtctaacccgaccagagtacgtgccccgacgagatcggaaccatcaagattgaccctagttcaagattttgtcgcagcggaaaaccaatggtatcgacggcacgtgagattgattaaatatgagttggtcatgttcccgacgaggtgtcctcggacacatcggcacaattcataccgagatcaacggcgcactgtttacttaggttaagaccgagaacatgcatgcatgcgtggaccagccaacgtgtttctgcacagtgcatatgcaaattggtttggtaagacatctatgctactcggacacgtgcacagaaggtaattagtgagattgatttctaaattaatctactaatttcatagatacattcggcatgtatctacaaaggtacgcaatattttatatgaaatttatcgtacctatttttcaagattatacaatattgtcatatcaataatttattatgtttacctagagcatgtcttttatacaatatctattgtgcgagcatttctgatgttaggccaactacggtctaacgctgggggctcgctctattttcttctgtatgaattatgcttgtctacggtttatataagagagaattccttatatgccattgaaatttggtctggtccttgatatgccacacaaaattggctcttcccttatatgccattgagtcaaatttgagcaccctctcatgtcactcacgtgagttgaccgtgtgttgactgttgctaggatctaataacttgtcagatttttgcagaaatgacaaaaatagcctttgacccaaacttgagaaaatggcccaatgccaagtggcccaagtccaacatccctctcctcaataggggaaaccctagatcgtgcctgatcagga

SEQ ID NO: 52650 - DNA, 2208 bp, Oryza sativa
ttgttcaagattttattcctgtccaaaaaaaaggcaaaagaaggctactaatgaacattgtgaaactagcattattcctgttcctagtgaatcttcagcccaaaatccttgcttagctccaactatgtcatacccaccaaccaaaagctgccaaagtgggaaaaaaaggacatactattacttcatcagattcaattaggtattttggttttcagatttcattttcactgatcattttgttttttagttacattttcctttcaaagattattgtcttacatttatgtgaatcttcagatcaagatcagtgacaggatccaaccaaccggaacctttgagtgtgctgatgccactaccagcactagcacctgacaagtgcaaggccaaggccaaacccaagacaaagactaaagccaaggtagccactaagaaaaacaaggaagatagcactgatgctacacctttggctcaaatcaagcgaaaaaaagttgttcccgtgactccagatagtccagcaatggggacaagaagcaaaaagaagaaatctctagattttaatttatactaagcatgtgttgaattattttggtactgtaatatttggaagttagcttggtactgtaatatcttggagtactgctctagttaatttgcatgttaggactgtgttagtatgcactgtgatgagtgctgatgcactataatgtattttggtaccgtcaatatgtattttggtgttgtgaggtcatttgaacctttatgacatgaccatgtaatattttagagaccttggtatactgcatgtccaagcttttgttggagaactacttgtttaattcatgtctttgtgaaaaatatatgctatggtagtggtagaaatgttgtatatacaatattcatataatcaatataatgctgaaaattattcatataatcaatataatgctgaaatgttgtatatacatgtacatgtcaaccaaattaaaaaaaaatgccaagtaatggtactgcctgcctaacaactcaggggtaaattcgtcttttcactatcaagttaacagtcaacacacagtcaactcacgtgagtggcatgagagggtgctcaaatttgacccaatggcatataagggaagagccaattttgtgtggcatatcagggatcagaccaaatttcaatggcatataagggattctctctttatataatgcctgatatttcatatgctcgttatatcctgataatactagaagatccatgtagttttttgaatacatactcgatattatcttctatatgtcttgccttctagaaaatatttttcaggaacaattgagcactcgagtaggttgtggtcgagtacacccattatcgagaacattctcgacaaatgcggagttgtcgcacccaacctaccaacgaagaccgacgacctatctcatagcgccgaccatggctgggctattcgagaaaaggttgttaacggataaattctcgtgaacgttgtcggcttgatcacccgatatgattgcgagcggatatccggatatgctataagttgggtatgtgagtcatgctggccacatgaggtgcacatgtaacaaaccaactttagcacccctataggtgattgagaggctcctactcctggttctcgaaccagtaggacgtagcgatctctcgcgccttaacttctgatggtcgaggtatgactacggcaatagcgtagcggtcctcgcaccacgagttcagatgacttcagatggttgaggaacagctatgactgatcttcgacagacagcatagcggtcctcgtaccacgactccaaatggtcgagagacacctactcactagttctcaaccagtcaatcgtagcgatctctcgtacaattacttctagtggtcgagttatgactactacctagtcctcgaccaatggtgtagcaattctcccactatttccactttaagtggtcgagttacgactactacctggtcctcgactagcggtgtagcgattctcccattattttcactttaagtggtcgagttacgactactacctggtcctcgaccagcggtgtagcgattctcccactatttccactttaagtggtcgagttacgactactacctggtcctcgaccagcggtgtagcgattctcccactatttccactttaagtggtcgagttacgactactacctgg

SEQ ID NO: 52651 - DNA, 18960 bp, Oryza sativa
  unsure (1)..(18960): unsure at all n locations
accaagccgtgtaatcagaaattaggtttttcaacttcactgctgggggctagggtaagcgcttttcaaccaaagcaggtcaagggtccaagagccttatccttcgagaacgattctccgacgacaaggctgggggctagggagagtgtatgactcaacaaactgactggtcgaagtcggtaaaagagaagacgctcatatacaaaacattagtctgtaaatttaattcattttcagttttccatacatattataacatgctatttctatctaatatttttttctaagtattgatttcaggaaaattctattcgacattgtcgaagactccatgtctctatggttctataccaagatcaactaaggcgagtacgacaaatgttgacaaggctccgtcgcagactctgcgccttctcgatcactcgagaatggttggtggacctcgacaaggaatacggaatgaagagatggtgtacccgccgagataaaatttcttgacttcaatccaaattctcgattacagcaagacgagagagttagtcctatgctctgtactttcttggttgacgtcggagattgactcagacaaaccctatactgtgcccgcacgagactgataagggaagtctatcgttatctctgaacttactgagaacggtcacgtgagctcgataacagttattccgaggtcttcggattgagaatatgaactcgttcatttgcattgaagtcgggggctactatcagggttatggataccacatacctaatagtagttgactaaatctcggcaggacccaccacataccatgtcttatatggaaataatcttcggatataggaggagttccgtataaggaagaatgaatggagttctatatgaaaacgacaaggactactcggattgtatccatattggtttccctagttctacttggacaaggggacacctatgggtataaatacaaggccccctaggaggagaggggacacggaacaatagatcaagacacaagatcaacatacaagccaacatgcgccaagacaagatgtcggatatcgacttcagagataagcatggctagtcccctacggtgtctacggatactgtcaggagagacatagcgttgtctttgatctcgccggatgcggattcgaggaggaaggctactctgttgtcgactacgagtcagcacttcagaccgccaagtcgacaacagttagataggctgccccaaatattatactggtgtgattatggtgaataagagcaacgaccggcttcggccaacaggagtagggttattacctgacaattcagtggcctgaacctatataaaaatcctcgtccccatctcttttattacaatctcgcatatatcctagtaccaacgatccccatactatacaaataccggaatcgcgatatcaaacgtcgacacagttcatcaaaataaagaaacataagtataataacttagatagcctgatgacattcaacattaaaaattcattcatccaatggacattaggtcatccatccagcagacaggagcatttcatctatccagcagacaggagcacttcaaccattaggtagagcagcaacacattagacatgaccttatctgcaggaaggaaataaaagaagagatgtcagtatatgtaaggtaaaaaatcacattacggaaaaaaataagtagttatttagttcaactgttactgctaagctatatatgaagtagtatatgtaatacacagattgtaaactagacttaaaatgatgcacgatcacctaattaacttcgtttcccaaactttagccaaatatgctcaatcaaatctgactgaagttgtctatgagcagtacaatcacgaataatgacatttctttctatcacttgttccatctctggattatggccttgagatattgtagcttctttaacagatgacgtgcttggtgtctcattcaagtcaagaggaatatcctgattcatatatttctcatcttcgattaccatgttgtgaagaatgatacaagctagcatgacattctcaaaatccccttgatcaaaaagacgtgcatgtcgttctagaatactaaagcgagattgcaaaataccaaaagcacattcaacatccttccttgccccttcttgatgttgtgcaaataatttgtgcatttatgattgtggttggcgaattgactttatgaaagcagcccattctgggtatataccatctgcaaggccatagccattgttgtattgccttccattgacatggtgctgaacttgaggaccttcccctctcaactgctggatgaacaaaggtgattgattcagcacattgatatcattgttggatccaacaacaccaaagaaggcatgccatatccaacgatcatgcgacgctaccgcttctagaatcactgtaggaacaccttgatcaccgcgggtatacattcccttccaagcaactgggcatttatcccaatgccaatgcatgcagtcaatgctccctaacatgccggggaacccacggtgctccctagtatgcactaagcattcaacatcttgtacggtgggtcgtcgcaaatactcttcgccatacacctcaatcacacccttcacgaatatcttcaagcactccactgcagggctgccatttcccaattggcgaatagccgatgtgcatttttttattggagatatccctgggcggttaagagcatccatcctcaaagtaaaatactcattccactcaccaagggcttcaacaatgcgtaagaacaggggccttctcatcctaaatcttctacggaagtttgttccattgaagactggattctctacaaagtaatcattcaagagcccctgttcagattctgcataaggcctatcaatataacttcttgtaccactccgcctggtaggtctcatgtcttgtagagctgcaacttcggacttcacttcaacaatcacttgatcagcaatatcgcccaatatactgctcacctcatctaaagggtacagatccattggatctatgctgctcacctcatccaaagaatcatcatgcaaaggggattcacttggcggatcattttcagattggtgggacatgatggtatggaagagggaagaggatatagggaagaagacagaatgtggaagccaccagagatgagttttggcgatttttgctctcaagcagagatattgaagaacacaggtgattggggaaaaatagaagcggcaagaaaaagaaaaggcgagcaggaacttggcgccaagaggattgatgccgcaccaaaaatttcgccgagaagaaattggcgcgctggacggagacgggcatggcggcacagcagatcgggagctcgagaaaaatccaggcggaagaaacgatgagttgcccccaacgctgatttctctcatttcatgcatcttggtggctgcgccgatccagttttgtgcatgagacaccgtttctctttttttttccttctctcacttctttaattaccttgccacatcagaattttacttatgtggcaggctaataaattctatggacaccatctgaggtggagggttggggatgccctaaccataaagtattgggttattagtcttccaaactacaacactcctgcttcaattaagaaatattactccctacatctacttttgatagtcatattccatcttaacacatagaccaaagataaataattctacttatcatctatttaagtatgctactaatcattcctcgtaaataagctattcattaatatttaaatttcttgatgtccatgtagccaatcttgtgtggaagaatggagagttacgcattaaatctgagaaagatattaagatgataagttgttggattgaaatatgcctatcaaaaataaatttttcagatttggaaatatgtctatcaaaagtagattgagggagtaataaataaaataagtaaataaaaaggcttaaaattttgaaaattaaacagttggttgaatatatgtactatccggaaattacacagaaaattatggttgagcaacttcttcaatggtcaaatacacaacttgttctatggttttgaaactcaaaaaaaatccttgtgctgtattctttacatatgttcttcccatttagagactttcgttgatacttgatgaagacattggagatctcgaaacctcaccactgcattacaagtatttctactggttagtggcccaccgccgttgctagacgacagatagatcaagcatacgtggcctgcagcatctctagcattgtgttctttgtgatcaacaggaaaagacgatctagttggctagaggcactctttatttatcattctagaaaatcagttagataaaatgctctccttcaaataagcaattgtttttccaatagtagtgtgatagcaggctatgacattgttgtaattctaacgtcatggtcaatttgaaaggaatagaacaatcgtatttcgaacggccagaaaaaaaaagaatggaggtggcaagtgctacctcaaaggaagccacactctagtactccttccagacgctagtctagtgtgagttttttttgtcatacaattcagccgtaagatatagcttttcacaattaattttttagagaaagatgtgttttattgatcatggaaaatcattacaaagtgtaattacaaatgataatattaaaaaaaacgagttagcatatgaaccgcgaagtttgacacgcgatagataagcagattaaaactaacagaggagaaacccaccaccatgacattgatatctaaaatcgccatgcctttcacaattattttgcaactttcttttcttcttttcttctgttcatacttgtcttcacttgtgctataatataaacttagtcttaatacgaaggtacgcaaatcttacccgtatttttgaaaataataaaaaaaaacccggagccaagactgaaattagtcgctagtcatttagaaaagtggagcaaggtttacatttgcttgcgattttttgcgtatttgatgagcctttgctgcatattttcttagcacgactacatatatagttggcatgtcggatcattcgtccatccttgctttttttaaaatgtccactcaaatgtaatattgagataagacccacgtgatgacgtgaacaaagatcgctaaatcttttttggttacggtatttgaagaggcgctatattctttatgcaactgtatacctctctctgtatacctatatatagtcgtaagatacaaaaggtgctacaaagagtaaattgcatcggcggtacacgaacttattaggtgggtgcaatctagtatatgaacttgtaaaatgctcgttttggtacacgagcttatattgcgcgtgcgacttaaggtcaaaaggacattacatgattatttttgttaatttaggtgctgattaggatactatataaacatatatatatgagaaggttactacttagacatacacctgttcaataaaaaagatagaatgagatatagtgattgtagagaaagatataaaataccgagcagtaatacaggggttagaaacatacgaaattcaagataaagtagataacaaatttgtaaatatagcatgttttatgcatactcactatgcgtatacacgtcacatcctaatcaacatcagataatcaacatcagataggtaaaattaaccttgccaagccattttggacctagctcgcacggattagatacgttcgtgtaccaaaatgagcattttacaaatttatatactaaattgcacccacttaacaagttcgtgtaccaccaatgtaatttactctgctacaaattatactcactaacctcatatgatattgtaagatataaaaaccatagaacttgaaaaccatgccttccattgtactcactctcccaacaaaatcattacacactaccaacagcactacattacattagtagatctcaccattttgcatcagtaatacaaacacaacatatgacagtcttctcacatgcactcgcacatactaacagatcagctgtaacttgtaagcagtgaagtcaaggaaagcaaaccatgtctaaattacgaattcaggcagctgacagaagtgaacttctgaacatccgacttgatcgctgccccgtggttgagtcctcgacagctatcccctgcgctccgatgcagaagtattggttcatgagcctgctgttcaaagacccgtgcttcttgggtgtacgcctgatcaccacactggtatcaggagatgcttggccattcttgtccagatggacggcttcaatcctgtcgaccaaggacgacgacgaccaggagcccgagcctgaaggcgattcgggctgcatcacgccatgtgcgaggccatctgcgaagctcttcttcatcgatggactcggtgagccgatcctggctgccatggtccgcttgttgttgaacagggagctcatcctggagtacttctgcctcagcggtgtcggggtctccccgtggctccagctcttgactgaatccacagaggatgcgtcgtcgtccagttcatttcgggcaccggatgatgatttcttctccttgcggaggggccatctgagtaggatcttgagatgtttcgctgcattttgcatagagttcagcttcttacgactggattccggaaattctggctcactctgtccaacgctagagaatgagttcgttctttcgctgatgtctgacgcatcgatacctgcatggaggaagatctcggcatctgggatcttgaaggatgttcccgggctgcctacgatacagtgcatctttagctgagaagcaatggctgatctggtctcatggtccattgaatttgcaattccaccagccaaaataagctgcttgatgagtatctcagacgatgctgttggtggctgtttcctaagtaaatccagaggagtcatgccatcattgtcccggacattaaggtcaatcaacggtgcagtcatcaagagctcaacaaggctagagtgcagattgccaatcacagccaagtgaagaactgtccttccatcgtcgttttgcatattgataatgctgcttaaatccatgatcactccaccaatcaattgcttcataagctccatctgacgatcaagccttcggaatcctggggtcctaaagccagtcagcgccatatgaaggaacgtgtcgccaacttcatttgtagctgatataagtgatggggatgcagtgatgagggctttgaccacgggcaaatgacctcgaaaggcggctagatgcaatgccgtattcccttgctcgtctgtggagttgactatatcgaaagaggcaataagatccttcacaacctgtagaattaagtaagaacatgctaatacttcagtatgcatccacagagtaacacacgacgattttaatcaataaatataaatttagaacaaaagaacagatggtgggaagacacttgtcatggcatcccagatgaacagactatttcttcaccacgcattagcgtgtcggtgaacacttccaatgacaagcatatatggatgtattataaaattccttattaggtcaatggtttacaactaaacctcagttgctgactctcaccaaacattcgtgacagctaaacacaccacatttcagtagtaggttgagaatatctgtcaatgccatctagtttccatctctattaatttaactagaacatgccatatcatgtgtcactaagaaatcatatcatgtgtaaaacgaaaggaaatctggctagcatgtgcacaagatcaacttcagggacagtcaaatcaaagacaataatgtagcagatatatatcattccagtgtccccagattagcaattaaatatgatcaaatcacctcaagaatcagaaagtttcatagattagagctgacaaaatgttaacaaaagttgcagctacaaagtaaaactaattcttctatggaattaccctgtcatgaatatttcatagataaaaaatttgtgaagcaggaagtagcatcacctcaagctgccccctcgcggccgcggcgtgcaagatcgtcgatccctgagcgtcccggaacgccgacgcgtcggagcacccctgcaggagctccctgaggacctccagttgcctccccttgccgcggcgtgcatcgcgcggttcatcatctcgcaccggaacatgaaacccccagcaatggcggcggtgccgccgtcgccttctcccccggcggagcactcgggcggggacagcaccgcgctgagcagcagccggaacacctcggagctgtcgctcctggccgcggcgtagagcacgtcggtgacgccgtactccccctcgccgaacaccagcagcggctgcctcccgagcagctcccgcacgaaggccgcgtccccggcggcggccgccgtgtagaggagccagccgccgtagcccgcgcggatgagccggttgggccggcttccgccgccagcggcggcgcccctggggggctcgcagtcgtggagcaggcggcgggcgacggcggcgcggttcctggcggcgtcggcgaagcgcatgtcgtcgtcccagacggactcgaggcggcggatgcggcggagcgaggtgagcttgatgaggaggttggcgtcgaggcggaggagctcccggacgacgtcgtagtggccgctcgccgccgcccagtcgatgggcgtcgcgtaccaccattggtcgccggtgctctcccaccggagcgggaaatgggattgggattgggattcctcctccatagccaccaaccttgtactatctcctaatcaagaaattttcctctacaaaacaaaaaaaaaaagcaaagaaaaattgcaagaacttgagcttaacacgtttccacgatgaacagagggaaatcaacaaccaagaactgcgattttgagaagaagtttcagctctaaatccctctaactaatgaattgttactccatgtgggagcaattgaaaccagagctactaaaccgagcgattaaattactggggttatcaagaactgcccatcttgggatgtcagcaattaattggactgttaataattcagccaccagcagctcaactacttatccggctcagaaatcgatgcctcgaaaaaacgcaaaaaaagggggtaaaaccaaggcggaggaaaccaagaaacagtcacaactcacaagttgctcccaggaaaaggattaattacccaagaacaaactcaagagaggaagaagcaagaaacctcatcctactctgcccagccatggcgtcattaactcagtaatccaaaccagaaacaccctcaagagaaattagcaccagagaggcaccatctctgggaccaatctagcacagaacacttgattgacatgggagcacaggcaaaggctattcacgcctgcatctacacgcttgtcctgagtaggtaggggccaagctccaaagggaagaaccccacaggaagaagacgtcacggagaaaggaggaggcaagcaatggccatgtgaacccaagacctcttcaagagaagccatccaccacatctgcctcaaccagcaaagatcatagcagtaaagacacggtccagcaaggacgaccttgtctcatctcctctcatccgctcccaaagaaattatggcaagaaccaagaatgcaggcacaagttttgcaaggaaacattaatctatgtacaaattacagggaaaaaacaagaaaccagccacatatttggcctgcttaccagtactctttcttgctgctggcttaagcaatctataacagaatcaatgaacaatttagaccatttgttctactcacaagtactactgtgagtccgtataaagtattggccccaggtggaaactttttttttacagtagctgtatgaactgtcagcgtgcgtgagcttgggttcacatgcaaagaagtgtgcagaagcagaagaggatagcagaaagcgaatcttattactcgctggccatcgaatgaatagtctgaggcagaggcaaaagagggggagaagtggattgcagacggggccaggataaaaggtttggattttttggacctgctttttggacgcaaagttcatcccggcttgtcatccttggaaagctttggtgataacctcaaagctgaaaagaacatattgatttttcttttcgttgtctttgtcacgttctaaggttggaagaacacttttttttgttcctttttgacgctgaagataatttatttatttaagtatggttcccattctgtctctttccgggagataaaaaggagtatagaatagaccatcaaattagagcggtattagtaattactcctaaataggagtactttataaatagtacaagaattcttataaataatgttatggcagtaataatatctacaaatattaggtaaaagggtagtaacatttatggcaaatttagcaggcatctgagtgagaaaatggaataggaaataaaaaaattatgtagtgggtcgaaagcccataactgttcctaagcccaattcagcactttagtgagaactatgggcttatttgttttggtaccttaccaaaattttagtagtgccaaaatctaggtaactttgggtactaccaagattttgatagggtagcatagtaaatgtgaatgttaggattagtgtcaaaccgtcaatgaagtgccaattttttgtgggtcaatttctatttggatatgtaccaaccaagggttaccattttttttttgttgtaatagctttggtactatttgttgcagaataagcacaaataagatgataagaaatatacataattaggttcattttgctcatcacgacaattacgtagcgtaaataagcacaatgttagttgtgtggcctgcttctgggcacttccggcggatgacactaccaatttactaccaatttgagcctatgcattgccaaaatttgcccaatttaggcaaattttgctacaggacactgcttatatgcggttttagccctagtacattgcccaaactcacttttgggggaaaaactccataaatgtggtaatttgacagtggacactacgccgattaaaataataattttcggttgaagagggggagagaaatcacgtgaaatgtcaaaaatgcccttggacccacgtgtcagctctcctatctctcttctctctctatcccctccttccagctcgtccgcaacggcctcgaccgcacctcccgcttccacgacgccctgcgaaccatccacgccgtcgtggcagtggctggcgatgaaggggcggcgcggcaaggcgagggtggtgctcgacgagacgtgggacaccaccggccgaggccgagcagcggctacacgagatcgaggacgtcgtcgctgctagctccatcggcagcaacggcgggggcgcgcgccggcatctggaaacaaacgatcgaacacatcaccggccgtcacgtctctctctttaaagcacgcacacacacatatggatggatcagcagctatctgcacaagcaatagaaatacatcgccagcgagaacacgaactatctgcatcgatggcggtggcgcacttcgtgttcgtctcgctcatggcgcagggccacctcatgctggcggtggacaccgcactgctgctggccacctgtggagattatggataccccatacctacacggcatgtataatccgattgggtatagggagccatgtatagatagaatatctttaatgaggcccgggttaagttccaaacttgtgtgttaaggaagtacccgggatcctagtcggttacgattaggtcatatctgtaactacatattccgttagagatatgggctgtattttgtaatacggactccttctcctatataaggaggggtccgggtgcctcttggggtacgagattctactctcagatcatacgatcaataatacactcggcggatgtcacgcccagaaattcactagtaatttccgaacttatttgtgcataaaaccctcgtccaggaatcagccgagctacacaaactgacaatttaatatacaaatccatcataataataacgttacatacttagaaattgtataaaccaaacgtctagcgatggctttagctccactcccacaggcagctcaactggggtataaaccaaacgtcttctccttctggatcctttttcttcaactgaggttgattgattattgcaagaatgagcatatgacatactcaacaaaccacacagcaaatatgcaagtgcacaagaataccaaaggatggcataatataggctcatttgcaaaagcagcatttagcaaatatttaagaatagtaaaacagtagagtaattaatcatttttaataaacactgaatagcacacccatactgctcaggcccaaccatcctgaacaaccatacctggctgtacagatctaactccaaaccaggagctaagcaatttattaccatttatagcatcaataattattgtgagagatgtgagactaatcacgaaaaacattgctcaacccacccatgaccgcaggcacggctattcgaatagttttactctggccagaggtgtaccactgtacccacaagacacagcctaaacatcatgtctactatgcgtcgcggatactagaaagtatccgaatagaggctgtgacaataccctctgcacaacacaactcaccacagtgcaccgttcctggatcataatcaccccctcaataaccaaaggcatggactccccagcgacccccacggacttctcgccgcttcacagtctgacaccccgtaatgaaccatgctatacaaaaggtaaagccgttgcccacgctggcttgtggttggtacggttaatgtctcacaacagtagctcgcgaaccggtccttaattgccataagcacgaccatcaaaaccatgtgctcacaacccaccattgacaagttttaattatcaattaattaacataacacgattaaccatcgtgagctaccattaaatataaccataagtaatagtgaagcatgatttatcccattaatgagctaatgtttctaagcatggctaagcaattatatatatataacatttgctggatcaaaccaatatataaggttctagctaatcaaattataacccataggaaaataaagtcatcttcggccataattaaatgggaaaggctcaccacccggtgacattcgaaaataaatgcacagttaaaataaatagagaatttaaatatagaatcaacatgctcaaaggaattgtgtttgggatctgtgtgacttgccttgcaataattgttcttcaattaatcttcttgaatgcttccggcgcactcgcgaaccttcgtaacgacggaaacgacaagctaacacgcaaaacggagaaaaagactaataaaaaccaaataaacagtacatgaaaagtaaacaagcatgtagatcatgattttagatgaattatgagacttgaactgcctcattccaacttcatatgaattaattacaaattttacaagatttaattccaattaaacctattaaagaaaagactattccaaattaattaaatcatttacaaatgatttataatggagataaaagattaaagcaacctccggaaaagattagatcatatttggtagatgacatatattaaaaaggaataatatgccattgaaaaaagagaacggatttatatcaattttggattgctgagattaatcttgaccgagtcgacgaagattggatggcttggattgatctggcaagcgggcctcatgagataccgactcaacgagtcaattctacgtgacacgggatcacccaaatgatcaaccgaaaccggcgaacggaaccggtggctctgaacagctctaaactaaaggacgactccacacggatgaacgaacgaagcacggggaacacctcgttccaacgaacgagcgaacgactcaacaacggctgcggctaaaccggtgggctagaaacgattcacgataaagccccgatacggcaaacgataggccggtaggaacctagagttgcacctatggccaaggttgtcagtatcccgattcgtatccaagtatcttacgatactacgatcctactaagccgaaacgataccgatcccacctagtatcctaatttttatagtatcttgatcctactattcattactacacgatcctacgaaatcttaggtggtatcccgattctacgatccctacgatactacaaaatattatttaaaataacatggtttgaaaataatgtaaataaatatgctcaaatttatataaaattcagttaaatatatcaaaaccagcgtggtttctcttgataaatatctctatttgcatgacatatatcattactacattttttatatagaatggctatatatataattaatataaatattaattaaacttaaaaaaagaaaatatcatagtatctcgatactacgatacgatcttacggtacgatattactttgagcaaaacgatactacatagtatcccgatcttgacaaccttgcctacggctagataactcgactactgagcaacgggataaagcggcggctaggtttaagcggcacacggctacaacacggcacagcagcgacggcacagcacgacagcaaggcgcagcagcggcagcgactcaacaacgacttagcaagacggctaccgagcggtagcaatggctctgctaagccaggaacgcggcagcggtagcgatgcacgacagcggcgcggcgactgcagtacgtgcactagggcagcggctacgcggcggctagcagcggacaacagcgggtgcggtgcacggcaatgaccggctcgacgctagggccaaataagattagattaaattggattaagtccctagggataaactacaccggtaaatgacatgggagagaggagagctcaccggagaagacgacggcgacgaccaagatgacgacggcgaggggtgacggctagcggcggcggcgagctagggcagcggcggctagggtgctggaggaggcggctaaacaggaggaggaggaggctaggggcggctgcaacacaaaaaaaaacaggaaacaggaggggagaggacggcttatataggggaagattgaataggattaggtggggccaagggaggcacggcagaggggggaggggagggaaggcgtgcgcggctgggagaggggagaggcgcacggctgggaggaggccgagaggaggaagggaaaaagatacgggaggagaaggttgcctagaaaggaaaggtgggggaaacagatgcggtgccgttttgggaaaggaagaggaaacgaaaccagaaagagaataggactcggctcgtcatacaaaacgaaaccgcggtggcaaaaggggtcggcggatacgatgaaccgcggacggggagagtgaaccgggaaggattgacaaccaaaggaaggaaaggaaagaattattaattaattttccaattaaattaatcactgaatgatctttcaattgttaaaaatacttccaatgctcaaataatttcaagaaaaatcctgaaaatacttggacactcaaagtacttaacaagattataatcagaccatttaatgattaatttaatttgtgggtaattactgaaatgttctttgtatgattaaaattaggaattgagctccgaaaaatccgagaaaatttcagagagtataattaaccacggagaatttaataaaaattaaatccagccatgctttatatttaggaaattttatttcccacatttaacttcacatgtaaattaatgaacatttaatataaattctaataataatttataaatcctaaaacgaaaatcaggatgtgacagcggatcaaaccccggacaagagtagagtattacttcttattaagaaggtttgaacttgtataaacttccttgtctccaaacccatccacttttctagcttgatagccacccccttttagtattgccgaaatcttgtttcgacaattggtgcgccaggtaggggtagcgtcaagttttttgccaactagtgcgatgggtttcgtctccggcatcgacgacttcgtcttcccacccgggcaggcgttctggttcggcagcctcgacttcatcaccaatgacttcggcaggatttctctcctcgactcggagccgaaccagtcggggagaggctaggtctccaccccgttcggtattccgaactcggccgagatctaccccaagatcatctcgattgagtcagccccaaaccactcggacgaaatccaatctactccaacacgacctgatcaagacgatggaccctatccctcaatcctgatgagactccccgatgatctggccgctgtcttcaccaccaaggcatcttctccccgaaggcctaggcgggatccagcttcggcttcgatccaatctaactctagggaggtcggtgttatactccaacctcttgggatggtctcgacggaagaactggacggctacctcagctcccccggtgtcagttctcgaccaacggagatcctcgagtacgacgacttcggctattactacgactacggtaacttcgatgacttcgacgacagctacgaggacgactacacgcctctctttttcggcgtattcatggccgacaacgagacggcagaacagcgccgagcccgagaagcggaagaagaacgcacacgacaagaagctgaacgttaccgactggaggaagaacgacaacgacaagagcgagaacgactacagcgtgaacaacaagatcgcgaacaggctacgaagaaggctgaggatcgacgacagcgcgccttggaatctggacgacgagcacgagagctcatcgggcaacaagacgtcgaggggacgacggtttttcgcaccccccaacagaacgcggttgcagcgatcaccctcctcgacaccctcctcacggaagacacactcaatcaggctgattacgtcgtcaacatcttgaaccagaccaaaaccatgatcgccgcctcggtcccagttaactccacgagcacccgcacgccgaccggcaaccgagttccacctcttcgatctcaagactatcaccaaccaagcctcagtgtcgtcggcgagggatccaatcgcaggagtagggatcatggcaaacgatctgtccactcgccccctgaccagcacaaggagagtcgagctgaacatccctgcttcccacaccgtaggcatcccatcgatcttcacgagactatcaaccagcgccgggcggcaagaggctacaacccccaccattcaccaaatcgttacgatgatgatgtggatggagttgctgccttcacaagcgacctgcatcgagtggattggccggctggcttcaagccgactggaatcgagaagtatgacagcaccactaaccctgagtcctggctcaccgtctatggtctcgccatctgcgcaacaggaggagacaacaaagccatggcaaactacctgcccgtggccctagcagattctgcccggtcctggctacacgggctaccccgtggcacaattggatcttgggcggagcttcgcgaccacttcatcgccaacttccagggcacctttgaacgccccggcacccagtttgatctctacaacgttatttagaagcccagacaatccctccgagattacatcggacgtttttctgagcagcgcaacaagatctccgaatcaacgaaggatgtcatcatcgccgctttcaccaagggcattcgtcatgagctctgtcacgccccgaactagtaccgaccggaactagcccgtgacgctccaaattaacctgttaatcgataccagtcccaggaaacagtgctggtatcacaggaagacagattatcacagcaacagaggtctctttattatagagtaaaggtacagtcatgttgggctgcggacagatcccgagctcacaactgcattacaaaagggaagcggaagccaatacttggaccaaacaacacaggcgcgacttgggaactaggccgaaaccctaaaactcatcatagccggcttgctcctagaagaactcgtcatcagcaggatccgcttcatcttcttcagcaactgggggggaattatttatatagagcaagggtaagtacgggagtactcagcaagccatgggaaataagtgtttaatgcaggcttcaaggaaaggctgttgtttttgcaattgattttatttgaactcttttctgtaaacaactaagtgagtgcttctcaaacgacacggatgagacagtgcgtctcgtccggtcggagtatgtacaatgtatcagtcttttgaattgttcaagattggcacccagccaacaactttcaaacggccacccgggccaacaactttcaaacggccacccgggcctagctgatcccatcagctgcagattttccaaacatcgatccccttttcacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacctggatcacccagcccgtggggatcagccacgtcgggagacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52652 - DNA, 806 bp, Oryza sativa
aagatccttcttcgatcagcttcccacttatcaaatgcaaatcttctccatgatagtagttgactactttcttaattagcgtgtttacatatccgtcactaagatgttttgcacaactagccaacatatacttacatgtgcataatgcacacacatgtactagtataatatcatagaagatagactcattttacgtccttcgttataagttattatatatatatatatatatatatatatatatatatatatatatatatatccttcagtattggtagtaataatgatcgagtagcgagcattgtaaagagagtctattaactaacacaacattatctttttacgagttactcatatgtggatccattatgttatagcctctcaaagtttctcaagcattggaacagctaatcatagtttgtcgcgacttgggcatagtatagggagggcagccagctgcaggaaggatcaagagagaaggcaggccaactggaactgtgggcgattccttggtgccgctagccgccgcgccgcctgctttattttgtcgattgtcgatcagtctgcccacaaacgtcacccatgtactgtccatctactgtacgtactgtactgctacaatcaccgttactcagtggttctacgtactactagtactatacacacgcgtgacacgttcctttgcatataggagtactactgtacacaaattcttactgaaattaatagtacagtgtgtgttcctttgcatatattccctccctcccccataaaaaacatatttttgagtttatatgttcaacatt

SEQ ID NO: 52653 - DNA, 36552 bp, Oryza sativa
ccgccgccaccgccccaccgcgccgccggccgcctcgccggtgccgttgacgccctccggccagccggcgaggcgggcggcggcgcggtggggcggtggcggcgggggatcgcacgcgagagacgggagtagcggtggcggcgcaatctggatgggggaggaggagaggagttagggttaagggtctgcatgaatcttgaagcatatccaatggtccaaaatttgaaagataggaggtgggattttctgtcaacagatgtgtagacagtcccagtaagtaaatattaggctctaatagtaccccttctcttcctactttaaaatatgtattcccttctccgtcattctcactctccacgagtcggaaatcattctcgccgactctagcacaagagaaatggcgaacaggatggtggcaccaaatcgtgtgatcttctagcttaggtacggatggagggagtccgacttctattgctatagctaggactcacgttttatagtatggacctaaaaactaggtcctgatctttcaatagatattgataactctcaatttgatagaaacttgacacatacgatcccgttttcgatcaacacgatccgaaccttgcaatcacagcaccacgtctcctctggttatcaaccatgcgctgttcggttgacctcgctgagaaggctaatccctacgggtgtttcacctaggcctctgaactctcaaaatgtatttttgggtccctcaacttgtctcgagtgtcatatatatccaaacaggcttcaacccgctccatgtgctgacgtggtatgccatggtggcgcgtacgtcagtagaacccatatatcagtcacatatagaaaaaatcaagaacatatttttctcctctatttttttatttttttaaaaaaaataaaaaaaatccctttctcttctctttataaattttatttttttttctatatggctggcatatggatcccactaacacgagcgtcactgtgacatgccacgtcatctcacaaagcgggttggagcccgtttggacatatatgacacttatgacaagtttgagaacccaaaaatatatttcgagagtttattagggatctagatgacacatccgtatacaagtttaagaaccgtacgtgtacttcactactcttaatgtttatgatatagctactactgtctgcttccaccaatcaccgcgtctatttttttaccaatcttacttctaatcacccctccttgctcccactgatccccaaccatttctcatgcattcaaggaacaatgatgcatatgtgtagagatgcatctattctcgaaataatttagagctatatatgtcgatagggacaagataaattgatgatttgccattttttggatatatcttagtgtttatatgcatgtgttgtgttaattacaaaggttctatgagttgataaactagcgtgtaggttgtacttgtttgagtttgaccgctgagctcaaacagaattaagatgcatacatgatgggcatgcatcaattagctaggttattgctttgaaaagtaagttagactttggtaggaacgtactgggtgggtatatatatatgcaataattcgaaacacggatgctacttccactaattgaagaatgaatcagtaggcgcgtcttcacacacttgcttcaatcggtcggatatatataggcatgttattatgattttatcctggttttcgttagcacattcaaattattaaatagaataaaatctttctatataaaagttatttaaaaatatcatataaatatcatatatatcgtttgtgcttgtctactcccctcccatctcctctgtcacatatggctagagggaaggagcccgacggtggaaagggtggcggagacggcggctggcagcggaaggtgtggcagctacggtttcggccggcctcctccactcccctatctcccttccctctcctagatctggccggatgggatgaggtcagcggcaactgctggggcttcggtcgggcctatccactcccctcactctcccaaatctggtcgaaagggaggaggtcggcggtagcaaaggggtgatggcggcggcaacaggggcttcaaagggctccttcattccactccactcccctccctttcccagactagctctccctctaccagatctagctagaggggaggaggacgattgtagctgcggccggcagtgacaagggaagaggagcaaatggcggcagcgcagtggagaatgatgacctagacgacgacaacgacgatggcctcgatagtgcgcaacggcgacggcaaggctcctggatctagtccatcgcggtcgcttgattgtagttgttgcttcttctttttcttgtgaatttttgttggatttgtaaatacaaaatattttggagtagcttgatttgcaaatctgatgaaacgttcttcccattttctctttgatttgtggattgttctatgaaaattgatgtggcaatgggcagacaaagggcaattgtatgcccccccccccccatgagccaagtggggaaattgatttctacaggcaaccgaaaccatcctctagaaatacccgatttttgtatgtcttaattcgcaaacaatgtatggccgaccgtgtgcgaaaacctgttttgttcgcatacgaaaaccttttctctcgtagtgatttctacagccggctaaaatggcatgtgtccatgcgtataacatttttttcctactgtccaagaatatataattaggagaaacgtacttaacagctagctagcattgtttcatgcatatattagttgaagaaaaaaaattgcatgcgtgcgtgcatatagggatcgaaattagccagtgtcaaattaacatacatgaccgatcgatcgattcccgaccacgatcgagctagcacatatatgtccatggtgtatgtatctatcatgtttaacgacctcagctagctgctggctaacgtaccaacaaccagctgctgtccaagtcaattacatgaagctgatgttgatcccgatcgatctcgcatgcatgtactcatctttaatttattccgatccctacccggccgctgctgtccattaattatattctttggttagttagatgatgattatccaaattatttcagtctcttctctagctagtatatattacgtgtgccaaattaatttaatcatgtctgagtagtaaaaaaaactgatatacagtacataattgtacttgagcaaaagaaaactaattagtaattcattcagtctatatttttactacggtcgacatgcatgtatatatgctttcaattttaatttgttatattagttatatataacaattatatagcaaattataaagaaattaaatttagtgcatcctagttcgttttccgcccggccctccaatatacgtagtatatatagtatatgcttggcattgagagttatatatagttggggtgcaatgcaaggaggccgtgcacgcgtgcttgcaagcgacggatgcatgatcgagatggatggatagatagatagatagatagatagataggagtatgtgccaagaattcaacttagtagctagccaagactacctccggctcaaaatatttatatttctaaaaaagagacatattagctgtacaaacaaattaccataataatcctaaaaatatagaataaagtaaatattgagacaaatggagatggaaatataggagggggtagaaggtaggatatttctaattgggtactacctccgtccttcccagaatataacaatttttggctaaatgcttatattttgggacggagggagtaggttttatcttattacaaatacaattattttaggagaaaatttaaaaagtagaaatacaattattatactccctacattctaaaatataagggattctggagggatgttatattatgcgacagagggagtaagaagcagtagtcttctttatagtgaagcttaattaggaacatacatacatatatatatactagcaaaatgcccgtgcgttacaccgggtattagcggggtgtttgaagtttgatattaatgatttaccaaaacaccatagtatgattattagcatcggttatatgtacagtgataaaaatgatgcccgtgcgttgcaacgagtgaagataattttaatcatgtatagtgttggacaaaaatgataaaggaatcgtaatcataataataataatgaaatgaaattgcagtgacatttggaaaaaggataaaaatatataattaattttccgttaattccattagctaaaaataatttaatatgaagtaggaaaagttattctcaaattttagcaattttcaaaaagcttaaatagagcaaactaattttgtaaatgaaaaaaaatttaatcgcctaaataaaacaattagacctgtaattgaaaatctgttggccatctcgtttaaacatgagcctgcgggtgcgtgtggtcacacaaattggaaaataacatctagccccatgccccatctgtcagcgcatttgatgctacctgcgaatttatacatcttttcggtgttactgagcaaagtgtgatcattgaatgctgggagaaggggtggagttgtaattatcagcacctgtgtgcaaaatacaaatgttctctcctctattggaaaatttatttataggaaagcgatacaagctgagtagctgatacatttatttttatcttcactaaaaagttcatgtgtgtgatacatttatttttatcttcactaaaaagttcatgtgtgtgatacatttctttttatcttcactaaaaagttcacgtgtgtgatacatttctttttatcttcactaaaaagttcatgtgtgtgatacatttatttttatcttcactacaatgttcatgtgtgtgatacatttctttttatcttcactaaaaagttcatgtgtgtgatacatttatttttatcttcactaaaatgttcgtgtgcgcaatacatttctttttatcttcactaacaaggtcatgtgtgtttataatgcttcctatttgtttagttttgccttttgcttttttcacctttctttctagaagctaaatataatataaacaacttttcttgttttcttcaagcaggtttctttgtctgatggcattattcaggaaggtcctcagagaatttcagaggcagctatacagatctctaggtgtcgtgtagcggattttctgaatggacaaactgggtatgatttactcccagattctggcaaggtatggaaaatgagctcgtcttgtatgaattttagtgctctaatggttattcttattacattatatttacaattcaggtcattgctctagacgttaatttgcctgtgaagcaatcttttcatattcttcatgaacaggtgactatgccttcttctgctagtttccctccaatctttcattcttcttctgctctgtagcctgtttccctccaatctttcattagttgttctgacattgaactagtgatattttgctttgatctgtaaatatagtggaataggtacatacctttttagtaaatatgttggcctgttgttgcgtacaatgtttggtttcattggcagcttcaattcatctgagattgcatgaaaatggaaacactgcagcctcatgccttaaaagttgcagctacttcacctacttcacacttcttgtacaacccaatgttgcatccttcctcttgtacacatcacctagaatgcatgtggtcaacctttaaaagcttgaaagagcactatatatgtaaaaacattcactttaatttattaatcgatacatcatcaatggggtctaatttttgttaagatttgattagagcaagtaattgtcaagggtgatgattgatgtgtcagacatccaatacaacaattagaagaggttggaggaagtaggttctattctgtttgcactccacaatttccatataggttataagaaagttcagctctgtgctttcttagctgccatcttgattctgatttaattatttttggcatcttgatataactggaaatttcatagtttctttaaccatatatattgaagtacaagaaatattggctggttttgggaacatacattaaataaatagtgtaccttgcagggaattcctgtggcacctctatgggattcattcaggggccagtttgttggccttttgagcccactggattttatactcatattgagagaggtaatttattctgtcacttactgtttggtgttagtattctttaattatttttttatgtgtcattgttgttctctattgtatattttttattgttacaagtgatggtttaatgttcatttcaaatatgctgccacttttagtggccctgcaaaacgaaattgcgcaattcttgttttttttttttaaaaaaaatctgaagcagtgtaatatcattctttgacagtattaagttattgacctagaagcttatttcacatgaattataaagacgactggttcattaatggaatgtgggagtctatgcatttgaacaatgtacctgcttgtaatcccgattctgctgtatcacttagtaaccatgcatctcatggaactttgtttgggtgaccacaagaagttcagccaagatagtgatcatgttgaactgtttttcccttaattggaagtgttcagttagtagaacctccaaaaatttgaaatcgtatcttttggaaggtggactctagaaaatagaaataaatatgctagtagtagcgactgcatcatgatactttatttttatgctgtttgaattgtttctgcttccaggtaaaggattattaatcctgaccatgtgatttgttacttgaaacaatttgtgagcatattccaacagagtagcatttaatatcttgtttatattgcagctggaaactcatggctccaatctgacagaagagcagcttgaaacacatactatatctgcgtggaaggaggccaagcgtcaaacttatgccagaaacgagggttcttggagggcaaatcaccatttagttcatgtgagttgtccactgtgtttgtgaaccaattgcaaatctgtatgcactcaccacaaattgagactgctgccatcaacttctatctatatttactggccaaattacactccagtgaattttagaattcatgtattgcattctaaggataatattttaccctttgatttatttgcatttgacaaattgttgtcaacaattgttgtgtgagtaccacataacagtttttggcacaccatgacacacatttttgtcataacattttttggcacactatgacacattttactttttgtgttacaactaagttatctactggatgctgaaatatattttgcttaattagctttaattgccatgctcaagtgagttacttagtgaactgcaatttgtttggtgtgaaatttcatcgaaccccttgcatcaactgttccttttcatttccatcctagtattttataacatgcttagttttataatgatcatgtgtctcatgcacttatgctggagtgaatctattgtttaggccaccccttatgaatccctgagggaaattgctatgaagatactgcaaaacggtgtttctaccgttccaattatgttttcctcatcaccagatggctcatatccacaattgttgcatcttgcttccctttctggaattttgaaatgtaagtgtttctatgtatttgcatgaaaagtgtgctatacacaaacatattacatgatagcttaacaacatttcattttcaggtatttgtagatattttaaaaattctcaaggtaatttacctattttgagccaacctgtatgcacaattcctctgggtacctgggttccaaaaattggtgatcctaatggccgtccattggctatgttgcggcctaacacatctcttagcgctgccctgaatttgctggttcaaggtatgttatctgtctgttttaccataaccaatgcctgggaaagtacttgcatttctgtttcttggtgcaattactgaagtttaatactaattccactgagatctcttacagctttcgattatttacgctatcttgttgccaaattaatgtcttattacaattactctgtactctaattgtttcattcagctggtgtgagctcaataccaattgtggatgacaatgactcactgcttgacacatattccagaaggtgcccatttgatactcaccattctttgtgtagtcatatactattctttggtccatgtattcattgtgttttttccattatgtagtgacatcacagctcttgcaaaagacaaggtgtacacacacattcgcctagatgagatgaccattcatcaggtatgctagtaaatatttaatgcgtcttgatttagtttgtgtctggaattttagctgggatacagttgtacaataatttttgcagagtttcttttggtcttgaagactggttaacttagaaaataataactttactgatttatgtatatgatagggaaatctgtatcgatacctgcatcacacatatatactatgaggacatgcctttgtggttctggcatttattagccctgtgtctttttgcacgcagagcatggagcatgcacacacatctaaaacaaaggctgtaggctgtagtttgatgtgttttgtccatttatcactcttactttccataccggtcaaacaaacatatactataatagaataagtagtgcaatgctgtttaaagcaggctttctcgtgaatttgtgtatatgttatccatcgagctggtgtgatttttggtgtgaacctactcatttttgttgttatgttcaggctctgcagcttggacaggatgcaaattcgccctttggattctttaacgggcaaagatgtcagatgtgtctccggtctgacactttgttgaaagtgatggagcgattagctaatcctggtaattatctgtgcctagatatgcttcctgaaagcaacttttcgggttcaacttactaatattttttttttgcattttatattgttggtaggggtgcgccgtgttttcattgtggaagctggtagcaaacgtgtggagggcataatatcactgagtgatattttcaagttcttgctgagctaagtgaaaatgcccgagccatctgtgttttgttctcacaactgccggagttaacaatagcagaaaaaaattgtgaatctccaacatcgatctctctggcttttggatcagacaggtgtcttttcccgataatggccaaccagagtctgtaaagtcttttttttttcccttgccccttcgttaccaaaatgtctggtgatttttatttattggattgttttgctgcttgctcggtttctgagccccccaaggagttagtagctctgttgaaagggtgggatgggcgcttagagacatattttagcatgaatcatcatcacagggaagtaagaattgaaggaaagaggggatgctctgaagcaagaaggatgaattcaatgtgttgtttttgctcaacaaccgtttttttggcgggcagtgttgcaaccatgaaaggagaaattacagtcggctccttgcttgttagacaaaaaaaaaaaagaaaaaaaagaagagaaaaactattggatatctgatgatgtagtgactgagaagcaggagtggagttgtgtaaaacctgtaccacctgatttttatgtctaaaccgcagcttactcattttccttgtctatgattcttgcttgcttgtgtagtgaatagtagtttttcttgtctggtatctctctctggtagcggcgccgacgtgcggaggctgtttgtacaagttgagccgcatgcaatgcatgttgaggagcaactggaaatcgatttggaacttcattgatgcgtgcaggtgaaggtgaaggtgaaggtgcaggtgcagcgtgcggtgcgtccttggtccctgtcgagtaacggcgacgggcttggcgtcgagcggaaagatctagagagggtgggttacgtcgacagacactggataagatcaatccacatcgccacattactccgcccttttagacgcttgtctgctgctgctcatcagtagttcatcagtagtagtggtaggggagataattcgtcgttcgttttgtgcatccatccagaattcgttccagatccagccagccagccatctcaagcttctctcttctcttgttattaagagcaagcaaacagtagtctagcgaagcgagactgcgagagcagagcattgttcttcttctctagctattagtggtggggaataatggctcccgccaccaccgcagcaatggccctcgcgccgcctccttcccatcaccatcaccatcaccatgtcaagcagctgcagctccctccgtctgtctccgtctccgtgcccctccgctccggtttccttggccgcgcactgcctgctgctgcccacccacagccgctgctcgccgccgagagccgccgcagcagcgccgtgtccgtgcggatgtcgtgggacgggcccctctcctcggtccgcctcattatgcagggccgcaacgtcaaggttctcctctcctactgctaccactagtttgcttccctggaatttccttcgtttcatattataaggttttctagcattactcatattcacatatatatatatatgataatattctagattcattatcatatatatgattataggtaatgctagaaaatcttataacctgaaacagagggagtatatataattcggtaatggaactagagtatttgttttattaattggacctttatgaaatactagtagaattcaacgaaactacattcttctttattggttatattagtagtaatttgcttcactagaattctattttatactagagagattaaaaattattacaaaactaactgtatacccgttgcaacggaatagtaatatggacctattacttattactacctccatattttaatgtatgacgccgttcactttttgtccaacgtttgaccattcgtcttattaaaaaaaattatgtatctattatttattttattatgacttgattcgtcatcaaatattttttaagcatgacataaacattttcatatttgcaaaaaaaaaaaacgaatggtcaaatgttagtcgaaaagtcaatggtgtcatacattaaaatacggagggattatatgggatagctacagtagcagagtcatgataaagtagtaatgtgttgggaggagcggtagagcgttgtgtggaaaaataaagatgggaatggaatggaatgaaaagcgtacgtgcgtggcgtggcggtgcagctgaatgagaaggtgaaggagcacatcgaggagaaggcggggagagcagtggcgaagcacagccagcttgtgaaggaggtggacgtgcgcctctccgcccgcggtggcgagctcagccgaggtcccaagatttgcaggtgcgagatcactctcttcaccaagcgccacggcgtcatccgcgccgaggaggacgccgagtccacctacgccagcatcgacctcgcctcctccatcatcaagaggaagctcaggaagatcaaggagaaggagaccgacgtccgccacctcaaggggaccaagccccccgtctccgactggccgccatcattgctcgacaacaacgacgacgacgcccaggcccagctcaaggatctggaggaggccgtcggcgccgaggacgaggacacggtgctcaccaaggtctgcagtctgatgcatgatcaatgcatataaatcaaatcattcatgaaccaaattaatgcaactgtgaatgcaggtggtgcgcaccaaggtgttcgagatgccgccgctgtcggtggaggaggcgatggagcagctagtgaatgtggaccacaacttctacgccttcagagacgagaagaccggggagatgaacgtcctgtacaagaggaaggaaggaggcttcggtctcatcgtccccaagggagacggtcatctccacaaggagaccatccccaactctgaccaccaccacccctcccttgctgcctagcctctacacctcctgcatcaccatcctcatttgctaattatttctatgcttgcccaagagtctctaaatattactagtattaattaatccaagtgatgagagaggtctttgattttgtctccgtgtacatcgatcgatcgactcttgactactctgtttaaccaactgttttcgatatatttatattattaatgatttttccaaggtttttactctgctttatttctggaagctgcatgtatagcttgtgcttttgctgtattattgcaaattttaaaaaatatatcctacatcttagccactcgatcgagaaacaactgaggaagtccatttgtacctgtttttgaagataggagaaacgttatattcagtttttactgttgacagagttgattcgatccaaatcgaagaggtgaggaatgtacaatagacttattcatgggtgtgtaagttaataaataggaataagttcaccagaggtcccttaacttaaccgcgagatttttcgaggtcccttaaccacaaaaccagaaatgtgtacctctaaactcactgaaaccgttcaaaggaggtcccatagcagtatttttgcccggttttggtgacgtggcattctagtcagcaaaagaaattaaaaaaattacatgggacccacatgtcatcagctgcacatttttttcttctctcttcttctttctctctcctctcttcaccggcagcgggcggcgatgggtgagcacgggatgcgggcggcatgcggagagccagcggagtgggtggcgaagctggatccgcatgtgctgctggcgccgccgccgcggcagatgaaacaactaaccgaccatcgctgcttccaggggcggagctagtatatattagggggggtgcccaggaacccggttaagaaaattttttagctataccttatctatttttaccatgtatgcacccccctcaatgtaaacttaggcacccgcataagcttaaactcgatctaaagtagagtaaattaagcaagtggcaccaccctccatttcgctctagctctgcccctggctgctccgcctgtctgctacgcccgtcgaccgctcgccgccgcgctcgcccgcccccacccccgccgatgggagcgaggcggccggccgcgccgacgtgagaggggcagaggcgacggtggcggcgctgacgggttccttcccctgtcgctggtcgctgaccggtcgggggacgacattgacgccgtgttcaaccccgaatggcgccgtacgattctactgcttgctatatagctcaacgattataaagcttgaaggatgaattgaagcttcgcttttcttgagctatatggtgtttctttgggttttcttctttgtaggtaggtgaccaggcgctgtacaatgggttcggggccgccggaatgcatggcgctgccgtcatgcagccgccgacgttcgggcaggtacgcggccaagaaccagtactcccgtgggttcaacttcttccccaattcattctgcttctttaccagcgttggaaacaactgcctgcctgccgcctccgcggcgctcgtccgccgtcgccgcgctcgcctacccccgccgctcatgcctgcttcgcttgccaccgctgcgctagcccgccgtcgccccgcccgtctcggcccgtcgaagaagagagaagagaagaaaataaaggagaaaagagaagaaaggggaagaaaaaagagatgtggggccacatcattttctctcactgacatgtgggcccccacatatttattttattatttttactgactagaatgccatgtcattaaaaccagccatctatactgccttagaacccaaattagatggttttgtatagtttaggagtgaagatttctggttttgtggttaagagaccttaaaaaatctcgctgttaagttgagagatctccggtgaacttatttctaataaatatagccattagtgggccgcctatacgaggcttattttaggctataaacgggccgtcattatgatcaacacggtccatcgccacgcatgctaagcaggctgattatgtgtcttctatacgttatgttactgcacgctcactttaaactgtcaatcatccatcattatagttaggcttatctcatattctcatgcaaaacaagaatgttcaacatcacccactgacaatgtactcacaaaacacacgtacacgcgcacgcccacacacaccaacacacgcaacgcacgcacgcacacacgcccccccaccacacaacacacacgcacgcacgcacataaaaacacacacacagacaattgcatgtttcaaacattacaatcaatccgcaaacgtttagctattattttctacaatgaaagcagcatttaattatcatgaaagcaatagtcaattcataaacactttattccagcactggtagggtgtataaaaatgggacaatagctaaaggtaaacaatgcactattattcgtgcaatgcatctactccctcagttaaaaaatgagaagctttatccttcaataccctttacctaccatcactcttactacttttattaatgattaagggcattttagtcattctcactctccactatttccaccttgggatgctaggaatggtttttttggacggacggaatataaggttggaacagtgagatgtgatatagtaaaatgttggactacgcacgtgcctgggatgcgcacaaacgcattgagaccagcccacgtgcacccgactcgacccatgctctttctcttccgtttctaatcacaatcatcgaccgatctccatccgagtccacgcaggcatttagggtcgaatacaagaaccaaatctattagaggagggtgaatggtaaaaacattaaaaaaataaatccttttatggaattaaaagaacctcaaacctaataaagttgtgtccggtcagaccgcgttgtagctgtcggtcagaccgctcttggttaacaaatctgccgacatgctcgctgtcgctagtgtgatcgcccatttatcgtcggttagaccgctcgcatgatgccggtatgaccgttgggaccaaaaaataactttattgcatcaaaatgtgtttataaagtgcatccaaaacacttagctctcaactcacgaactagaattgaagcctcaaagcaaaccctgactttcctttccaaaaagtcaagatacttaagccacatcccctcttctatttataccaaaacatagttgtattttgccacaaatcgaactataattaggaatcctaatgacaaagcaaacccttcaaatcaaggaaacaacatccctatacaactccaaactcagatctcctcaaacttggaccacaatccaaatttgactcatctttccatacgcacgcaatctcccttatatgccatacgaaaatctttatcctcacgtgcattgttctctagccttagtatcccacaaaatctcgttaaccgtctagacctcaacttctcccaagctagttcagatccatcactagcgatactatctgaggccttaagcaatatatgcacatgaacaacaagagaccatatccgagcataaggtcgcaccaacttaattcacatcagcacacaacaatatcatatacgtatagaaaccatctacaaatcataaacatgaaacaatatagaatatccactaaaataacccgaaattgactcaaaccatacatcaccccggtctgaccgttaggctgcccggtcataccgcacaaacacctcatgtccgataagtgatcactgccggtctcatttagagacgtataccctgttcacggtcagaaaacacttcaccgtgtttttcataaacacttacctttgacaattattcatcacaaatattaaaccatcatgatttcacatagtagtgagctcagccccacgatgtacctcattccgatggatctatcccaacgaccagatttgccccctcccccccaacattgggcataccccgccttacctaactggtcgatcgatcactggtgttatttttttaataatagaaatggttattagtggcgctgtttccttacatgcatctcctctctcgtctctgatagtttactccactagataggctgccgccacacttgcctactaaccattgtatcttcctttcctcccacggaccctacacatgtggtcgaccctgcccaatttccttctctctcctcgtagctccggtactccgtccatcacatacaagtacattgtagcctatccatctccgccacccacacctacagttggccaaaaggcccgtagtccgacggtccggcccacaacacggagttttggtccggtccaggcacgacacgactcgactgttgtcgggcctgtgctagcctgactcaaccgttgggtgttggctgggcctcttccttggcacgacgtgccagcccgacacggccaacactcccgcatgccatagcccgtcgatggctggcccaaagagatgagggaggcaaaatagacttattttagccatataagacacaatccaaagatatgagggagacaaaatagacttatttcaaggatgagcacagtaagctagtcatgccttcgggccggcacggcacgtcctgagtcttattgggccgtgcctaggccataggtacagcccgtgggtggacaaggcacgacacggcgtatcagtcgggccgtgcttcggtcgtgtcagaccgaaccatgtctggtgatctatttgactatagttagctctaattaagcctcaaagtctcgaactttctttcttcacagaatcacaatgctcccctctctaacccgctatctaggtagaatcctaatatgtccaaatcggaatcgggcggtcgtcgaacgaacgcataggggccggcttggcgcattagcccatctttctcatgaaattgaccacagaggcaacacgtaggccagcgcacgtacacaagttccaaattatgtccctgccaccacttaatacgcagtggattattatatactccctccgtttcaaaatattttttttgttttctgtactttatcctttttttttacagtttttgtctcctctattcaatgaaattgacggcctcattgattcgttcaaaaaaaatgtttgacaccgttgactttttagtacatgtttgatcgtttatcttatttaaaaaaaattgtgaaatatgtaaaactatatgtgtacatgaaagtatatttaacaatgaatcaaatgatatgaaacgaataaataattacttaaattttttgaataaaatgaatggtcatacacgtactaaaaagtcaacggtgtcaaacattttaaaacggagggaatagtatgtaattgtaaatacagatggaagggtgggtgtgcatacatggcaagtagctagggaggcttgcacatggtgggcaagagatcgaaaagaaacactgacaattcataaggcccctagctagctatcaatgtgaagtactcactccatccgaaaaatacgaatctagaactgaatgttatgcatcttaataccatataaatctggatatattatatccggatttgtgtcacacatcagtactagattgattttttataagacgaagagagcagtagtatacgtttagctagtagcctctctagctcagcatacgtacatcgatccatccatccattatgtgctagctccaaacataagatcgcccatggtattaattaatatgttggttgctagtattagctaactcttgtccgatatattgtttctcgactcttgttgcggggacaataattagcaggcaaattataaaagcagggggaagatccaagctaggcggccagtccgtccggtatggaacatgacatgacatatggtactaagcatggatatatatgattgcttgctagttgcattcgctagctatatacacaggcctggatccatccatcgatcatatgtatgtatgcctgccaaacatgcacctacctgcagatcttctacccttccttgtcttatttgttgtcgtttttgtcagagatatatcgatcaatactactgctaattaatagtagtattaccttagctagtcgatcgatcgttctagctcccgcagaagagttaatttgtttgtcaacaaatcagggctatagatgatgggtattcagagttccaaagtagctttcttagatataacaatatcaattgatatgttgttagtacaatatagtaccatttttatggattacttttactacgatttgtatgcatgtacgataaaattatattgaaatcactatagaaaatgatttttcacgacgtcacccaattattctcggtggcggctatttgttcaaaccgccagcaaaaaatgtaactgggggtggggggcttcgaatcgcaagcgaaaactgatcttcgctggcggttgaggccgacggggctcggcagcggcggcggtgatggtggaggggacttcaaggacgacgacggcaacctcgagtgcgacgacgccggcggcggttctctgtatttgtgatgtttgtaatatttgtgatgcactctatttggattgatgcttgatgttcaaatttttgttaatttggtgatatttgtgatgcttgaatgcttgtgtgaatgggaatttttggctgtaaattgtcgatgtaaatttatgtggatttgtggatggagcgctgatggaggtggacggagcagtgttttcttttcatattttttcttttcaaatttcctcttcgctggcggctagggtagctgcatggttttgattttcgttggcggtcgttttaacacagccgctggcggtcgcggtcggtgtaagacaaccgccagcaaaaatagatctttgctggcggctgacttaagacgaccaccagcgaagattctgatcttcactggcctttgctttgtggcggctccaaattccgccagcgaaaatctaaaatggccgtcacgaaaaatggttttcgtagtagtgagttttgtaattcattataatcagcatcaaactataaatctttaaaataaaaattagtaggatgttatttctttacataaatttcactttggaccaccttttattactgatgtttgattcattttggatcacctttcaaccaatgtttttattttatattagatgattttacctttatggcactttggactatcctcaactcttatattccatctatatctaatttatcatatgtcaaatatacggtctacatatagctgagggagtttattgatgagagtgaaccagcgtacttgagtatatattcatgcatgcaactgcagcttattgtttataataatttatcggtgagagagagagagagagagagagaaccaacggaagtaaggttgttaaaggtgtactagtacaacagatttggggttgttctgcataaacgattatgtcgtactatcgctaaacgcagtaaagctgatcgatcttacatgtcagcaacttgactacacccggtccctgctgcctaactaactaattataatttactagttcgtactcttgtacttgcaactaattacttactcctaattgctactgctctcgatctagggttacaagccaattagatcttaaactaactagcactaatttttcatccatactacacatatatataccaatataaaaaaatataatatcataactttattaaattctaatacaatcatttttctctttatctattatcaatgcactactaacataatttgataaaaataattacttaaaataaatttattttgaaataaacgtgaggggtcaagaaataagaacccatctcctatacacgaaaaatggagcggttcattaacacatgattaattaagtattagctaattttttttaaaaaatagatcaatatgaatttttttgacaacttttcgtaaaaaacgtatcatttagcagtttgaaaagcgtgcacacagaaaacaaaaggagagtgttgggaacttgctcttgcaaacacaccactctgggaccgagggagtaagttcttggagattcgtcgaattaaatgacaagacagactggttggctgttggtcctctaattgtgcgcattgatctaatgtgtgcagtacttaatccacaaatgattgcatcagtacttccgagctggtttccttaattccaaaaccaaaagggaatcccaagcacaacttgctactttacatacatatgcttgctcaagaacatatttaaataattaagggcaaaagagaaaaaagacaaattgatcagctagctagagactagccagacaccaaattaaagatggctagaccgtgaactcagcgtcgtgaacctccggatgactcaacaaattcataccacctcaaattagagccgttggtgctgagccattatagcttagcgctaaggcccatggcgttgagtccacggcctatttttggtttaatttttttataggaactagtttcaaaataagtttttaaaaaggaccaatttattaaaaggacggctagttttgtggctaaatactttagtattgtggttctttatcaaaaagtcagtctattattttaatatttcctcttcacatggagagataaaactttgcaaaagacgattttacccttggttcatctagtatggtcaaatccaaacaaattttagttggttctaaatatttgcaaaatttaaaagctatctcaaattacggaaatcaaaactattctacaaaaaatgtcaaaactcaaaaataatatttcaaatttcttttttagaaaaattgaatgaatttgatttcagtaattctaggcaacttttgagttttgcaaaatatatttaaattataccaaaactgtgtttaaatttgaattaagctaggttagccgagagtaaaatcgtcttttttgtaaagttttatctctccatttgggggaatatattaaaataacggataaagtgtcttttggcaaagaaccataaatagatagatcgattggtagtaatacacacacacacaaaagaaattttgcatagcttatgctaactttcttctcaaattaaacttaatttgcaggttcctatatatagcaagctagtattctggttggatgcattgtacttattttgcaaagattaagggattgaattgagcatatatgtagcaggtggatcgcgctcctctgacgtaaagtcggagggacgtgggtcactgacgtgtgggcccaacctttgtgggtcccacatgtcagtgacaaagtccctctgactttacgtcagaggagactcatccgtagcaggtgtacatacatatatacaggctgctactagtagtattacttttttttaatatatgacattattaatatttttattaacgtttgatcattcgtttattcaaaaaatttatgtaaatatataaaaaaatttaagtcatgcttaaagaatatttgtcattaattaagtcaaaataaaataaatgataattacataaatattttgtgtaatatgaatggttaaacgtatctcaaaaaatcaagaaaagattagcatatattgatctcttaattccaagcttccctctcacagttgtctgatcggatccaatccggaaaaccgtatgatcgattttggattcccttgttgccactctaccctagctactgtactttgctagctgtatagtacatattccaagcccttaaacatgcatgcacggttgatatatactttatgttaatccttctatgcaaaatgatcgacgacgaaaatactgtccaactgctaagtaaacacaatcactagctccatcttagaatatagcaatttagaatggaatgagacctattttagaacagaatctagacatgaggcatatatccagatttatttttctagaataaaatctattgtagattgctacattctaagatagaggtagtagcttacaactaaaaagcaaaatccaaaaggatttttgtaatgactggaatattacatctacatgaatgcttgtgtcatgacagcaaatgcttttgagcaaactagccaaattgctaggcggcaccaagacaagaacattactgtacagattaaggaacagcggaaaataagaaccctcaccacgacccaatattatctctccgtgtgaagtcttttattttttaaacatcttaagggctccttaatttggaacgcaggatctgaaaaaatgcataaaacatgcatgaaaaacacaatattatagaatgtcatgtatgggtaaatccaacatatgaaatcaaaacatagaaacttggatggttaataggaatataattacatgaatttaatggaattaagagagagaagatacattgaacttctaaaaggaaaaatcaagagaagaaattttaaaaataccgttgataaatgttctatttcaacgtttaccattgacggtagctacataagtaatagctaactcggcggagacacaatccctatcatgacattactattttttacagatcaaattaccatttgtgaccgttcaatttagactactaagcgtattattaccacgtattatgatcacagagataaattaaatactactacatagaagtttagaacaaacggtctaaataatactccctccgtttcacaatgtaagtcattctagtatttttcacatcatattgatgttaatgaatctagacatatatatatctctctagattcattaatatcagtatgaatatgagaaatgctagaatgacttacatctgaaacgagggagtatagtggaagaaagatttttagaaaacatatttagacatgcataaaacatgcaattaatttaatttaatacttcagttaattatgtctagcctaatatgtttgcaaattatgtctgaaccaaatgatctttctaccggccgccagcagagattgatcacaatcaagtgattctatatattatatatagctatgggtacgtcgtctgcgggtgcgtgtgtgatgtataaattgcatgtatatgggatgtctagtcgacacgtatgcaatctaagtacctgacctgtttatttcgtcgttacatgatactctagctaactagctagcaccatatatattaattacccctgtgtccttttaaatcaaaagatttatgcaaaacttcataagactttaaatcttaatggttttttttctatttggccctttgtgtatataaaggatacgactatatagaagcttttcaaatcttatgaaatttctatgtaatggtttattacatataaatttttgaggaaacttagcatgagcttcaatattttagacaattttctttgagcctatctctcttacccgattgctgtgtttttcccgcagtctaattcaaacggtcgatattaatttatgtgttttgtaatgctttgttttacacttgtatttatgttagaattatgtatttttttatattcttgtaattcaaagagccataagtgattttgtttatgtaactgggacggaggtagtacgtacatgtttgttgttagtttcacagttctgttcaagtgttcatcgatctatatatatctacagaggatggctagttatagccgcaatatgcaagcacgatcgatcgatcgacttgttgaacgcactgtgcgtactgttatgcatccatgcatgtggtagctgctgttgccgaaacaaacaaaaaattgcctgattaattaagaaattaataaccctcgcagctatgccaggagccaagtaatctgatcgattagctagtcgcagctttttgctagctgctatacctacctagctggctagcttaatttaggtttaacgtggaacatgcctatgattgtgcaaattccaacaaattgatttggattttgccaaatatccttctatttgagagatgattaatagatatgcggatcatatagtgtaattaaatatcatatatatctcacaaaaatacattttaatgccagaacaaaatactcataattaattagctatatatacgtgcgactgtgtacaaactttttaattgtacatacatttatacgctcgatcgatcgcagttgatccatgcatacagtagctgcgaccattcgctaatatgcaagtacatcgtgctaattaatccgacaagagatgtcatcgtcacctgttaattaattgttagactagctagtaattgcacacaagtgtgctgtgtcagtggtgacaacaacattagcagtccagtccgggctagtgggtgataattaatgatatgatcctatacatgcatatataaaaatgcacgcacttatatatacacacacacacagatacattcgtctcatattatagatcgatcgacgtactcttataaagcgagatagttatcagtggttaactaagagatcgaggctgaaaatgtaatataattttactatcttcaaatctctcaaaaattgaagagaacaaatattattagccagactggaaattgtaatatattaattactacattgcgccaacgaatagctaacaaattaacatacataataatagtagtatatatataaaaaaaagatgtagccttactttgtatatccattttggctaatatatatagctactagctagcttgtttgcatatatagatcagcttagatgcattacaattaattgtatgcataaatggtaatatcgttccaactaaatagctgacatcagcatggtattaaatttggtacctacggagtagtatcatgtttgataccagagacactagccaattaatcccgtgtggttccggtgcaccgcggcttctgagaggagctcggggaggcatgtgtggctgctgttgtggtgccgacggcgaggggcaagttcttgtcgtctccggtgcacgggcacgacaacgaagctcgtgctcctgtgggtgccagaaccgccgagcaaggtgttcgttgcggccacctcgatcgccaatatcaacaagcagctcatcttctccatcgcgtgccaaggttgaagcgcctcgatcggtaggtggatcgctcgctgctgaaggaggatatgatggttgtgacaggccggcatgctggcggccggcaccgacgacgctggtggccacgaaggtagatgtcgactgagcaggctccttgccatcgcccttctccaataagcggcacacctgcctagtccctccttcctatccatgtctaccttacacattgtgtgctccggccagctcgtgagccagaacgagctggctggagctttgcttccgagccgagccgaactccactttttgctcatttagataacgagccgagtcaagccagctcgttatctaaatgagctggagcgacatatacccctatctgtatactgaaggtatcatatccgatacttagggtatcatactgacatcatcatgatacctaaatactagatttgatacttgtggggtatcatgtttggtaccagaggtatatataccagatctgatacctatttggtatcgtgctgacatcatacgttattctattgaaacggtataccactacgtagtctcactcaataatatactatatatgtacgggtaggatggaaggtacaatgcaatctttgcgtaagagaagaagagcgatttggtgggtagctagttatctatctatctcatgctgttttgtcttgattgctggaccacatgcatcaacatgatgtggcctggctctggctgtaatagttctatggaagagagagccagagccagcagcatcagcatgcatgatcaaggagagagagagagagagagagagatgcatgaagacgtactagctagctgtgtgtcgtcttctagctcgatcgtgttcgctgattctagattaggatgttaattgcgtggttgacatgcgtactgccaaaaccatccatcggtacgccagattaattaacaatctctaattccaagatcgatctacgctgtagcatgcagtacattttatatatgtatagttaacttattatatctgacatatatttgtttgggagccaacagacaaaatacatgaaagacaaattagttgaggctagctagctgcgctgctgcctagctctatgtaatggatcgatcgatcatatggcaccagctagcagctatcttcgtcctcattaagtttaaaccaactgcttgatatatatgcatgcatggagcgtagatatatatatatatatatatatatataaaagctgttgcgatggttgagacgattcaaacacacacagaaaaagcaaaaaagtatcgagcaataatccatatatgagtaaatatttaaaataaatccagcgtagatgctaagggaactcgagtcctcctatcccgctagatcaccatttaattaaggaggaagggagggtagaagaagcgggagaagaggaagagtaggaagggtagaaagaaaaataagagttcccctctaatttaattctggatatgctccttaatgcaacaaaagaataatattctctagagatagaaggccaaattattaatagagagaatcccttatataccactctaaattaaccggttcccttatatgccacttcaaattggcttctctcttctatgccaccagttcaagtttgttatcccttttatgccattgccgtcactccaccgtcagttgaccgttaacttcatagtaaaaagacgcatttgcccttgagagttggtatacaaccaatgataggtattttaatactaatatagctactggatacaacatatgaaaattgattcttttttgcattatatgcaattttagccatcaccatcacaaataaattttcaatataagcatgaaacatacagtttccaacaatatttttaatacaaagagcattattcattggtttggacaaaattttgttcactcaaaacggatttaaaataaaatagttatgattttttgaagtttacacatttttttagttgagagggcatattggtcatttacgaaaaaaactaacatgcgactaacagtcaactaatgctgcagtgctgaggatggcataaaagggtagaaaaacttaaccagtgatatataagggagaagccaattttaattggcgtgtaagggaactggtcaatttctagtagcatataagagattctctcttattaatatgacagttctcagcttgtgtatggcctctcaaaggccatgcttttatatattttcaccctatcaaaactcttttcatattagactacctcagtttatggtcaattatatagatcctattcgaagccaaccctcaatccatttttttcgcaaatttgtgtgaagctggatttaaaatatataattcttgaattaaatataaacaactctcttatttctattagcctgttataatttatatacaactatatctattaatttataatctagaccaaccacaatctaggaatgtaaatctttctgtttttcttattaatgtagtaataatttctaggtttttgtgaacgcgcaataatttctaggtctctctagagtaacatgaccttattgcggagttgtttgtccagtcatcaatctggtggtggcacaggcgctggggtgttttgtagtttctacttgagtaaattgcataaacgtgaatttcacgttttaaaaatcaaacatgtgaagtggttgtctaaatctcgacatagcgtcatgtcgcagtacaacaacacttctgcaacgccagccaaagaaaaaaaaacttgcatttagataacccttgcatgtccaagataaaattggcccaagtgaaaaactcagaactacataaataattttcgcaaatggccaaaactcatttttggatgtggtattttgacgtgtgggcatcacaggtgcacgtgaaaacccattttcacatatggatctgttgaggaggctgcttgcaaaactgatttttgcaggcaggcaagtaaggactttcgactagaacgatttttttttttaaaaaaaagaataaacactacagatccaagaccctatagctagggtaagccgcatgtggccgcggccgtgtggtccgttggctgggtacaaagagcagagtgggctaagcaaataccgggttgtggcaccatccctttcacattcactcgctcttgatatctttctctctcatggaaaagaagagataagtaattttaattgatgccgggatagagagagagagagagttaagaaggtagctaggggagagagcgaggttgatgccgtgatcgatcgatcgatctgttggcgcagcgtgtatataagggcgggaaggggagtgagagagagcagcagctagctagccgcggtcggtcgatccagctgctggggatgagtacttagttagctcggagctagctactaatggatgatatacttatgctagttagttaaatacagttattagttagttgtaggttgcatctatcatatctccatcggttaattaattgattgatagctagattatcaacaattaatgagcatggtggtgcagcaggagcaggaggtggtgttcgacgcggcggtgctgagcgggcagacggagatcccgtcgcagttcatatggccggcggaggagagccccgggtcggtggcggtggaggagctggaggtggcgctgatcgacgtgggggcgggggcggagaggtcgtcggtggtccggcaggtgggggaggcgtgcgagaggcacggcttcttcctggtggttaaccacggcatcgaggcggcgctgctggaggaggcgcaccggtgcatggacgccttcttcacgctgccgctgggggagaagcagcgggcgcagcggcgcgcgggggagagctgcggctacgccagcagcttcacggggcgcttcgcgtccaagctgccgtggaaggagacgctgtcgttccggtactcatcggctggagatgaagagggcgaggagggcgtgggtgagtacctggtgcggaagctcggggcggagcacgggcggcggctgggcgaggtgtactcgcgctactgccacgagatgagccgcctgtcgctggagctgatggaggtgctcggggagagcctgggcatcgtcggagaccggcgccactacttccggcgattcttccagcgcaacgactccatcatgcgcctcaactactacccggcgtgccagaggccactcgacacgctgggcaccggtccgcactgcgaccccacctcgctcaccatcctccaccaggaccacgtcggcggcctggaggtgtgggcggaggggcggtggcgcgccatccgccctcgccccggggcgctcgtcgtcaacgtcggcgacaccttcatggcgctctccaacgccaggtaccgcagctgcctgcaccgggcggtcgtcaacagcacggcgcctcgccgctcgctggccttcttcctctgcccggagatggacacggtggtgcgcccgccggaggagctggtcgacgaccaccacccgagggtgtacccggacttcacgtggcgggcgctgctggacttcacgcagcgccactacagggccgacatgcgcacgcttcaggccttctccgactggcttaatcatcatcgtcacctgcaaccaacaatatactcctagctcctagtcctagctatatactcctattatccatccatccatccatcttacactactataccattagcatcgatcgatcatccattaattaattaattaattactagttccggcttagatatatatctggcgattatttcagttcctagctactcctacatgcatgctttgcttaattagatctatctatctaatctatcccggccggcctgttttaattccatatatcatttggtttgcacgtacccatctatgatctatatatacatgcatgtcgactattgttggtcgtacgatattatattatatatagatgtaatacatatgttgaaaatatattgatttcttcttgctgtaggagtaattaattactccagttgttgctgtcactcgatcaatccatgggatatggggatcgatcggacgatatgcaggaagctcaaggacgatatgaatgatgcatgcatgtgtaaatgtgttgttgtgtttggtttctcttttgtcgtttcccctgcccgtccgttcgtccctcagctttttacctatatactatagctacctacacaaacaaacaaacaaagaaagagagacatatgaatcgattactagtaacatcgatctatcaatggttgcttcaatttctacttctcaaaagaaaatggctggctaaaccttgggtggggcgggtgacgccatgtgatgaagtagataggaacctcttcgccgcctcaacaaacataacaatatgggacggaaacacggtgcgatcttgggagtccgcgtggattggtgggcgaagacccaaagacctcatgccgcttgtctatgcgatctcaaaaaacagaggaaaatcccttcggcaaggaaaggaggaggacgcctgggtgcaagatttgaagcttgattcacaatcatctatcacagtcgacctcgtcgaacagctagtcgcactgtgggaagcggtccgaaatgtgcacttagacgttggagaaccggatcagattatttggaagttcacaaacaacgggcattacacggcctcctcggcttaccatgtgcagtgctgcgggacgccgagtacaaacttcaattccttgatttggaaagcctgggcgccggggaaatgcaaatttcatgcttggctcatcattcagaacagagtctggacttcagaccggcttgcgaccaggggatggcagaacaatggttgttgcgctctttgccgccgcgagactgagacggcattgcacctcgttgccacttgtagatacaccaagaggatctggcacctcatctctgcatgggtgggctatcagcagatggacccaacggaatgggaggaagcccagtcagtcaaacagtggtgggagaacattgcaaacacgcctagtgtcccgaaaaaaggacttcgatcgctcattctgttagtcgtctaggaaatttggaaagagaggaatcggcggatttttgatcacaaagaggtggcaacgaacttcctactaatgaaaatcaaagaggaggcgagcctttgggctttagcaggagctaagcggctgcgtgagttaataatcccgcactctgtatagtgtacagctatagtggttctccgttttccttttacgtctaggggtttgtattttctcttgctctattcaatgaaaaggcactctagtgctgctttccgttcaaaaaaaaaaagaaaatggctggctagctgctgacctatatatactgtatgtatgctcgatgcttctcctttcagacaggcaaaggacataggtacatactgtacgtatatactctacagatagtatttattatgtagtactgtagatcagacgacggcggcagcaggacgtacaaaacaaactggtgactagtctcctccagctacctatagctccattgcatcacgtgctaacgctaattaatgctaatgctaatgcaattctctctgctgcactgtgtgtgctactgtacgttactgaccaatctctatagctagcttttcatgcttgcgcctcagtggttacggatagagatctggccgggagagatcgatcagctcagcttaatactagtactgaaagaaatatcagatatcaacttcaagggattgattataatatactagcatcaaaagtaaattaattaagcaaatataattaatactactccctctgtcctaaaatataacaacttctagcctttaaaatttattccaaaatataacaacttcttctcaactaatcaaaatcctctaccattcaattttcccacctaccttcacttatcctaccatttaatcttaccaactttcttaataaccggaccatctctaaaaatacttatattctggaatgaagggatatgaatacatatatagagcaaatattaagatgccgatcaagatgcttagctagctagtaatgtcttggataattacatggtctctaaaatatatttttattattatactaatttataagaaaaatatatatattattttagtattttttaaaaaaaattaaatattttaaagctgttaaccattaaatttataaaagtttaactttaaatttatctaaaatgtcaagaattatgaaacgaaagaaaatacaatgcaattagaaaagaacatgggaagggatgggcatcggcatggccggattagatatagtatcaccattttaagatgatcagtatacatgactagtcgtatatactacactatgcatatgccatgctacatgtatgctgctacctccgtcccaaaatgtaagcatttttagctatgaatcattttaggacggagggagtagctagctaggaaacgatcgatcggcatttcagctatactacagtacttacatcagatcgtttcctagctatcagatcagggtcgggtcgatcagagtgatgaaaatcaatcgatatatattgatcgaggccgcttgctgtcgcctatcgacctactagtataacaacgacattttctctaaaaaaaaaaagaaaaacaacaagtacctagaaacactccacttagacacaacggcttggctatttcttaggcaaatctcaatcatctgatcgcgttcgttggatttcaatccaatgcgcttctctccatgtatatattcaacctctgcatgctcttaatctctccactcaactaaactctcagttaattactaattatcctcttctccaccaacagagtacgtttaccacaatactcctcgaaacagactttcagccccatcgttttccttgtacttatacttatccattagtactacttgttaacaaccaaaaaaaaagtcacgagtaaaacttttatgtgtgtgtatccttagcgatttaaaagcaaatgcggtagaataaattatgatgaaaaaaactaaaaaagtaagttttgaaattaaattttggcatataggcattagcataagtgaaacgatagggttgtttgttcttttttttggggaaaaggatttcatcattcatgaaccttagagcataaccaacatatgcccagtagggctttctaatcttaaaattttggttttctttaaagctggttccaattgaaccacttgcattatatccatcagcattcattttggtgcatccttggttaggacagcttcatcttttgtccattttgtcatttatcatcacgtgaattattgcatatagctagacagttctagtatcacccggaaagattgaccattgaagacacacttccatcctcatttgtggccataagttcagcttctagagcatatgaacagacctctagtgatctataggcagctcatatgaccggccattactatcccaaataaccatttgcattacaacattcagttaatttgttccatcctatgttaggatagcttcgtcttttcatgccaagatccttcttcgatcagcttcccacttatcaaatgcaaatcttctccatgatagtagttgactactttcttaattagcgtgtttacatatccgtcactaagatgttttgcacaactagccaacatatacttacatgtgcataatgcacacacatgtactagtataatatcatagaagatagactcattttacgtccttcgttataagttattatatatatatatatatatatatatatatatatatccttcagtattggtagtaataatgatcgagtagcgagcattgtaaagagagtctattaactaacacaacattatctttttacgagttactcatatgtggatccattatgttatagcctctcaaagtttctcaagcattggaacagctaatcatagtttgtcgcgacttgggcatagtatagggagggcagccagctgcaggaaggatcaagagagaaggcaggccaactggaactgtgggcgattccttggtgccgctagccgccgcgccgcctgctttattttgtcgattgtcgatcagtctgcccacaaacgtcacccatgtactgtccatctactgtacgtactgtactgctacaatcaccgttactcagtggttctacgtactactagtactatacacacgcgtgacacgttcctttgcatataggagtactactgtacacaaattcttactgaaattaatagtacagtgtgtgttcctttgcatatattccctccctcccccataaaaaaacatatttttgagtttatatgttcaacatttgaccatccatcttataaaaaaattttaaaaataaattatacataaagtattatttatgttttatcatctactacctccgttccaaaataagtgcagccatatgcatgctcagcgttttgaccatccgtcttatttgaaaaatttatgaaaaatattaaaaaaattagtcacacataaagtacaattcatgttttatcatctaataacaataaaaatactaatcataatcttttttcaaataagacgaacggtcaaacgttggacatgaacagtgctaaaactgcacttattttgggatgaagggagtaataacaataaaaatattaatcataaataattaaataaaaacaaagagtatcaaaaactgaaaaaaaatgtacttttcatgggacagaggggagtacgttattgaattccttattaatttgtactgtactactgtggatgccacatcagccatccagcaagaataacctgcagccacacgtaccaatcacactccaccctgcaacctgtgtttcatgctactatacagtagtgctgtcagatattctcttgtcaagtgtaccatgcacctatgcatgcacgcttctttcttgcagccgaatcgtacgagtacaacctaatttagttttgtttttcgtcactcagctggatagcaaagaatagaactgtaaaaacttctaaggcatcgttcgtttaggggtgataggggagattggttctcgttttccgcgcgcacgcttttcaaactactaaacggtgcgttttttgcaaaaaatttcaatagaaaagttgctttaaaaaatcatattaatccatttttagaatttaaaatagttaatactcaattaatcatgagctaatggctcacctcgttttgcgtatcttcccaatctcctcaatccccttctcctcaaacactccctaagcgatcattgcttggcagcttgggtgaaatcaggttctaggaaaacacgttttagattatttttttccaacttccaataaggttaaatcgctaaggtagcttaatttgctcaatggatggacggaaggatcggtcctgcatgcatccatgcgtggtgaggtttggtggggaaatctgatctgatcgacgatcgagtagatggatttggacatgcatgcatatatacagcaaattaaggaccacaaaacctaatcgatatcagttagttttatactagctatatcgaacaaatgcccatcagctttgcattgtccacaccaggccatgcacatatatctgtggtccctcccggccgcccccgccccgcgaatgcaatctaatcaaatactattgtaatctaatctaaatttatcagtatgtgcacccatgcagcagatagctgcccggccggcctccatccatcaatcctttctcaaacctgcacgcgtggatcgaacactccttttattttgtttgcctgacccggcccatatatctctctctagctataacgtacggtacgtactaatagtcaaaagtaattaagatcatgaccaacagtttccccccccccccttccaataccaaagttttaagcttttaagtaacggaattgctacacttcagttgacaaaaaacctacctccaaatcttgcaaattttggttcactggatgtgcttcacgattcgtactccagctgcttcttctccaactccgacgaactcctcttcttctccggcgccggcgacaacccaaactccggcgaagagccgacgaattagggtcctggagtggggtggggtgggaagggtgggagggggagggggaagaagggggagttcgccgggcttagagggatgactgggtgaggcggcagcccggcgatgggcggcgaggcgtcggagccgcggggctggaggatggcggtgggccggcgttggtggcgagggcatctcgccgcagacggctcgaggaggaaggaggggggagggggagggggaggaggc

SEQ ID NO: 52654 - DNA, 806 bp, Oryza sativa
agcgtgttcacatatctgtctctaaaatgttttgcccaaatagcccacatatacttacatgtgcataatgcccacacatgtgtgtgtataatatcataaaagatagactcattttcagtctttcgttataagtttttatatatatatatatatatatatatatatatatatatatatatatatatatatatatatatatatatatatatatatatatatatatatatatatccttcagtattggtagtaataatgatcgagtagcgagcattgtaaagagagtctattaactaacacaacattatctttttacgagttactcatatgtggatccattatgttatagcctctcaaagtttctcaagcattggaacagctaatcatagtttgtcgcgacttgggcatagtatagggagggcagccagctgcaggaaggatcaagagagaaggcaggccaactggaactgtgggcgattccttggtgccgctagccgccgcgccgcctgctttattttgtcgattgtcgatcagtctgcccacaaacgtcacccatgtactgtccatctactgtacgtactgtactgctacaatcaccgttactcagtggttctacgtactactagtactatacacacgcgtgacacgttcctttgcatataggagtactactgtacacaaattcttactgaaattaatagtacagtgtgtgttcctttgcatatattccctccctcccccataaaaaaacatatttttgagtttatatgttcaacatttgaccatccatcttataaaaaaattttaaa

SEQ ID NO: 52655 - DNA, 6025 bp, Oryza sativa
taactaagaaagttcagtacagccacaaatggaagaaatacatttgaagtaaggaaacaccggtctgtgcctccatcagcctcaagcaggtatatcacggaagtgcttgcttatgccacatctgggggagaaccaccaggaaccaactgtataggccaaacaaaagatgaaatagcgttagacatagcaggtcacaccgaacttttaccaaaccattcattacaagtatttgatcaagatttctcacaatagctatattgttgccgtttaggagtatctgatcaagctttgttatgcgacggccttcagcagtgtattcactataaaacaatcagaggatcatgaaacaacaaacattagactataatttcatattgaacatatacatatgctaaatgtgcaagtgaaaaaaactaataaacatcagtatggttttgctaagtgatttcctagatgatacattagtttggcaagggtgatggtggtaacttcatattcagctaataggaataaattccaccattaggtccagcattttattaggggactagtgaaacattgcacatcaacagatcatatagatttcagtcatggtatataatcagatgacacaaactctaaaacacgctcacttcagccccttctgcaagatggctcaacaaccatcattatgttgcagtatatgtttgtgatattttttgttgttaggaaatacctctctttttaagaacatagttacaacatccacatgtgcattctacaaactactaagatactgaatatgaatatttctagaactaattcaggtataatagaacattgtaatatcggggaaaacaaagtaatacatcaacacctgggaggactagtataaacttaatgcaacaattgtgaagagctagcacaaaatacatgatgcatcagtataacactcatggaaacctactgccaccatctgctaaatatctttagtcatttttacatgaccaattccctcctagctatcaactatcattctgtcctataccacaaataaataaccatataaatcatgatgaaaagagcttgtcttcccttccgcgagaaataatattcccaaacaagacaatactaactacaacgatgaacatgttactgcagcagaaatcctacaaaacagtgtgttccactgctgcagcttctttggaatcaagcgttcatatcagttgatcttagaacagacagactagtgattgcgttacaccttaagtactaaacaacaaataaaatcttcagttatattaagtatactgaattactgataagagcagcaaatgttataattatgtaacttcatgaaaccaagtctgtgtgagttaaattgaagcacacaatgggttaacaatcatgacatgagtactgaaaggatcaaaaatagcttgcactataccaactatgatgattggtagtataatacaaactcatgttatacgaaatctgcctgatgacatggaggaaagtaaccaacaaagcaacaaggtaggagcaatctggcataaggtgggcaatatttctgtacttcagttctcagaaaatcaaacaatgttttctaaatattttagctaattccaatatcagcacactgagacacaaatgtgagaaactgagctaaactaatctaagaatctaatcagaagaaaccgaaattaccctacgactgtgacaccaaaattaccctacaagaaaaaaacctggcgcggaaagtagaaaaataaatagggttgagaattggaagatttttcacatactactcagtaacgtcctcgagcaccatgttgacgtacacatcgaacccacagagagtgccgacgagctccttgtcacccttcataatcacccaaatcttggacccgatgcagcggtcaatcagctctgcacaaaccaaagcccgcaagaactgaatcaagaactcgaaccccaaaaaacaaaatctatctggaacaaagttagcaagctaggatgcgagatttataagaaactaaagcgaagcttcttccgcgcacctgaagggaggagctgggaggggttgttctgagacatggcggcggacgccctctccggcggagatcgaggtggaagcggcgacgggaagggcgcgcgcggctacggcggaggcgatgcaagagtagcggcgctgcggcggcggaggcttctgctttgggtggaggattccaactgcgaacgctgcgcccctagccgactccacccacgagacgtattctccaccgtccgatcgagcaatcagccgtcgattagatatcacactttttttttcttttgctaggtttcaagcaccataggaataggtcaactttaacttccttataagtgactcgaatctaatccataaccctcaaccgtaaaatcagatagggtgactctccgaactattaaaaccagtgcaatttgattcccttcgtggttttggaaggcgattttgctgatgtggcgctgacgtggcaatgttgacatagtcttcgtcccacgtggcgcttacgtggcttagaattaaaaaaaattatttgtggaacccatatgtgattcaaacaaaaaaaatgacatgtgggaatcggctggtacgacggcgcggcgagcctccgaccaagcggctgggatgccgagaggcggagcgaccggcatcccgtagagcaccaacccattctccggcgaccctccatccgtcctcgcctgcaagagcgagtgcacacattaaaacactcttcgactgagctcgtgcagaaccgagctacgggaggatgatcaccttgatgtcctgcacaatgaacgagttcgtctccacgagcctcgagcaacctgagccgacgacgactagctccggcgagtcgtggtagtaccccaacatcaacgccgccggcgctgttccatcaatgtaaaggatcaaagcgagttatagcactgagatatagtatgtgttgtcaacaaagacgatcttaatcagagattcagagtaactaacccaaaaaacagaaggcgaggagggtgacaaagccgagcgccgccaccgccatgactgtaagtcatgtacccttcaccggcgctggactgacagcaagacgacgcgtaagagaagctatgaatccttgaacgggtcacggccaagggggattttgtggaatcggtatcttagctgatgtctcccccttttctcttcaccttctctctcgtggagcaatcgacgggcagggacggcgacagtgggtgggagccgaagcggcggcggcggtgacaggcgggagggctagggggagggcgctggagtgtgtggcgtggaagctacccccttcagcggcggggtgcgcgggggaggcgtgcgagcacgctaacatccctccggttcttctcgaaagtcggagcagggttcctccctatctctaccatcttcggcggaatcctgtcggtcaattggttgtcagccagagcaagctgctacagttccgccgctaccgtcgcttcagctctcgccggccaccaccactctagcccccgccactgccactccagcccgtgctccccgtggccgaccgaaggggggagaagagaaagagaaagaaagagagaagggaggaagaggggaggaagaagaaagagagagcaggacatgtgggtggccccacaatttttttatgtgtgtgaatgacaaacgggtcccacatatacgtttttaattcaaatgccacctaagcaccacgtcagcgaaaccgccctcaaaaccacaaagggagtcaaattacaccggttttaatagttcgggggccgagatatccggttttgcgatttatgatcatggattagatttaggtcacttttaggggagacaaagtggacttattccacgaaaataatattattgattagttgggcttattcattccaaagaaatataagttgggcctaaattcaaaagatataaattaggctcaatttcgaacagaatttattagtcggcctctctgacagccttggcccaattgaattattggacaaagcggtgggcccactgaaaacccagcccagatggccgaccaccgatgtggtgatgtggccagcaccagcacgacaccgcacctgaccaaaaagcccagtcacatccgcccatggcttaggccagcccgcgccgacgagctcctcttctcctcccatctccaccacgcgcctacccgcacgccgagctgtcgccgcgtgtgcccccgcctcgttccatcgccttcgcgtcaaaaaaaacccactaaaacaatccggccagttaacacttcacacccccgcgccctctcgtcccccttcctacgtgtccccctccctgatcaagaacggatcaccggctcggcgccccactctcttcttggatcggggagcgggagagggggaggaagaggcggcggatcagaagatttgggcggcggcggcggcggcggcggcggcggcggaggtggtgtgggtgggtgagtgagtgaggagtgatggagaaggagaggaagatggagggggagaggagggtggaggcgacgcggcggtgggtgatcgcggtggggttctgggtgcaggggttccggctgttcccatggctgggcgtcaacttcttcctcaaggacggcatgggcgtcgccgcctcctcgctgcagatcctccaggcgtccgccaacctccccatggtcgccaagccgcttctcggcctcctctccgacgccgtccccatccgcggccaccgccgcctcccctacgtcgccatcggcggtatgtatatgctcccactcccactcccactcgttcctctcctcccttccccccctgaatttcccgtcccagatccagaattcctctcacatctcaactttgcgcggaacccgtgtcgccgaattgtgatgcggaattataataatctcaaatctgttcgtcttgcctgggcgcgcctggccatccaatgcagcatttcgttagagcagtatgtgaataactgaatatgcatagcatctccatctttagcattaacctcactgcacattcttttcttgcatttgtttggaggcgcatcacctaatcctgtggcagctggcgacaatggcatcgccgcaaaggatatgctctgatgctcacggactttgtcctcttgattcttctcaccctttccctttgtttcggtttacttttcatttttgtgcataatttgtagtatctgtcagtcatcttttcccgtattaacctttgacagcaacaacttttatctaatgctccaccaaatttgtcctcctgttagtatcacacattcgcaaagcaacaagcaagtaatcccttgccaaccagctcacgcacggcatgaatatttcatctactttaggactttgggtgtggccctttcggtccactttaattaaagctgtgttgaaaaacaagcacagaggaatgtcatgatgaaattcttcaaggatgaatggatagtgaaccatctcactccaacatcacataacttgggattttatatgtgcaaattctgtgtttttatcacaaactttttgaatgccatcaagttagtttaacctcagtgaggcctttaaactctagcttgcgttaagaagtttgctaaccggaaatatgacataaggataggcccgctatggaagttcagggacctaagtggcatgttaagcaatgaacagttgaatgtaaatgactgaaccaaatagggatggacataattgacaagatcatatgcctaaggacgttgctataatttacaaaatgaagtatacaaaattgggatatgcttactgtgcattgcaatgcctttttcttcttttgcgcttgtattagactatgatactaacctgacttgttattgctatctgtgcagctctcttgcaggcaatttcatggttagcaattgccctctggccagctatttctcttccagttcttaccatttttctcctcttgagcactttggtgcatccatatgtgaggttgccaatga

SEQ ID NO: 52656 - DNA, 1982 bp, Oryza sativa
cagaaggttttatcagttctgcagtttcttacagcactcgtaatgctgtcagatgtactatttgttcagggaatatacagaaacttcggaataccggattccatgtacacaattgttttctcagggttgttggagggtcttatgttgttcaaggtgctgcccttcagtgttcttgttgcaaaactttgcccttctgggtgtgagggatcacttatggcttttgtcatgtctgcacttgccctcgcaactatcatcagcggttatcttggggttgcacttgctgaattcatgggagtatctggaggtgatttctcagcgctgccgacttgtctgttgattgaggctgcatgcacaatgctaccactctttttctcctcattgataaaagagaggagagaaaaggagaagaaagaagaatagaattcacctataggattcgatgaggttgtactggtgctcgttatactttacagtcatctttgggatcatatggatttgccgatagttcggtttcataatcagaacatagctggtggacacaatttaaaagactaggttcctcgagaggttttcagtgtttgtcgagaatcatgttcagtgtagatggcatatttgtacctatatttgtgttaccattcttctatagatcaagtcttgtttcatgtaactagtattctttttgtgtatgctaatctgttttttgtagatgaaacaatataaatgttttgtgcatcttaaaagtgttattggctcctacctttgtgtccacacgactaactaaaattagcacatttctttatgattcccaagttgacgagtgttgccagaagaaatgatatggtgcaagatccatcctccatctggtctgctatctgagcccttcactaccataactccataaggaacttaaggtctagctacaaactttagtcctatgaaatcctggtagtgaaactttaaagataataataacaaataccctccaatgtgtagaccatgtaacaaaaattctggttgatattaataaatttgctactgtttctacaataaatccaaacaaatcacggggaacgatcccaggggacatttgttgctgccgtgcaaaatgcaatcagccttcgctgccgagtacctgaaaatcggcaccgattggcaaatgatcgctaggatggtgaaagttgggtagccctccttggacttcggcagaatcccctcgtggtatacgaagtagactggtaggttttactgaactgccgtccgacaagaatatgtagtccagtgttcctgtaaaaccaggagtgcagttggtgaactctggctcccctccattcgcagcataaaggctgcgtaatttgatcggagcttcgtccgtagaatcggagttggctgatacgaggtagttgtatacctgcaaatgattagtgacatattatagaggtggaacaaccaagaaatttcggcggagctgggaattaaggtcaggtaatatttttcctaattggagggcctgaagttttgaatatcgttcagtaaagcatgaacctagaagaatgcagaatgtgcatatcggaagttacatcacccactatggtttgatgagtcgtttgcatacaagttcacagtatttgatattgacatcagcctacgtctatccagaatattgtactgagagtaaagttcaaaaaaacaccatgttcatagccatttgtaaacacaaaacaccatgtgatggtttcggaagtctgttaagcttgaaagaacaaaatgtagcagacgcagaccataccttgtcaccaggagttgagttgaagtcaccagcaatcatgactgaaggtttacagttaaatttattcgagataagtttctcaaactgagtaactcttgaaagaatatactttgcttgagccaattttacatcaatccattcaggatccctacaaaatcagaatagtatgaacaggggatccaatacagatatacaa

SEQ ID NO: 52657 - DNA, 3105 bp, Oryza sativa
cttgcttgcttctgaaagagcataatactgaattaacccaattaacttaggtagagcatcatactagccacagatacagcagacataaaataagtacggaatgcaattggacaaatctatgtcctagctagaatatgattaatgataaaggtccaaaggtagaatcataatagtggaggcccaaagaatttgtacttcatgagtttggatgtggagtttgaatatttgtctactttctttgttttcaagatatgacagaatagtttgtatgttgtaacttgtaagtagtttgtttagcctggctcactactttaccttttgtcgcctccaatgaaagaagtcattatgattcacaggataatatcaagttgagcagctgatccattaccttctgttggtgaagaattatttgatgtatcactatttacatgatcagtatgaacatatttttccactaaatcattgtaatgtagtacttccttctggaccagttccatgctgtaaaagtaagaatagcccaaaagggggatattgagaagttaatttgcaagtcaatcgaaacattcatgcatactataatttccattcttgtcttctcattgttaatcatcacttatttgaaacaatatggatacctttttggtttatagaatatgccacatccatcccgtttgtccccagatcgttgaatgtaaatacttgaatatccagaattctccatgtttttcttgtagaaggtatcatactcatccaactcctgagcaaaccacatattaaaaataagcagacaaaaatgttccaaagaacgaaaaaagcagacaaaaatattccaaagaagaaaaaaaagggtcaaaagtacacattaatataggtcatgactaaatattgaaacaatacaatcatatgtaatatgtaaccctcccaatatttatttctgaatgagtagaacactaattaatttgtgttgggcataatggaggaagactacataatttttttgagaaacagtaatagccaaaactttctactatccaccattgtgttgtgttttggcactaggaaccttgtgtatcaggttccaatctgtcacgttgagaacttgggattaatgctccctttatcctaggatccaatcaatgttgcagttttttcttggagggtatttttcaatccactaaatacaaacttggggaatgttacataaaccatatatagaaccaaataaggatataatatgatttaaaaacgttcacattctatatttatcaatgacaagtacatgaccacatgaaaaaaatgagttgcttaaaaagtcataagtctgtccaacctgtatgcacatgaggtcagcttcgaagctcttgagttctgatagaacagctttagaccgagttttccacctgtttctcaaacatgaggggaagcatacagtccacaaatgaatgattgaagagcagggactagaacagaaatggaaaattgtttacagtcacaaaacgaaactagcacactgatgcaccaatcctttgatagttttatactttgttcttgggctgggtctactcatggtgagaactgagaatggaactcaagtttgtccgaaaatataaatgtacaaacatcatatcgtaaagcttactgttgacaaataaatctattcgtacaacctgaatgctactaaggctgcgctcattgctgctagttgggaaccaatgtgcaatgcacacaaaacatagtatttatgtaatgtctttctttcatagtaaattatttggcattcaccgcagtgtgttgccactgctctaatgcttagtagaatcactaaagtggtcgcaagaaaatattgaaacccaaaagaattctaggaagaagcttgtcagtcaagagcttacttgagacaggcagatggagaatgcgggaaaaacgcactcttcacataaacctgcaacacagatcaaatagttagatgcagctagttttctttcctctgtgaatactgtaatccactcatcgtcaccaaagaaaataccgaaccataagcagctcaacagaacaaaacagcatattgccagcctacctgggccaagatgttgtaggaaaccagccggaactggtacccagctgcccctgtaacccaaacactaaaacagttttaatacaaattaccctgggcctgcgcgatttgcaagtaatactagcaatcaaccaccaatcaaaatcgtattactcgcttcttaagattgaccaagaaaagaaaaaacacaacctgcatcggattcggattgcgccgtggggagaggggcgaaactgggctgcgcctgggtgctcatccgccgcttgcaaattctgactcgtcggtgtcacgatccattagaacagtagaaagggggggaaggggtttggaatcggggatcagcgtgtgcttacgggacgaaggggagacgggggccgcaaggaggaggggagctggggcggggacggaggcggaagagagggagggaagcttggagctttagcatcggcggattcgttgggctctccggcgccggaacacgcgcatctggccgcgaggagatggtcgcgccgccgccgccgccgcggacggctgtacggctgtggctccaccgctcaagcgttttgattcaaacctgataactgggcccgatctgtcggtgagaagcgccggtgtacagtatatttgaagtaatacccttttcttttctttttttttccttttccttttcagagatggccacggatgggataagaaaagggatttcagccaaattatgttttcgtcggcacttttaactctagtcggattggaatgtgcttgctaccaccataagttatcgagtcagtcaggacacattataaacaggtaatgaattattcatgctgcgttttcaaaagggtgatttttaaaaaactttttatacataagtaatattccctccgttactaaatatttgacatcgttgactttttcaaatatgttgaccgtttgtcttattaaaaaatttaagtaattattaattctttttctattatctaattcattgttaaatatacttatatgtagacatattgttttacatattttac

SEQ ID NO: 52658 - DNA, 3732 bp, Oryza sativa
aaaaaagtaattacttaattaatcataagaaaatgtgccgctttgttcttaacctcacctcccgaacacagcctaagagcaagtactctaatgcttaatatgttgcccctaaaaatactatatatgattagatatgaggtggaaaaaataagtgaagaaagagaaggtgagtcacccctcatgcaaggggcaacctccccacaatgacacaaaccccaaggagatgaaagaaagaggggattagacaaacaaataaaataaaattatttgggttagtatgctggaggtagtgtagatgtggtgtgttgtttatatcacctcctatcttatagggataaaattagatgtgacaactactcttactataaaacttgcagtaagacccgttctaaactcctctaaatttcgactttcctgttttccattagcacgttccccaactgttaaacgatgtatttttttaaaaaaaagttttatataaaagttcctttaaaaattcaaatggacccatttttcaaagttatgataattataactaattagtcatatgttaattgcttgttccggttttcgtgccgcttaaaagttcatggtgtgtttagttctttgggcgtaaagtttttgaagtatacggatacatatttaaagtattaaatataaactaataacaaaacaaattacagattccgcatgtaaactacgagacgaatttattaagcctaattaatccgtcattagcaaatatttactgtagcatcacattgtcaaatcatagcgtaattatgctcaaaagattcgtcttgcaatttacatgtaaactgtgtaattagtttttttcccacatttaatgtcccatgcatgtgtccaaatatttgatgtgatgtttttggccaaaactttttgggatctaaataaggcctcagtccctatgcagaaactaactaagcctagcctaattcatagtataactttacaaattatttactattggtacgaacacatctgaatatgtgatttagcaaggcttaattgctttgctagtttgcttgctagtatggtcttagttaacttgtatatgagcttgattagctaatgaggtaaaaaaaattactccctccatcccataatataaggcgcacatgtatttcaagattcaacatttaaaacatttgaccaacacttagtgtaatatgaaataaattttatttgttaaaaattatatcattagattgagattttaatttactttcatatgattataatgttgttgctacaaaccttatatatgagaaattagaagctaaagactagttttggagatcgtgacagttttgaccatgccttatattatgggatagagggagtatgaagtattaagtactacacaagtagttgcatgcagtggagagtggagcccagacaccttcctatggtggctctgctttggttccaacgctggatctgggtgatcttgggccttgttagttgggaaaaaaaattgggtttggttgtcacatcggatatacggacacacatttgaaatattaaacatagtctaataacaaaacaaattacatattccgccaggaaactgtgagacgaatttattaagcctaattaatccgtcattagcaaatgtttactatagcaccacattgtcaaatcatggcgcaattgggcttgaaagattcgtctcgcaatttacacgcaatttgtgtaattggttttttttcctatatttaatacttcatgtctgtgtccaaacattcgatttgacagcgtgaaaatttttgttttgggaactaaacagggcattaggtcgtattagctaaaaagtgtgacgtgcttttcccgggcatattgctcatgatgtgccaatgctaccaaataaatctcactgccacaatatcactcactcaacatgtgagttcaccaccgcaaaggccattctcttccacctatatttatggctgctaccttttcgcgatattgtgtccagggttcaccgttgttattttcttctcccataagttctatgtttgttactgatcatccttccctcccatagcttactaatccttgtgcaattttgtggcacatactagaggcaatcacagtgacacttgatcaaagggtcctttttttagtgagtgtgtttttcgaaaagaacaaacggtaagtgtggctaatgtgtaatgtgagtgttgatacactgagtgcttgggaatttatgttcttttatgagaaagaatgtactaacccgtgaagtttagctcatgaaagtggatgtttttccttttagatagtggacagtttgacctttacttcaatagaagctatagtcacctattacaatgttcttaactgaatcaaatgcaaatgtacataataaagaaacatgacgagaaaacgttgtaaaactcaccaactaaacaaaaggaaatacatagcgtttagaaagccatcctattactgattctccattggaaattggtgaagatatgaaagtcattatttggggaacattttttagtagtttgctcattttcgctatgtgggttgatgaatgatgtctagaccatattctagttggttgtatgctcattttggctgtgtagtcgtggagaacgactaaaacgtgtagttagatggttgttggttttgtaacttgactgggtgttactataatgtaattcctccactaaactaatatttgaatatcttgcactagactccaaccttttggaatggtactatttcaatgaatataaagtctattgtgcttgtaatattattcaaacatatgtatcttgttgctggaatgtgacatcctggctcaattaggatttggcatgtgcgaccatgaaagatgtgtgcgcatgtttatattgctagcttagcaagagttgaacaaacttacaagggcttgtccctctaaccatatcactctcgggttaatccttttatatgaaacaagaacgaaggtgtaagtgagcctgctcatcagatgggctgggctgcgcggttttgaagagtgtgttgtacgtacactaagagggggtgtgttctcggacatttagatatgcgggtaagttggactgatagagacatcaggtcttttctttgggtgggggatgtgacattctaacccaattaggatttgtcctgtgttatccatgatttgtgtgtatatctttagtaccatatttcaattaggatctgacatgtgttacccatgagagctgtgtgtacatgtttagaaccacattactagtttagcaagggcaaagcctacttataagggctagcccctccaaccatattactcatgggttaacccttttacacgaaatgaaaacaaaaatgtaagtggggtggtatgtgtaagtgggtccgctcgtccaatgtaggttgggctgcacggttctggatggtggtctgttacatgaaatgtgattgtttcgttagaaggcactatggtatcaagatgtttttactaacgtgtggtagcaattcaaacaactaccacaacttacttccaaacattttttgtggcaatccaaacaacaaacggattgattttgtcacaccttagttgcgaaacaaacaatctaattttgcaaaaaaaatatggctagccacaacttagctaatacttaaccttagacatggaaatacatatctcaaaatcaaaatgacccgatattcgagaggtgggtgtaatattttttt

SEQ ID NO: 52659 - DNA, 11416 bp, Oryza sativa
ttactaaatgatggttatgttatggccaaatttgtcacaataaatattgactttgtggatttagtttctagacatggcagaactcaatctttgggaaaagacactcttaaaatgcggctatttgctatcggacacaatggtcactaaaatattaatttttggttgagtaggtgataaaaatagagtgaaatatcctcaattatgaccttcatgtgagcaaatcatagaaaaaaactgaataaattggtttgaacaaatgaactagtatcttcagatccaacacatccatctggtgcatttaatcaacaaattacttccaaacccaaagagtaatatatgctcaatcaactcattaacttcagatctgatgtgaccatggctaccacagatgcaaccattgctcacatcatggatgaacaagaagatatcaagatcaagtcctccaagtgctggaatccgattcggccacctactacactgctgacttcaaacggctgccgaatctgcatacgacctccgttttcggcccgtgagtacttgatggaaagctcttggagtcctctttccaatggatccagcctcattgcgaaattccatcttattgagctgcaattgaagcaacaaggtgatgcgtcacctataatgggcctatgggcttgtaacttcgtctgggaccccggcccaggtggggcccatgtggggtgcgccccagccaggtggagcacgaccctaggcaccctaggtcgtcctccccacccctatttatatagttaggtaccccttcagggtttcttgggttttgttagattaaagtttagccattgctacttgctagcagcgcgcgtgtcggctagaccgtccgtctacttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtagggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgttgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagattgttttggaaagatatagtagattggattggttaaaaatcagttccctttttatcccatacaccaaattcggctgccatccactccacctcctggccgagtcccactcgcccctttggccgagtccgactccctccctctcttccaccgttccgagttgtgtcaaacaccttggcgaatttttgtttggtgtcggtttcgagatctgtttggaaaaacggaaccggcataaattcagcattccattttttgtataattttaattttgggtttagacttttacatttgagtccctgtaaattttatatttatgtttgagtccctgtaatcttacattaaggtccttgagtcagtttttgttaaaaaaaatcaagaaaaaagtgaaaaaaaggcagaaaggtgcaaaaaaaaagaaaaaaaaagccacacaaaaaaaaaacagaaaagaaaaggaaaaaaaagaaaagaagaaagaagaaagaaagaaaagagaaaatactgttatgtttgagctaaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatattttagatatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctgaagagggcatcaaaggtaaacttaatggtgctgaaattaataaaggtgagtgtgttgttaatgaattgaattcgtccactttttatgctatagcagagcaaccattagtggaaccaactgctggaattcctttgtcacaagttgatttactcgctgttctttgtgataaagaagagttgtgtgataatgcttcacttattatatccattccacaactagtgaatgaacatgctatttctagtgtttctttatgtgctgattttaagcatgttgttcatattgctaatgaagtacaggaacgtgaattgctatcttctttaaatactttgggctatgttcagtttgatgatttttgtgagctcgataatttgaagaagaaattatttgctaagtctgatttgccttgtccaactactgctatttttcatatatttggcgaatctgatgatagaggaatatatttggtgcatagagtttacatatgttcagatttagaacctcctatacatgtggataaaacatgcaagctagagcgaaatgttattgctaaccaaattgtctcgagtttgccttgttttgactggaagaaacaggttgttgtaaatggactacgcaaagagcaccatatggaaaaaccgaggacggttttccgtgaagaaggggaggatgatgtgaccatggctaccacagatgcaaccattgctcacatcatggatgaacaagaagatatcaagatcaagtcctccaagtgctggaatccgattcggccacctactacactgctgacttcaaacggctgccgaatctgcatacgacctccgttttcggcccgtgagtacttgatggaaagctcttggagtcctctttccaatggatccagcctcattgcgaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgaccctaggcacccctaggtcgtcctcccacccctatttatatagttaggtaccccttcagggtttcttgggttttgttagattaaagtttagccattgctatttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccgcggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaagatctagtgggaaatcgagggaatcgatgatggggcgaaactcgatctttagatggtgcggtggggctgagctcgagaaccaagtagtacttgggaacgtgaacgacaacgacgtggggcttagcacgtagttggaggacgaattacgacgaaccacaatatctctcggacccacaaaccacaactgtcaactgatgatcaacttgttcttgattgagctagaggcggctggcaatttaaaattgggtgaaaatggcctaaagtgaaatttaggccctgtttgattcagcttaggattattataatatggattactatgagtaagctgaaacagacaaatagattattatgatagattattataatctataagccagattactataatctaataatctccttggaggagctttttccagattattgggtggctaaaaacccactaccctaagatgccttcaataatccagagaaacaaacaactcgtagcttattttatgttagcttattataatccagtttagagtaatctgatttaataatctagattacaataatcttaagctgcaacaaacaatcccttagtcaatactttctccgtcccaaaataaatgtagccatggttttccacgcccaacttttaccgttcgtcttatttgaaaactttttgaaaaaaaattaaaaacataagtcacgagcaaaatactattcatgttttatcatctcataataacaaaaacgctaattataaaaaaattttaaataagacggacgatcaaagttaggcgtgaaaactcatggctgcacttattttgggatggaggtagtaaaagatagcctaaatgcaaatcactcaaatttaaacgctgaaatattaaattaaattgcatggataatctacgaataattaaacaattcaaaagttttgaaaatacagcatcaaggctaattaaagcggccgaacccaacaaaacaagctagccgttctgctgtcatcagactacgccggcacgatccggtcaaaccgaaaaccaccaccaccagaggtgtccgtaccgcgcgccacagtgcctaacgaaacacggacgcagacggcagacggcagacgagacacccacaacgacaattcgaaatcaaaaaccggcgcccccgccgcgagagaccccacgccccccgcccggatccacccatccgccgcgcggccgcggacaccaaccacacgcccacccacccacccacccgaggcatcggcgggttggccgggttgctgccgcgccgcgcgtcgcgtggtgcgtgtgcgcgcgggcgggcggcaaaagcggacggggaacgtgggcgatgtatcgccgcgctccgctccgttgtgcggtcgcggtctcggtctcggactctctctcggctagtagggcggtctcggtctcggtctcgtctgccatcctgtgcctcgtgcctccacatgcggacaagtcgcgcggggtgggggcggaggagtttttcgatcggcacgacgagcgaagctacagcaccgcctgccccccaggcagctgactgctccgctggattttgtgttgcgggtggcccccaccatccccgccccggccgcgcatctgccaccatcaattatcctctcgtctcgactcacatcacctactatactacattgtactccttccctaaaaaaaacttggtttccgtgcctaatatttgaccgtccgtcttatttaaaaaaattataaaaaaaaattaaaaagacaagtcacccataaaatattaatcatgttttatcatctaacaataataaaaatacgaattataaaaaatttcatataagacgtacagttaaagttgcacacgaaaagtagggtttgtaaacagagagagtagtacacagtttacaggacgggactcttgtattacgttttcccacaatcctattaccagcgcaagcatagtactgtaccactcttacgagtgtactcctgctactacgagcgtactgtactagtcactccgtctcctaatataatataagggattttaacttgttatttgtactgtttgaccatttatcttatttaaaaaatttgtgcaaatataaaaatttaaaagttatgcttaaagtattttgggtaataaagtaagtcacagataaaataaataataatttcaattttttttgagtaagacgaatgatcaaatagtgcaaataaaatatcaaaatccctcgtattaggggatgaagggagtacactgtactagtacttcctccgttccataaaaaatcaatctaataccggatacgacatatactagtactacgaatctgaacgtagatatgttacatccgattttagattcgttttttttatagaacagagggagtatactatgtaccgctgcccttaccagcatcctcttggatttatactgacgtgaacagtgcatgaaacgatccttaattccttattgaatcaagattgtgattcacgctcataagaaccgtagtatacgtatctcatgagaaactgaacattttcgtagtgcggtagctgtaaaatttagggttaattcgatcgtaccattgcaaatttgattgactgaaaaaaaaaaccatttggtattcctttgaaatttgaattgtgccattatgttgtcttcaatcgtcagcgagctcatttttttctctaccgtatttttatatggacacgtttgcccctgcctgaatgacctaagacgtatgaataggatgatacgttagagataaaaaaaagaagctcgatggcaattcaaggcaatgtaattgcatgattcaaatttcagatgtataccgatgatggcactcaactagtttaacgaataataaagatattttttcaatcgttcaaaatcacaatgatatggatctgattaacctcaaatgtagtaagggtgtgcataaaaaagagagtaaatttgagagtagaaaaatggaaattctcggtgaaaggaagcgaggagttgtctcggagagagaggagagtgcattattgcacactcatcgtaaggctgaagtccacgaggacgccattattggtaactatccaatccaatcaaatcgaagagagagaggcattagttaattttaccgaaccctctcttctcctctctctctctctctctctgactgcctcgcaagcctcgcctcgcctcgctaggaaggaaggagagagtggttgctaggctagcagcaggagcgaggcggagcggagctactcctactagcttccctttcgcggccatccatgcgcgcacgcgcgagcgaggcgtgaaatccgagcaatgccgatggtgatggcgcgcggcctgccccgatccgctcatctgtagtagaggtgggagtggggttggtggtggtggtggtgtggtggcgcgagatgggatctggaagcagcaaggccggcgcctcgtcggcgtcatcttcgtcgtcggcgtcggcgtcggcgtcggcgtccggcggcgacgaggcgagtaaggggaatgggaaggggcagcggagggggagggggagggggagaggcctgctgcagcggctgccgagctcctcctcctcctgcttccgcggccacggcacgccgtcgcgcgacgacgcttcctcggcgtcttcgccaccgccaccgccacggccgccgcggcggccgttcgaggtaaggaggacaccgccgtcccgcgcttcctttgactgagccgggaatgctgcctgtgcaaacgtcgtgtgatgatgaagtggtgtgcgtatgcgtgcatttccatcgatggactggggctagatctcgtgtttgttgagcgattgccttgtttttcatgtcgagtcgtggttggggggagtttgtggtttccaccgttttcgctgcagagcattcgagttagtacttgggtggggatgggagattgcccaatgcgatttcactgagtgctgcatgatttggctacagtggctttgacagtgagtggagcttgatgaatagtgagagtttcctaatccatactcatagtatgaatcagtgtataatgaaattgattaaatttgttgggatcagacaagtctgttcatatgtaagcaatatgtggttttatgaattagatgccctgctaataacagaatgatgcatttgtgtgtttccagtctagcaagggagaggagaatggaagcctgccttcaatcgctcaaatggacaaatcagaagaggatgctcccacaatccctaaatctcatccaggtgaaggggcaacattgccttcatcacatataaacagggatcaggatgttgatgtattgcagaatgccactgccgtcaacaacagggtggaggtcaaccagtcaccaaatcattctgacagttcacggccacgttttggtgtcaacttcgggttgagtagagctgtcagcttgggatcatcggtagcctgctccattctctcatcggacctctccacttcagctaatcctgatggaggccatggaaatgtggacaattcttctgatgcaaacatctcccagcaaggtggtgcatcaactgctgggattgattcgactctggatatgcttagagatagtgtaaccgcacaagctagagcagcccatcaggctaggagaaatttgctagaatccgacaatgctaacttgagatattccaacagaaggatgggacctcaggaaccttttgaaggcagtgttcgattcagccgaacgttgagtgttggacgtcttcgtgacagagttcttaggaggactccattctcagatgggttattcaccccttcacttctttacgatagggcaatatggccatcaggaaatgctagtgccaggcaaaattcagcaatcatgcaaaggactaattcagagagaaattctgaactgcaattggattcttcaaccgactctgcaactctaagagaggccaataatcgggatctactggagcgcagatcagcttttcttgagaggaggaggatacgatctcaggtgatctgtgtttcaactattttgagcctttagttttcagctatacatactaatgtgtttgctttcttaacaggtccgagctctccaaagattgggcagcaggtatgaaaatctatcaggactatcaggacatgagagatcatgcatactatctggtcagcatagaacgggaaattgtaattgcagaacgagcagtcgaccaggaaattctgatgaagaaacaaacacaagagctagcatatcaagaatcgttatgttagcagaagcactttttgaggtaagtagtacaattgtttgtagttattgccgctttcttttactggagaaaaatgttaaattgcatccataattccatatggttatacacatcaggttctggatgagatccaccaacagtctgctgccttatcctcaaggccatcgttttcttcaattgggtccgttcctgctccaaaggaggttgtcgagcgtcttcctgtaaaagtatacaggagatcattaaaacaccaaactgaggaggctgcacagtaagccactgagcttgtatagaaattatttaacatttttagttcaatatttgaacttctacccatgctcaatttatagccattattatttgcccacaaagttcagagtctaaaactaaatcttgaggacaagtgaagcagaggcaagtaaaaaactgtgaatgtctagagtgattaagatcttatgtcttttaattgcataggcataagattatttgtgctatttgatcacccatcaagtgcttggatgaagacatgagcggtattgagttgctatcaacgctctatctagccacaaacacatgccatttttaagtcaacatttaagtgcatggtctatggatgcaacctttttccactgaaatttgcttttatttatttataaaattctataaaactatggtaccatgaatgtagtttatgagacatttcttcacatctacttttttactcatccaaactaaatagaactggtgttagtactcaaaagttttgatactttgactagatgttgtgatgtatcatgcgtggtccgaaattccaaattttaagctgagtataagaaagggcccatggatgctaattcttggcttctcgcaatataacagaattgctattctcttcatagggcatttgagctgctagttcatttccagcttaggctgttgcgtctgtaaatttttctactgtagaattatttagtactatcgttgaataaatctaaagaaaagtgtgtcattttgcaacttctcatcttttccttgctatgcagatgctacatttgccttgttgaatatgccgagggagactgtgtccgtattcttccatgcaatcatgaatttcatctaacatgcgtagataaatggttgaaagagatacacaggtatgatggattaatctaaataatttataatttgcataagtaaatgaacagaactgcggtcaacatgctattgttacctctttatgtcagagctctatagctgttccttgataagtgttctaacataacttgagtaaatgacagttaagaaagcaacattatgtactgaaaagacctacatgcttcgtgtttttcaggggtgcgtgtggggaattgggtgccaattctttt

SEQ ID NO: 52660 - DNA, 3810 bp, Oryza sativa
ttctctgaatttagtttctcaatttgctcaaaacatctggcttcatatatatgtgtgataagagtagatgtcaggttagcattttatattttagagctaccaagatatgccatcctgctaatatgaacataacccttttctttcagggtttgtccactttgtcgtggtgatgtctgcagatccaatgcatcaggcattggaaaaaccacatgatcttctcttctgtgagaaaaatggagcttctgacattgtttctgatccaatcccaacagaatttgtaatacacgtgtttcaggtgtaatttcacatattctttccctccttcgatcaggacaactcagagtgctccttcatgtggtggcaaatttgcatcgcagtcatccctgttataaaatcgatgaactgccatgtgaatttggaattcttgtatggcaagggaagtttgttgatattaggatttcattatacgttttctttgagtgttgtttgaacttgttgagacgatgactgtctttttagatgcatcagccaacgacaactttcaaaattgtgttgtcatgctgaagcaatcaatagatttttcatgctatatgggtttgatgaggcaaagaggcagtttgtggctacctggcagtgcaggagtatcttatgattataatgcgcttagtatcttcttaaggataaatgaagtataactcttatagtcttgttgtatacacgtatacaatcatcggctaaatgtaagtatagacaaaactgccatcagctaaatgtttattgtacaaccaaacggaggaaaacgaaaaaaatggttatatacaccaattaccatgctatgagctcatagtcttgctatatttaatctattagactcgctctaacgtggaatacaactcatgttatgattgccaaacccaacttagataaaaacttccaatttgggatgttgggcgatgccacttggattaatgcgaaaatccacgtggaatacaactcatgttatgattgccaaacccaacttagataaaaacttccaatctgtcgtcaccagcaagcacaaattgggggagggggagggagaattaaagatgggaaagaagggtattttggtttaagaaaatattttgtcaatgatgagcgtttgagagtagtaaattaacgaaaccaatctatagagtgatatattaacgagacttacattttttacaatggcataatttcaaatttctctacaaggacatgtacgtcccctaaccttctcttccctcgtcttgcactctagcggttacaatggtattgctagattacaatggtattgccgtaccctagctcctttgaggccggagcctgacattattgatgaggaatacaatttaccgcaactttaaaataggtcaaatgtacagttgacccaaaagaaaaatactgagaagatacataacgagatgagccattaacacacgattaatttaagtattaattacttaaaacttaaaaagtaaattaatatgatttttttgaagcaaatttatataactttttaaagaaactatcattcaacagtttggcccgtgaaaatgtatgaaaattttcactcgattgtatcagtagcgacgcaccctattttttagcattttgttgtttacccatatacccagtgggtatgggtaagattcggtgagggctgggctaccatgggtatgggtatgggtatgggctgccgtgggtatacccataccctctgcaacggctgatccgtacgcgaaaaggaaaagaaaaaggaaagaaaaacctaaaaaaaatagctgataattaaaagagaggaaaaaaaaaactcgccccgtcgttccctcctcagctcctctcccctcggaagtcgaaaccctaagaaacgcgtagcgaaggcgaggctcccgagagagagagagagagccatggcggtggcggcgccggggcagctgaacctcgacgagtcgccgtcgtggggctcccgcagcgtcgattgcttcgagaagctcgagcagatcggcgagggcacatacgggtaagccccgaacctatcgattctccccccaatctcaattcgatttctaatcccttgaaaaacgccgttccaatccggctgcgttgttcgtaggcaagtgtacatggcgagggagacggagacgcaggagatcgtcgcgctcaagaagatccgcatggataacgagcgcgagggcgtaagtatccgtgcccctgtttccggcgattttgtgtctctctctctttttttttggtttgattgatgtattcttcatcgttacggtatctggcgtagttccccatcactgcaatccgcgaaatcaaaatcctcaagaagctgcaccaccagaacgtcatccagctcaaggagatcgtcacctcgccaggtttaaccaatgattcgacatagtagaacatcttgtgatttactgaaaaatcatcctctgtatccagaggaattgatggatttggttaattgttgcaggaccggagagagatgagcaggggaaaccaagtacggctttttaaaagaacgataaatattgatattcttgggttgctgcatatatttttttttatgttgaagttgttatgtcgttgtatagtccatggtaacaagtacaaggggagcatttacatggtcttcgagtacatggaccatgacttgactgggttggcagataggcctgggatgcgtttcaccgtgccgcagattaaggtaaaaccatccattatgttatgatggctcttggtttgctaggaggtagttcttgatccaatgatggcaagataactggtataacctcttgtaccagtgttacatgaagcaactccttacaggccttcattattgtcacattaatcaagttctgcatcgtgatattaaaggtatacaacactaagcttcgttacattttattcatctcatagtgatcatgattttgtggtttttatgctaaaatattcctgattcaaaatctactcttgcaggatccaatctcttgatagacaatgaaggtaacttgaagctggctgattttggcctagcaagatcattttcaaatgatcataacggaaatctcactaatcgtgtgatcactttgtggtacaggtattgcagaattatgaacttgccattgaattttgcatattgtgttatggtatttagtttttgcttggatcatgctgaccatttgccaatgattttcagacctccagagttgctgctcggaagcaccaagtatggaccagcagttgacatgtggtctgtcggttgtatttttgcagagcttctcaatggaaagccaattctgccaggaaagaatgaggtacgatttcttcaggatttgagctagtaacatcactatcttaggattagcaattcatatggtaagttttttactagtcttggtatcttggagttggatgtgttctgaactaatatcttattgtgctaccgttgaggaaatttatgattctacctcatgttgaccaaaagaaatacggattctttgttgtcataatttgtttaaatgctattaacagctgtttctgtttattactatgattatcgacaaaacttatgtttaagaatgctttctgatgaagtgatgtgacttctgcatacatgtgaaagtgaaaccagagtgtatagataatggaacaaattgatagatttgtgcaatttagaaggtagaatgaaactttaggaagttccctatatttagtgtactgccttcagtcataaattaaactttgctgctgcagccaccagggaaaaacatgatt

SEQ ID NO: 52661 - DNA, 10065 bp, Oryza sativa
tgcatgctcatttactgaatttgttttagaagttgagaaatgcctttatgctttcccaagagaacatgaacttaacacattcactgtgggtcagctttatgaatcttaatttgtttcaagacctgtggggttactttgtacatgacatgaactctgaacacggtaactccctgtctgacctagctctccctcaccttagacaaatgcaatcagtctcttgaattgtttcattgctgtcatacattcgaagcttgaatatgtaacttaatctagttaataatgcacatttgtgagtgaacttttgtcgctctgcctttttatgcagccagagcaactgagcaaaatatttgatgtttgtggcacacctgatgaatcaaactggccgggtgtcacaaaaatgccttggtacaacaatttcaagcctccccgccaactgaagagacgtgtaaaggagtactttaagcagtaagtattatactcgtattgtttgaaacttgcttggctactcttccaggttacttaacctttatttgttttcagttttgacaggcttgctctggatctgcttgaaaagatgttaacactagatccagcacaggtatattttcttcttttagtttgcttactctgttgacataggaaatgcccgtacctgcgtatttcctcagctgtcattgcatttcattactgagctgtaagttgacatgattttgcgctgttcagaggatatcagcacaagatgcacttgatgcagagtatttctggtctgatcccctaccatgtgatcctaaaaggtagtgatcatggccttctctcctgttcttgccatctaaggttgctattttggatctcttctttctttatttgatcatatccttttcatttggaataatgcagcttgccaaagtatgaatcttcacacgagttccagaccaagaaaaaacgccaacaaatgcgtcaagccgatgaagctgcgaagaggcaaaagacacaacatcctcaaccacatggccgtttgcctccaattcaacaaacaggacagccccatcctcaaatcagaccaggccagccgatgaacaacccccatgcgccgatggctgctgggccaggccatcactatgcaaaacccagagggccaggaggctcaagcaggtatccacagggtgggaaccaaggtggaggatatccgaaccgcggcggacaaggtggtggtggcagctatggaaatgccccttaccctcaacaaggtcgagggccgccgccaccgtaccctggcagtggaatggccggaacaggtggcccaaggggtggcgttggtggtggctatggaggaggatcaaattatccccagcaaggcggcccatatggtccttctggcccaggccgagggtcaaattatccccaacaaggtggttctcgcaaccagcagcagtacggaaactggcagtagtacgttacctaaactcagcaacactatgccaattgtcttaaactctgatgttgatgctaacttgtgcttaatctattctattgggcattacattttgttagagcgtgtattgccctgaatccagtaggaattgtagcaatgttgttcgttttgattaaagaatgataagagatacacaaattgagcaacaagcaaattgtcttgaattttcactagttggtttggtaattacagctattttacaagttaaaatggtactttacacgtcgaagaaattaatgtgttctattaggcattacgtttgttagagcgtgtattgcctgaatccagtagggattgtagcaatgtttttcgttttgattaaagcatgataagtcacaagttgagcaacaaacaaattgtcttgaacttttcacttgttagtttggtataattacagctatttacaagttccaatggcactctttacacgtcgaagaaactattcagattcggagtctgcttcgttggtgtagagccggccgtcgtctgctcttgcggcgtagtcgccgccgccgtcttcttgggctcaggctcgtcgacgtccttgcgctcgtagtagtgcggcgcgatctccaccagccactccggcttgagctccgtcacctgcctcatgtactccttggtcgtgagcaccagctcgtggtacaacgcccaccgcggcggcgcctgcgccaccccggagctcgggtggacgaacaccgtctgccggctcttcacggcgcggtacgacccgtccctctgcagccgcgcagcgtggcggaagtagcccgccgtgaccgccttcctgaccgcgtcgaggtcgccgccgccggcggaggagcacggcgcgatctccacccgctcaagcagcgcccccagctggtcccgcacgtcccgcgcgcgccgcatggtgcggtgctgcacgaagctctcgcggcaccactgcggcgagtagccggactccgcccacgcgttgtacacgttgagcagcgcgacgtggtcgccggcgttgccggcgtggaacgcccgccgtgcggcgtcggcgtggacccgcttgtcccttgggcggtagaagacggcgttcccggcggacagcatggccgcgatggtgatcacctcctcggagcacccgtacctctccgacgcgacgatggccttggagagcatggggtccagggggaactccgccatcctcctcccggtcttggtgagctcgccgcggctgttgagcgcgccgagggcgaagagctcctccagcgccctgagcagcgactccgccggcggcgggtccatgaagtcgaagccgacgaggtcgttgatcccgagcgccttgagcgccagcacgacgctggcgaggttgctccgctggatctccggcaccgcgtcgtcgtcgaggtcgctgacgaagttgtactccgtgtagagccggaagcactcgcccggcccggtgcgccccgaccggccggcgcgctgctccgccgacgccctcgacaccggcgccaccaacagcgactccatcccggtgcgcgggttgtacgacttcaccttgcagaaccccgggtcgaccacgtacttgatcccgtcgatggttttttacgtctcggcgatgttggtggcgagcaccaccttgcgcgcgcccgccggcgccggctcgaagatcttggcctgcagctcggcggggaggttggcgtagatggggcagatcaccagctccgccaccttgccgccgagcacccgcagccgatgcctcaggatctcctccaccgtctcgatctcctcctgccccgtgaggaacagcaggatgtcgccgccgccggggggctccgtgacgtgcagctgcagcaccgtcacgacggcggcgtcgatgtagtccgcctccggcgccacggtgtagtggatgcccacctcgaaccgccgcccggggatccggaagacgggcgccgcgtcgaagaagtcgctgaacttgtcggcgttgagcgtcgcgctggagatgagcagcttcatgtcagggcggaggcgggcgatgtccttgacgaggccgaagaggatgtcggtggcgagcgtccgctcgtgggcctcgtcgacgacgacgacgctgtagctgcccaggtcgggctcgccgaggaactcgcggaggagcatcccgtcggtcatgtacttgatcaccgtcttctccgacgtgcagtcctcgaaccggatggagtagccgacctcgtgcccgagcttgacgcccatctcctccgccaccctcgccgccacgctcatcgccgccacgcgccgcggctgcgtgcacgccaccttcttcctcccccccgccgtgtacccgacctcgtggaggtactgcggtatctgcgtcgtcttgccggagccggtctcgccgacgacgatcaggaccttgtgctcgtcgatggccttgagcaggtcgtccttgagcttgtacaccgggagagtcttcctctcgtcttgcaacgtggccttggcatccatggcctcggcatggtactcgtcggccgccgccgccgccgccgtgtcgtcgtcgtctgcaggcgcggtgcccgccatcaccgtcgacctgacgaactcgacgccgtcgtcgaacaggagctcgtactcgtcgccgcgccggccgcgatccatggatccgaactgcagcctcgacttccgtatctgctgctcctcccaggcctcctgctcggacaaggcgttcgccgtcttgccgtccctcgccgcctcagctggctcctcgtaccgccgccgcgccaccgagaacctcttctcctgatcgacgttcgcggcggcgtcgtaggcgtccggcattctgtagtagtcgtcgcgatcgtgcacgaggccgtagacttgcttcttgtgcctcatgtccctctcctcggcggccgtcagctggacgccggggaagaggaactcgtggtcgacgatctcgtcgcgcatctcctcgaccttcttctccttccgcctctgcaggtacgcgcgccgggagagcctcctgagccccgaggtgtcgttcttgtccatggcgtccgaccggcgcgcgagctcgccctgctcccgcttggtcgtcttccgatccgtcagcctcctcgtgctcgccgcgtcgcgctccctgatgttccgctcgagctgcgccctctcgatctgatcccgctccatctcttcttcctcgccggcgtcgccgtcctcctcctcgtcgtccgggctacgccgccgtcgcgcgttccgtccggcatcgtcatcgtcttcgcccacggccttcctcctgaaacgcttcctgccgccgctggagggcgacgcggaaacgccgatctcgccgtcgtcgtcgagcagcttgatggtgctctgcttcttggccatcgccgcagcctcctgcatctgcctctggtactcgctgaccccggcgtcgtcgccgccgccgccgcaactgcggggcaccctcccgtacacgtcctcggcgaacgcggcggtgtcgggggaaggcgggaacccggcgaggtcgacgagccgcgccgcgaggtcacccgcggaggcgcactcccgcgcgaggcggacgacaagccgcgccacgaggccctgggagtatccgaggagcgccatgaggcggtcggagacccacgtcctgagctggccatcatcgctcgccgccatggcctcggcctccgtagcctcgtttgcggcggcggcgcggcggtgccgcgagaggcggtatcgaagggggttacgggcttgggctttgtggtcgccggtcggtggtgcggccaaggccgctttatccgtgcgtgaccgtgtttgtgtttgacgtattcgacgtggaggtggctccgctatggcggttcgtgtcagtgctgggaaaccgggaaccgacgcaaaccgactttgagtttggcgcatgttttttttttaataaccccgagcataagtcaaatacacgtgcatacgtcacacttgtgctacacacatttgagtgcgactcaactggcgtatttgtctctggtcaaaattttggtaatgaactggtagggtgtagccagttcaaaatttatgtcactactaaattaccatttttcatatcaccgtccgtttattttattgacgggttaaaaaaacacacgcttgtgaaaatacattttggagattatggtcatgaaccgctagtgagaatcgactttcgctaacagtcacttaaaaggtccacttgtaaaaatagagtgtttttacaaacgggtctattaagtcatcgttgcgaaaaaatcaattttcattggataaagaggatcgtaaggaaaaaaaatcgacataataaaagaggagtccttgaccaatccaccagctgagtccctctccttcatcctctcccttacctctccttcctccctctcccttcagcttctgggtcatttaactttttgtcacttttaaaatgtggcaattaggaatttgttattcacaatctatgtgagccctcacatgtctatgatatgtgggtccaatagcaaatccttaattgtcacaagtaatagtggcaaatagttaaatatttctccaccttatgtaccagtctccttctccctcctcctttctagaaaattgtgatttttctatcgcaaaagaatggtttcgctggaatactatcccttcaaagtgattcattaaaatgctattctaaactaaggctgcattctatacccatggttcccaactttcctccatcgttttacgcacacacgcttttcaaactgctagacggtgtgttttttgcaaaaaaaaaattctatacgaaagttgctcaaaaaatcatattaatccatttttgaaaaaaaaatagcaaatactaaattaatcgcgtgctaatcgctactccgttttccgtgctaggaagtgaggttcccaaccctcactcccgaacacagcctaagaggtgttcactgaaatgctattttggatctttttggttagtactaatgtttttactctcttttagtttttctccggaccaaaatgccctcgcctctatgtcctcctttcgcccaggataatggctggttgacacatgctttgctctagcaaaatatattgctatatatttgtgaaacctatgcacggctcacgctccgctgcgtgatatatatatactaattgatcattaacactaatacaaaagctctagtgcactggtttgaaagtcaaacagcacttctctggttttgacacatgctttgctatagcaatatattttgctttcacattttgtacaattaaaaatggtgtgtagtccagttcagccacaagcgcgcatacacatcaagatttttctcactccaagttataaagatataatggagaagctagcttaacccataaaatttgggcatgaaaaaattgtaaaaacaaaatagaacaaatttggacagcatgtagacataatattgaatagcatgtggttcacaaaatacctcacataacaatggttcacaacataacagtagttcacaacataccagtggttcacatgcaccatggttcacaacgtaataaagacaaggacacaagggtattttggtcagaacaaaacttaaaatagagtaaaatcatttctagcaatcaaaaagatctaaaatagcatttcagtgaacacccttagtttatgatagcatttaatgaatcactttgaagggatagcattccagcgaaaccattcttttgcgatagcaaaatcacaattttctccctcctttcgcctccttccctaccggcgtcgcttggattccacaggtgtgtgcccctctcctcgtccttccccatgggtggtggtgagcttgggcgagcctcgcaggctgtatgtggtggtgactcaggcgaggcgcgcgggtgaagctagggtgaggcgtgtgggtgacagatctggtagcggcgacttggttcgatagtggattcgtcggcggacctcgcgcgaggcacatgggcggcggatccggtggcagcgactccgttcagcggcggatccgatggcatcgagtctcgcgggcggtggagctcgagctgggcatgcgggcggcggatgcgacgacgacgacgacttgtgcgggatggtggatccgatggcaaggcattagcggtagtccggtggcagcaacttgcgtgggtgggaaggtacaagcggtagttcggctgatccagtgacaacaaaccgtgctccaacgaggcgtgcgtcctctgcctctcttttttttttctcttttctatttgttctttccgttctcttccggatccatgttggtatgatgcaaatgatttgatttgtattttgtgtttgatctatggaaatgggcagggagctagggttcctaggagagcaatgatgcagatgatttgttttgttttttgtgtttgatatgtgaaagtgggcagggagttatgggggagcagggtttctaaaagttttatttttttcactgaaaatctatgttgctggcttaacctcaccatttgcaaaaatgattttcacaagtggtcggcttaacatagctgcttctggaaatcaattttcactgacattgtaggacccgctcgcgaagattgtcgattttcactggcttttgatctcacggtattaccagccgaccgactgtaaaaacctattttgaccgcctgcgaaaatcatttctattttgtagcggcttttaagtgccgctacgaaagaggcagcaatcgtagccaatcaatgccgatgtgtagtttgctatcaatatgtttggtatagcaaagaaagttaagtgttgttaaattgagtatggagcaatgggagattaaaaaaaagattgagtatgggaattatccatgctttgactctaatccaacccaatcacattatcattagagttgccaaataatcgtcatggcacattttgacacagatccaaaatggcccaacactcatctaaacaggattggaggccctagcccacaagcgccaattttttttgagaactttgacatctattcttcacgtcttgcaccatagttgttcctatttatttgagcttacatttttaataagttcataatattgtaagacgtaaagatttttagtaaccaacgcggctggaaatatgttgactcattcatcatttatcatttataaacgaaaaacccatccgaaagctaacttgatctgcaagaacaattgacttgtgaacccagaagtcaaagtagatactccaacatcgtccgaactcgtaagattttccaggatttgcagataccgacatacgtcgtttggatgaaacggttgctagggcagcttccgagaaaatcactgtaaaatagtactagcccatagctccaacgaatgatggcagtagccagatgagctagctgttgaccaacaaggttcagttgcccagattgcatcgtgctgctacgcaaatgggctgcgtgcccctcatggtgggctgcacacgttcggaatgctcatcatgaattccgaacctggaaaaagttcactttaggtacatcatcttgacgtcgagtttaacttgcatacttaaaccacaataccagatataatgcatccctaaatttacaaaaccagtgtaccaattacctgaagcagtataatacctgttttggttgacttagcgagtagatcccatatgctagcaactcactcttcttccttctccctccccctctcccctctttcccatccctcttcagaataggtggcgagagatggggagaaggaaggctattggcgggaggcagtggtagggagacgcgagctagtgagcgcgagtccgtgagcacgggagcctagaggaggaagaacacgacccttccagtccgctgcaaccatcgctcctctccaagaccgtccttctccacgctgcttgccacctctagtaggtcaccgtgcaccaccccctcccccttgtcgacaacccttttcccagccgcttgctaccctcccgttggctgcctctccctattagccgccacccttctccccaccactcaaagccctcccatcaacttctgctcaaaggcttggtgagaatctaagagaaggggaagtgagggaagaggtgggaggaggaagatttagccactgacatgtgaggcccgtgcaatataccgctctgggacctcgggcaaaccagttttataagttgagggacacgttatatccggtattgcggataaaggaaataattcaaacttgacaccaagataagagatctaaagtgaacttattccttctggactttcgctagcgttgacggctcagtaactttaatagtaaaattcatcgttttttattagcacgttttctgtactgctaaaccatgtattttgtgtaaaatttatctatataaaagtaaaacaaattaaataaacctaatttttaaatttataataattaatattcgataaattatacgttcatgggctttcacttcccgtcaaaattctaagttcaattcctcaaagcaccctcagcttattctcttctctgattttaatacaagaaaagatgacacggaacaagcatctggacgaccttggacaatgcgcagagataaggg

SEQ ID NO: 52662 - DNA, 2569 bp, Oryza sativa
ggcggtcgggctggacccagcggccgtcgggggcgcggaccatgcccttgttctcgtcctggcgccagcacgggggcacgcagtggtggtcttgaggaagtcgcacgccttgttcaccagcgccgggtcgcgcccgctcgccagcacgaaccgctccccgcgcccgtggtacctgcatgcaccaacgccatcgcgcacatgtacacaccgtcaccgaccgatcgatacagaaaacgcaggactagtagtagtactcggaacgatgatataacctctatccagaatacttgtcaagtttttttttaacttttaatccatcatcttatttaaaaaattatagatttattttttattttttatttactttattgtcaaaagtactttatgatttctctgtttttatatttgtattaattttttaaataaaacgaatggtcaaagaaaaaaaaaagtcaaagcaactactaatttactaatttatgacggagggacggaggtagtatatgctaatctatctatctatctatctactattatatactaaaagtccattaaacgtcctacaaacgctcctaagccgtcatgtggcatcctataaacactatcgagtcgccacgtgacaaatcataaaaaatctatctattatatacttaaaagtccattaaactttctacaaacgctcctaagccgctatatgtcatcctataaacactcttgagtcgcattgattttccgttaaatcagtggacccatatattttaaccattagatctcttccggaaaaaaaatccggtagccccatccctatcatgcgcaggtactccctctgacctctcttttcctctcctattttctaggtaactactcctattttttagctaattacaattagatctatctaagatttcctagctatgtttatctttgtaagatttgcacgtacaaaaagttccacatacgtacgtacatacgtactctcactttttttcccttgatgagatagaaaaccaaattaataattcaatacacatattaactgttaatattttaagttgtaaaaatacacattagtaaattagaaaatatttctagaaaaatacgaggaaaaaagcaaaacatctggtcatcgatttttatttaaattagtggatatgttatctcggatcattaaattaaatatattaataaccttacacctaatctctctcagcgcaccgacgagagaaaggtacttacacacagctaataaaaaaaccaaaaaatacatatataactgtaatgtgtgattaaaaaggataaaatggaaaaaaacataaatttttattccatgtatcattaaaaattacatccgcttccatctcctcctctcttttctccatgcatgtatagatgagattgtaactataattagtgatattaaattttaaagaactataactttataaacatagattatatatatcataatatatacgtaaataaattagatccataatctttggaaataaaatttattggactctgttatttcacccattatattaacaatataatataattttatttcgaaccattattttaaaaacacacggtttaaaataaaggttacagaactatgttttgtaccattaaattaccaatttatgatctatattaactaatttatacttcaattagtggactcactattttaaattatttttaataaaatattttgccatcgatttttacttaaactgacggacctattaattaattaggcagacatatctatcttacgtaaaaaaagaaaaaaaaagcttctaaagacctatcttcaatcctctgcacaacacacgtgttcatatttgccttctgcagatataacaaagcttcgtagctgaggtagctaaaagtgattgccaaagtgatcatgattgtcgataaacactacacatactaattaaatttatataatttctctcttatttcaaacaaatattattttgaagaaaacaattgaacatgtgaaaaacaaaaaaaaatagcttcaaataattgctgatatttttgcactactaaaccaagcatttgtgcactactaaaccaagcaattgtgtaggtgatttgtgccctaacataaaaagcctttaattctttaaaagtgtggaaaaatatgaacattttgaacttctacgaagggaagaacaatgcaaccgttaatctatccttaatttggttgttactaaatcatgcatcttcatgaggcgattcaatcacaataactttaaatttcttactatttatagtaatattgtacagtatgtgttcagatggtatacatattatttacttactatttacttactagatccaatagtcgacctcatataaccttgatttatcttctaagtcgataaatgatatttagacatgcccaacctataatttacctttataaggtacaatttccaaaaaaactataatatcacgttttaataatacgaatgtccacggaccacctttctagttaatatacagattgccaatggcaaaatatacgtctcagccaacgatagaaaacgacaaa

SEQ ID NO: 52663 - DNA, 12153 bp, Oryza sativa
  unsure (1)..(12153): unsure at all n locations
gatcagtacagtataatatgtgagttgtggggtgtgtttagttcacacaaaattagaagtttggttaaaattgaaacgatgtgacagaaaagttggaagtttgtgtgtagaaaagttttgatgtgatganaaagttaaaagtttgatgaaaaagtttagaaataaactcagcctataatacaaattgcagcaaatgtatgcagtgtaatctatgcacaaccgtactagctaatactcatggttagcaagtcgtcatagggaggaacatgtcttcaagagattcaacatcttaatacgtgatacgagtagagaccgcaaattgttcaaccaaaggacatcaccactatcaccaaatgctatcagctgtgtcctttttaaaaattttgtcatgaaccaataaatttggcacttgtagttatttattatgttttggaaaatagaaaagtacgcatgttctagatgacggatcacgcacgctagctatatctcaaacaagatcacactatcattgccatctctcataaataaaagagagagaggatcatatatcatgagtagtatcatataattgcatctcatgtccctgtatgactaataggcgatatgatcgatctatactagtataccacatgatcacatgatttttttaaacacatgctgaatgcaagctgccacctactactatacatatactgtactatgttgcattcctgtaataaactggccaagtggtcgaccttctgccctccggtctttagtctcttactaggccataatctcgtcattaagagtactaattcttcttcaaagaaaaaataattaataagagtactaatgagatgacttgaccgcttcagaatattcctgggccgaaccaccttttctatcgttgattacttgtaggcgttcgagaatttatactcttacccggtgaccacgctactgtcattttctaccgtctgtttagccctttcaaccatttcaatgtacttaagtctatgacacagcccgtttcaggcgacgtcatcaccttcaagttgttagcttatactaaaccactgggccggcgtgactgagataggcatgcggtgacgtttagggattaggtagtttcgttttatgtcaaaataaatttattaaattttgttgacgtcaaattttgttattgtttttttaaaatgaaataggcatagaaagacctctttggtttgacgtcctaccattttaggttggtatgcagatgtagtgatgtattcagggttactaaatattcagtgatagtggtttgttaaaatattgcgtttgtcgccttatttcaagaactttattttttaccgaaatcaattgagttctgactttcaaaagttagctttttgatagtacgaattaaaaacgtgcatgtagtgatgtattcggagctaccgaatcttgttgtgaacttgtgattaagtggtttattaaaatatagcttttgtcaccttattttataagaaccattttttttaccgaaatcagttcagttctgactttcagaaattagcttcagatatttgagcatatggatgaggaggtagtgaaaacgtgcaaattaccagatgtagggaagtatttggagttaccaaatcttctcgtgattgagcggttggttaaaaaacttaatatagtgcttttgttgccttatttcaactcctttttttttttaccaaaatcggctcggttctgactttcaaaagttggctttcggagatttgagcatggatgatgaggtaggtaccaaatgtgcaaagctgatgaggtcaagttgagatggtcaccattattagtttctaatgaacattaaataggatagaaaataaaaaaactattaacacatgattaattaaatttcaattatttatataaacttaaaaaataaatttatttaatattttaaattaatttcatctgaaagtattttatgcaagttttatattaaaaagggcgtatttaaaaaactaccgcaagtttttttaattaaaaactttcagtgtagctatattttaactacactaaactaggatataacttatataaaacttgtattcaagtatagtttggtttagttagttagtactgagattttaagtacaacattttctatcgatttttttcatgcacatatttggagacatatgtggagacaatctcatggttgcaaatctaaaagttttagggaccaagaaaaacctacgaaagttttattttttagtaaatttaaaaaacgaactatcatcttaatcagaagtgaaggagggcttacccgtcgaggaggtggaggtgcgcctcgaggttgtggaagcaggccgggtcgagcgtgtccttgaggaacggcgaccgcttgtggtcgagcgcgagctccacgccgacgtgcgcgtagcaccacggcacccggaggatgccctccgccacccgccgcagcgccgccggcgccccctcgttcagcaggatccccggcatccgcgccaccccgtcgtgcacgttcaccacccgcagcgccttcaccccgagctccccctcgaacctctccttgaacctcgcgttccccaccctcggccccgcgaacgagtacacgcacaccgccgccgccgcctccttcccgccgccgtgcgccgcgctcgcggcgcccgactccgcgatgtcgtacgcgctgatcatcgccagcgcgctgccgaggctgtgccccgtcaccgtcacgctcacgtcctcgccgagcgcggcgtagcgggtgacgaggcggcggacctccgtgagcacctgctcgcgcgcggagtacttgcagaagcggcaggtggggtccttgtcggtgtagaggtccacgaagccggactccaccttcacctcccggtccgggcacgggatgccctcgtcggcgacggggcggaggaagtccatgaggtcggagacccactcgaggcgcgtgaccgtgccgcgccacgcgatggcgatgtcgcgccggcccaggcgcgcggtctcctcgtcggtggagacggcgacgtagccgatccagttggcgcgctggctccagatcttggcacccgcgcgcgactgcgagaagaagtttgggaagcggaagttggaggtggcgtagaggtagcgggtcacggtgtagccccgcgcggcggcgggcatgccgaggcggtcgaagaaggcgcggcgcgggtacttgcagctgccgcagtagcgggaggacgggtcgtagtcgaaggcgtcgtagcacgcctgcgcgaactcgccgtagcggatgagctccgagcggagcagcgggtccatcggggtcgagcagcccgcccagtcgtcgcgccgtggatctcccgccaccgcgccgccagctcgtgcccgtcctggtggtgctgccggtgatggcgcctccgcgccgccccgaggtcctggctatcgtggtgatacagctcctcatcctcctcctcctcctcctcctcctccgccgcttgtccgtggcgaacgacgacgtcgtgctcgagctggccgacgagggaggcgagcgcatcgtccctcgtggccgcggaggggaggaggcgcagcctgtcgccgtcgtcgctggctgtgccggtgaggaggcggcacggaggtggagcgcgtcggaaggagaggtgcgtgtgggcggtggtggtggcggcggcgcgggggagagaggagaggtgcggggagagttcgcggcaggagatgggcgccatcgggaaggtcaccggcgaagtcgccgcgggttcgggtgagcgagtattctggacgtaccaacgtggggagatcatcaaaggagtagtttattgatgatgatgggtgtaggactgtgggaggctctgtccggtgggtcggctaccactgccgtaatttattactccgatactgtaacaatcgattaagataacagactttgcctcagtcttcaagactctaagagccctttaaatcataggaatacgaaaacataggaatagaaaaaacacaggattttgatagaaatataagtgtaaaacagaggattgcaaaatacaagaatgaccgtttgattggaccgcaggaaaaacataggaattagaggagagataaagactcaaaaggaaagtttctaagaggttttacctcatgttagaatttctccaaaacttacatggcattaggcaatccataggaattttataggattccataagatccattcctttgattcaaaggctatataggaaaaattcttataggaatgaaattctctaaaaatttctatgaatttcctttgaatcaaagggggcctaaacatcgtcgaccttcgactggtcatggagtagggaaccggacaagtccataaaatttgctcgctaatttatttctcacatgatagtataatattttttttaaaaaaataaagttcactcgttagttcatttctcacatggtaatataacttttagataaaataaactagaaatgaaataagaagaagaaaaatcccactaacccatcctgcttgcatccatagagataaaagagtggcagggaaagggtgagaggagggaagaggacaactgaacatttctgtttaacagagtatttattctatccttaaaaaaatcaattgtttatatatcttgttttaagctatttattaagttttatttctaaaatatttaacttatccttttattttacaaaatccacatcaataatatttttaaaaatctaaattaaattgggccttaggtgacttgagaagaggagagacggagacactagtggtggcggtaataggaaagcaataccaacgagtgacaacaagtctagaggcggtagtgcataggaaggtgggggtgtcactactctagcagggagaaaaggaatccgtcaacaggctataccccatatatggtatttttgaagtataggagtcgttggtgtcaaggtatacgcaagattaaggtaaaagttaagagacgagagacatttattttttatacatatccaagactcttacttacgtgtaataactttactcctgttgatcggaactggtgttgctattatatatcaatatcacacgagtacaataataaggatgacctaacataatctctatcagtatagtggtgtaaagctgtcgacgactagtagtagtcgacttcctcgaacatgaactcaacaagattggagattgccctagcttttgtggcgctatagtcttgtcttgacttatgctaatctgtattggttttttatttgtgcgtcccttctccttctggtggacttgtatttatatcctcgggtgctctcttgtccaagtaaggcgagggaggcaactatggatacgattcaagtagaccttgtagtgttcaagtaggactttgtttctcttcccttatccagaacaccttccatatatgagacttgattctgtattaaacttagtatatggttggtcccaccgagcctaaaatagaagtaagaagtatctcatgtccagaacacttacagaacctccattttgtgattcagccaaggcgctagtgtgcggacctaaagtcgggaacacgagacaatgagtttatacaggttcgccgtacggaaacgtaataccctactcatatgttcttatctggatccttttgctgtagtgtgtacaagatgttaagtttcttctattctagagctggagagggctcttgtccttagtggcttttttggttggtagattcaggatgccctcctctctttgtctcttgagagtagcggtgatattgagttctatgtttgggtacatgaatggtgggattgatcacgaagagatggattaattagtttgttgacgtgcatgaatttctaggcaatgctaagcatgtaaaagtgattaatggaaaaagaaaaaaaaagaaggcaaccgataaatagacaacttaagaaaaaaatattttggtattgcaatgtgatcttaggtcctagcttctctcttcccattacgatcacctttgtgcggagaaagtcaattcaaacattttaagggtacatacttcatttcttacacatcatcgtatatatattatatgtctaaataaaaagtaactattaatgacatagtaccaaattttggaaacaatgaaaaggaactgttcgatttgatatcaaatctgtgtccataagagagaatatgcgcaatgacaaaatttaataggatagcatttccatggtttgtctagtttgttaccctgttcaagttctggtacgatggattttgatagaaaagcaaacatagattctagttggatcacctgaataggaaaaccgtaaaaacgtagaaacatgataggatgacaatcaaatttctatgttaactttaaaaatacataaagcttcaaaactattatacatagggaacatgcagaaaatttgagtcacgggaagaagaaaacatgaagcacaacctcaatcttattttcctaaatgtttcccatggattggccgtccattccatacaatttttaaaggaatttgtagtgctggatcctttgttttaaatgtatgcattgaattttttttcataggatacaaatctttcaaaattcctttgcttttctattattccatatgagctgtgaaaatctatggtgtaaagatggaagtgctaatattctcgtctattttttcaattgagtcaaatgcattgtcaattcttaaagttatacttggtgtcattatagtttctaaactttcgaaatacaaatgtaacccctcattcttgttaaatatacccactccgttttcaaatgttgtaacatagaatgagattagacccatgttagcactacgaatttggataaagcagttatctgatttgtttgttttactaggataagtatatttaagtgcagagtgactatcatacaagttaaaaaaaatagtaggacgtgtactctatgtactaacgtggttaccgacgtgtatttatgttgttttcaaagtttaggaatcaatattatatcgtgatataagtgtcagcgtatttcactcttcttaattagttgcttatagctactaatggggttatgttcggtaggccgaaactatagctgcaactttatctgccgctgtcttgtgtgggtggtactatttgtgcttgctatagcacaacattaaaccatatagccaaacaaccccaataattcttagcagatattctttttacaaaattagttgatagatgtgttcaatgtgttcaattaaactgtatctctatctctactattataaaaattgaagatgtttttgctggtattttggtacgtcatccgtgttagagtcggtttttaaatttttttcgcttttagaaatatacatccatgtttgagtccaattttaagttcgtttgcttttagaaatataaaaggagtcgtataagaaatctctttaaaaaaatttgcatactaacttaagatgagtgtcagactcctaattacaactcatgattttctagaaaaaaaatatccaagcgaattctcacagtaaattttaccatagccaaaccgtataacaataataagattaaaataatattcatccgttgtaacgcatagacatcttttatagtaaactaaaatatctggttagtgcacgtactcatgtctcccgacgcattttgcacaagccggaagttaaactccagtaaaaaacctgtcacttaaaccacgctagtttttgaaggaaactgccatcaaacggtttgtgcgagtgagcgcgaccgggaaaatcccccgtgcgggcgccgggcggtgctccgcaatcaccctatccaaccaaatccgcgagaaaactccatatcccctccactccactccacgcgcggctctacctcccactcccccctctcctctcctntcctctcctccacctccactctccgctgtccacacgcgcccgcgcgcgcgagaggcgagagctcgctctcccagtcccatccctgtcgctccccatgttcgccgctttcacctcctccaccggcctccccttgccgcgcgcgggcgggctcctcctcctccccacctcccgctccctcctcctcccgcgccaccgccaccgncttcgncttcnnnaatttggccgccgctgcngccccccggagggggagtgtccgccgggggcggcggtgctgcttttcgagggagccgccgaggacgctgttcccggcgggttcaagcggccggagatccgggtcccggcgctcgtcttccgcgtcggcgccgacgaggcgctggcctccggggacgcggtggtcgcggccgtggcgcggggcgtggggatcgtcgtgctcgaggccggggaggagggcggcgggcgcgtctacgaggccgcgctctcgctcaaggcgtcggtcggggaccgcgcctacctgctcgtcgcggagcgcgtcgacgtcgcctcggcggtcggtgccagcggcgtcgtgctggctgacgacggttggtgactgctttttttctccccagcttcgtatttcgtacgagtagttgcttgttgtggtaggtagttgcttgtttgaaacaaagccattgaaaaatatgtttcagggtgatatttattcggtttgaaagttgaggccgaacgccaatcgattttatagttcatggcgaaaaatggatttcgagcaaagtttaagggccataattggactttaccctttagaatatgccatatggtttcgtataatttagtaccacctctatcccaaaataagttcatttttcatcaatcacacgcatatcataaaaaacaaaaaaaaaactagaatactcctattttatcaaatcccaatgcaactattcatcactttatctactccaaataccatcctttcttcctttatagttggtacccactacaagtcatttatgctataaagcttaaattctgtgagaccacatcatcaagattatattaaccattagatcatcttgcgtctatgcaaatcaaccattagatcaagttcttctcagccgatggcatttgagaggaccaatgctttttgtcttccgcttaattacctcacgcatcattatatatccctttatcactaaccactaaccaatacatctcccacctaaagcctacaccactacatttgtgtctacctttttatcattccttttaatttttctaatgcatctactagccatatctaggttgatccaatggattttcttggaatatttatgcttgaacaggcttcctcaatcatctaaagaggaaatgtcaatggtccaatgaaattttggtttgtcactgtcatagatgacatcgaaaatttgttggacagattacaacactcgatgatttttaccaattgcaaggatgtgtatctatgcctatctcctatggtgattggtttttggtactctatcatgatcttgcttcttttcatatctgatttcttcgtgttaaaaggttgtgccaaatctttgtgtttttaagaccgcaatcactaaatttgtttctccacagttcctccaatttacttataggtgaacatgtttcttgaaattactagattcatgcacccaatagttgtttttttttaagatcatataccaacatatgcatgcaacattatccgtattttctctttgttttctcacaaaaagaaatattttattagttatttaaaatatctgaatgagatcttaagccaatttagtacataataaaaatagtgtcatgtttgcttaccgtttatggttcttcgaaatgggagtatcttaattggaatcatgtcatttctattcatatagcaattcaatgtacagatcgaacgttcaagcatgttgatcatgtaattatgataaatttataactatatggtcccttctatgtaatgatactataccaatagtcaaaagttctagaattattcagtcaaaaaaaaagttctagaattatagcttacaaattcatgatataactgtcccgcagcaacgcgtggggtatcaactagtcattcacaatgattactccaaaaatgaacttattttgggacaaattgaagggctaaaaatgaacttaatatgggacgaaggaagtacattttttagtcacttgtcttacctgctccttttcccagttttcagtacttgtcatgtcaataactttgaccagatttcgctagatattgttctctgtcgtggtgctaaccaataatcagtcagtttctttagaagtactaaaaaagaaactactagtatgtagcaacaaccaagcatttttctaaggaggttccttctgtactttgatgcaggtattcctgctattgttgcaaggagtatgatgatgaagtccaactcggactccatatacctccctcttgtcgctagaaccatacgttctgcagacactgcaagaagcgccacaagttcagagggggctgattttcttatcatcgataccggcagtgatgatgctattaatgttatgaatggtgttagtggcactcagcatgtgaagatccccattttttccactttgagtgattcgcaaagtgaagggtcttactcagataacacatccaggttgctccaatccggtgcatctggaattgttatgtctttggctggtattcaagtactcgctgatgatattatagaacgggatttttcaaaagtggataccgctgaaagtgtcctacaggctaattactcttcagctagtactttggaagaagcagataatgtaatggtcctaactcgtgagaaggcaaaagttgctggattcacaaaactagatgaaaaagtaatgcagctgatatcgatagaaaagcctattctaagtgaagctgttgctgttatccgcaaggcagcaccaatggtgatcatctaatgttacatatttggtagttgaagttgccctggaatgaattcagtttttcttcacatcatcatttctagcatatcctcgacttgaaatataattttctgttttgtggcaacagatggaggaagttgagcttctagttgatgctgcttctcgcctgagtgagccatttttgttggttactgtggtaatttggtttacattaaatgttgatagcttgctttatacttcatagacagatgattttttagacatgattcttctgttgtttgcataaataatgaaattgtattatgtggttcatggaaatgctgcttctcacgctggataacactgacagtcctgccatggattttctcaaagcaatttatattatatgattatttctcaccccaaggatttttttatgagaagttatgaccatgttggatcaatgcttagcagcaattatatttttaggcggttcagataaacctgtagcatttaatgttgattttggctgattttacatcatgaactctggctaaaaaatttaaaaaactaaaattctttttaagaggagaaatattgttcacactatgctcgtatgatgctgacatacactatgtttttctgaaaaaatccatttacagcccacacctttgcaaagtgttgaaatcaactatctcaacctccaaccttggaacttaaaaatggatcactcccaacctgaattcctggagtagagaattggacattttgcgaccacaaactctaaaatcttgttcactttttaaaccctcaggctggtttggttgatgtctgctcacatgctgatgaccacactgatgttttagctcacatgccagcccacctagcaaagtcttttttaggtctggcactgacaaaatctcaagggggtggcatgcaaatgccacataaacaaaagcaatccagttttgctgtgagagggttgagagtttgatgttaaaaaatatctggttttgtagtttagagttcatataaactaccagaagagtcgctattaaatggacatttcttaaaacaaaactcatttatgtccacatcctcatttatgtaactggaagcatatatgccgacatccttgatggtgatccatttgcatcagctgacataaagccccttgcttttctctttcatctttcattataattaatcagattataactcccccaaacataggtccctgttctacaaaggcataaactgaactgctgggcttgttgtcctgatgaa

SEQ ID NO: 52664 - DNA, 2683 bp, Oryza sativa
aatcctataatagatcatttgttgaatgtgccccatttttatttcctctgcatggataactgaataatctcttgatttgtatttggttctagttctttacaattatgaaattaatcaaaagggaaggattgtctgtatgacttgtctaagttcctgggatcggtgggtttaaaatataatctcccagggcgattaactcaatgcatccttttatcatgcattggcaatttagcatgctgcacttccttaggaaagtgcctgttgcctgttgcctaaattattgcagaacacacttccttggccccaacctatgatatgcattctgtctcacattttttatgtagtttggtacacttatttgaatactgactaaagacttaaattttcacacccaagtttattttttgaggaacgtgatattgtggccatctgtgacgagcctttttaaacttatagattgcatattgcttaggattttatccttatgcgattccttacctaacaaatattttattgaaaattctataatccttatttatctctcaaggatgcagttttgtccttggtcctttattatttgtcctttacagtggagctaaaaacgttcttgacttctaggtcggatttctccagtatgttcagcagtggaagaagaaagttgtatttgtactaaacaaattggacctttatcggaacagtaacgaggtctgatataaatctctagttcaaaatccctgcaaaatattgcctatcctatttacctttttcctgattgctattttgcttctcaatccaacggttttagcttgaagaggctactgcatttatcaaggaaaatgcaagaaaattgcttaacacagaggatgtgacattatttcctgtatcttcacgctctgctctggaggccaagcttttgtattcaaaaaatgatggaagagagcatcatggggaagctttgtttaatgaccctagatggagaaacagcaagttttatgatctagagcattacctattgagcttcttggatggatcaacagaaaatgggaaggaaagggtccggctgaaacttgaaacgccaattggaattgcagatcgtttgctaacgtcatgtcaaaggcttgtgaagctagaatatgaaaaggctattgatgacctaacatccatcaaggatcttgtttctggtgcaaacaattatgctgtgaagattgaggctgacagtgattcttggcaaaggcagatttcatcccttgtaggttttctgaagatgactatttctgttttacccttatgttcttcaattctactatgatatattccctatttgcaaccataaggcatacatagtagttagctttgatgcaaaataagagaaaacatacaaataatggtgtttttcctgctggtttttcattttttctccctgaagtttatgcgaacaaaagagtgaaagtcttcctctcctttctaaggaaattatgaggggtggtttagtttttcttccagtggcatgtgcttcagttgagatatctttagtccatatgtaatactgtatagttgacaaatgtcttaacctgttgcattgatattttctttttatcttgcagattgcgagagctaaaggccgagcaatttcgctcatggaatctacacttcagttgtcaaacattgaccttatttttacatacaccctttcaggggggaaaagcactcccaccaaagttacatcattttttcaaaatgatattctgagcccttcccttgatgacgcagcagtatgttgaacactcttctcatttacatatcatattaaaaattttctttctacatgtttgtattttccacattttcttgcacatgtcattcagacaaaaattgcccaggtttgttgcaaacaattcagatacataaatatcacgagaaaattgagtagtgggcatcattaactcctggtgtctggttcatatttgttcatgcctgttactcctatttgtttaaaagatttctaacatttgcttcatgttggttatttatttgcattgtggtgcttatttgtttgtgttatcaacaaaactttctttcttttgtctagaatttgctaagtgaatattctacatggttgagttctaccaatgtccgtgaagcaaatatatatgtggactgcttccatgagagatggggtgcattggttgcccaggagcaaaggattccgccagagaaaaatgaacttgtcaatgaagaagagaaactctgtgtaaaggcactggatggcttcagtgctagtgctgctgctaaggtttttgaagaagaaattcgtgaagtggtatgcctatgaagatatagttataacttttttatacatacagtatacttctttattattcctgaaactgtagaataagcttatccttataaactaacaaagtgtgacttctaagccctgaagttttcagcacagatgagaaaacctaaaaccactgaaaggtctcaagtaatactgatacagaaagtcacatggaagagatgatataccaactataataacattaaaataacctgaagtaggggagttggactgaagcttactttgattctttttttcttaatgaaaatgataataatggtcttcttaattcttattatgtaccaactattttaattttatcataggcaagtaattagtatt

SEQ ID NO: 52665 - DNA, 7875 bp, Oryza sativa
aaaactttcttctaaggttgacgaagctattcagcaggatatatcccgtagtgctaatcaattagtccattttgttgagactgtcagcaaaccttatcaagatgcatgtcagcaaaagatagattggctgcagggtgttcagggtgagttgtccactgttgagcgtaagctccaaactttgaaagttgaaattcaaaatcttcatgaatcatgaggtttcaattccattgaaattttcttcatttatttgcactcatgccttggatgggtgatatgcgctcatcaaattttgttagttggtgttgtattatggtggggctgttgatagatatatctgtaatatatgttgtaccttctcaacaagtgatacttatcacgtaatcaggagcaatgcaaccacaggttcaatcgatcattattcaaatgtttttccctgttctatgttagttgcccagggccattacaaaagctttgcaatggtgttggaactactgccctacacatgaagctggatttagattgagtttctacatacatagtatgtaaacagttctttatatttgaatgtaaattttaaattcgcgaacgctttttcataattttatggctagcttcaatcaatacgactgcttgcattcactaataaacgtttgttgtcgtacacagtacagaatacacattatggcattattccagccgtatatcctccaattgtttaatttctctggtccagttggtacttcgtatcacccctttttcttatgccaagttcttctccgtcgtctaattaagacaaaaggacaagtactacaccattcattggtaattgcttctgttgaaatcttgtagctgtcgtgcatctgggcatctagcctttcggttagtgccttgctacagagtacaactagatactgttgatagcttagtcaaatgccatccgagtgcccataaaacctcctctgattggaggtcttggcaacaaatggtgatgtgccttctgccactctcttgctctctttattcttcctttcactaccatgtctcaggtagatgcatatgcacggatacctgtccaagctgcacggtatatcactgaacttgtgggtaacagatgccaagctgaatttattctctcccactctcttttcatatgtatacaccatacacacacatccacgagtgcgttctcatttcatatgcgacaagaagaaaaaagccaacaaaactctttatggaagcgcgcccgtaatcgcacgattacgggtactaggatttaacctctgataggtaagagtcatgtatccacacacgtcaaatgtgcttcctcaaactgcatttgttctctttctaggattggaaaaaatgctgcctgaaagttcaaacattccggtgagcaataataatgcaatatgccagtgttccaagattatttctactaattccttcggctcagattaattaacaagcagttgaattttcgtgctaccgaaactagcagctactgggggtgcctaataatcgcctaccattccatgttttgtccttgtttatgtttgttttgctaaagcatgtcttgggagtacttttaattgcttgtcctgcatgcatcacagcatcagcagcataaacttttttttgcaccccttttctttaatttaagagtagtacaatgcatgaagtagccgcgagtgcacggtaggattcttgcctttgcggtgctggattcagctcaacgctcgttggacacatgcgaagcacaagcacaaaaggttaaggcgattgtttaccttgtgttaaaaggtgctaagttgacatcattaggggtagatatattaaaagtgatcgagactatgcatgcctaaatattgtttttaacgttgtcgtcacgaacagtcactgtgatacctccgttttaaatatactctctccgtcccataaaaaaccaatctagtatcgaatgtgacacatgctagtactacgaatctgaatatacaatgtcatatccggtcctgtattcgttttttatgggacaaatggagtataactcagtcggtttgttatactgattgttataattaaaataaatttaatgtaaaacaagtttcacagcaaaataaatcatacttacataaatttaaaagatgaagagaaacataagcaaacgaagggctaacatgtccgtgagacaacaaatgatcgtgtatgcatgagatttccattgagatgaagaagtgatgatgagctttgctgtgctcaagagtacgtaggtgactaggcttcactttgtttttagggagacaaaacgtctccctagctacgtaaactactcctgacgtgtcgcaattagtgaaaagctaatccttcattttaatctctaattaactatactatgaatcatggtggcctgctcgtgcagccagaccatggaattagctgtttgtcggcttcttgtcctaggcgctggtttgagcttagctatgctagagctagagcttagagcaggtacaatagcaggctataagcgagcagcgggctacacatctgtagccagctgaagtacggatttcaagacataatgtgtatatgataggtaggaccagatattaataatatagtaagcacctattatatgaattggctatatataatttagagctagtagtgggctatactattaaacttgctcttagctgaatcctttctgcatatatatgtacgtacgatttcgatggatctcgcaaatctgaacaaggtgacagcacaatccgggctcgaagtgacggtactcgctttggctgattcaccggtggccaaagatctcacattgtctgtgaaactccacggcctttttatttttgccggccaactttgtctgaaaccccagcatatcatccaggggcaaagattctgagctacaggtgtcaacaggggagaagaacgccactgacacccaaaatgagaggccatagcttaattagcaatggccagtgccagatgtggccagaccatggcaccatcacatctcaaatcggtgtattatgggatacatttgacagtaagcaatacatgggaatttaacaaagctgaatatgtaacagaagttctagccaggggaccaagctctcaaaggaaaaaggcattgtccatattttgatgtcatctagtagtatatatcttggagcaacattgtccagtcatttcttgagaaccaaaaagatgagcttagcttaagaacataaatgtcttgctttctgcttaagaagggtagctaaaggcaaaaaaaaaaaaaaaaaactaatgcagaggcagacatattattatagaaatatggaacagtgatctttcacttaagaaggcaaaaagggcagggaccaatgtagagacaggggtttgtaggttggtaccacctaaccaaccctagatactcttaacatttatgcaaaagttagaacatataggtaatgtagggttataggctatgttaagcaattaagcttgcaaactacctcggccgtccaaattgtatcgactatcacaagtgtttatataaggagatgtattactactgatttgaccaaaaaaaaacaaaatcttcaaaagccatgattctctctctaaaaaaatgcatgcacatagccaaaaaaacgctatgtagttacaattcatttcgaattcaatcaatggtttgaagaactagaccaattgatagcaactttctggtgtggtactgtcatttgtcttatttttgttttcgggtaatctccaaaagaagagagaaaataatcagaacaaaatcaacatatgccatgtacagtactatccattgtgtccacaagctaaggtagtaacatatgtgagggatgtttcaccttttggttttattcttatccactatccagagaaccaaaaagctagcaaagcacaaaccggaaattgacctcttcatggaattatttttattttcagaaaaaaaggtcaaaaattaagaaagcacccaaccagtgcgtatttttatatctcctccacaagatagggaaaaagaccttttccatttaaattgctaggaatgtattcttttacacttactaattattttttcgcatccgaaaatttctgaaccatcaattctgaagtctgattggtgcaggtggatccacaatggatttagattctttcagctgcctagcaaactacagtaatccttaatataaatacatcatatggaaattgtttacttcacaaaagataattagcaaaaagcaattacaaccacagaaggaaagggacaacttattgatcaatatttcgtaaaaaaacacttattgatcaatatttgtgcaccattgacaccggtacactactgctacgatttacacttataacacaagtgcagacgttacattggtgcgttgataatcaaatattagtgctaattatttacaccattacgagtgcatgtctccttggtggtttgtccacggtatatcctcatccatccaaaacctctggacgtgtgtgcacaacgtgccctgcaaatttaaagcaactgattggagcaacttatttctgtccccaatgtaaaataatgtccagatacaacgagggaggtgatgtgatgtgaataatgctccaattgttttttttttttggtgggggttaagttggtcgtgagacatggatgatatcaggaggccaactgagctgttaaagctgatctttgccgtgacttgttcgtatatatgatcaattattctttcctcagtgtacgtacagcttacacaaaaatctaatgagggggataatgagactatgttaactgaaaacctagaattggagaaatgtgacattccatccttgtctgacattgcaaaacagatggaagaggaagagtgtgatgaagaggatagctttcaagaggttccttacaagaagaacagacccatgaaagcagaacctgctattacttcaagaatgagcctgaggaatagagctgaacttctaaccaaaaagaagaatctggagtccacgggtaattccaacccttttgctgtttttcagttaattgatccctttgagttgaataacattgctattgctgctaatatttccttagatagtaacttagtagaaatcaataatactgtcagggttatggataaggtataccctctatacttggatgtgcgttgtatactgatacggtatactcgcgcgtatacggatagttcctgtatacgttaaggaaatctatcacgtgacagaaacagaatccacagatggagggagtcctactcggacaagactgggtctttaccatatcgtgaggggtccgatatctccgagccctacttggagatcaactgacccgcggtataaaagggaccccctaggcaggacctaaggcatcgaatctcaccgccaatacatccaccacagcctacgaagttggagtctataggagccaagtcgccgggtgatctagtcgaaccaactcaactacggtcttgtcggtatcatcgagttccgctattccctttgtaatatgtggtttccatcatataatcccataccaactggattagggctattacctatcaaggggcctgaactagtataatccttgtcttttgtttgcttgatgtcgtactatgtggatcctcataccagcgtaccccaataccctctatatccggtctacgggtattccccgtcgacaaatactattgatactattaagaccaaggaggaggttcaagctaaaattagctaaactgagatggaaaaaaagagaaggagaaggaaaaggagactcatgacataccacatactgatttgagagatgtcttggaaaataaatccgaagaggttgacattgtggataacactgaacaagaggtaggtgtagtaaacaaatcatctgagagcttagaacagaagaggagaggcggtcctaaaaaacttaggaaaaaaatgaaagtattattttggaatgtgagaggtttgggaaataaagctagaaaaagacagttgaaagagttagttagagatagaggggctgacattatttgcttacaagagacaaagaaaatgagttttcaggataaatagttgaactccttccaaggctccaaggatttctcttgggcttgggaatcttcaagaggtgcatctggtgtaattctattagatactaacaatgaggtgattgagaggttggggactcatgttggtgcttttttccctgagtactgatatcaaatataggaaagacaacagtatatgggaagtaattgtggtctgtggtcctgttgtggattctttgacagatgagttcttagaagagttgagatggtatttataggataaacaacacccttttatcattggtggagatttcaatatgtacagatttgctagtgataaatcaaatgataacctgaatctgagatccatggagtctttcaattcttttatctttgatcttgaacttagagattcatatagaagtggcccaaaattcacttggactaataagcaagattgccctactttagaggtgctagataaagttctagttagtgctggttgggaggatagatatccaaattctactctttcctccctccttaggattgggtctgatcattctccccttattctagacactggtgaggatttagagagacctcttaaatattttagatttgagtcaacctggctagccatagagggttttcatgagatggttagacaaatttgatccctagagatagttcttacatccttgactactggaataaaaaacaatcctccctaagaaggtttttgaagggatgggagataaatacaaaaaaggagaggaatcaacacaaaactgagttgacgtctctgatccaagagatggactctcaagctgacctaagggagttagatgtagaggaatggaataagagatatgaaatggaacctgagttagaacacatatatgagatggaggaattgttctggcacaagagatgtggtgacatgactttgttgcaaggagacagaagcactgaattttttcacagaatggccaatggaagaagaagaagaagaagatgcatgatactctccctggaagatgaaggcaaagagctgcattctaaagaagagttgaaaacccatgtcattgagttttataagactttgtttagagctgatgacccttcaaatgttcacctctcaccacttatttggcattaagagttgagcttgaaagatagtcaaaaagaatatcttatttgacctttttccatagaagagatggacaaagttctaaaagaatccaaattaaatattgctctaggtcctgatggtctcaatgttcacctttttagagctttctggcctgagattaaaaatgagttgtttgagatgctgctgatgttgtatgaagggaagttagacctaaaaagacttaacttcggagttatttccctgatccctaagagctctgatcccaccaatataagacagttcagacctatttgtgtgctgaatgaatgttttaaattcatcagtaaagtggtgactaacagattctctgaggtgacctctttagtgatttggcatacacaactacctttatccctggcagattcattctgaaaggttgtataatcctacatgaggttcttcatgtgttgaaaacaaaatcaaagaaagggattattatgaaaatagattttgaaaaagcttatgacagtgtgagctggaatttcttatttgaggtcctagagaagaagaactttccaaatagatggattgattggatcaaggcttgtgttatgggtggtaaagtccatgtcaatatcaatggagagagaagtattt

SEQ ID NO: 52666 - DNA, 859 bp, Oryza sativa
ctaccatgattcctgggtattcccgggaatacccaacttatttttttttatcaaaaagcaagtatacttctagtatatacacatgtacacatattagtgcacctaaatcctcaattcttcgatccatacacagcccaaccggcctcttgcaacgcctcctaccaacccgacccactccgtcatgacccatttatcatacatcagttgacccatttagccaccactcttctagacggccccctctcactctccctccgtgacccatccctccctggctcggctccttcgcgccgctccccatacctaggcggcggcgcggcgaggaggtaaccggcagcgggagctggaccgtgctaccgtggagggcggcggccggcgcccgccactccgccaagctcaggcggtcaggccggttgggtggccggcggccgcgaggggcaggggcggccagtggctcagcgcttagacgggaatacccaactttgaaatcctggatccgccactgtctattttgctacttcacacaccgtcacaaaatgtcacaccaacgccactacaccgccattgcttgaaactcctaattattagttatatgacggcatcgccattgcttgacactcccaattattaattatatgacaccccattgcttgacactctcaattattagttatatgatggcggccaataaaagaaagtgaacattcattccacgaattattactttatattgcggcggccaataaaagaaagtgaaccttcactccacggctgtcgacgaaaaatctgcacttggctaccccgccattgcttgacactcctaattattagttatatgatggcaccgccattgtttgac

SEQ ID NO: 52667 - DNA, 3353 bp, Oryza sativa
gccttagctaatctaatctagtaatacaatttagccgataccggcagaaaccctaaagcgagagacaaccgatagagctaaattgggatactaaggtggtgtttgaatttcctgaagataaagatgaagatgaagataaagattaagtgtttcacgtaaaacgatgtggtaataacgtgtgattaattgagttttaattattataaacttgaaaaatggattagtctgatattttagagcaactttcatatataaagttttcgcacgaaacacgtcgtttagcagtttgaaaagcgtgcaacgagtatccaaaatttaatcctgtgcatgcagaagaaacgaacagggctttaagactagattaactgaaacatatgataaataggcaggcaaatatattaatcaaatcagagcaatccaagaagtccaatgtactgatgctgaacggcgccaatgtaaccaacacaattgcctgggccggtggaatattggacttaccccttctgctctgataaaaagtaaaaaaggtaaaaggtagcgatgcgccgaattgtatttgatcatggagatagtttacaatgactctgggtacatatatttatacccatggggaaatactagtccttacaggacaagaaagaaacatttctaaaaaaataaaaggaaaacataaagtacttatgggacacttgaactcggtcacttctgtataagctattaattttcttaaccgaatatagcaggaatccgactattggcggcgtgataattctcttaggggcttaccaaatttcactgttaacaacggcccattaatgaaataaattggaaatgaattataaaagaaagtgaacactcactccatgaattattagtgacggcggccgataaaagaaagtgaaccttcactcatattgaaataaaaaaaatattagttttaagacggcgggcaaaaaaagaaagtgaaccttcactcatagtatgttgaaataaaaaagtgaaacatcttctcagtctctatgggggcaattaacttaaaataaaattaaaacgaatcatcaccttaagcatcatgttgcaatgaaatttaaacattgtctcaagctcaattagtgaaataaactgaaaagcatttattatgggtaaaataaacttaaaatcatttgatatgggaaatacaaataactaaaacatcacctcaagctacaatcatctcaagcatatgttgaaataaggttttatatattttcatacaacccgtcactaattacaagtaatatgagaagagatgatgctattaatatttagctgaaatatgaatggaaagggaatcttccaaaaaggttgtcatccaagtgagatcaaaatagtttgcaatggtggtagcacgcaaaatattgtcaagatctcctaaagatagttatagaagtatttgaattgttattttatatgaataatatatatgaatagctcatagtccatattgccgatgagttagatgccctctgtattaatctatgcagttttttctaatatcccatcaactaattttcagttcttttgatatatgactagccgctatcctttgcatatataggtataccgttgcattgctagctcaatagagagcgaccacaaccttatatacacacacccgtttatatatacacccgtttacctaaaccatgtcatgactcatgcaactcagattgttgatcatgcgattgtgcggagatcacggtgtcacgcaaatgaaaaaacctcatcaacgcgaaaggcccgaaggatgaaagtcggaatatatatattttctacgtctctcatatcaggggaaggctggacccgtacgtgacactctgcttgattgtctgctccctctcgcgacactagccgtcctatgcaataaaatggatcggtatgcatgcttagcttgagcagataaattacacatcttcagttcctaagaaactattggattatcctttggaactcaagttgctatgctgggtaagaggagtagatatcctttgggtgtgctacaacattctcgccggtcatttaatgttacgatagaggagcatgatactatgcttttagagttggtagtcaaggctcttttattccgttttattctgttttgtgggtgacagtatatatatgcttacttgttagaatctagtaagtgattgttttaagtgtatcagttggtttctttcttaggttaggaaggtagggattttccccgttacctactatcttactccctccgccccataatataaaagattttggtttttttgactatacaattgatgcataaccaaaatctcttatattatggggcggaggtaatattattcagttaaaaaaacttgttggttgtgtgtcatatggcaaaagtggaggatgtaatatattttcattactggaaaaaattgcccgtgcgttgcaacgggtgaatgctattttaatcttattattattcactgtgaaattctctatgagaattcgcttggatatatgtttttctataacatcatgccaagttagcatgcaagttttttttacagatatttcttatacgattccttctgtatttccaatagcgaacgaatttaaaacccgacttaaatatggatctgtatttccaaaaacaaatgaacttaaaaaccgtctcatacatggatgacgtaccaaagtaccaataaaaatgttttaagattggaaaaaaatgtacatggtccccataacaacaagctgagctctctagatgataccgcaccgttgttgcttaatttaactcacgtgattatttttataaaaaaatagctggtttaaaacaatagtaaaaaataaatttatcaactgcacctaatatccgtcctcgtaaatataactcaaatgaacaaaaaaaaaatcatttcaggctatcatagggaagtgaggtatatgatatttatttctctgtctttatttatttaatacataaaagtatgtaaataaattgcgtcaatatcaatcaatttagaactcatctttttagcaacagtttttcaagatttgcttttaaaaaaagagagcccttaaaactttaattaaaaaacaaaaacaccatactttttaatttacaattaatttgttagacatgttttatacataaactaaagctccattagatagtatgggttgcgaagtgaacataactcaactggttaggttctttgtagtggaaccagcccacccgggttcaaatcctagatttgacataggtgctcgcatttacggctaattattctttcagtggtagggttcaaattctagatttgacacgggtgctcgcatttacggctaat

SEQ ID NO: 52668 - DNA, 19388 bp, Oryza sativa
ggtgagtgtgtgcacgtaaggatagtatggggtgagtagtatgggttagatgagcttatggtgagtgtgtgcacgttgtgagcaaaaaaaagggatagtatgggggtgagtagtatgggttagatgagcttatggtgagtgtgtgcacgtaaggatagtatgggggtgagtagtatgggttagatgagcttatagtgagtgtgtgcacgttgtaagcgtctacgtttgtactgtgtttctcaaaaaaaatgagaaaaaaagatagtatgggttggatgagcttatgaggtgcatgaaaaacgaagcaacttttataggaataaattgaatattatatagtctttttataggaataaattgaatattatatagtcttttataggaataaattgaatattatatagtctctccatccaaaatgtagctattcctggctacaaagtattggccttataaagctaacaaatagtttaaaaataaaatctagatatgttgatgaagaaaaattttagaagaaagtattgctttagaaacgtaataggtgtcatctggatgatactttttgccctttacgtttctcatgcacaatatacgatacatgtctgcacagactaactccctaattctattaaaaatagcctgaaaaatacttggggataactactgaactaaacagtacaacgatcgaccatgcatgccgttatcagaggctaacaaagaacagtatcaccatgcataatgcgccgctagcctcatggtcctcctcccatttgtgcttggtcagcagcgccgccgatcggaacgtgaacaccaggaaggacacccctttccctagctcggcgacgtcgcgcaccacgttattgttcgccatgaggcgctggtagtcgccgccggcgccgacgagctggtactggccggtgaacccgtcgtcgttgtatccgcacctgaagtcgtagcgccgcccctcctcgtcgaacaccggcacctccagcccgtcgtcgccgtcgtagccgtcgtcgagcaccccgtccagctcgtcgtcggtgaagctctccgcgatgtggcgggcggcggcgccgccggagagggagaggcggccgagcgagaggtcggcctgggcattcgtgacgtcgccgtagtagacgcacgccggctccgacgcgccgagctcccgcaggcgcgacagcacggcggcgctctcgtcgcagacgtccccgatcttgatgtagctgtagtcggccggcggcaagccagctcggccgggcgcccgcagcttctccctccacctcgccagggccttcgcgaggttctcctccggcgtctggccggccgggtagctgacgcccagtgcctccacctgcgccgcgttcgccggcgtctggccggccgggtagctgatgccggcaagtgtctccacctgcgccgagttcgccggcgtctggccggcgcagtagctgtagctgatgcccagtctgtccccctgcgccgagttcgcttgacccatttctgaaagacagagggtggcgacgagcttcttcttctggattatcgtcgatctaatctcttttcttgatctgcgcttttctgtttttttttgtgcaagtatgcttcctatttatagcttagcaagcggctaagacgtactcggattcggataacccgcgagtcagtttcggaatataataagctagcgattcgtgcgttgcatggagtagtagttggtttcggaaacgggttatatatctgacactttctagtccggtaccgatactatttttaaggccttaacttgtccggcatgccaaaaatagcatgcgtctcttttcctatgcgctttttttaaaaaaaaacaaaaaaaaatctcaacgcagcgaatgtagtcctataaacctacctatgcaagtgatctccatttaatatagttattaccaattttctgttctatcgttgatccacatcattcagttcgattagatctcaacgatttgtcgattttccatgtcgcctgcatcaagttgatcggtagccgtttgatcagctctcaaaacgatcctgcgcgccacctcaatgtgtccacacccacgtcgaccggtggaaaagcccaataacagcccagcatttcccgaatctataaggaaaaagtacaccgaaggtccctcaacttgtcatcggataaaaaaaacgtcctcgaactgcaaaaccagatatgcggggtcccttaactgtacaaaaccggtcatctgagatccttcggcggttttgaccccggttttggtctacgtggcggctaagtcagcatgggacccacgtgggccccacatgtcaggatgccacctcatcaccactctcttatttccctctcttctccctttctctctttcacttttctcaggccggcgacgggcggcgctgtggggaggaggccgccggagggaggggagaggaggaggtccggcagccggtgtcgcgccggcggaggaaatgccgttgtccgcatccaacgagcacaccggccgctgccacaccttcctcctcccccacacgccggccgccgccacaccttcctcctcccctcagcctcgccgccgcccggaacaacgtcagctggggcacccggcgcccatggtggacgcgttcggatccggcaagggcacgccgacgggagtagtgccaacccccgcaaggagtcgaaggtcgtcgagatggccatgggcgaacggtgggcaacgtcaagcaggtcgcgggtgacggtggccggcggcggtggtggaggatgcggatccgtgctcggatctgaccgtcccgtggccggatccgaagctcccgcgttgaatcttgctgatggcgacgtggtaataatagtgtcggcggctggacggcggggaggcaactggcggcggggctgagtggtggtggcggcggagcccgagccctggtggtggtggtgatggtagcggccgccgccgacatcgccgatggcggagaggctacggcgaatccgaggcggcggcgccatgctcgtgctcatcctcctcgccgtcgtggcgtcggcgcagcaggagtacgaggtcacctcctcctcgtcctcctcgccgtcgcggcgcggcgcgggcgagggccatcggccgccgccttgggcgcagcaggagtacgacgtcacctccgccgccaccacgggtcctgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcccagtcgcttgaagcatgtgtggtggagagaagaggggaaacacacgcgcgcgctcgctcgcctcgcctggcctggcctagcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacagcgtggagtccggataagttacgcgcgacttatccggttcggttacgcgcagtagagatcgtgcgggcgccctgatcaagcgacccttctctatataaaccgatccgccgtcttcacgcaatatatacgcaaaatcaatctagggtttgcctcatactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgatggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcgttatatgtctataatctcaacaatccaaaaaccttattataggcactgtgattttactatggctggttttgccgatgcactgaggccggataaattcaccggtgtgcattttaagagatggcagatcagggtcactctgtggctgacaactatgaaatgcttctgggtgagtactggcaaatctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatgaagcagtttcatgactacaaaatggcagacaaccgttctgtagtcgaacaggctcatgagatacaaaccatggctaaggaactcgaactccttaagtgtgtcttacccgacaaatttgtggccgggtgcattattgtaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttaccaactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttttgagtgcggaggcctgttccgcttttccctttctgatttctgcaataagtctgtgaaccatatttgtggcagtgtggatgatgaggttaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaatagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaataaactataggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtacctgataagactttgagtgaaacttccttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcccagtcgcttgaagcatgtgtggtggagagaagaggggaaacacacgcgcgcgctctctcgcctcgcctggcctggcctggcctggcagggcagggcagggcaggcggcgcgcgtacacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacagcgtggagtccggataagttacgcgcgacttatccggttcggttacgcgcagtagagatcgtgcgggcgccctgatcaagcgacccttctctatataaaccgatccgccgtcttcacgcaatatatacgcaaaatcaatctagggtttgcctcatactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcgttatatgtctataatctcaacaggtccctgcgacgcctactgtcacgcccagaaattcccgaatagaattccaagcagaatgtgcattaaaatccccgtccaggaccagccggggtacacaaacgacaatgttgacattcagatccacgtcttacaaacatcataaagtcttacataaatgcagcggaagaaaagaaaaacaacaggagctaagccttgactaaactgcagcgggaacaccactccacaggcatcctcgacggcacggacgaagcctactcctcagagaaaccttcatctgacccgaactcgaactctggggttgggaaaagtagagcaagactgagtactacccactgtactcagcaagtcataccggaataggggtatgatgcagggaatcatcaaagaagagctaaagtggttcatttgcataaagcgagcatttataaacagagattgaaagatttaaacagttgtaataattaattaatattaatcatccgctgtccaacgctaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacatatcggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcagctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgattcattttaattaaccaacaccagagcggtggtactaatccaacattatcattagaaccaacagtctaaacattaatatgattttccccattgtgaactagttgaactaagcatggctaagcaattcctagtccaaactctaatcatgttataaccccaagctaacaaaggagcatgatatccaaaaacatggctgtaacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatctcaaagtacaccgagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaatatattccagggctgacgtcagcacggaggggggggtgcggcgccgacaagcggggcccgcatgtcagcgacgcacgggtggccggtctaccgtggaccgggaccacgcgggtgatccaccgccggtccacgggatcgacggcccggatcggcccggggccgatcggacggtgcggcggcgaccaggctaggctcggctcggcacaaagccggccgaccggtcacggcgacggcgcgcgcacgcgcacgcgcgttgccgacgacggcaaccgccggcggagacggcggcgcaaggcggcgccgaagggcggtgatgctaaagcgacgactaacgggcggcggcgctaaagcggcggctaggggggagagggaggggaaaagaaaagggaggggtgcctcaccgagggtggccggcgcggaagaagatgatggcgaacggcgacggcaagccacgggaggacgacgtcggcgggcggacgagcttcggggtgccctaaggaaggagaagagagggattagagagagggagatggaccacggcgaccggaaaccatggccgaaggcggcggtggaggtggtgctcacccgagtgcgagggaacgaaggctccggcgacgaacttcgacggaggaggggtggacggggtggatctcggccacgcgaacccgacggcggcgacggcgcggcctggcggcgaccctaacagcggctagcggcggccggagcagcggaaaaggcggcggcaaggggttgcacggcgcgggagcgatgggaggctcgagagagtgcggcgaaatggggaaaaagtgagaggggacgacggcgatgcttaaatagggggagagggaaccggacgtggccgggagaggcgggaatcgccggccgacgtggggagtgtgggaggagagagaggcgggattcgaaaatcgaatcccggccatctcgggcgcgggcgcgagcgggagagagagaggagtgggcgcgggagacgcggcgcacgcgcgggcgtggtcgacgtggctcggaggaggcggagacgagggcgcggcggcggttgcgggcgcggcggcgcgagcgagatcggcgggaggtgggggaaggacccgacaggtgggccccacctatcggtgaccccgagagaggaggcggcggggcggcctgactgggcctcggcctgcggccggcccagcaaggaagagggggaaggaaggagggaatgggccggcggcccatccgaaaaaaaagaggaaaaagagaggaaaaagaaaaagaaaaaggaaaaaggattttccctggaattgaaatattgcttgctcaattttaattggttaaaattatttctagagctctgaaaattccactaaaaatcctgttaatgaatttcgacatgtagaactcaagaaaaattccacatgtcaaatccgattattatttgcattactttcttagggttttctcctgatttcacctgcattttcttggggtcgttttacaaattaaattttaggcttgggaggagaacttcggggtgtgacacctacctcgtgttccgctcctccccaccgctctatgcctccgccgtctccatctccaacctcctcaacgtcaccgccaccgccgtcaccgaatccaacgccgtcgacctgatcacccctgtcgctgccgaccccctcgtcctcgcgcccattgtcggcgacctcatccccacctaccggctagcctacccgagaggagagaaataagtgagggagagagagaggaggaagggaaaggaggggaaagagatagagggtgatgacgtggcatcctgacatgtggtgcccacgtgggtcccacgctgactcagccaccacgtgggataaaaccggggtcatatctgtttttgcggttagaggacgattttgtaactcgatgacaagttgagggaccttcggtgtactttttccaatctataatagatactattatgggacctaaaaattgacgattttgtattaggggtgaaaaattctggtattggaaattagggatgtcatacaaactccacgtaaagttgggggatggttggtgaacttattccaccatattatatacctcggtatctagcctggtccaactcaaacatgtattatattatgtgaggccaatgtcatgaggcaacacgcgtggaagaggggtaaaccacgttctcacacatagcacgctacgaagcggaaaagctaatacgtgcgccgccggcgcatgtctcgggcccagaaggcccagcgctgctgcgccagcgcgagcgtctcctctactttttttttctttttttttctgttttttttccctttttccactttttttttatctttagcatgttttgagtttgaaagtttttaatttttgagttaaaaattttcaaatctgaacttgaaagttttcgaatctcgagttgaaagttttcaaatctcaaattgaaagttttcaaaattttcaaatctaaatttgaaagttttcgaatctcgattctcgagttgaaagttttcaaatctcaagctgaaagttttcaaatctgagttaaaagtttttaaaatttgactttaaaatttaaaacttaaatcgaaagtttacaaatctaacttaaaaaattttcaatctgttagtaaaaaaatctccagaatttttcctaattactattattagtgtgaagtatattaaataatatagttagttaggactaaagggggagggggagttctcgctgctggcgcgcatgcgccagctagtagtcccccgctacgaaggtggatatacgagtacctatgcatcatttttatgattatatcacatagatttttaatctttaggttaaaattcaatagatacaataaaaggcaaaaatcaactaagaaacaccacaatggatactaaattactatatctttaagaaaaagaccaaatccaatataaatttcaaaacttacaagtgaagattcaaaaattacactgtaacttataaaagttacaatgtatgtttcataaattacaagaaaatacactgtaaatttaaatgagaaaattaagtgagagataagaaaaaaaaactttcgagtgagatatagcaaaattgatcgaagaaagggcacatatatgagaagcaaaaggctagcgtggatctatgcatgaggagcacccggagagtggattgacaatcgcgctctatgggtggattatccagtgacccgactacccgagtccaaaatctataccggtaaatcgatggtataacatcatgtgactatctacataggttctgagtacgtactataagcaagcaaaagaaaaggtaataaataaaatttcaaaatacttcgcacctacattataaatatggcctccaacatttgaacaatattgatggtgtacattaatttcacaagcatgcctactagttcctgctaaaggacaaccatgtgtctataaatatggcttccaacatttgaacaatattgatggagtcatgcgccatatatgagtcctatggttgtagtgtcatactaagacctttttaatgtatatatttttttaaccattcttgtagctgaatgatttggcattgttttcattacgaatattttggtgccgtctctgacaaaggtggtgtttgaatctcctgaagatttttatgaagataaagattaagtatttcacgcaaaacgaggtgataataacgtgtgattaattgagttttgattattaccaacttgagaaatggattaatctggtattttacagcaactttcatatagaaagttttcggacgaaatacaccgtttaatagtttgaaaaccggccacgagtatccagaatttcatccaactcttatcagataaacgaacgcagccaaagcataaagaaaatatcattcgaattgtacaactcaaacaacaagcattggacatatttgctcaaaataaacaattaagctttgaaaaattcgtgttcttctgttctcttcattctatagaaccaaccaagtagctgaaataagaaccgcgatatgtacagacagctctataactaaatatcattaacggggcactaggccactaggcactgtatatattacataactatggttgtacttctcttaccttctattcatggcttatgaactatggatacaaagggtatttgttcacgggtcacctcaaaagctaggaagaaggaaacccatagacgtgcaggatgttatcacccacctgaaatatgcaaaaggtttcagttaagcagaaaagaggaatgcaaacatgtcctataactaccgtgctgtttttcataaaattaacaattagttcgttcaaaaggaataaaactaacaattttacaaaaggatgtgccagtaaaatcactgtgactgcgagtgcaaagcatatgcaaagtggatcttcctgggtagctatagtaaattaagaatttgacacccacatgtcagtgttactgatattttaacggagggaaagctgaaagcactgtccacgcgtgggcacacgcacataaacaatgttgatttatcatgtctcaaatactcgatgcaccacttacacaacataatcccatattttcatcattataaaaatatttatgcacacataaatatctcacaacagtatttttgtttggtttaattgattagatttaaactgtctcagttcattttcattgtgttctttcaacggagtgtcatattgtcaggtatattcttttcttttcaagactggcacctgtcaatcaagggaaaataaatccttagatatttgtaagttagacataaacatatttccattgcttgcatgttcttatttgaatgcaaatctggacatctcgtgatgcattgagttcttcaagcagataatttaggcgatacacagaaagaaaatatatgaaaaaatgtaaaatttactatgcctacagtctctacttaccaagccaaaaagcaaatcctgcatgcactttggtaagctcgtacggtcactcttgaccatggaatggatcacttgaactcacctcattctttgcaaactgtcacaaatcagcatcaaattaagcacaagaagaaaaattgaaaatatgttacagatttaattcaaattgtcaagtagagccaaagaggaacaaaccgttgttgttgctattgttgccatcgtgacaggttgacttgctggcaggatgaagttggtccagaaaagagggtccgcagaaggatcagcagggttccaggtatttttcatttgtgcagtaacagagggcaatgtgtatggagctctttgcacaagcaacccattcacgttcatgttaactgcagttgtgtcatgtccagttgcaggtactggggtaactgtctttccttcatccatttctttgctaaaagtacattcttcagatagttttgtagatttttctgagaagcttttgaaggcatcagactgagataagatatcacatgctgataggaccacggaagagggctttgagttagaatggaggccaagggaaggaaacttataaggctcagtccgttgcattgaactttcaatagcacggatttcatcagtaacctcttccattttagatgtatctgactgccgtgtcttttttgggagccaccaccttatgtaatttgtcagatcaattttcctctctaagccaaaggttcctgcaaatttcccatccagcgtgatgtccttccctgtaatttaaatagaaagactggttacaaaaccacatagaatttgtctttctcctctgtagtttgttaaccagaaacagcagtgtagaagtttttatggagacaccacaacctaggctcatgtagtcattgccaagcaagtgtcccaaagaagcatcccatctggaattatggagctgcctgcatgataatgtcacaacagttgcagttataaaatttatatcaatgtgactgtacgtgtccagcagtgtagtgcactgtaatgattagtcgaagactgacatctggtgaataattaagtaaaacagaattacgtacaccctccgtactcgtaaaggaagtcgtttaggacagcgagatggtcttcaaaacacaactttgacttcttgtttctataaaaatatttattgaaaagtgatatatgtatacttttatgaaagtatttttcaaggcaaatatattcatataatttttgcattgtcaaactcaacaacttaagagttattaatgatttatattcccaaggtttgacttaaacattgtcctaaacgacttcctttatgagtatggagggagtatagttttactttatatgtccaaataataaactttcctaaactaatttctagtggtcctcaggacactattaagtcgggatcctatcctagaaggaaatttcaagtatgtcgatctcttcaaaatctcagctacaagtaatcactctcctctgaaaggatattctgttgagaatattatgttttggttggttgagatcccacagaaagcaggatagctgtaaccatacaaagaacgaaggcactgaatgccgaatttccattgacaacagtaatcagtgaggaaacacagaatttcgatgacgcacattcagcatcacaagtacagttgagggactgtggctgtgcaatcgagtgattattggaaagaattaatgttcagcaaaacttgaaggtttgcatctttgctaaatgacactttattttaaaattctctaaatgaagaccaatgacacacgaataagagctagtagtttagtatctaagctatctacctccaaaaatctgctgagcttactaatttaattcatagcagaaatacatgaagttgctgaaaataatttctaatgtaatataccacagggcatcatctttacatactactacttggtttgccataaatatttgtagcaagatggaaaatgttaccgaaataaacaaaacatggacaatgatagtttgtgcacaatagaaaagaaaattggacatgagacttgttactgaattagcatcacaaacatgcatgcaaatataataactgaacatagagttaacttccaaatatatttctcattgctaataagtacctaggaaggccgcgatattttggtaaacccctggaaaaggcactgctctttctgcagtgcatgtgtcttacagttagtacttaagaaccaaagtaatatgcacgtattataaattcacaaatatcctccgaagagacacaagataatcctccttggagatcatctgcatttcctcaagatctcttgcataatcagagacctaaataagcaaatacataatgaacataagcctgaaaaagattaccacaaatcaaattaactagtgcaaaatatagaatggaaaaaacatagtacaataattcataagcaacatcgcaattattttccatcgagatgtataggcatatagataccaaactgaagagatggcatgtatgcatatgtttgttttgccaatattcttctgagacaatgatttttcaatgtcgcttatatgctcagagatgaattttctgaaaacaagagattttttttgtcaaggacacaaacatccatctccgaatcgtcaagtgtaaactgaataaatccctaacctttgcatacaaaagaacataatataatagtcaagagtattcagatttttcaaacatcacacaatagttgcataggatatgtttggactagtatgatccaaagtttggtacaacactctctaagatatcttttggttttcaatttgcatcttaagagaatcagtcttcgaaattgagctcaggtgatgcaaaatataaatgattaaatttaaccaaatgaaggtcttgaagaaaaggcagtgtgtggttaataattgtagaagaactaaatggaagctaagaaaccaattataattagcaagtatagatgactcacaggaaagtttatttgtgtcccagctccccagtatttcaatgcagcaaggtcataagctcttgctgcagcctcttcatcatcatatgcacctgtgtatttgcgcattgaattgatgtggataaagaagtttatacaattgcacattttacagttaacaccaaagatttcttacctaaatatactgcacttgcagggccattttgggtgataatttcccatgcaaaagagacaattccattaaatcagattaattatagctagatttttaaggaaatgacgtgcatggattatctatgaaatacaattaaaattcacctagcttccaacgtcccttggtcaacttttcaaaacatgtaaaatatagctgctaatttgcattgggtatacagaccttgtttcccttttttgttctgattctgattccatgtgcttttatcccagaggtgagcttcatatcggcctgtccacctatgcctatagatgatacaaaacaagtgtcaaatcaaattcatacataataacagctgaaagttaaaatcttgcttacaaattacaacaaaattaagaaagaagtagcatatggtggtacaagaacagttgaataacaatatagaacaaatactacttttggatcagattaaacaccaaataaaagatttaagtatgtaaatacacatatagtttgaaaattcatcttttagttgagccccacacttgtctggaccgaaaagggtccaaaacttgcttcttacccagattagagctaaaccctgtcaacccagtttgacacaacttaaatcaagcatgatgttggatgtactggtcaagtgaaaatcattcattagcttttatatttatttagatcaagcgaagctcctaattatttcagatcgtccccttggagacacaacaggtaatccgatgaatacagctaatccgtatataaccaagtaaacaaaaagaaaaatctagatcccgaatcgacggtaccattttgagcatacaaggagacctgacgaacggatttagcgccacagatcaatccaagcagagaacgattgcatatcccctaataagcatccaagtaaaacttctccgcgactcgagacacggaggagggagagggcaaaggggggaggagccgtaccgggtgacgccgcggtagatggagctgcgcttcccggcggcgcagggcggcatgcggctgatacgctccttggccgtgcacaccctctccttccgcgccgccacgggcctcctcggcggcggcgccacctgctccgcccccgcccccac

SEQ ID NO: 52669 - DNA, 736 bp, Oryza sativa
atggcgacccttctttttttgcattaaggaatcgccgtcattgagccattagctaacagcagcaacactggaaaaagcaaattaagcaaaagcaaagatgaatttaatttttttaggagggtttaattatgaatttaccattttaccccctccttgtgtggccctatataaatgagtggtactcgctctcctcttccccacacacccacaaacgcagctgagctgagctagcaagcgagcgagccgagctcgagctccatttgcttcttctcgtggcggcagcgcctcctccccgtcgccgtcgtctccacgtcgtccgctccgatccgcctcgatcggcgttcgatcgcgtccaccacctcgatctccagaaacctttatataagcagccgcgtccgcattcttgttcgatctatctctccacaccatgccttcgttgctcgactcgccgccgcagatcacgccggcggctgctgccggcgactggagctcgctgtacgcggcggcgcaggcggagacggccgtgaaggcgccgcggcatggggcggtggcggtgaagaaggccgcggcgtatggtggtggcggcgggaggaggatcaagaacctggagatgtgcaccgaggcgctcgggtgcgagaccggcggcgtcgacggcgcggcggccaccgccgccgatgccgtcgttgtcgctgctgctgcggcggcggcggcggctgaggatgccatgcccgtggtg

SEQ ID NO: 52670 - DNA, 7325 bp, Oryza sativa
agtgctaagagatcatttgttcttataggccttgttcctgagattttcccaggaaggatcacctatttacaatatgctgatgacattgttatttttatttcttttgatgctaagcaagtgattgtcacaaaaattctcttatactgctttgaagagatggcagggatgaaaattaactatcataaaagtgaggttttcatagtgggtttagagagattagaaattgaagaggttgcaaagatgctcaactatcctataggtgaattttccatgaagtatcttggtttgcccattggtcctaacaaaattttaaaccaagagtttgatttccttccccagaagatggaaaaaagaccctctctttggattgggggtaacttaacctatgcaggaagagctattcatatcaatgcatgtttatcttctatcccatcctatgctgtgggtttttaccaacttcctgaagggattcatcataagtttgattcgataagaggttagatactattgggctggcaataaacaagggagaaaataccacatggtgagatggatagacctttcttttcctaaagagtttcgaggcattggtttaactaaaaccagaatgcttaactctgctctattggctaaatgaatcattaaaattgaatcccctaataatagtctttgtataaatttgttgaggagaaaatatattcaagaggatggtatcttccaatacattggtgacaagggtctcaattctggaaaggtgtgatgaatgttagaaaatggatgacattagggtctgaatggcttctgggagttgggaatcatatttgattctagaaagatgtttggaatggttcttgtccttttaaaatcactttccacaatttatttgagatctgtaatcaacagaatgttacagtctcagagctgatatcaagaggtgctaatgtgctaacttttaggagatcttttggagaactggagagaaatcagtggttagagctgagaggaataactgaaaatacctccctaagtgtctcacctaactctcagacctggggtttatcagctaataaactttatacaacaaaatcgctctatgaggctatggcttttagaggtatgaaagatgttaaaatgtagatggtttggaaatgccctgctcccatgaaaatgaaacactttgtttggttagctatgaagggtagaatccaatcagcagagcaattgaaaaagaaaaactgcgcaggctcagaattttgtcagctctgtggtgccttggaaactacttctcacatcttattcacctgtcctatggcttcttttgtttggtgtgtgtgtagatattcttttggctgggtctttgttccgagagattttgatgatttctttctcatttctaagcacaacaataaggcaaattctatagtttttccagctttacttatggttgattcctggatgctttggaccccagaaacaacatgattatcagagataaaatggtttactctccactgatcctgcctttccaaatcatttcctttttattgcagtggaaagccctatgtcgttctgaggtgactttgctgatggagacgatggctgagaagttaaaagtgacaacaactacccttggcgctcagagaaccggcgttggatgatgatgtgccttgttttagcttgtcatagtatcttttgtttactgtctaccttagagtttttctgctcatggcctgatgtgtggtgactgtttagttttactgtggtagttgtggcttaagcctgtgctgtaaaatggatattccccataaccttgttcaacattttgctttcaatataaggagggatgtgaggccttttatctaaaaaaaattattctttgaatggtaggtgatataccattcgatagtgagttgtctatgatgatttcgtcaatcttaagatattcatacacactctttgaagatactcatatggataggatgtatgtatgcgtttatagaggtgtgtgtgagcgttagcatttgtactatgttttgaagaaagaaaaaacacgccaacaaaataagatggctttgcaatctagactgatatccaccgaggaaaccctgctgtaggatacaaggtcttttcttttgttttgttttcaaggcttgggccactatcatctcctgcccttttctccacattctctgctccttgatgggtcatccatcgccacgttttcttctggtccgacatggtttgaattatctcttggaaactttgcatgaaatatatccaacttttcttgtgaggaaaatgtagctacaacaaaaagttttgcgaatgtacaagctatattacgagtaaaataaaccacgtgtgtctaaacttgtccagcggattcacttagatctacaaactttgaatctgtagttcgagttttctaaacttgtctaaatagttcattatagtttgggcctatttggtttactagctattgttagtatcaaaatatagatacgtttttagaactactattaggagcgcagcgccaaacatgcatcagctcaggcccaccccaccccgcgtcccgtcatcccactcctaccgttatcggagtaaacgacttactcctatcgcgtgcctctaccacccacctatattcgagtaaacgatttactttgataataaaaaccactcccttgcttccgatcccacccccacgtcccgcatcgtgctcccactattatcggaataaatgacttacttcgataaaaacaacttctctgcttccggtatatatattctatttttctcgtacccaaccaaccactctcgcccccacttttattttttttcctttttttcggatctgaatcgatctaccttcctagtgcacagatcggcgacacaccatggaggaggacaacgacaccgtggtggttgatggtggtggctggcgagcagtggccagcggcggttcaggcgaaggcactgcttcggtcctcgctgccggacgctgggcagcaccttaaacaacaaggaggtgttcacttaggtcaatagcaacaaccagcggctgctccacgtcagcgacaatgctagaacaagcaagtaaggaaatgacactctgatttgcatctgcatactctccttcaacttcacgcatgaagccccaattttttttttttgcaaatcaaattaacgtgcaatctccaatattacctgatctcaattgataggctgcacaggtcctacatttgcacatcattctccatgtggctagccctgagaggatagggtggagtacgccggtgatagaggttgtttgctatttttcttttgctcgtcatctctattgacatgaacgagaatgtttttgcatttttttcgtgcttgctagatgatggatggctgctactgcgcaaaatcgagctcatccactacatccttccatgattccatcgtcgactactgctcgccacccggttgccctctccactaccagtcacaagacacaaaccaccctcttcatccttatagcaagatccagcaaagctgccagatgaatttttggctgaatcatttttttcttttctagtttgattcacctgtgagtaattttattgcttgtctgtgattgagcctgcaattttttcattcatacgactattttgtgatacagatcaacgatacttttagtatcagtttttactcttgtatattgaacacatcagtaaacatattactacacgagatcatggctatatcgataggaaggtgataattgttttactcgatgaccacaaaatattagtttttattcttagactatgtattgaacacatcagtgacatattactacacggtggctacgagatcatgggctatatcgagaggaaggtagtaattgttttactcacagaccacgaaatctaaacaatatttataatattggaattactagcgttttaagctagtagtaattcttttacgaccatctaggtatggcgtcatacgatgtggaggcattcatgcgagtaaatttgttacttttgaatgagccgatgtgggaggctgggagtaaatgaaaaactccatggagtatattcgttacttttgaaacgtgcggagatactagaaaaacagaaaactcagaaagaaaaactagacggtaaatattttactaaaacgcgaaaacagaaaaactacagagaaggaacgaaaaacaaaaaaatctagatggttaatattttaccgagcccattgatgaagcacggatgagatggaaaagagaaaaaagaaacacggaaggtgaggtggtaaaaaacgaaaaaaacaaaccgagaaaagatgggatgcggaggaaaggtggggtggtaaaaaacaggaaaaccagaaggagagggcgtgctacgtttgaactaatattccgcgctgtagcacgcggattagcgctaccgataagttttagcagtaacaattactggtagagtaagtttatattggtcatgtttttgtttgttatcaccatagagcgaaattgtaaaactatatatagtaaaaagtattctagattgctactaaatttagtataggcattgatttctgtatagttggtacccaccaactcctaaatcttatcatgcaagtgtgttatatcatcacccattagtaattattatttagagcatcttaaatcccatacaagcatgacacatcatttacaatttattatatttttagagctcgatatgtaatatcaaatcattatatccacatcattttctataatgtataacatgtattcatccatatattttgtagtaaaacgtgaggtatcaactagtatatactattattgatagggcatattttggtagcaatctaaaacagcccgtaaatctaactcacgttgcaccatctactacctccgtcccaaaatatagtaatttttagctatgaatctggatacgcgtttttggacggaggtagtacatggcagctacatggtgcctgggtggataagaacaaaccaacatgtacaatctgatcatgtgccctcttttttccacctaaaaattttcaaataattgaatataacgcttgtcaagttcacagtcgaaatattacgttgcgcttgaactatcatagctatcctttgaaataggcattcattgattcataaaagttgtttcacgtccataattatcgtgactaatgtaaatcatactccttagatgatttaactgcaaaatgcccccacctagaaacggcacaaaaattccagctgcagtgcacgagtgcccaccatggtagtagaaatggaggtgtgggcgaggttggaccgttgaagagtttagacaagtttaagaacctcaaattcaatatgaaaagttcatggacttaaataaacaggtagacaagattagtggcccatggtaaactgaaaagagatgaatatattactcaaagaaggaagaaaaggggtattcatgcacatacgcactttcttacttatttggatgagtgtagatatccacaatccctttggaagaaggaaatttgaatgtaaatactaatcaacccgaaccattctagccatcaaggtttaggccctcaagagttgtactcgactaacataaattgtcttacagccgttgatataccacctctattgattcgacgtcttctgatattagatctaacaacccctcctcgaccacactagtatacatacttgtttactttaattaactcctctggtgctgaatctggacgagcgacgaccaacgatatgcatggtggcacctaagtccccggcgacgagaagtcgggagagctagcagctcctatgttggtttttcttttctctggcatgagtttgcctcatgtcttatgcttcgttcattgccttgtaaagagtcgactcttcttttccttctcccctccagtcatccataccgtgatggtatttttatgagcattttttctatccttaaggaggtaccatgaggtatcataaggtaacaatctaatctaactattgatttaggatgggtatgatggggttaaataatgctcttgccgtgcacgcacgtggaggtatacatttcatcgaacaccttcaaggcgtcctgcggtggcctccagtccctcaaccctccaggaaccccctcaccggcggcagtccctcaaccctccaggaaccccctcaccggcggcagtccctcaaccctccaggaaccccctcaccggcggcggcatggtggccctgttcccggacccgtacctccacggcggcactgacgaggtgaacacggcgtgctgggagaacgacccggtggtgcgccggttcctcgccgagggcggcacgcacaaccacctcctggaggtgttcatcaacacgacgcgaccattcgtggcgcaggagctgaaccagctgccatggcattcagtacctcaacctctcggccaaccagtttgccggccgccgtcgcatcgcattgagtccgccgcggcgaccgtcgcatcgagcttccgacgaatcgctgctgcaaccatcgccgagctcccgatgaatggtagctgcaaccatcgccggactcccaccgattcagcgccgacgtcgcatcgagaccaccgcccgccgtcgctgatgaatcgccaccgcaaccatcatcaagctcccgtcgctgatgaatcgccgccgcaaccgtcgctgatctgggccaccatcgggtcgccgatctagggttcgagacctaccgcccctgccgccatcccaagcttcgggtttgtttctctcgttgctcctgcccggcgagatgcggaaacagcgacaaaggaggaagagatgcgcgtgcgtgatgcggaataaacgcgaaagtacaaaactaccctcctatcacaccctgaagttcttttccaagcctaaattgaagttataaatggtctcaagaaaatactggtgtaaaagcaagagtaaaccctaataaatcaatgcaaataataatcgaaattggcatgtggaattttttcttgagttctacatgtcgaaatacgctaacaagatttttagtggaatttttagagctctagaaataattttaaccaattaaaattgagcacaagcaatatttaatcccaggaaaattcatttccttctttttctttttccctttttctctttcgaatgggccgccggcccattctctcttctctccccctccccgctgggccggccgaaggccacggcccagccagccgcccgagcccccctcctctctccctgggtcgccgacaggtggggcccacctgtcgggcccgtctcccacctccag

SEQ ID NO: 52671 - DNA, 2879 bp, Oryza sativa
tttttcgttttgcagccgcccgctcccgtgcactccaccgccctagcgccgtcgtcctcctctccgccgccgccgccgtcgctccggtcgccgctagccgccgctagccaccgtgccgagccacgccattgacgtcgtcatgttcgccgtcgtgcgggccgttccgtccacccctcctccatagcaatccaccgccagaaccccgtccgcgccgcgcaccggtgagcttcgccgtggccaacgccttcggtcgccgccctagccatccatggtttccctctccctctctaactcataccttttgatcccttaggtggtcccggagctcgtctcgccttcgccatcgccctccgtcgctcgccgtcgttgatcgtcgttggtgaggcccctcctcccctttctccctctctcccgtgccgcttagccgccgctatcgccgcccacgttgccgtgacgccgccaccctccgccgccggtcgctgcctcgcgtcgccgctgcgtgcgcgccgcgccgccgcgcgccatggccaccgggccagcttgagccgtgcccgcgcgcgccggccgcgagccgcatccgctgtccgatctaccgggcggtagatcggggccgtccaacccggctgcccgcgtggctgccgcgtggccgccgcgtcggcgccctgtcagcaccacgtggtgcgccgcccctttcccggtccatggaccccatccaccatggaccagcgcccgcagccactgccatgtggagcccacatgtcggcaccgcccctctctctcccgggatttatttattgcgcaataaatcaattaaggatttttctgtttttagtaaaaacacagtgaatcttctaaaattcatatctaattcatctgagctccgtttaagcccattcaaatctcagtaaatcaagaaatatatatagaatccattaaaaatggttttgttctctgtttcagtagtcttatagcctgtttgtattgtttgctttgtatgtcgcttagattccggctctcccgacgctccggcgtactttgaaatagtcgccgaggttcctccagcagcagagcaaggcaagtcattcttgtcacttgaacatgttgatcctatattgcaaatgctccattgttttccttcaaatactgcattgttttataatattaccatgggatgtttacctactgttatagccatgctattttgtaccatggtcctttgttagcttgggatataacatgcctagatattggactagggattgcttagccatgcttagttcaactagcacacaatggggaaaattatattaatgtatagacttcaggatctagtgttgatgttggattagagccaccgtcctggtgtcgcttcattaaaatatgttaaatggtgggctgtgggtgcatggttttgctagtcgcgcccatggcacttaaggatcggttcgcgggaaaccctagaagaattcctcgtacttaccacaagccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtatgcttggttagagggggttatgtgaacggtcctgtcacggcctctatctggtatgtcgtggtggcatgtcggcgcacggaaacgtgtcgtggggctatgtcttgtgggtatagttgtacacttctgatcagagtaaatctattcgaatagccgtgcccgcggttatgggcggtcaaccagattcaccgtgattagtttcaccctagtctagtctaatggaattgaatagtataggtgggtggttgggcctgttgcaacgtggtatagcgttggacagtggatgattaatattgattaattattacaattgttttactactttcaactactatttataaatgctcgctttatgcaaacgaacctctatagctatcccttgatatgacttgctgagtacggtgggtagtactcagtcttgctctattttccccaaaccccagagtttgagtatttgtcaaatggtggcttctccgaggagtaggcttcgttcgtgctgtcgaggatgcctgtggagtggtgatcccgctgcggtccaagtcaaggcttagctccagttatcttttaatttttctgctgcatttatgtaagactttatgatgtttgtaagacgtggatctgtatgtcaactttgtcgtttgtgtacccggccggtcctggacgggggttttaatacacattctgcttggaatcctattcgggaatttctgggcgtgacacctcccacccacggtatcgtttcaatggggaggtgcggtaccacgaggtacggatgatttttgaccgttggatgatgctagatcaacagctaagatttgatactgcacaaccttaagtacagtaaaaaaaaaacttctacctttataggtctatgacatttgcacgcatttatcggcctagattgaatatttaagtataactcccagccaaccagtgaacagtggacaaccaattaccccattctaattgcgagtggctccatatatttatttccattggccctaactcaaaggcaatcaagcatgcgtcagtgccagttggagcttcattctaacaccctataaactccaagctgatgcactttcagtgaccaactatctcttgtataagccataaaatcagcacatttgaggacgtcaccacactcacttgcacaaaaaggcaaattcaccattggaggacactgcctaactttacagggcagagagagt

SEQ ID NO: 52672 - DNA, 12027 bp, Oryza sativa
caggccgagcgccgcggcggccgcctccgcctcctcctcgtcccctgcgccggctgcagcaatgccgccgagtgccaccagaaggagaagcaactgatcaagcaagaggcagaggacgccgccgccatcgtcacgaagaaggaagaagagcacgacgccggcgacgaggcgacgccggaggaggagtacggcggcgtcgccaagtacgttcgcggcgggcggtgcgtggaggcggaggtcgccgcggcggcggcggcgaggcgcggcaagaagtgggagccggagcaggctgccccattctgggtggccacctcctgaaccacttttaagatgacggacacatcaacatcatcatcacatcaactactaatcaatcaatttctaggctaaattaagcttaattaattaatcaccttgatccatctctacctaggagatggtatccataactacgtgattgatcgaacacttttgatctctggcatctcacagtgcctctttcgatctatatttttctctcaccttatagcttcttgattgatcatcagtcaagaacggtatatgactccgttatatcattggtgattgaggtgtaattagtagccgttatcaatattattgattggcttgcatatgtatgcatggatgcatctgaatgaaaaacccgtggcttaattatgtgatctacaatcgatatgccattgtgtcactgtcaccatatgtgatcatattcttcagtagtaaacacttggcttaaaatggttcaggatatttctgagtcgttatgcaggtataggtctctgttgatcatttctgaagcaagaaaacaaaacgaacaaacagtgtctttttttagagaaaacagcacaaaaccaaccaattaaaccacgcgctctcgctgctgcgtcaacttgcttcagaatttttgccttgcgaacggcggaaaacttgtgagagggagacaagggagatgcagtgcagcgacgctgccggaaccaaatgactagatgagaatctgtgctgatgtccacgaatgtgatctggatgctgactgtgcttttttttttttttgcacttgggccccgtagggccggacgagctgcgggtagtgtactgtacgatggcaacctgcaggtatttttacatagggataagtttattttacctccttaatttcaacttttgtgttaatctaaaatatacatcttaactttaaaaccgggtattcaacactcttcaactcaacttgcacacatctgctgaaaattgaagtcattttatcctgaatggcacctatgtgaatactccctccatcccaacatacttattgtttttagtttttgtttgtaatggttgaccattcgtcttacttaaaagattatgaaattactatttgttttgtttgtgacttgctttattatcaaaaatattttaagtatgacttattctttttatatttgtactaatttttaaataagacgaatggtaaaaggttacaagcaaaaaagtcaaaacgacatctaattttggactgagatagtactccctccgtcccagaatataagcatttttagcataataacaagtcaaacgtttttaactttaaccattaataagaaaaaaaaagatcaatcatataaaattgatgttactagatttattattaagcaaactatcataatatatatgcaaattttttatttaaaacatcttatttttatagatattgttggtcaaagtagcatcttgaagaccgtgtcaggatccaaaattgcttatattttggactggagggagtactatcctgttaacacacttaattaaaaatcatgggcccaaatgtgtcatatccgcataacttaagaaaaaaaaacaccctgatttgactcccagcacatgtgtggacaaaaacattcaggctggagacttaatttggcctaaagtaattacttgtatcgtagccgatattgtcaaattgacatataaaggaatcggaatttctgaagaacgtaaagcttttcttcttcaacgcttttgatttttttttaccgtcgtattctctctagattcatgcaaggcaggagaaaaatcgaggcgcctataaatcggacgttgttccaccaaatagatcagaattgtttcactatatagaccgaaaatgtttcaatcgtttaaaaagctgaagcacaactaaatcacctcttggaacattttgctataatgcatgaaacaaacggtttccaaaaaatcaggtgttgtttcaccatatataaaaacaatgttataacaaatagcgaaaggatgttttaattcactgcaacatttgatctatacatagtgaaacatcacgagtacactgactgaaacattgttggtagaacaaaaattaaaacggattcccttaatagagcgtttccataatatgtaggcaatttattgcaacggcgcatgtagtggggcgcatggtggggacggcacggaggcccgcgcggaggcgcgggaagcggcgggcgcccgatccctagcattttccgagaaaaattatccgactcacgctagtggaagtcaaactcccgctttgtaggacaatggttcgtgctgctaaccagttgcccacatacacatttcaatgaagtatataaatgttacaaattaattacaatgtatgtagggttacgttttaattataatatagttgtatttgatagtttcaaaaaacaaactgttaaatgtgatagagatcctcctataggagagagagagagagcgcacgctatatttgagaatacgaccaaacaatgtgaaaaggcaattggtaatcataatttggtttggttatatctaaatgaagatagagttatatagttttcaactatgtgaagttacgcaaaaaattatgtcaggctttagttttaggctttggttacttttgcgtgtgcaaagtgtttgttttcgcgagtgtagtcatctctataaataaataaataaatagaaagggtcacttccgtagcaaattggagttagcaacacaactgacaaaacctttctttaggtcttttttcctaccgagcattaggttagggcaatagttatctttctttaccgattcactgtattgatcattcattcagttctacaaaagtgaatcaacctagtgaaatcaaggtcattctgaaaattgatcatttctacgtcatgacgttagcgtccaaaattgctccgcgcatcaacacggagtcgtcaaatcgtcatctcgtaactctatatgtttaaaccacctagaaaatttgatctgaagagggtaagtccaatgaaaccaagttaagttacgcaaccagccttgcacatcaaaatccttagaccttaggggtggtgtggatattactgtggttaaacatgaaaaatgaggaaagggaccatgccgacatttcacacaagctagatactgatctgtcctaaagaacttggctcatctcaaaatctaatctttttttccttgtagcaggaaggaggcacaccaccgtcacacaagtacaagggacaatttgaaccatgccacacaaattttgcaaaatttgtgatatgccaccctgacccacatgtcatcgattcatgtgggtcctatatgtcattgagatacgggtggcatatctcaaattttgcaaatatagggtggcatggttccaacaaacccaaagtacaaatacacccttttttatatgctcaatagataggaggcgcctataaatcgagcgcccgatttttgaaagatcgaatatgtcgacgggggatacccgtagaccggatatagagggtattggggtacgctggtacgaggatctacgtaatacgacatcaagcaaatagaagacaaggattatactggtttaggccccttgataggtaatagccctaatccagttggtatgggattatatgatggaagtcacatattacaaagggaataatggaactcaatgataccgacgagatcgtagtcaagttggttcgactagatcacccggcgacttggctcctgtaggctccggcttcgtaggctgtggtgtatgtgttggcagtgagattcgatgtcttaggtcctgcccggggggtcccttttataccgcggatcagttgatctccaagtgggactcggagatatcggacccctcacgatatggtaacgacccagtcttgtccgagtagaactccctccatctgtggactccgtttctatctcgtgatagattttcttaatatatacaggaaatatccgtatacgcacaggtatactgtgtcagcatacaacgtatatccaaggatagagggtataccttatccgtaaccctgacagaatatgtttcactaaatagatcgaaaatgtttcagtcttttaaaaagttgaaacacaactaaattacctcatgaaacattttgctacaacatatgaaacaacgggttccaaaaaatcagacgctcttttaccctatataaaaataaagtttcagcaaatagcgaaagaatgtttcaattctttaaaaaagtgaaacacggtcagatcgctagatgaaacaattttgttcaacgtatgcaacgaatgattcgaagccattcaacacttaaaccccgtgtatatcaacaacccacgtgtccatcaagatggaaaatattaaacagtataaaaaacccactgcaacattttattcatgcataatgaaacatcacgagttcacttgctgaaatattgttggtggaaaaaaataaaacggattcccttaatagggtgtttctgttatatccggacgactgttgtaacggggacgcgtgtggtgggggacacgtggagcgtggtggggacgcctggagcacgcgcgtgggcggcgggcggtgcggcgcccgatttttctcgggtccattggacgtccgacacttgcattttcacattagatagcgcttaataattttttttatggacctcacatgatatctatccaaaggctactcgcacgagaattttaaaccctaataagtaaacttaatagatatactatgatacttaaccaccacaattttaatgttttcccctcaaaatctgataaatcttgaagtatcgtagctaggccatagttggacggccacccaagctagcttaatttgcgcattacatctccactgcagattgctctatcgggtgcagggtgccatcgatatcaacaagaagtgatcggacacctagccacctaggagcgatattagtcgcctagggtcgatagtgcctctagctctggtactgcttgaagttggtaatttgtttaatcataaactcaataaaaccaaagcgaaacaatcagccatgcatacatatcaatgatataaaaccaaagcgaaattgaacttaattggacctcgcgtggtgtcggtgtggttactggttaaacttgaacaaacgaggaaaggagcgaccaggtcatgcgattggtagtagacacatcacacatgtattgacacctgcatggctgcacacaacacgtgcaattcgacgtctcttcctgtcttcctctcccggcctgagaaaagacgaaacatctgaatatctatctatctatctgaccggctttgcacatgacgattgacaggagcccacgagggagtaaacaaaaggagagacacaccggcgacaaaaagaaaactcccgtcgagagggctcgatcgatcgaggcaatgcgcgtgcgtgcgtgctcgcgacggtgtactacgcgagtgcgcgcgccacgcgacagcgagcaatactgccgtattcagcacaagctcgctgctgcgcgcgctagctgccgacgcacgcgaaaaggaagcagcagcggtagtgcaggaatcgagcagcaaaatctccggcaaccacgcgtgcagctcagcggttggttggttggttctcagtttctcacaacctcccgcgtcaggtcaactccacgccttccaactctggggattgttttctccacggcgacgacgacgtgacgtcgatcttaagttaaggctggggggatatcgcgcgtcgcgtcggcgtttgtcgttgtcgttgacaaagctctcgtctgacgctggcatcgtgggattcctccctggtctccatgcccaaccggctcctccactcggtctcccctgcacttctgctctgctggtgggcgcggcgcgaatgcgcgatcgcgtcggcgatctcgtgtcgggcgtccgcgccaactgccgccatcggcgcaggcgaaacacgcgccgccgtcgggagatctcggatttccctttttaatttttaattttacttattaaaagagtaaattgcattgctggtacacgaacttgtcaggtgggtgcaatttagtgcacaaacttgtaaaatgtttattttggtgcatgaacttgtctggtgcatgcgggggaagacgaaaaggacactgcatggctaatcttattgatttagaagttgattaggatgctatgtagacatatatcagagaaggttgctactagacatacacatcttcaataaaaaaaagaataggatatagtaatagtagaaaaagattaaaaaaatccaacagtgataaaaaaatccaatcaggatatatggaattcatcatttcgatgatgaaggataaagtagagaccaaatttataaatattgctttttttatgcatactcactacacgtatgcacgtcacaattcttaatcaacatcagctttgtaaaattaatattgccaagttattttggtcctcgttcgcactaactagacaagtttgtgtactgaaacgagcatttcacaagtttatgcattaaattgtacccatctaacaagtttatgtatctccaatgcaatttactcttattaaaatattttaaaacaaactggttttcaagttttacaattctatatccctaactcctctcccttccaaaatgcattttttatgacgtggcacacgtccattgacacattgtaacggtcacatcgagtgatgaaggataaccggtcattttgcaagcaactccttgccgctctcccaaagggttacagagaccacctataaaatgaccagggttggccatttatagccaggaccttgcaaaatatcgtatgtcgctattttacaggcaactcgtttgccaccctcctaagagctgcaaggggaccacctatcaatcgctcaattattacagcataccaaaggatatgtgccacggcataaaaagcctcccatataacgttaggggtgtaattttagcaaggataaaaactttaaaaccaaatttttgtaaaaatattttattgggaacatatcctatgcatacaagcttcccgtggacacttcgtgtacaccaactagtaaatatcacagaaaattctagaaaattggacacatacttccaatagttttacacctacatgtgaaatcttatcttcaaattcattatattttaaccgtaacaaaaaaagataaaattctgacaaatttttatccttaaatctgtcagatttttcacttttttgctacggctaaaatataatgaatttaaatatgagattttgcagatatgtgtagtactattatgagtaaatgtccaaattttttttagaatttttcgtgatatttgccagttggtgtgcacggaaatcttgtgtgcataggatatgtttcctatttttattagtaaatctctactattataaaaatttaagatgtttttgctaagattttgatacgtcatccgtgtttgagtaagtttttaattaatccatcgtcaatcgcgtgggaaccagcaagctttcgaacttaggtcatgtaaaacgcgtgaccctggactgtggtctcaaaactccacatcggaaccgagccgagctggcacgagtttgggtggtctcgcaggctgtcagtgagcttgcagaggaaccggtgcaagcgtcgcgtctgggctcgggagccgcgaagtcacaagccgaagcctcgcgttggagtcggcgccccgcgcgttgcctcatccggtcaacgtcacgtagaacgtagaaaaggtaacaccgccacgtagtcaacgaaaccaccctccaaaaccgtcgagagagtcaaattgcaccggttttaatagttcagggtctacatatttggtattgtgatttaaggatacaaataagattcggccactggttaagagagacaaattgaacttatcccgccgccgggagatctcgcggcatcatgggccgtttcacctgagatgatggcccaaacgaggcccaaacggaggccttcttctggcgggccagcttttcttccccctatgatttattacacaacacttgcgcatccacccaccccaaccgaccaaagctcgcccctttgccctcggtcatgagcctcgccgccgagtcgccgtcgccgtcctccccgtcgtcgtcgagcggcagcgacgacttcgcggcgctcctcgacgcggagctcgagctgacctccgccgccgactcggcctccgccggagacccctccgccgccaccgacgacgacgacgaaggtggtgacgaggaggaggaggatgtggtggtggtcgtggaacaagaggacgccatcgtagagcagagcaggtacgcgcctctccgtactctcacctcgtcccgaggggcgaggagccggtcgagttgggtatggcggcggcttgaggcgctcgggggctctgtgctcctcgcgctttcggtgttggacggtcggtgacggcgagcagatttggtccccattcgaacctgttagggttttactgtttgattgggccggttagatgggtgctcgagggtcttcgctcctgttccgcttgaattgcgatggttgctggattcagttgtgcgaatgctgatggcaacgaatttgatcatcatcgcgggggattttttctagggtttattgaagtccgtactgttcatgtagcctgcacttcatttcattatacctacaagtgatttgcttatctgcaattgtgaaattgtgaatgacagtccatccaaatagtagatcccatgagattgctttctacgatttgaatagataccacaacttccttagttctggtatggtatgaaaattttctcatttgtggtagcttaattgcctacctatggctttatatgctgaaggcaggcaatacgtattagcatatgttgatcctataataagctggccatccaaatatgcttacgcagaagtaagaatcctatatgttggtgaactaaatgcgctatagttttaaggaaaaattggttgtataccaccaaaatatcactgatcttgttttataccactggaattttgtggtacactacaatataatcataatatgcctaagttgccatttcaatgctgctcttggttccctatcacccattaggggttggagatggcttcttatcttctgtgcggtccgtgcctttgacattcgttgggtaaacattgacagtcttgggggtgcattggtgagtttgaagtgacttggcactgaaatgagttggggagggaagaaccagctgtgggaatgcagggaaattttctttttgcggatgagggcaaaatggtcaacatgacagaaaagagcacttttgatggttgtgtttaaatgaaatggggtgctatttgagtgtcattaatacatactgtaaaaatttaattccgatagtatagaactaaatggttatttgatggtatgatagaaaattttcctttcatttattggatatgctaaagcttggctgaacatgcaatccatgtccttttgtttagaaaatactaatagtgagctgttttctggattttgtattttggatctgactgctgtcaacggcatgcaatatgcagtaccaaacggcgtagagtggaggaccaacaccgtcatcaagcagtagtaatgaagtcagatgaggataccgttggtatgctaatttgtttcacttccaacccactaacatttggcttcatagaggagggggagggggggcacttgattagttgattatctactaaatgcgttcaaaaatttatttactttttatatactatttagttgatgtggttacagatttactgtccccattcttgtgtgtgtgtcgtaggagtttttttttttttttttttttgggggggggggtgtatgttattgcttttaatcatttaattgttgaggttccatgctgtgtctggactttagagaggaacatcagtttttcacatttggcttcagtttcttctacagttctacttttagatggagtcccagttgccttctgtcaagacttcctttatttccatgagcagatggtacactgttgcaggttcttctaaagatgttaaaattgatgaatgcccaccacatcctgggttttttggtggactttgctatagatgtgggaaaagacaagatgaggaagatgttccaggagttgcttttggttacatccataaggtacggtcaaacaggaagcggaaaatatctttgaatttttaaggctcctttgacttaaatcagtccttactataatacaagtgttgtaatgcttatttattgcatttacctttcccaaaatcacactctttccagtacgtagtattatgcaagcattgcatctcttgatatattcttatctttcccagttacatttttatttccaattgtcctatctgaatttaacagaattatttcaacgcagggtttgaggctaggtacaacagaaattgacagactgcgtggagctgatttaaagaatttattgcgagaaagaaaactagtactcattttggacttggatcatacactgatcaactcaaccaaactctttgatctttctgctgctgaaaacgaattgggaattcaatctgctgctaaagaaggtaatgtgtacgtctttgtatttaaattggagaatttgtaagtttttagctattgatttacaaactttgatattttgtaaacatgagcacagagatactaccttcagtccaaaactagatgttccttttgtatgtttggagtccattttaaaaaaaagggaaaagttggcctgtaatgtacattgaaatatgaaaattctgcggaaatgtcatagctatttgtcatattctttcactgtaaatgtgatttttatgacatttagaatttgtggtgaaggttgcttcttgcagacactgaaaagtaaaactaacatcaattctagttgcttctattatgatagaagttatggcattattacttagcactaaattctaattaatggtgaggttgcattcttccatattaccttattgtggtttgatccttcctaaatctgttgcctaaccatgaattagtcatctacaattttacttaaccagaaacatgcttaaatgcagttgttccggacagaagcttgttcacattggagacaatgcagatgcttacaaagttgagaccatttgtccgtagatttttaaaagaagcaagtgatatgtttgagatgtatatatacactatgggtgacaaggcttatgcaattgaaatagcaaaacttcttgaccctgataatgtatattttggctcaaaggtgatttcgaactctgattgcactcagcgacaccagaaaggtcttgatgtggttcttggagatgaaagtgttgcagtgattcttgatgacactgagtatgtaagtgcaaataatccagtgaacatggttgataaacattttatatgataatactgccagtaattaccgtctgtagtttgttagaactagttaatgtttactttggccactgaaagtttgttttggtctctgactgttctatgtttgcttctacacagcagtagaaacattcatcctgtattgtttaaatgttgaagggctgaattaattcatcatttacattgatgcacatcgtgtatccggcctaaatggtttttttcttttcaggtgtggcagaaacataaagaaaatctgattctaatggagagatatcattattttg

SEQ ID NO: 52673 - DNA, 2637 bp, Oryza sativa
  unsure (1)..(2637): unsure at all n locations
gcaattaccctgcaggcttttttattatacattatatcttttagttgtacagtggtattcattacaacagatttttttcacactgtataagttgatgttaccattgcttggacagcgttattcattcctacctgtaaagctatttttgattgataagatctaggggtacaatcaatatgaaaagaacttaacatagacaaaattcagttttggtgtagatcaatatttcaaatggttatgaactacagagtgctaaatatatcccctttagtgctgtttttttattaaaaaaaaatcgttggctaatatctggttggtgtacgtatatatccctctctaggtgatcaagagggtacggcaggaagtacttcaaggctgcaaactagtgtttacgcgtgtattcccgttacatcagcgccaacaagatcagatgatctggaagatggccgagcagttgggtgccgtttgctgcacagatgtggattctacggtcacccatgttgttgctttggatctaggaacggagaaggctcgctgggctgttagtaacaagaagtttttggtccacccccgctggattgaggccgcaaatttccgatggcaacggcaacaagaggaggattttcctgtagctcgaccaaaggagaagggtaaagaaaatgccgctgatgctcctatctcaaaggagaacggtgacaaaaatgccgctgatgctgctaacgcaaagaagggtaacgaaaatgtcgctgatgctggtagcacaaaggaggggagtaaagaaaatgctgatgatgctgctaactcagaggaggagtaaagaaaatgctgatgatgctgctaacgcagagaagagtaaatctgatggtgctgccagcggtgcaactggctcgtaaccagcttataccttttgtaaaccgttgcggacattgctgtagctgcgaacctacattaggatacgtactcttgcgaaatagaaattgtggctagtttgaatcggactgtgcggatgatggtgttatggtacatgtgagatttttcctactgatctgggcctccagccatatactttagttgacagtttctgttttgaagatctgtgctagtaacatgggtacccatagaccagtgatctcctttcagtaggtgttgatttctctaaacaccacaattatacatttactcaatgattgggagaccaaaaatagtgcaaatgcaataattatccactgaaagaaaggtgcaccagaaggctatcatgtctttgggatcaaccataacatacatgatgtcaaatgctagccaacagagtcttaggttagtcggtctcttttagaaacaaagcaagaaagaaatgccactcacccgtggctctcatgatttactcttactttcccacgaatgcgacggtggcacagaaattcacatcatcttatcctacacccttttaggcctgtttgtcttatcgtcaaagctctcaggaaaaggtgtaaagcatctcttgtccgtgaattctgcgacggtgacatcaaacatgcgcaatcctacccccattgttgtcaaaggaggttgcatgaatctagattcccctgctcagtcagagaccgaaaccatcatcgtcattatcctgaactctggcaggagttcatttcaacctgcaacatctctcgactagtcaccaccagctcagtccatgtcatctggcaccgggccggtagacgaaccaaggccacaaatgccgcagagaaccacaactccacaagtcccaacaggtactatacgcatgcgcattattggggggtggcacagactcgacgacatgtgtgagatgcgtgtactactccttctgactactgtgatgatctgcaacgccacacgttgccacgagcatctctgcagcaggagtagtaggaggaggacgacgacacggagccgcgctgctggatccatcggaaatccgagccggcgccccaggctagtaccgcagctgctgacctttcttggacaggaaaggccaaaaaccgatcgcccacatgtgacctctggtcgcgctgctcccgctgttcccgtcacacggtcacgcgctccgcgcccccccgtcgacccggcgaccgacctccccctcccccccgcgcgaacgccgcctgcgcgtcggctcgctcgcgtcgcgtcgcatgtgctgcttgggttggggtgggtggctgcatcacatgcggctggatcgcgagcatcttggtggtgctcggcgcccgcgacgacgtggcccgagcagcgcgcgccgcggggcgcctgcgtctgcgtgtgggcggcgtcgtggatcgatcggtggtgcgagcgaggagcggcgaacctagccgtgtggggggatcctaggcggattttcggtttggtggctatgctagctcgatcgtacgttgtactacttggttgtttgggattggacccgctttgagatgtgtggtacgtgacgcgtgggggtttcggaatttggatggaaggaacggcgggcagctgcggtggatccgtcgaccacgcgcggtttacatgcacagatagtcccagaaccagaagggacatcatcgatgagagcatgtgtnnnnnnnnnnnnnnnnnnnnnnnnnnnnnnnnnnnnnnnnnnnn

SEQ ID NO: 52674 - DNA, 737 bp, Oryza sativa
agttcgcagctggccgttgagtcaactacctggtcaatgcgaggtaacccgaagggatctttgggacaagacttgttgaggtaatcaacacacatgcgccattgccccgtcttcttccgaactaggattgggttggccagccagtcgggatgaatgacttccttgatgaagcctgctgctaacagcttgttcaattcctccttgatcgcgtccttcctatcttgtacgaaacggcggagtcgttgcttgataggtttagcatcttccttaacatgtaaagagtgctcactcacctctctaggaataccaggcatattagatggtttccatgcaaagatatctttattattttgaagaaaggtgatgagcgcgctttcctatttacaatctaactcaacgcctattacagcagtcttagtaggatcagagggatcaagaggaatcttcttggtcttggcgtcgccttctccgctctttgtcatcttggttgcaggcacttctccttcggttgctgtggacgcggccagtcggatctcttgtcgggcgagcgtgatctcgcgggtctgggccatctcgcagctttccttgtcgcaagggacggcttgcttgatgtcgctccgcagggatatgactcctcggggacctggcatcttcatcatcatgtaggtgtagtgtgggacagccatgaacttggctaacgccgggcgtccgagtatggcatggtacgctgtctcgaa

SEQ ID NO: 52675 - DNA, 5044 bp, Oryza sativa
gtcgaacctgacattgccggcaatgcattgtaacatcctgaaaaatcctgacaataaaagtcactaaaattttgaattttttaaaacttttgcatcatgttggatgttatggttgctattgcttgccaaacttttgcatcaatgtaactaatcaatctacaaacaatcaatcgaatcgtttttcatattgcttttagttttttgcttagtttgtccatctttgtcgatttgcgctgtaaatcgtccgcagccgctgcgaaagtgcgacacctcttttaagtttgtcctgaaaaccttccgtttttcccacgagatgggtagttgtctatcgttctatctagaattggctccgcaagccggtttagttatcaaaacccatcttgatttagctttgactagattgaggtggttggcgactctactatcaccgcaaagctttaggtgctgtgaaaagaacatctgaaattattaactggaaaaaaggaacatctgacatcactacatatttcgtcctggattgccaaacaataccagaattgaacactgtagggatcaatattaatgatccacgaaactgcagaaaagcccatcatgcaaacattttgcctcccaaaatctatgttgtgaattacaaattatgaccagaacaatggtagtgttgtcgaacctaacattgctggcaatgcattgtaacatcctgaaaattcctgacaataaaaatcactaaaattttgaactttttaaaacttttgcatcatgttggatgttatggttgctattgcttgccaaactataaattgtcacgattgaagattaagctaaagctatacaactacgtaacaattataaaaataagatatttattatgaaccctatagatatttacgcacaacacaacaaagccatataaagagaaggttaattactaatttaatttataggtcaaatattaatattgtgactgtgtcatggcatccactcatataaaataattgatcacataaaataaattgatctttatatatagagattgaatgatgggagtatataattaaatatttagatcaatattgtgccaagtctcaatttcttttgtgaaataaatagattaaacctatccgtgtgtaaatacattgttaatacaaataaactcgaccaatgtgccattgtattaatatggtgatattagtatattataattaataattgtccaagcctacaagttatataggataattatgttaaaccaacacatggtgaaaacgaataaataccaaaatcccaaaagtataggaaatcataaaaggtatagtacaatttaaaaatttggacaatattaattttgaacaaaattcacatttgaatacttcatattgtcgttaaaatgcattggtgaaaatataaattgaaatagacctttttcctcaatttataaaatcaatcaaaaaccctaaatttacagcctggctctgttcattgtgcgccaggtgttcgactcggttctaacccggccaaacacccagcgcagcatccgcctccccgtgcacgcgcacgcgccttctctgctcgtgcgccgcattgggcgtgcccgtgcgccacaccgcgtgggcccgccgccgaccgagccaccgaaaacccgcgccaaagccgcgccgccacgggagcgcgcatcagcaacgtcgcgtcgcccatcgtctcggagccgaggggtaacggccgcgacgtcacccccacaccacccctaaaccctatccaaccgccctacacccgaaaacccgccctcaccaagccgccgctctgccatcgccatgtgcgcgcatcgccgtcgccacgtccgccaccttatccgaatgcggatgccgggtccctcctccattgtaaccagcgggtaaaacggagccttcctctctagctagggctagaacacacagtataggggtcatagatgcaatgatctgctacagaactttaatggaaaaggaggaggaaacatagccgcgtcaacctccctaatctaggccgtatagacagccattgagtgcaccagctgccgatcctatcctccacgccatcctggcttatccccaagccaatcccccccataaaaactccatccctatctgccttttcctcgaatacatttcatcgaacaccttgtgagcatgcttcatcatcactggttggagccgaagccggcgtagctgaccgcgggagctgtggctcgggccgcctctacttcttctgctgccttgcatcaacgccgggagccgctggacgtcggggagagtgcgtcgaacacctgcgtgcgctgccgacgtcgattcgcccctgcttcacccgcaccgtgccgcgcatcaccgacctatgccgttgctccaccgcacggtaaatacttgcgctcttagcaccctctactgacctagaaacatttggccccctcgatttgaggtgtgtgtgccgctgctagcctgccgacgggccgccattgcgccaccgttgagctcaccgtggacggcactagttccaaactaacctaggccatattattgcatgaattagttcactagagaccctagatggtgaatttaggctcggttaggtttaattcgtcctctcccgcgccatggccgagctcgccgtgagctccgtgccacccgtccgtcgcgtcatgccccttgtagccgccgcgcctcgttgctgccggcggtgggtctccggtggtgcgccgccgcttccctcaccacggccgagccgtcccggctcgggctggtcgcattagccgtgcgcccgcgccgctgccctgcgcgtcgggaggaggaagacgaccgagggagagaaagaaaggaagagagagagagaagctgtgggccccacatagagattagtgcacagtaatcacctattaatccaatgcaaattaatctattacacgtgggattggatgattagaaaaatcaaagaaaaattgattatgaagttactgtcaatggcatgcgggacccaccgggattaaagggctggtttggacccaggtcaaatagggccggtcccacttgtcaatgactctctgcattttctatgggaaaataaaaacaaaggaaaaagaaatggggtgaccctacatgtcagccactgtaatcatgcccctctcggctgcacagtgccatttcacaactgtttgaattaattcaaatttgaatctttaaacaagcatagctcactcattttagctcggatttaaatgaaacttgaacctaaattcatctaaaatcaagatatagctgatggaatcacttttgctatttatttttgtactgttgaattttggtgatttaatttgaattctaattgaattcaaatcgaatctttcgcacgtacatatagattccgagggagtggttgagttgactgcaaaacaaggacagcaagacagtgagcaaggcaagtcatcactaatcttgagcatattggacctattgcgaacttattttgatttaaataaagtttgcatgctatttatatgtgaatgtcctactttgttatatgccatacctttgatattgattatccatacaatctttgtaatccataatatcgtgtgtttttagtcaatgcttgaccaaagcatgggtatgatttgactgataaacctgatgttttattattttttttctttttacttctaacttgattgccattttttttgagaattccttcgtaaatcccacagcaaagcacggggaatcacctagtcaatactccctccttccaaaagtctcagtcgtatttggttttcttgtttttccagatgagatgggcgcattccactctgcatgcatgcatgcaggctttaaatgtgtagctggtctcttcgttaaacatgcatggatttaattcctctcagcaaccgaacagtattcttttgcatgcatgcaaatccatccgttgcctattcgcgagcggtgggcgcggacggttgcggtgttgcacacacgcgtatcgtgcatcaaccgaagcgtcgcttcctctaaatccatgcagatgtagcgatggttaaatgcgtcggagagttccttggtcttggagcaaaacgtaatacgactgagacttttggaaggagggagtatatatgagtgagaccaatgtttacttgaactttatcttatttagtcttctttacattgagaacatcaacataatgaaggtttgtatttatgtgtctttattattgctacatgcgttctccatgtgtagggaacaaaccccattggtttttctctaattatgcatatatttgtctccattatatattccattatatgcatatatttgggggagcatatcttatacatatatcgtgcatgttctagatccatgttgttcacctattatcctacactacaacaaatctgggcttctgtgacgattacctaatgacagaacacatatatgtcataaacagagaggctgtttatgacgactgttcataggatgataactgtttatgaccaaactgtgtatttgtcataatcatcatcatagtatactttgcatgggctctgtgaagatagcacgatgacaatagtggatcgtcataaaatatagaactattatatttttaaaaaacaaaaaaaatcttgttatactacattgctgctagatcacaaatcgtttgtcctaggtggactcttcttgtctctcattttagtattttaggattgaagtcatcgctagtcttattttatgaataaaaaaatcagaattatggcgtttcattttatgattgaatgaaaaaactttaaaatggctataagttggtttgaacctacattactacaagaaatatgaccttctatgacgaatttctcgtaacatcggagctattcgtcattagcacattccattttatgacgattaattagtatgagatggggaggcttagtgacgaaaaattttgctttaaaaatcatggctggaaatatatttgtaatattctacgtggtctaaattattctctgaaatttttttgtgaattttcggagct

SEQ ID NO: 52676 - DNA, 5356 bp, Oryza sativa
aaagagaggtggagagggagagttggagctctctccttgggtttcttcggctcagggtggacagtgaagtttggcgatgcgtcagggagaggagtagaggaggagctcggcattttgagggcgtctacacgtcatagccacgcgtcgcgcgcgttcggactctgaagggcggcagagcgtgctccctccctccctatgtgtctctggtcggctggaggaggtgaacacttggacagcgacccagagatgatgacaggtgggtccagggtggtgtggtctaggtgtgggtgtaagggatgggtaggattttgagtgaaaattgatttttcagttattttcaagattatttctctcccccttactttttaaatctatagtttaatttgtggacatgataaaattagaggggatttttctggaggtagatgaaggtacctagattccatttggacgcgactacaccgagaccggtatcgcgatagccctatcgcgcgacgtgcgcgcgcccatgccaaaaaaggaaacagcgttttcccgggcccccgcgtgcgccatggctcaaaaaggaaaggaaagtgcgcgcttgcgcgcgcaagcgccgtgcaacgccacacgtcgctagctggcgtgggccccagctaagacagcgcgatgcgcctctctcccccgctccaacccatcaaatccggacatcggcgacatcaatcgccacgcagttgccacagcggtaaaaatcagaaacaaatcgccatcttggaagaggggaaggaggaggagcaaatctaagaagaaaaaaatcgccatcttggaagaggggaaggaggaggagtaaatccaagaaaatatccaggtaaagtacacatgaagttcaaattctgtcttctttgagatccatccaaaaaaaaaaacaaatagaactaacctagaaacttttagatcttttctgtattcttcgagaaaagaattcatatgaatatgtgctgtaattttgtaagtaatgagctgtagtgttgttttctgtcttcctttataccccaaattcactttctagtgctgctgagaaaaaaagttattgaaaaggcatgagtactggtgtttcaaaatctcaaagcgattttaacaggaagttacttctaacaaatcagtaagttacttcctatgaacttgcaacttacttccagataaacttgaattcacaatccctagtttacacagcatgatacattccatttggttgcctctcagagcaatttgaacaaaaagttactttacttcccaaaataaacttaaatttgcattccctagttacataggcatgagtaatggtttggaaatctcaaagcaattttaacagaagtctcagtgcatttttaacaaaaagttacttctaacacttcaatgagttacttcctacagtacactaaattacttctcactgtgtattaagtaacttctcactgtgcattaggttaattctcatagcaattttaacagagtctcagtgtatttttagcagaaagttacttgtaacaattcaatgagttacttcctagaaacatgcaaagttacttccctataaacttgaatttacatttcctagttacacattttgtaccttgtttctatatacagcatgatgcattgtaacatactagatttttcagggtaaaatttttgtgaaaatatttaaagtcaatgttcttcgttctttcgaattggagcctcccaatccttatatttcttttgttccctctaagtttccgactcccacgtaaccttgtttagtttccctctccaaaccaaatctgagatatccagagaaaattccgaaaatcatcagaagagctcgtgtttattttaagttatcccggagtcatcattcaaatattctaaaaatcagtcttaacgatttcctattcaaaaatatcctaccaaatttctatacaaaaatctctccaaaaattcaaatagatcactgtgtttcttctcggaccgagttccttgcaatccagcccatattccggatttccttttccctggtcactctctgtgttgggctgttctaccccatgtcctggcccagcctaggcagcccggctccagccgagcctctgcaggccgacgccatccagggccgctctcgcgctacacgcaagcagcctcgcgaccttcccgtgctcgcacacgcccgcccgtgccgcctcacatcagccacgcgccgatctccattagccgtcgcgcaaatcatagcgagaggctgagctcgcctcgccatcgatctccccggtcggttcctagaccttgcactcttttcctttttctccttcttcttctttccctggaagcgttaaactcgttttcatcccaaaatttcctcagccacagccaaggccagctgtgtagccgattcgtcgtcgtcgtccctctgctgctgcaccacagcaccgcaggaacacctctcatcggtgagaattctcaataacctttgtccccttctttccttgcttctatcgggttcctatcgtgctcctgtccaccaccatggctgccaccgaggtcggcatggccgacgcttcatctctatcaactaaccacaaaaatggaaccttctcatccaggaacacgttttgacgcactcacctgcccgcgttcgccaccggagctgccacttccatgcccggtgtcaccatagctcccgatctggaactcgcgttccggttagctctgttgtcttccagcccagtgtccacgtcctgtgggggtgtcagcctgtggaacacgtcatgctatcgtatccatcgccgttccctcactggagctctagagcttttctctctacctctgttactcacgtgaaaagccacgggaagaacatgaacagttccggcagcgctgtttcctattggttgaacccaaccaatcccatcaaaaccacctaaatagtgcctaaccacaataaaccagtccaaacaattccattaggatgtttttctcatgttcgagctctaaaactccaaatcaatttcagttttcacctctgtcatctatagcattaattccaaattgcaaccactactacacataccatgaatcataaccctagaataaatcttttgtcatccaaatcaagttaactcttgatttatcattttcttttgttctggctccgattcacaatatttattttatcgtttatttgtagtatttttattataggcttatttggtcgtttcttcgtgtgcgtacgttagatggtgttgaagattccaccggactcacaggaactgaagtggacctagaaggctacgctgaagcttcggaaggccaccttccacaaggcaagccacagttccaatctttgatcatattgaaacctagtagagaaccacttagttattttatataaattattttgcgtataaattatttttgaataaacttattagtttagttattacccattattacattgttattattggccaaatccatgaattgctatatcacgcccctttgataacctagtggataagaccaccaaatatctatattcatatacatagtttacccgtcgtcacgtggtggcgtgacgggtgatataaaatatgttatttgatataagtcactcgcctagagtgatatggaagattaattccgggtgacgatggatgttgtggtgtgtgagaccgtgcatgtttgtcacgccttgaagtttccccctctccttgctttaaaaattggctaaataaattgctcgaagaaattgtttaaattaacctagagctaaatccctaattaataaatgcatttaataatcaaattcggcatggtggaatttttcttgggttccacatgtcacaatatattaacaggatttttagtggaattttcaaagccttggaaataattttaaccaattaaaaatgagcaagcgcaatatttttaatccctggaaaatcctttcttcttttcctttttcttttccttcttttttctctattgggccgtcggcccactccctcccgcgctcggcctcccctttgttgggacggcccatgcgcccctccctcctctctctgggacgccgacaggtgggccccacctgtcggtcgtctcctacctccagcaaccgccgctgccgtcgaaaccgcccacgccgctgccgccgtttcccgccgttctccgcgccccactccgcccgtgccgcgcgcccacgtcgccgccccactcctccgcctttcccgcccgcgcgcacgcacgaagtgggcgggattcattttgaatcccaccccactctctctctctcctccccacgtcgccggcggtttcgaccatctccccggccatgtccgcccctccctcgcccataaaaaccctcccccgagtcccctcccttgtttcccccatttgccgtcctctcccacgccccctaccgcgcccgcgccgtcacacccgagctccgccgctgccgcccattccggccgcgcgctgccgccgcgccgtgccatcgccgccgtcgcgctcacagagcccgtccgcacctcggccgccgcttggttgccgccgaacaacgccggagcccttttctcctcgcgcgccggtgagaccttctctcctctccatctccggccagcaattcaagccgccgtggtcgccttcccttcccctaacccctctctgctctctcttagggtgccgccgctgcccgtccgcgcctcggcatcgccggtcatcaccgccgttttcttccttcgcgccggccgccgtgctcgccggtgaggaatccgctctcctccttccttccctctctcccatgagcgccgccgccctccgcgcgtgcgccgtcgtcttcggccgccgccgccgccttcgcgccggccgccgccgtctcccgcgccgccggtcaccgccggtggaccacccgcgtggtcccggtccacggtggaccggccgccttgtgccgctgacccatggggcccacgtgctgacgccccccctgatgacgtcagccctgggcatttattgcgcaataaataattaaggactttttctttattagtaaaaacacagtttatcttctaaaattcataagtaattcatccgagctccgtttaagtccattcaagtctcagtaagtcaagaaaaatgcaaagaatccattaaaaatggttttgtttcctgtttcagtagtcttatagcatgttttgcttgtgtgctttgtttgtcgcgtagaattcggccgtttcgtcgatccgcggtttctcgaagacgttgttgaggtctcatcggttcgagagcaaggcaagtcatgcaatacaattgatcatattgtacccaatttacaaatatcccgcat

SEQ ID NO: 52677 - DNA, 1196 bp, Oryza sativa
tgtccagctgccggattcatcgcggcgcaagaggggaccgcccactgccttttgaggggtgggggtgaaaccttagcgtggtgtggatggttaggggagggatatgtggagggtcttatcacgatttccccctttgcagtatcatgatgatacttcggggtatggcgacatgtgtggaatcgtgtcttgtgggtacagttgtacacctttggccagagtaaaactattcgaatagccgtgcccgcggttatgggcgatcaaccagattcaccgtgattagtctcaccccgagtttagtttaatgaactggtgtagttcaggtggttggttgggcctgttgcaacgtggtgtagcgttagacagtaattggttaatactgcttaattactactactgttttactgctttcaactactgctttgaaatgcctgctttatgcacaagaacctttagcctcctttggttatatcctgcatcatacctcctcttccggtatgacttgctgagtacagtgggtagtactcagtcttgctttcttttcccccacaccagagctgaagatcttcctagtgggagctgtcctgttggagttggtttcgtcgctgccgtcaaggtttgcctgtggagtggagtcgccccgctactgaagtcaagtttccaagtctagctcgttttatcttttttgctgcattttgtaatcttttctatttttgtaaaacgtggatctgtaggtcaacaattgtcgtttgtgtaccctggctggtcctggatagggatttaatgcacattcagcttagaaattctggttcgtgaatttctgggcgtgacaatgttgttataattattttgtggaaagtgtatatttacacttgaagtatgcacgggcctgtgctagttttggtggttttccccggatataaggactacccctatgccatggaaaatgatgtaatttgcgcccatccacaggactgagtaatcaaacttagcctagtacattgtctcactatatgaaagactgtagggtggctctatgagcaggtttggggtggacatgtggaaggggctttggccaggttgacatgatccacaacggtggaacctgtaggatcgtacaagaccaaacgaacctaccagagggggggatgaatggtagcgaaaatcaaaaacccaaaatcttttgcggaattaaagat

SEQ ID NO: 52678 - DNA, 1781 bp, Oryza sativa
tcaggcagtagactgatcgaactgcagttaggtggccctgtgtagaaccaaatactaatactcctccaggaaataagtttgttgtttatggaacggtgggagtacacgagaattaattgaaccataacttggactaactaacaaacccatgcatgcatgcatgcactcattatgacaagaccataacctaatgcagtacttgtcatttgttttactaatttgcagtcagcaatgaccctgagtcagcagatagaccacttcaggcagtacaaggagaagctgaggtgggccaaaggcgaggcagcggcacaccacatcataagccaggcgctctacattttgagcgtcggcaccagcgacttcctgcacaactacctcgtcttccccatcaggggcaaccgcttcaccctgccgcgctacgaggcctacctcgccggcgccgccgccggggcggtgcgcgccgtgcacgggctcggcggccgccgggtgaagctcgccgggctgccaccgctggggtgcctgccggtggagaggacgatcaacccggacaggcctggggattgcaacgagatgtacaacatggtggctctgagcttcaacgcaaggctcaagaggcttattgggaggctcaactgggagctgccaggggcacaagtagagtatgttgatcagtacagcatcctctctgccatcattgccaagccatgggaatatggtcagtacccagtaatgcacttcgcttcatattaaattttggtcagtagttcagtacccagtattgaacctagttcgagattgttaattgtattcagaaccttttggatatattaaacctacttcgagattgtatctaagtttcccgagtcttaacacttccgtaacaccttcataagcccaatcggatgtggagaagatcctttaggtgcaacaccatccctcctatatatataaaataggagccaagctcgatcaaccaacaatcaatcgtcaaaatcagtctattatctatacctctgtcatctacatatccctcctttcttctggcatcctatgtctattcatcctccaatatatcccctaattactcgttgtctctctcgtctctatggcgttagaggttgtcctagctatccaccgagtctaagtcaaactggtgtgtgttcacgatgacaggttctctatcggtctcgagtgatcgttcagtagtacctaaccctgtggcattgtgtctccgggtgtctctatgggttgtacacaagatactcaagtgtgcctaggcatgtaacccgttcttcgtgtcaatgaaatttggttataaatatttgacatttgtcataatatttaacctcactgtttgcttgttggtttataagccacaagcaaaagttaaaattttaaacttaatgttaaattatttaatgtacttttatcaatgttttttagcattggctttatttaattcgctaagactaaaatctaatggtcctacgcaaaacaattttatgtatccttacttagccagaaaccaaccatgagatcgttgatcaaaatttggaaattttgactatatattttgtattaaataaatttagggtcttatgatagtaatcttaaaagaaaatctatgcatgccattttaatttgttattttaaaactaagttttgagaaattaattatgatcaaagttttaaatgtttgataaaatcttattttaaaagtcaaatatttatgattgaagggagcatataagttatgtaatcctattctccatgattaaacg

SEQ ID NO: 52679 - DNA, 5450 bp, Oryza sativa
tgagaagaaggagaagcacaagcatagcaagagggaacattatggccaatctcaccttgggatgatctttggctccgactccgagtcaagctcaagtgatgaagaaggagtcgccacgttcgccgtcaagccttcatcaccaccgagactctttgactactcaagtgatgaggatgctccggtttgcctcatggcaaaggagcctaaggtaccttctcctcttaagtcatttaatgttgatcttgttagtgatgaggaggatgaggttgaggatgagattatggatgacgaattgttcaagtccataactaaggaatccctaccacacttgagtgagttgcttgggagaattgaggaccaatatgcaattcttgagaggcaagagactttgctcattcgtgagaaagagcggtctcatgaactcaagagtgagcttgttaaggagagagagaaaaatgaggcattggtacggctttacaagcaaaccaaagagtctcatgctaatcttgatgtggcgaacgctcaacttcaagagagagtggatggcttggacaaagcatacctcactcttgaagaaaagttcgaaaccttaaagaatagtgtctctctccctagcgagccatcttgttccaaaattgtcccaagcaatgaaccatgtgtgagatgcaaagatattgatattaacgcttgtgctactaactctattgccttgagtggtttgcaaaagcaaaatgagaagcttacgggactccttcacaatggcctacttaagtgctatatgggtagtaaggccctaaatgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcataggcgctcaactggggtataagccaggactccacctaagacttcttctccaaagcttctcttactgaagggggggaaaagattgagcaagagtgagtacaaccacagtactcagcaagccacaccggagatgcataattaatgcaagggagtacaaggggataataatataggggttaagttttgcagtaaacagcatttaaaagtcacttacttgcccaaagctattttgtaaacacgatcctagagctatacaatattattaatcaaggccatgaacccacacgaacctgccttaacccaaggcctacgatgattcagaccgaactggcaacccgaccctgggtcccagctcgtcccaagccaacccaggccaaccattccatattttagttgttaagcaggttttaagaattaaaacactaacttgggtacattgctcggcttgcccatatccgagggctcggctattcgaatagattatctctgatcagaggtgtacatctttacccacaagacacatcttcctcacgtgtaaccacgtgccacataccaccacggtatacggacggaagacgtgacatagttcccaacccatcctagccataaacaagagtaccgacccaatcccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttataaccagtctgagctacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaaccacctaatgttgtcctattaaacagcgaagcatctacctaaattcatactagtggaaccatgaatagagtacccactagttggggttttgtttattctagggtgaacaaggtaataataacaatagcaataataatgtcataacaaaggtaaataggcatggctaaacaaaacagtgataacgcgggaatttaaataaagcggtaatgcattaatttaaatcaaaataattttataaactgagattcaatatgctcaaggatgatgtgacttgccttgctcgctttcccaaacgtcggcttcaacttccacgaagagcggatcttccgaagctgcagcgtctacacgaccaacggaaaagaaacggcttttactctactaaactccatataacaagcagaaacaaagcacaaaaatgggttcttggcttcttaaggaaaaattagagacttgaacggtccaattccgagttcaaatggccaagttatggccatttgaagcttatatgctctttaaatggatatttgcgaatttcttcatttaaattttaatttaaaatcggatttattgcgtcagccgaggggaggggcgcgcggaccgggtccacaggagtggggcccacgcggcagcctcacggtccacggtggaccgggtgcacgcggcttacgccggccggcgccgtgggtcccgcgtgtcagccgtacccgagggcgcgggcggctgacggccgggccccacctggcagccgcggggcgcgcccgaaggcggcctcgccggcacggccgacggggaggcggcgcgctcgcaccccgatggtcgccggcggcgaccaccagcgcggcggagcggcgcccgagagaggggagggaagggggaagcgaaacggcggtccacggctcaccccgggtcgacggcgacaacggaaacggcgaccgaagcggagagaggcggcggcgcggctcgggtcgacgggaacggcggcgttccggcggtcggctggcgaaacggaggggtggacgaggtcggcgaggacgcggcggagccgaaggaggcgacgccgaggcgggagaaagtccgaggcgacgacggcggcggaccggagctcggcggcgacggcggagagagaggacgacggcgcgagctcgattccgacggggagagagagcggcgagtggcggaaacggaggagggaggcacggggaacgtttaaatagtgttgggagggggagagagcggccggatgagggggaatcggccgcggaagatccggccgccattgatgcgccggcgaaggttgcgggagcgtttccaaacgaatccgagggagagagagagggaaaagtgggggaaagagggagggaatcacggggagtgatttccccctctttattgcgcgcggggacggcgggaggcggcgggattcgcggcggctgcggcgctagggcacgggcgaggctgcgggagcggcgggaggatagggatgacaggtgggccccacccgtcagcgagggtggcgggcgggcccgcccgtcagcggcgcgcgcgcggggagaggccgagtgggccgcggggaggagagagagggaaagagatgggccgagccggcccaagagggggagggggggaaaagactttttagggtttttctttttataaaatcattttaactttgtttatttcttaataattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagagaatgatttttatttcgggatgaatttatcaggacgtgacactaaaggagtacctaggctatcaaagggacaacttcaaccatgagggtcttgggtatgttcctccaccaaaagggaaggtggacaagagtgtgatgatcaagaggccgcaaggtcttagcaattttgttaaggccaaaagtatccttcctaatgattatgcttgacattgttcttttgatgcatcttatattcttaggaagaatgctagtggtcgtgttgttgctaagtatgtaggcccaaggggcaagaatatttctatcaagagagtactttgggtgcctaaggcacttgttactaacatgagaggacccaaacaagtatgggtacctaaaactagaaattgatctcttgtaggaatatgtctccggtggaagaagttgggtgattgatagtggatgcaccaatcacatgaccggagaagaatcaatgttttcatctcttgatccaaatggcacttcacaagataacatagtgttcggggacgatggaaagggaaaggttatgggattgggtaagattgcaatctctaatgatctttccattgccaacgttctcttggtaaaatctctaaactacaatcttttgtccgtttctcaattatgttctatgggttacaattgtctttttaccgatgttgatgtgaccgtctataaaaggaatgattcctcggtagtctttaagggtgttctcaagggaaagctttaccttgtggatttttcctcaagtaaagccaaacatgagacatgcttagtggctaagtccaacacggggtggctttggcatcggaggctagcccatgttggtatgaggaatcttcacaagcttctaaagcacgattacatccttggactaacaaatgttcaatttgagaaagatagggtgtgtagcgcgtgtcaagccggcaaacaaattggagcacatcatcccgtcaagaatgtgatgaccactacaaaaccattggagcttctccagatggacctcttcgggccaattgcttatctaagcattggaggtaacaaatatggtcttgttattgttgatgacttttcacgcttcacgtaggtgttctttttgcatgacaagagtgagacacaagccatcttcaagaagtttgcaagaagagcacaaaacgagttcgacctcaagatcaagaacattcgaagcgacaacggcaaggaattcaagaacacgtgcatcgagagtttccttgatgaagaaggcatcaagcatgagttctcagctccatattcacctcaacaaaatggagtagccgagaggaagaataggactgtcattgagatggcgaggaccatgttagatgagtacaagacatcggaccgtttttgggccgaagccgtcaacaccgcatgccacgccatcaaccgcctttatcttcaccgccttcttagaagactccctatgagcttcttaccggtaacaaaccaaatgtctcttactttcgtgttttcggtagtaagtgttacattgg

SEQ ID NO: 52680 - DNA, 7504 bp, Oryza sativa
tcattgggagtaggagtagtactagctgttgcattgaaaatttaagagagggaaatctgggctcgacgagctattcgagctcggctcgtcaagctcgcaagcttggagctaggcttgagttcggctcaaattgttgacgaatcgagctcgagccgagtctacagcgagccaagctcaagcagctcgcgagcctcgagcttttttgacagccctacttgctcgtgatcatttcacgtaacgtttaggttcattggttgtgctccattcaaggagctaagtgcctaagacaaaattagactacaagatcaccggtgttgtaagcttgtgtacgtgctattggtttccctattcctctctccgacacagataggatcgaaaatttggaaattgtggtaattttggtttgaattaatttaaaatgttaatcaaaatttgatcacatctaaaataaattttgctaaattctattttaatgaaagattcagaaaacaattaggataaatagttcctgtcagaaggggtgacaaaatccataacctcgggcagtgtttgtcaaatggaaaaggaaaatgatttcccacccatctttaaatcctaaccattcattctccctcttctatttaatcctaacccttcgttcatttccctatctcaaccccacccctcatttcccattatccaaacacacccttgatggtttagatcttgttggctagtgggaatcaaccatacagttcagggatacatggaaatgcaaaacagtttgaatttttaagttactagtaaagtgactgtgcgttgcaacgggaaatgttgtatatcaatttcaaattatattaagtgaaaagatattaaataatcattgagtgaaaatttgttgaacataggaaaaaaaatctggcaatcaaagaaactagaaatcataatagttatgtagattaatttcaagcaagaaatttgttttcattacagaagcataatccaagctttttgtcgcataaaacaatcttacagtgtttattaaattataaaaaggcaacataggtaaaagcctgctacgaaaatttgatgatgtcatacaaattaaagcacaaacattaaatctagaacattaggattttcagatatggtatttctcatggatgatcacctcaaattaaattattctatataggtaaataactaccctaatattgtgtatttgtgatacacttaataatatcccgtgcgccattaggtatgttgctttcacactcattttgttggtacatcagtagatttagcaaaaaaaaattgcattagcttgtcaccatcctgcacatgtattttctttgtaagttaaatatttctaattatatgatataatattcaaatgatcaatgccagtcaggacttacattaatagccggcaaatgtaattcttcatttttccatgtacacatgaagagatgaacaagaagacccgatcaatttccccctcaatttccttaattccctttttcttaggaattaaacaaacaagttcttaaggtttagatgggttgggaaagggttcatggcttctgatccattaccgcccctgctctctaggcataccgcgtgcatacactcgccgcgccggcacgccattcccttctcatcaggtcacgcatcacgctctccccccttcttccgccccttcttccctaaaacaggcaattcaagcacaccatagctggaagccaatccgatcgatccaatcgagattcggtgtgctcggctcctatcggcttagaacaaggtcaatagcatggctagttgtttgctctaagtaatgtgttattttgtagtttataccacagacaaccaatacaatagattggctattgtgttaactctatcttattaattaagaatcaattatgcatgcacatataaaatatatatgatcaaaatgaaagtacatccttgtggccatctgtgttgtcgcatacagtctgcgacacacaaaagctttccaaagctaagcttgccatgacacttgcattttgattgatctatgtgaagatcctgaggaggctgactttctcggacctggccgagggagcacactggggggtggtgctcatgtcgctcagccgctctccgcgcagcgacggcgctgctcgtgctcacagctgcggcagcgacctgcgctgcaggcagcgatgaccatcacttggcgaggcacctcacgtcgtcgtccaattcaaacaaatcagaggctaacttcgacaagatttacaccgaaaaggaaactgcaagttgttctctgggttgatagggatcgggcatgacctccatggaccgatcgagaaatctaagaattaatcgcgatggttgagcggagtggagaggagacacaaaccaggtgaccacggaaaaggaacgtgcgagcaacggctgaacatcggcatgcgcgcgcagtcatcgatccggagaagggctgcccgctgtctagatctatttgctacgcacgggatcgttcgcgatggttgtgggcccactaaggtcttgtttggttaatcatcgtgagggtggaattggagagaattcattccacacatgttgtggtaaggaattattccccctcaatcctctccaatcctcttcaatcccctccaaatcgaacaagacctgaaagtgttttctatcgttgggggattaggggcgccgttattttcttgttgagtgcggatcgcgatccagaggagtcgcgcgatggtggtgcggaggagcacgatgggatcgctctgcagcgttcgattttttatccatgcatggttaatagatcgcgtgtctatgttggatcgtgtgtgttggcttcaccatcatcaatatggattttttaagtagcagagattatccaataagtgaagaatatgttgtctctttcttaaaataaattataatcattatcataacattagtttttcccgttgcaacgcacgggcagtttttctagtaatatataatagaaaaatatttataaggcttcccttcgtccgttttgtccatcctttgagtccgagttcatcgtccaaaaaaaacaaggtagatccccaaatcaatcaatcaacgacacaacaaaatacagcacggaaaagccaatttaatctagagctcatgaatttgatccccaagaaacttaatccccgtcgtactaaatcaacatccaaaacacaaaatcctcaaaatattcacaaatcaaaccgccgccatgctggagagaaccaccgtcagctccacgtcgaggaggtgaggggtcagttggggggaggggtggagctgctgccaccacaccagggagggaagtagccgccaccgccacgccgggggggggggggggagtagtagccgccatcggctgcacgtcaggaaggtgagtgggcaactggcgagagggtcgcagccattgccaccacgtcggggagggagagcagcagtagccgccgtcgtcacttagtatttgaggagacgggagaggaggcaagagaggatggaggtggcaaaagaggaggcgcagaaaaagagaaggaaaaaagaaaaagatgtgcaggtgcagaaaaggagggttgggcgaaaaataaaggagaagtgagggcagagaaaaaaaatgttcgcacggctcgattggataatatcggctcaatctgcataaaagtgtctgtttattaaccggaaccagcacctatgagcggcatctatttgtatactaagctgacggtttttgctattgacatccccatgggcatgtgtttaggccagaaatgcactatatgtgctggttttagccattccggtatctataatgcggacatctttgcgtgtttatatagtagtgaatattgcatcacgaggcaacaaatcgacgaatcaaacaaattagcggatcaagctgaactcaccaaccaagccactgtcgtcatcgtcatcttggatccgctgtcatctccctcgagctccagtccccaccgccaccgtctccctgatttgatggcagaaacgaagaggctaaggaggagagggagagaggggagggacggccgtcgtcactgtcttcgcgccatacccccgtcgacgaggagacggaaggggtatggatggctgtcgctgccatctccgcgccgtacgcctgccgtcaccgcatcatgttgaggaaaaggcttctgcggccgtgccctcaccgtcgctgcgcccatccgatcagtcaccacgtcgagcaggaggcaggagctcgcagtctcgcaccaccgccaccgtgccacgcgtggcacacccttgttgacggttgttaagtggaaactttaaccattaactgttacataaaagatatcaaatatactatcaaaacttagtgataggagtttactaccaaccacttccatctaaactgagcctattattgatatgttcttttatatgtacgatgagtttttcttttatgatgtattaaaaattgtttccttttaaaacggaacggtaacatctcatcattagtggggcatagtaggattcgaggcaagaaaactcagatgggctgaaaatggtccaaaagaaaggagggtttttattttcagcccaatagaaaggagtgtttttatttaaataaatgttgtcaatattattaaaattcgaaattgagctttaaaaattctgagaaaatttcacatagcgtaattaatcacggagagcttaataaaattaaatccaaccatgttttatttgggaaatcttatttgctacaacttatattttatttgagacttatatattaaggttgtattttttttgtctatatttgagtgggttaggtttgagtatctggtcgacatgtcaaggtttggtttcagttattttgtatcatgggggaacggcgtggtgaccgggcttgcccgcggggcggcgaagctggctgcggtggtggcagggcgcgggagcggctcaggtggcgacaacatgcggctggaggcggtttaaggtggtggcggctcgggtgcacggtggaaggggagtttcggcggaggtttgtgcaaatggagcggtggccggtgtgcggcgaggcatggcgaagctggcggtgcaagcggcgcggcgcggcggtggctacggcgacgacagcgtgcagccggagctcgccggaaagcggcggagagcggcctcgtgcggggagcacaggagagggtgcgaggagctcggggaggagggggaaacggaagaggagagcacgagggtggtttttataggctcggggaggagaaatagtggccggacgtggcggatttgaagcggcaacggccggcgacgtgggcgacatcgtgggcgaagtgggggctcgatttggcgccaaaaatttgggaaaagtgggggatttggtggaggaggtggaggggaaccgattttatgtggtttgggcgcgagggcgcgagcgggaggaccggaatcggcggcgacgtgggcggcaacgggcggcatggcggcttcgggcggttgctggccaggatggaggatggttggggatggacctgacaagtgggtcccgcggtcccacttgtcggccagagggagagagggactagggctttatttagacttcaagggcgagcgggccgagggggagagagagaggcccgatagggggaggggcgcacgcgggccgcggaggaggggaaggattcttgggccgaaaatggcccaaggaggaaggggagtttttaatttgttttctttttatttaattgattcaatgaactttgtgctattaaaattatttcttgagctccgaaaattcacggaaaattccggagaatatattagggcacaaagaatattacaaaatattctcggctaattatttttaaaggaaattttaatttcctccataatttcacttgattaaattgatttatcttttatttaatttctagacaatgcattattaaatgatttttaattccgaccgaaaatcggggcgttacaggtacttaccttgacgtattcggcggttgatgcgcttggtggacttgcggacgtcgacattgccggcggtgagggttggagttgcagagaatcgcatttgggtcgccggaaacttcgaaggtgtcgcgggagagctcgaggaagagattggggaaagttttttcactagagcggttaaaacgggagctgacgccgtgaaacgagcaaagcagtggttactatttaaaagggagtgcggtaacggccaaaacggaatcggttaaggaaaccctagttttaatcggaaagggaagttgagcaaatccgccaagcattaaggtatattaggcttcttgtttgatatattctgtctattttaatatcttaatataaagtggtatcggagtattagttgatacatgctagatctatctggtcggttatgctataaacgtttatataatcattgctttaatgtatacttcgacttaagtggtttataccgtctcggcatggtgaccgatctatcccaatcacttagtttaaatatacatcgaaggaaggattatacatcgttaatatctatacctgatcaagtagatttagttctatcttatttatttatgattgccgatcgattccaatatgacatgactcgaggataaatgatatgtcatcagcaactagactatcggctatcgtttatggatttaaccgcggttttttttgtctttctttcttgttgattgcaggatcaaatcaactggacgctcacgaacctaaaagcaagattttggacctgcactgaagttaagcagatcttccaggccagtgtgtgtttttcgcatcaacagtgattaactcttagattacctatctaaagattagagctataacctgcacaaaaggtccaatattttatttacatatgttgaagctcactattttctggttttatagaaacttggttcactccatttggactaaagatgaattttttacaaattttacaattaaaggctattcaatgtgggttatttcttaaataaatattaagaggctttattattaaagtaagtacataatttattttaatactttggaagtatatgttttggtgattctacagaactttggtttattcaaaaaggttctaaaatgattttaatataactttttaaagtcagccctcaagaaacctaataatttgaataaaataagtttaagagccttttgccaaaaattaagaaatgattttattttcataaaccaaaaagtggtaggtggggaattttttaaatggttatttacccccaaatgaggtgagatggattttcggaaggcatttaaaattttggtggaaggcttaatggaataatttttcttagataaattttataggtgaaatttgtactgtgagtgcaagtttttattccttaacattaaagttaatgacttggtgagttcacagaaattcgaatcatctcaaaaagagttatatttgattttatatggattttacaacttt

SEQ ID NO: 52681 - DNA, 1074 bp, Oryza sativa
aaatgtcttcttcatgagaaattagaacatctgaaacacaaggtgagagtacattcatgaattcaaagtttgcattatctacagtggtctaaaagaatgcaatgaaaacacaatgcgtagatttttcaaagggcttagttctgaagttcaggttatgcttgctaatgtgaaatataatcatattggacacctattcatgtttgctcgtagcattgagagtcagatcatatcaaatgcgagaaagttgaacaatgtgatttatctcctatttctgaatctcctatatcctgatgcaatgatgatgtgcaaacattggaggagcaatcttttgtctctcctgttactaacattttgcaggtaattcatcacattcaacaaaagagggagaatggtgtacttgagaagaaagaggatgaagcacctgtggtgtctgaagaaagtttgcaaggtaaattaaatggtactgagataaataaatgtgagtattctcaagctaagctacacatgtctatttttcatgctatagtagagcagccattagtggaaccaattgctgagatgcctttgtcacaagttgatttacttgttgttccttgtgataaagaagagtcgtgtgataatgcttcacttacatgttgtttctagtgtttctttgtgtgccgattttaagcatgtcgttcacattgctaatgaaatagaggaacgagaattgacatcttctttaaataattcgggctatgttcagtttgatgatttttgtgagctcgatgatttgaaggagaaggggaggatgatgtgaccatggctaccattgatacaaccattgctcacatcatggatgaacaagatgataacaagatcaagtcctccaattattggaatccaattcagccacctgctactgtattgaattcaaatggccgccaaatgtgcatacgagctccgttttgggtccatgagtacttgatggaaagctcacgtagtcatctttccaacggatccaccctcattgccaaattccttctcagtgggctgctattgcagaaataaggtgctacgtcacctataatgggc

SEQ ID NO: 52682 - DNA, 2974 bp, Oryza sativa
ctctagaattatcacgcctagcaacatgtctaatagcaaaattatataaattggcaataatatccaagcattgatcaagatacctatttaatgatccgtacaagcatttgtaagccccggcaacttgttgcaccaccaattccgaatcaccaaatgcttctatgtgtttggctccaatcatctccatcacttgtaagccgaataataaagcatcatactcagcttgattatttgtataataatatttcaaacgaaccgatgcctcataacacatgccattaggtgaaaataaaactacacctataacttgaccctatttgcaagaagaaccatcaaaataaatcttccaaggtataacttcaactaagcaaatctcttcatcataagcaatatcgacatgatggtctactataaaatgtactacaatttggcctttcatagatttcaacggttcataagccaaatcatattcaatcaaaacatatgcccacttgccaattcacccacttagaattggcctttgcaacatatgtctaataacatcggcttgacaagcaactatgcatatactagataacaaatagtgccgcaatttggtacaagcatagtatagacataaacaaagtctctctataaagacataccacatttcagcatccaaaagacgggactcggattcagtaacatcgctatggcatggcacggtgtgacattggagaaatctggagcgttgaaatctgatcgaacggtccgctgcgccagcccacctgcagcctccgttttcaacccaagatctccgttcctgccgcccgacgccccaatcccgcggctcgcctcaatccacacgctccactcccgccgccccgcacgcgcccgcaccggacgccgggccgtcgccgcgaatagggaggcggccaccgccgcgcgagctgggagcagggctgccggcgtagaggtcccagacggcgaccagcggagagcaaggcagccgccttgtcacttcgtctcccgtgcccacgtcagcccgccaccgcgccaggccggagagacgccaggctgtcgtgccgccgcgagtggggaggggaccgggtgaccgtgtcgtcgcttcgcctccctcgcccgcgtttggccgccgccgcgaactagatgggagccggcaaggcgccgctccgccgcaagtggggaggggaccaggcggcagccgtgcgaggccagggccggggccctgccctgccaccgtcatccttggcgatggaggcagccggccgtcggggtgccgatggaggcgatgggatttcatgctgtttagctatttgttttccaaaattgttgtttaggtgtttgttctctatctccaagattgcagcagcagtagtttagctgtttgtccttctgcttcatggtgtacctgaacctgattaccttaggctgtgcattgtcctgaaacaataatttgttgaggttgcactgtgttaaccattgtggttgataaggaagttgtcattgctgctgggagaatgattctgtaatttttttgtgagcagcaacacctgggaaaattgagagattggtttggttgtatgacctatgctgtaatttgaatgaatcaatggatgaataaatcagtaacttgtgtgatgttattttctgaaaaatttgacagcatgtccccataattggtggatggattgagacaacacagaaagagataaacagccatatagaagttgataaacagccatatagaaacttggagcattcagacatcacagatagcattaagacatctctcatataacattcagcccatttctctttcaccttgtaaatgctatctaaccatgtttgcttatgaactttggatctcataatctgaaatgcctcttcaaatgatgcctcatcttcatggccaaacatacaagcactaaaatcagagagaacatgcgattcctcttcaccttcgtcttcctcttcaccttcatcttcctctttacccttcactggagataaatgcttcacagcattctgcattatgtgaaaggtgcagagaccatgatatgattctgtgaatactatctttatggcttttcctattgctgcatcttgatccgtgtaaattgttttaggttgctttccattatgtgcaggtagaaaagtctcaaacaaccatgtaaatgatgcttctgtttcatcaaatagaagtgcagcaccaaaaatagtggtttctctaaactgattgagcccaagaaaaacaccgaatggcctatattctttgtttgtgccaaaagttgtgtcaaatgtgacaacactcacttgcaatcctcctctgcagatgcttggctcactctggcagccctcctccccgaaatcttggcggcagggcaggggcctcggcccccggcctcacggcggccggcctacctccccaatcacggcgaggggcacgcctgcctcccacctatccggtggcgacggcggggcaggcgctctggccccggcctcggctggttggcgtgctgcacttccccggcgccggcaaccctgctccaagcgggattgggaccttcgcgggattggaactctgccggcagccctgctccggtgcgggattgggacctccgcaggaccgggcgcgtgcgggacggcaggactggagcgcgcgtgtgggatttgggcgagccgcgggattgggcattgggcggcaggaaacggagcgcttgggggtgaaaatggaggctgcaggtgggccggcgcagcggaccgttcgatcagatttcaacgctccagattgctccaatgtcacactgtgccatgccatagcgatgtcaccgaatccgagtcccaaaagacggatatgtaatgatatattccttaccatcttcctcttgtgtcaaaacagcaccaatgactttgtcttcggaggcaatatataaccgaaacggtattccggctttaggcgcccgcaccacgggtg

SEQ ID NO: 52683 - DNA, 2978 bp, Oryza sativa
attgtgtggccggtctgaccgatcccggacaggggctggggggcacgttacaattgattaaaaggccgaattaattgtgaattcggacatttgtgcccatgagttagaaatagcttggagaattcctttgaatagaatatttgaaagatcctagtcttaaggttgatcaaaaattcagcggcaagagttcaaatacactttgcttgatggagagttatatcgccgaaatatagatggagtgctattaaagtgattggataatgatcaatctagagttgctatgggagaagttcacgtagggatttgtggaattcatcaatcggcccataggataaattggttgcttaggagagtggggtttcattggccgaaaataattgatgattgtttcaaatgctatagagggagtgaagcttgttaacggatcggcaatgttcaattagcgcctaccgctgtgttgaatcctatcattaaactatggccgttccgaggttgggctttagatttcattggtcaagtttatccttcgtcatcaaaagggcattggttcgtgctagttgcaatgggttacttcactaagtgggccgaagctgtgccgctcgagaatattacttacacggaggtaattgactttatttttaaagcatattgttcatagattcggtattccttaaactttgatcgaagatcttcttttatgtccaaggaggtgagaagttttgccgaattttatgattttaagttgttgagttcttctctttactacgctcaggctaatggataagccgagtcgggtaataaaatattgttgaaattagtcgaaaggaaaattgaagaacactcaaagaagtgatatgaggtgctttcagaggcattatgggttcatgggatatttaaacatgatgctactaaagtcactccttttgagttggtttatagacaaaaagctgttttgtcggttgaggtaaatcttggctttcttcagtatttcaagcaagacgacttgttgattgaagattacaatacctttgatagaaggcaattttgaagacgtcatcaacaagcgtttgaagactttgaggagatgaagatacttcaagacggtgttttcagagagcaatcaatgggaaatacttgaagaaatacttcccgagcatttggcaagatgcttaggaagtcctatggccggtaattagattatcgccctgagataacatgttctatgcttttaggttcacgtatgttcaccaaaaagacgggggtatgtgtttacacccaaatttggcacctatggacgaaatagaggaaaattgccaaagtttggaaagtaccggttttccttcacagggccggtcagaccgcaggtgtatgggcgatctgactgcaggtatgtgggtggtcagaccggcagggtccgagtccgagtctgttttcgtcgggtctcgggtttccttgctcgggaaggcatgtttcgtgtttccattggtttctatcccgagttggacatagaggagggcctgtagagggcaagaccaacccctatttaacggacaatgccggttcattgtaaaacccctgaatagaatttacttgaattgttttttttactatgtttttctattttaccccagtttagtccatctttgtcggtttgcgccgtaaaccatccaccgccgctgcgagagtgcgacacctctttgtaggtttgtcctgaaaaccttccgttttgcccacgagacgggtagttatcctcatatcgatctaaatcggcctagaggctgattttgatctctaaatcggctccgctagccggtttagctgtttttcctcaaaacccatcttgatttggccgtttggctagattgaggtggttggcgactccataccaccgcaaggcatttaggtgttgcgatcgtgcttgtcgacttgtcaaaaaagttgccaacacttaccaatgtggtgaaaacaactggaagaaaaaaaaacaatgcagagcatccagctaagatcgatgtataaagcaaaatatatcattagtcccttatgttctactactccatttcagaacattagccagctttattggtaagttcaatttcagaacataaagtcgacagatagcatcgagagtatcatcacatttttacctatgagctcatcctatatacaagatgctattataaaagtcggtgcactgtgttagcttactagattccaatataacatagaacaataaaatcaacggaggaaagaaaggcaagcagtgagacacaatacttgtgcagacgaaaacagccagccacaataaaacagtccatggcatattcatattataaattatagtattatactagcaggaatcagctggaagctatgaaaataggagctgctacataaaacaggactagcttggtccccggacaaatttaggaattagctttagctcttactgaaaaggtaacagcatgaatgaatgaatgaatgagttctagggggctagactgctagggttacacacacagttcaaattacagctaaacagaggcaggaattttggcacgaagcagttcatagccagaaacacttcgatcaatttcatccgtaaaggaacaccagaaacacgaattcatcgtagtgttcgatcgtatctgcgagacgcgactagaccacacactaatctaagcttcccacgcggaggaatcgccaactacacgagctctcacacgagtaaaacaaataaaatcaaaccccccagatctagcaactccgctccggagaccagggttttgacctcacttacgtcgcgggggttgggggagattgagatttaagagtgagggagatgaagtgaagggacttgtctagtgtactgactggggtggcgggagcggagagccctgtcatggtcggtgctccattgcatggtggacgccgccgccaccggtaactttttcgccggagggcgccgcggggggggg

SEQ ID NO: 52684 - DNA, 1590 bp, Oryza sativa
aggcgacgagcaccccgtacccataggccgccgacctccgggggacgctgaggtaggggaatagggaggagagaccgccgcggcggatgagccgttggaggaggagtcgcggcggcagtggtagtcgccgtcggaaaagaagggaaaaaaagaggaaagaaaaaaatgacgcgcatggcgtcggcagcgcggcgttggcctcggcggcggcggaagacgcgcgcggcggcggaggaggaggcagatgcgcgggaggcagacgcgcgtggcggctgagtcgacctcggcggcccggcggcggcggggaggcaaacgcgagcggtggcggagtcgaacgcgcgggagtcgacctcggctgtgtcggagtcggcctcggcggcgagccggcgacggattcggcctcaacggcgacggcagagtcctcggcggcggcggcggcgaaggggagtagacacgggcggcggcggagtcggccgcggcgtcgtcggagacttcggcggcggcggcggaggcctcgggcggcggcggggaggcagatcgcacggcggcggaggagtcctcggcggcggcggtggaggggaggtagacgcgggcggcggagtcggccgcggcgtcgtcggagacatcggcggcggcggcggaggcctcgggcggcggcggggaggcagatcgcacggcggcggaggagtcctcggcggcggcggtggaggggaggtagacgcgggcggcggcggagtcggcggcggcggcggtatcggcctcgggcatcggcggagtcggcctcgatggtgaggaggagcgacgacggagtcggctgtggcgtcgtcggagtcctcggcggtggcggcgtcggcctcgggcgaggaggagcggcagcgacggcgaagtgaggaggagggagaaggatgggagagaaaagaagcgaaccgttttttttaatggtataggtgggtaattttttttccccaaaagcaggtgaaagcaggggtagaggtgcttttgagttgtactacaccaaaagctggcttttggcaaaagtagctgtggcttttgagccctttggttggcttttagcttttgcaaaagcaaaagcaggttgaaaagctcaaccaaacacacccttaacagtatttaccaaattgtatggataaaacgaacatttcaccttaaattttatttttggcatgaccgccaagattggcgcctaaaaatttggttccagccacaccaaaattttggcgcctctccagcattaacttttttttcaaaaaaaaatacaaataatatcttgtactttttaattttaatttatgagaactttaaatttaattttagactgatttttatgtttcaaatgcaaaaatcataaacaacaaaattgtagaactcatcgagatctacaactattgtattggtcctttttacaaataagttcatttgaacaattcaaattttaaattttcaaaatttaacaacttcaaacaaaaattgggtttaataaataattttaaatggaaaagtcaccaaaaccaaagttgtagaacttatcgagatgcaaaatttttattttggtcatttctccatctgact

SEQ ID NO: 52685 - DNA, 1307 bp, Oryza sativa
tggagcgacggcgacgacggcggcacaagatctcacggcgctagggcgcttccgacggcgagagacgaaggcgagggtggcgacgggtagaggagacacaggggatccttttataggggcaaggaggcggcggcgaaggcccacggctgccggcgacgagaaggaaaggtcggggtttggaggaaagagaccgatccgaatcgacctcgaatccacgaatttccaaacgattttagccggtgattccaaaagagaaaaggtggaggagatcgagaagatcatttcccctctatcaatttcaccggagaaggaaaggatcgagcggattggaaagcggcagcagcgcgactcggctagggttccgggcagcggcggcggcgcgaggaagacgaacctgacaggtgggacccacctgtcagcgacagagagagagaggagagcggcagctcggcggactgggccgacttgggccgagggagagagagaagagaggttttgggccgactttcggcccaaagccaaaagaagacttttaaaaacctttttcaatttacattattcatgaaatgcaattccatttattaaaaatacttccttggctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaaaaatttataatttaaggatttttaaacaagaaaagcacttaacaattataattaatgataaaataattattgaactgttctttgtatcatttaggaattgaggtctgaaaaatccgagaaaattttagagagttgacttaatcatggagaatttaataaaaattaaatccatccatgctttatatttaggaaattttatttcccacatttaacttcacttgtaaattaaagaacatttaatataaattctattaataatttataaataatttataaatcctgaaacaaaaatcaggatgtgataacgcttcacccgttttttcttctggaccacatttgttgcaaacaaacattactttgtcacgttctccatctttggctgacttccttgaagtgttgattttgattgaaaatccaacgcactttgcatacctgttatagtgagcccttgcttcctcctctgagttgaaagtcaaggtgaggtatggcacttgtgtgctgcacaaaaaatcctgtgatggcgctgactgtgcttctgaatcatctgtgcc

SEQ ID NO: 52686 - DNA, 718 bp, Oryza sativa
gtaatttcggacatttgtgcccaggatacagaagaggattggagaattcctttgattaaatatttgaaagaccctccacttaaggttgatcggaagatttggcggcaaatgtttaaatatacattgcttgatgaggatttatatcgccgaaatatagatggggggcagttgaagtgcttagataatgatcaatctaaagtggctatgggagaggtgcatgaaggaatttatggtactcatcaatcggcccataagatgaattggttgcttagaagagcggggttctattggccgaggatgattgaagattgtttcaaatattataggggatgtgaggcttgtcaacggttcggcaatgttcaattggtgcctgccgccgtgtgaatcctactatcaaaccatggccgttccgaggttgggctatggatttcattggtcaaatttatccttcgtcatcaaaggggcataggttcgttgtagttgcaacggattacttcaccaagtgggcccaagccgtgccgctcaagaatatgattcatacggaggtaattgtctttattttgaagcttattatccatagattcggtatcccgcaaacattgactacgaatcaaggagcttcttttatgtctaaggaagtgaagagttttgccgaattttatggtataacattgttgagttcttctccttactacgctcaggctaatggacaagccga

SEQ ID NO: 52687 - DNA, 35908 bp, Oryza sativa
  unsure (1)..(35908): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattcctcactcccaagagacagaatggccttaccagccatactggactcctgacaaccaggatcatcatggatagtagcaacaaggctggtaaatagtgaagatcaataccaaaagaaaactaaccacattctctttcaccttgtgtggtctctgtcttcttgaatatacaacattgctttcttgaagaatgtatgtactacggttgggagaagaaatagattaaagagatctgtatagatctgcctccatgaaaaaagggagatcaaattaactgtgcaaggacactccaagatagaagagacaaagttgttgaaagaaaagaaaagagaggacaaaaaaagtttgggcaaaggtattgttgtgcttaattacatcagaatgaaggctagacatgctagatgcagtcaatattaatgcaccccaatcgaagcataattataattacattttggtttatcacagcttttgatatgcattagatatttttcaactgtaaaaagtagtattgtttgcatgtactgtgatgtacattacaccccctggccggtcccttctctctctagatgggtgtgtgcgtgtgtgtttttcaccttgcttaccttgtgcttcaaatgcatccagggggactaaattcccaacttaataagttctttttcctttctagaggcgcaaaaattgtttagcgtttgggtactgatgctacttactttgtaacgagagttgaattcatctgccatgcatgttggtttcaaggaataaactggcgttgacatgcatgatttttgtggtctatatatatcacatatatatcagattactcgatgatctaactagttagtttactgctgtacctgtacatatggatttaagaatcagagtggtgttggctatatattaagagttatgcttgcatactgatactgatgtacatatacgtaagcacagaaaattcctttgttcatgtaaaaaaatatcagctctcaatatagacatgtgttgtatttatacaattaatgtgcagtagtgcacctgtacctattggcatttcaagtttcatttacatattacggtgtatatatatagctactaaattaaatacaaattaattaacagctatttaattattgcatatcaatttaatgttatgcatatagtgtgctattttttgacaagtttgattacagttttaggctagactattttcaggaggtacatacgttttttttttaccaggggaacaattaatgagcattattagtattgttggatatatactattacattttagaaatacaaatattagtatattctaatttatcactattgcatatatagggagatctctgtgcatcgtcatactattccacagaatatattttttttgtgtgttggggggcactaacaaatatcacagtataattaacacaccctgctatttatactttaataccgtgcatgcatgttattgtcaatttatttacattaagttgcatgccctacatagaacataaggctttgtttaatttaacaaaaatgactcctttcaaaaaaaatttaacaaaaatgatgatttttggagtacttgaggattaaactgaacgaatccgaccccagcatgtacgttgcacacacatatatatggaatgaaaccaaaattgcattgttttttactgctccttccgtttcataatgtaagttattctagcatttcctatatttatattgatgttaatgaatctagacatcaatatgtatgtgagaaatgctaaaataacttacattgtgaaatggaggaagtagctagcatcactagatgtactgttttttttttcgggtaatgcacatatcactggtggtgtactcctacctattgttccaaattaaagagctagcgcttgtagttttcaggcaaaagtgcaacatatgaatatatgtcgatggaagaagaaaggtgcaggcatatgtgctagctgcttgtttaaggttgtcgctcgcatattctactgtgtacatttgtgtgtgattttgtgcacgtattaattctcattcgatcgtacacgcgacgtatatatatgccaattaattaatgcacgcatgttagagatcgacaaaaacatgtggttaatgtacgcatttgcatatatagtagtactatatgtttgcatatgtacagtacaccatttagaacaaaattaatctgcgaggacgtatgtgggtagctctaattaagtcggaacacctaacataagtgctagtattagcgcgcatgcatgcaacgccaccttttgtacgtagcatggtttcatcaattagtttcgtttccacattatgtgggaactatgaaacttttgggtaattagctattacccatttaattaattaattaggctgaagcatgcatgatatatataattttcttttcataatcctccaaaatgaacagcaagttattttcctacatacctttttttatgaattagttttgataattacaaacgggcctcaagaccaatacagcaaagtgctcttttttaactacttaattattgtattttgcgtttctattaaccataaacctcgcatcatgatagatcatcctatatatcgtacgtgctggctaatactgcattcaagtttactacgcatactccatatatatgcatatttaattttctttctcaattcgatcacatgagagatgcacccaccacgtcactgcttgatggggaggaagcagcaacgtgcatgccagtaattgcctgtggaccatgcatgggcggctctcgtatactcccgcgttttaaaatgtttgacaccgttgacttttaatacgtgtttgaccattcatcttattcaaaaaaaaattaagtaattatctattcttttcatattatttgattcattgttaaatatgcttttatgtatatatatagttttacatatttcataaattttttttgaataagacgaatggtcaaacatgtgttaaaaagtcaacggtgtcaaatattttgaaacggagggagtatatatcttggctgccggaatagatatcttaattactcgcagcaattttaattaactaattgagttaaatcaacactgtaactgaatctctacttaattagacgtacgatctaaatttactatctccatcccaaattaaaatacatggcacaactaccattgacacaaatatcaagaattattatcacctctggatcactctaataaaatataatacatacacccaaaaatattagattagagatttttaaggtgtatgatttaaaaatgaattaaaaggaagaggaatgtgctagttaactacatatatgcatgcgtgttttgtattaatattaaaaacaaatggttacgtgtcttactcttgtaccctctccgtcaaaaaatccaatcatacgtgtacccaggttcgtagctagagtttgctcttttttttttttgacagagtagtataaattaagatcgagtacctaggaagcttctatcttctgatcattaatgcagggggcatattgatcgatataggagggtttcacgtacgctaggtataaaatgtgcgtgtgcagtagtacatgccacatgtgatagtcccaaaatataagggattttgggtgaatgtcaaatcccttatatttttggatgaagagagtgtatacttagctatagctagtagaatatgtgtatatacaccaagctagattaccgttttatctagctaattgggatgagattcgtgtgcgctaatatatcctaatataacattgatgtttgatgaaacacagtacaataccttttttttgacatgaaatatattcaaatgacttatgatatgaaacggagggagtactacctatacattatatattagacatttatatgttagcacctcagaatcggagataaccctatactacaattagataatggaggtattccgatccctaaaaaaaattaaatgattggaggatcgatagagattattccggacctcagattgtacgtcaactcgatcctaggacctaccatgcatcgatatcagggtacgcgcttggaatatgatctcttcttttttactagctactatgcatacctttctttctgtaccatcatcgaattttatctggaagatgcttcttaaatatcactcggtctgatcatatatatacacacgaactgatcatggagttcgtctttctagggcataatgctacttctataattgctgctgagaatctcagtgctaaggagagaacatatgcatcgcctttcctcataaaaaacttgatgatgaacgagttaggtaaaggaaaggttcctccttgtttgttttgcagttaatgtcccctattatttgttctcgcatttgtcttttagcgaatcataataaactatctctatctttataattctacctttcagagcagctaaccaaagaagtaacttgcccatttgtgcgtctgtgtttgtaacctagctaaattatgaacattattcgtttcatctctaaattaagactgaaatatatagttcttgtacaatctgttttgggcaatttaacactagttaatatttactgctagatctctcagccgatatgatagtatgatatgatccaagctactgatcatgtgttttgttgcctatgatatgctcagagcctcagagattaataaaaaataatggttaggttcagacagtttcaggttcatggaacatcatagaacaaaccagatgctcacatgtccctttccacaggagatagaaaggataaaagaaagagtgaaaaagagagagttcggccatgtctcatgtctgtcttcttcactctcatctatttcttttatggccatgcaacaaaacaaaacaactattttgttaacaaagaaattgaaaagagatcgatctggggatatattctctctcacgcgcacaagcatatatacaataagaattaatacaccttaattatattacttggagacgatactatagaaaagaaaaagaaactaaaagtgcacatgtgtgtaggtgagttaacctcttgttaagctctcccatgtgtcgttgattcggtcccaaaaagaagttgcaaggcgaattgtactgttagatagtgggattgagaataacacaacatggcctagctaagctagcctatctttcctttccggattattctctcccaaatgtgatattgatctagctttagtttcttcttttcttttaagcaattgttccctaatcatatttaattatctcaaaggagtatgcctatctattcctgcctccaatgcgacgctgtttccttacccacatttgtggttttagtgctgtgtaagtaattaaacctagctagtaatggaagtaagtaaaacaactttattttcttgaaaggtacccatgtgtgcgatatttgtggggaattcggattttagaaccatgatgaataatcatatgcacccaacttctcaactgtacctcgatctgtcggtctatttaggagagttttagattcagataagcagcttgagagaatagaaaaaccatgtgaaaaaaaaacacacaactgaaaaaaaaaacatttttgcaggcgtctgcttcttattattttcctgaattttaaaactatataacttctccaaacctaaataaaaaaactaaactatttgagtagcttttgattgtcggaagcctctcctaaaatagccatgtgtttcccgccttcccaagtaagtaaaacaactttgggctatagtagtggatgggaacagaagagtggactaattttgtaataatattttgtgggaaataaaatatatgctggtgcgggtatatcttagattctgttggctttgcaattgtcgcctgttgtttgcagatgcgcgctccgcttagaaaatagcagcagaattcctcccaagaatatgacaaatccgatcatccgatgcgtcatggaactcgtggcgtcatcacatcagcaaatccaagtacggtgaactactacgcttcaatcaatttcccttttcttccaatgggcctcacaacgcaccgcggcccaatagctcttagcccattgccatccgccatctcggcccggaaccgcatgggccggcccacgccacgccgtccccatcacatcacaccggcccgcttctctctcgcgcgcgcgggtgaagcgtcgcgcggcgcgccgtggcgtggcgtggcgacaggtgaagcggccggcgaggcgaggcgaggcgaggcgaggcggcgtcatctgcgccgcgtccacacacatgtacgtcgcgctacgcgcccgcggcgccttatcttgacaccagaatccacatgattcctgagccccagctataggctatagctagctgctgttgctgcttggtcccggataacgtgacaaatgcgacatggttcatgcttgctcgattgattgattgcaatagacaaaaactcttcttgtctcttcacctcgccaccggggccgccatacaattacctccataaatcttggatagaatgttaggagtaactaactctgcactgtgccattgctgtgtgtcagtgtgtgtatatatatccagctgccagctgcagagtgaagcataaacatcagtagacgacggcgatggcgcccaagcgacttgtctgcttcttggccgtggccgccgcgctagccaccacctgccacgggtggggcgccggcgccggcgatgtcgtgtcgtcgtcggcggcggcgctctcgttcgtggacaggctgaggcagatgatgatcccggcggccgtgggcgacggcgactactgcgacagctggcgcgtcggcgtggaggcgaacaacgtgcgggggtggacggcggcgccgcgcaagtgcgacaactacgtcgagaactacatgcgcggccaccactaccgccgcgacagcaaggtcgtcgtcgacgaggccgccgcctacgccgaggccgccgtcctctccggcgaccccgccgccgacgccaacgccacctgggtgttcgacgtcgacgagaccgccctctcccacgtcaagttctacaagaagcacggcttcgggtaccacagaaccgacgagccggcgttcatggagtggctgatcgccggcagagcgtcggcgttgccgaacacggtgacgctgtacaagaagctgctcctcctcggcgtcaagatcgtcttcctgtcggacaggccggacacgccggagctgaggaacgccaccgccaccaatctcatcaaggaaggcttcgactgctgggacgagctcatattaaggtcacgttacaaactaattaatctctgaattcctgcgtgtactccctccgtcctaaaatataaatatttttagcatagtgacaaatcaaatattttaaactttaaccattaatagtaaaaaaagatcaatcatgtaaaattgatgttactagatttatcattaaacaaactatcatgatatgtaactctttttatttaaaacatcttacttatatagatattgttggttaaagtagcatctcgcagaccgtgtataagagtctaaaaatgcttacattttgagacggtgcgagtataaaattgatgaaatgaacgaacaggtcggagaactcgacggcgacgggatcggtggtggagtacaagtcgggggagaggaagaagctggaggaggagaaggggatggtgatcatcggcaacatcggcgaccagtggagcgacctgctgggctcgccggagggccgccggaccttcaagctgcccaaccctgcctactacatcgacaactacaagcgcgccggcgccgccgtccgcgccgccgtagccattacagcctcctcctcgtcgtcgtcgtcgtgaagcaaacgatgcctagctagctatagtactcaactttgaattgcatttttttttcagacacataagttcagttaataatcggtcgtgtacgtacctgccgtgctgtgcactgttgtatctttttggtgagacgattgaaatatctttgggtttatcttttataattggttttaccgtgaattaattaggcttgctgctaatgacaaatttctgaggagatatttctctctgctggtctatatcctgcctccggtgtcgcacgcgtgtgcatcggctgttggcgtaggcgattgcagatgcacaaccttatcctgatgaatacgctacgtgggggcatccgatcttggatgggctcttgtttggccggcatatcaacatctactacctccgtttcttaataataaaagccgataactttttatcaatatttaatgatttatcttattcaataatatttatgtaaatataaaaatatttatatcacgtttaaagaacatttaatgataaatcaaatctaatctacttacggttggttgatttgttgccatacgtcgaaccattttgtttctatagcaggtttttacatctcaaattaattaattttattagtctaaaatagttgacttttattgtgttaactatttttcactattactatttgtgatgctatggcttgaatattgaacttttgcaatatactctctgtttgaaaagctcgtttacctttttctttttcttaccatgtgcgaaacaataaatgatattagtgtataattaattagttattaagtacgacaaacttgaaaaacatgtttatttgatttttttaaaataaacttttatatacaattatttttaaaatatatcgtttaacagtttgaaaagtgtgcttacggtaaacaagggagttgcaaaagcaaaaaagaaaaacgaacacaccctaagattgtgttctcacttctctcgtttttcgcgtgtatggttttcaaactgctaaacggtgtgtttttttttaaaaaaaattttatatgaaagttgttttaaaaaaaatcatattaatcattttcttttaaaaaatagttaatacttaattaatcatgcaataatatgtatttcgttttgcttgccgggggggaggggtttccgaacacagcctaagttatggttggaagcttcagccttcaagctttataataatagctttctacgtatgtaagttccctacaatacttcttttaaatttataacagctaatccatttggttgtacctcaaatattatcacatcccaaatcatcagataatccgttgcagttcagccattcatccattaaagcttggaaataagtgtgatgcaatgtctccaacaggtgcaagtgcacaaaataaaaggaggagaaatagggtggctcatgatcttgctcgaatggcaatgagtgctaggtctagtgctgactggagactgtatgctccccgcccaaatcctagactcgttaaaccaagaatgtaggagtaatcatttattcagccaatgtaaaaaaaaaaggtattgggcctactataaccccccaccccaccaaaaaaaaatctattaaaagacagcatgatgatgcaaggatcaacacccgggcaacaggctgattttccattacgggccttcaaggcccataatactactgatttacgtgcgatcaatcaaacatacggtgagcagagacgacgcttgccaagatttgggcaaggcaagtcaggggcaagaatcgaatcgaatcgaatcaaatctctgggagcacaggacgagcggagcagagcaattttctctctcgctctctgcttcactctcatgagatgagagatattcagatgcgtaactctaaccctgccattaccagtagagacgtttgcgattgctttgcttgttccagtcctggaagagaagagaattttgatctagcagcaaaaccaggctctattttttttccctgtcatgtgttttccgttgctaatttttagtcagcattcgatgttatcagtcagtcattctgtgccaaaaggaggactgacatcgttgttggtgaatggtgaatcagtggtaaactaaacacaactgattagaagtttagaacaatgtgatgaagggaaattatattgctgaacacaaaaggcttcctgtgtgtccagcgattgcgttttatacttggtatatttggcaagttgttattatcgcaaaaatttctagaaaaatgagagaaattttggttcctgattcttgcaaccttgcaaggactgtttcatgtgaatggccctccaaacacacctctgtatagacttcatcttctgaaattcgaatgaccatgtagcccagtatcttatgagcattttattcgaattttccagttacatgggaataaacttctttagcttctatctcacagaaaggtagactatgttggcttccttcttatatctacccatagggcgcacaaatatgtgaaagctatgagagcaactttaccgagttcgccgattcaaatttcaacttttgacctacaaaatatacttcccttccagcaaatcagctgaaagcaattacatcatttttcgaagctaagggtctagaatagtgctgcaagattcccctttctttcagaaatcactaggaacgccacaatatggaccataaatatcactagcacattgataaagtttcctagaattgaatcacactaaggtttttccgaccgttttcatccctgctactatctccgttctctcatcaaaccgttttatctcggaaagcagattgaccagacctttaattgttcagacactatctcaaccgcagaagtattttatgtttaacaaacttacaaattttacccgaaaattgatttgctacaagctattgctggtctctgtagagacatgctaatttcatgtatcgcatttttgttacattttctcagggaactggaggggttactgtcaagaagaccttatctatccatcatcattggaatctatgaggaaccgatgactcctggccagtgcaacatggttgtggagaggcttggcgattaccttgttgaacagggtttctgaactcagaatctgcagtaagagggcaactgggtatatgtatacaagaatctgtcattaatcccataaataatcagcacaaaatttgggtatctgtttaaaagtcagttcgtcattatgttggaattgttgagtacatgacatgtgtcataaatcatgcatgtaattgtttaaccatggtggctgtgatgtttttgaagattatccagtttctcttcaatgtgattatccaatttctgcttaaaagcaaggaaattctctccattgctactttgcgctgcaccgtattgtttgttatctgctactgcctccgttttttaatagatgacgtcgttgactttttctcacatgtttgaccatttgtcttattcaaaatatttacgtaataataatttattttgttacgagttgttttatcactcatagtactttaagtgtgacggagctcgtggctcctcaccgggagaccgcgcaggcccccctttgccggttcggccgggggcttagggtgagatctcaagctctcgctgtgtgtggaaagattactcgcccgcaagacacacgagacacagcgatgtatacaggttcgggccgctccgaagcgtaataccctactcctgtgtttttgtggatttgtgtatgaatgagctacaaagtgtgtccacttctcctccgctctaggctctaaatctggcaagaatccacccacctctctatgggcaaggtcctccttttatacttcaaggggataccacatgcacccttccctttccaaactggactttttcttctttacgtaaatggacggagatttgcacggttgccctccaaacgtccttctgatgggacggcacatacctacctccacttctgccgggggcaggcgcgtcgcgggaacgtggctgtgagctgacgacctgagcagtgtcagaccggtcacaaatcggtcattcttgtccaccgcgtgtcagcttagcaacgtgcatgtttgcccttcttcacacaacatcttgcctgtaatggttaggatgaagcctggtataaatctgaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgaccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttccgaagggaagcggtcaggtgtgacgccacccctaaagcctggtgacaggtgggaccggtctccgtagttgggcaaaacacccaacggtctcaatccatgcacattggtattggtgactttggttgtccataatgggcggtctactcaagactgccacatcacttgagcagcgcgcgaatctgggtgagcagatttgtctcgctcggagatacggtaacgccgcttcggtcggcgagcgtacttaatgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggaccagcgatggcaagggtataaaagcatcgaggaaaggatttgctcccttcctttcgccattgttcctcttgccttcgccgcctgagctctaactctttctctgctacgccctactttcgccacacgcgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcatctcacccccaatgcggtgatgacattggccatcttcgcacacctgtgcgagatgttcattggggtgcgcccctctcttcagttgttccggtggttcttcaccgtgcagtcggtgtcgccgccgtcggtagttggcggctgctacttccagccgcgggggccggtgctgaaccgctacatcccctgcgtcctccgcaagaagtgggacgactggaagagcgactggttctacacccccctcgccaacgaagcgcgcctccgtcttccaagccagcccccggcgcaggtctccagctggcgggcgccggtagatctgggggaggagtacgacgccgtcctcgaccgcctggcgggcctgcgatcccaagggctcaccggggccatggtgtacggcgattacctccatcgccggattgcgccgctccaacggcgcgcccggagcgcctgggagtatactgggcctgaagactatatgcggacccaccagggagccagatgggattgggctcctgaggacttcaagatcgtagtccaaagggtgctgaatcttagctccgcggaggcgtctcgccttcctcaggagatcctccccctctgcagcgatcccgaccgcgtctccattctaaccattatgatgggggtcggggcctcagaggagagagcccctaagggccacgacggcgcgggcgtgcgccgccggggggaacaacctgccccaggagggggtcgtgcttctgggccccgcgtcgggggctcggggagcagccgccctgccgacgcccaggggaagaggaagctgggaggtacacctcccccatctcctccccgagggggcggggcggcgcgtgccagcagtcggcgcccggagggggccgcgccgacgtcgcagcccgagggggtgcgcaagaagaagcggctccgtaagacgggggagacggaaccatgccggggaaacctgatttcccctccaaagtggtcattcaaccgaccccctcgcaggttcgtctcactctcattgcaaccattttcctcccaaaaaagaagttttttcttactcattttgttcgtctttcggttttttcttctgcttcagcgatgtcccgtcgcattcctcccgccaccccaaatccggccagtccgaggccgaagatccggcggccgcagaggagcggaggcgagagtctgaccggcgtgaagccgcagcccgccttcgggaagctgaagatgccgcccgggaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcacttgggcccactccctcgggcggtcctcaggtgacatcctccgaggcggctcgcgacgaggccgcgggcgcatcgcctgggcctacctcaccgggcgacgcccaggatcaaacgggcccgggggacatccccgagcccagcgcatcctccggggggccaagccgcgtcgccttttctccaaggcgacttttctcctcgtcttccgttgccccggtgagcgccgagcccattatgcaggccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggcccaccgccgccacatctcggagctcgaagcccgcaaggcggcgctggcggagatcgcccgagaggtggaggaggagcgagaggccgccctcgtcgccaccaccgcgatgatcgaggcgcaggactccctccgccttcaacacgggagctgggaggcggagctgaagaacaagctcgacgccgcccagggggtcctcgacgccgccgccgcccgagagcagcgagcaacagaggctgaagcggcgttgcggcggcgcgaagaggcccttgaggcccgtgccatggcgctggaagaacacgccggcgccgtggagaggggcttgacaggccgcgaggccgccgctggtctccgagaggcgacgctggtggcgcatgaggccgcctgcgccgaggaggagtccgcgctccgccttcgcgaggatgcactcgctgagcgggagcgagctctcgaggaggccgaggccacgacgcaacggctggcgaacagcctctccctccgcgaggcggcgcaagaggagcaggcgcgccgcaaccttgaatgtgtccgtgccgagagagccgcgctggagcagcgggctgccaacctcgaggcacgggagaaagagctggccgcgagggcgcctatcggcggggcggccgcaggcgaaagcgacctggccgcccgcctcgcggctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcggcaagcgggcctctggggaggccagtcgtcggtgccccccaccaatctggaaggcctcgctccgcacctcaacaggatggcttgggttctcgagcaactccccgaggagcttgagaagaccatcaagtcatcctcaagggacctcgcgcggggagcggtcgaactcgtgctggcgagttaccaggcccgggaccccaacttctctccatggatggcgctggaggagttccctcccgggaccgaggacgacgcgcgcgcgcgcgtccgggatgccgccgaccacatcgtcaacggcttcgagggctcagcccctcggctcgcgttcgcccccagctccgacgaggagggcgatgccagcggtgaggacgacgatggcgacgaggccggcgacccgggcgcgtcagaatgagcccccgagcccccgtcaatctttacttttttctttttctttcttctaaggccttcatgcctcttttgtatagatcaaattactctgcaatcaaaaatgatgaaacaatttctatgttaactttattttgctatatatataagttgaggatgatctgtgccatggtccttttgcgccttagcttgaaataagggctcgcgcccaagtcccggtcctcgaatggctcgggtcggggctagtgcctggggagatccacatgtcgagactggccaggccgggaacgtggtgaccgaggggtatgggtaacccgatcgtgggcttttgccgattcccccccggagttcaccacaccccggggcacggctcggttctgggccccgtttggcgatttttgctgaccgaaccgaacccccgagggcaaggttgagcacgagtgaccttatttcaagttaagattctttagaaggaaaaacggcacagacacaacctttaggaaattgaaactgcttttattgaaaagctgaaataagaaaaggaatatatgtgcatgtgtggtagcccccggccaaccctgcacacccgaggggggtgcggggttggcccgagatagaaacctgacacccgaccccccctttcaggggtagaagcggcgaaggtgttcgatgttccacgggtttggcagctccgtgccgtcgcccgtggccagccgtaccgagcccggccgggggacaccgatcactcgatacggtccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcacagtagtcgccgaagagttcactagtgaattgggtgccattatccgtaataatacgattaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacaatggtatgatctgcagggcctgggccggctgatggatttgcttggcgtggaactgacacgctctgcatcgccggaccagatcgactgcgtcattaagagctgtcggccaataaaatccttgacgaaaggccttgccaaccaaggtacgcgaggcggaatgggctccgcactcgccctcatggatgtcaacaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggttaggcgcatccgtctcccctaagggatcgggtcgcgccgatggctgggtaagcctttcttcaaaggcgcccggtggggtctgggctcgcgaggacgcgagccgtgagagttcgtcggctatcatgttatcccgtctgggcacatgccgaagctctattccatcgaaatggcgctccatacgccgcacttggcgtatgtaggcgtccatctgtgggtcagagcaccggtactccttacagacctggttaacgactagctgggagtcgcctaataccaagaggcggcggatccccagtccagctgccactctgagtccggcaaggagtccctcgtactctgccatattattagtcgctcgaaagtcgagacggaccaagtatctgaggatgtctccgttcggagaggtcaacgtgacccctgcaccggcgccctggagagacagagaaccgtcgaactgcatcacccagtgggcggtttgaggcagctgtgaggggttcgtgctggcctcgggcattgagacagtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacggtgacccgatgcgcctggaaataatggcgcagtttcctcgaggccatcagaatagcgtaaagcatcttctgggcctgtgggtatcgggtcttggcgtcccggagggcctcactaacaaagtagacaggcctctgcacctttcggcggggccgatcctcttcgctaggggccgtatccccggggtgctcttcgtccaagtggcctcttggggcacactcgtctcctgcgctgatgacctcggggtccgaagatgacaggtgcggccttcccacagtggcctcggggccgtcccgggggtcgggggctcctggcgttgtcagacaagcgggcaaagggccagctccggtcgtcaggggcctcaggcctccgttcggctcgggggcctcttctccctgctctctcccgggtcgaatctgcacagggttagcctcggggtcaaagggtggtagatgcggccttcccgcagtggcctcggggccttcctgagggtcgggggcacccggcaccgtctgacgagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgccgctaagtaaagtagcaggggctcatttggctctggggcgactagaaccgggggagagctgagatacacctttaactgagtaagggcatgttcagcttcctccgtccaagtaaacggccccgagcgcttgaggagcttaaataagggtagcgccttctctcccagcctcgatataaaacgacttagggcagccatgcaaccagtgacgcactgcacatccctaagtttgctgggggggcgcatccgttctatagctcgtatcttctcggggttggcctcaatgcctcgggcagagaccaaaaacccgagaagcttgcccgcgggtacaccaaacacgcacttatcggggttcagttttatgcgggcggagcggaggttttcaaaagtttccgctagatctgaaagtaaagtttcttggttgcgcgtttttacaaccaagtcatcgacatacgcctcaacattacgtcctatttggctacccaaagaaattcgagtagtacgctgaaaagtgggacctgcattctttaacccgaagggcattgatgtataacaataggttcctacgggggtaatgaacgcagtttttttcctcatcctccctagccatgcgaatctgatggtaaccagaatatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggacgaatccggcctccagaagtctcgccacctcctcgcggatgaaggctttacgttccggggcctgccgccgcactttctgccggaccggccttgcgcccggccgcacagcgagacggtgctcaatcacctccctggggaccccgggcatgtccgctggtctccatgcgaagacatcagcgtttgcccgcaggaaggagacgagcgcgtcttcctatttgccatccagaagaccaccgatccgtgtggtcatggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtcggcgcgctgctccatgcaagcgagcgcgactttaaggtcgccatggacagagatggggccaccggggcccggcatcttcatctggaggtaggcgtagtggacagccgccatgaacttcaccaacgcgggccttcctaggaccgcgttgtagggcagactgaggtccgccacatcgaagctcacccgctccgtgcggaagttggcgggtccaccgaaggtgaccggtaggtcgatgtgacccaatggccacgtgtgccccggcgtcacaccgatgatcggctgggacggtcggagcaccatccccggggccttgatagcatcaaaggccgcgggggaaaggatgttgagagccgctcctccatctatgaggacacgtcccaacttcacgttgcagatggtgggggaaactaccatcgcaacctgccctccccgggcaatgcacggtgggtggtcggtctggtcgaaagtgagagcaacctctgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcgtcaccatcatcgatgtcaacagcgggggccatctgcttggcctcacttcgccgtttgccggaaggaaccgccggggacttgccctcacggcgttcctgtctcctgtcctcctcccacttcctcgttcgctcagccaggtttttgactgcacgacagtccgcgagatcgtggagggaggtgttgtgcacggagcaccacctgccggcggggcgctccctgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcagatccgggggcggccgaagctgccactccggaaccggaggagttccatgtccacgcttcctctttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacagatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccgacaccaccagccgggggcacggagggctgatcctcacgtccatgtcgaggtgacactctggacgaggaggcgccctccgttgcacggggagtacgccggctgttacgccggcgctcgctgttgaggcgggcatccggcttctcatgctgatcctcccgagtcgacggtgtcgacgagggagtggcagccgaatgacgtgcagccgccgccgctcgccgcgccctccgccttgatgacacggaaccggtggtggcggcgccggaggtcttggtggtggtggaccgtccaccagcacccaggcgctgctgagccgtcatgaccaagttggccacatcttccagccatcgttgggctggagactccgggtcatggacgacaggcgggtgtcgtaagagcgcgccagcagcctgaagcgcaccctgaggcgtgctgccgtcgccgtatacgaggaggcggcgctccccatcttgccgtcctcctgcaccacccgcgactggtgatgccatggacttgtcgaccttctcaagcgcctccccctgcttagggctttggcgcggaggaggtgggggagtacgagctcgacggcgtggattcggctccccgtcgtcgccgctcacactcggagagaggtcgtgcgcctttgcttgctcggccattaggctgaacaagggaaacttggcgcccacggaagagtctgagagctcagaaaacacacgctgagccccctacctggcgcgccagatgacggagctcgtggctcctcaccgggagaccgcgcaggcccccctttgccggttcggccgggggcttagggtgagatctcaagctctcgctgtgtgtggaaagattactcgcccgcaagacacacgagacacagcgatgtatacaggttcgggccgctccgaagcgtaataccctactcctgtgtttttgtggatttgtgtatgaatgagctacaaagtgtgtccacttctcctccgctctaggctctaaatctggcaagaatccacccacctctctatgggcaaggtcctccttttatacttcaaggggataccacatgcacccttccctttccaaactggactttttcttctttacgtaaatggacggagatttgcacggttgccctccaaacgtccttctgatgggacggcacatacctacctccacttctgccgggggcaggcgcgtcgcgggaacgtggctgtgagctgacgacctgagcagtgtcagaccggtcacaaatcggtcattcttgtccaccgcgtgtcagcttagcaacgtgcatgtttgcccttcttcacacaacatcttgcctgtaatggttaggatgaagcctggtataaatctgaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaaagtgtgatttatatcttatacatttgcataaaatttttgaataagacgaatggtcaaacatgtgagaaaaaaaattaacggcgtcatctattaaaaaacgaagggagtatcattctcatctaaaagagtaaattccctgtgtacccctgaaaactcactcaatccctttcatacccctaaaatttacccgatcccttctatacccctgaaatttcaatttgatccctcccatgcccctacccttaaaatttacccgatcccttctatacccctgaaatttcaatttgatcccttccatgcccctaccgtgaaatttcaaattgatcccttccatgcccctaccgttacattttccatcatttcagtgttacgtttggttgcaaatgtcctttttgcccttgatgctttaggtttaaatataagcttcaaaaacaattgaaaattttgtttgagtgcacatcgtgtgcattttataaaactaatgagactaaataattagtgcagaaaattttgacataaattttgaaaataaaataaatgtaaaaaattaaaatttttatttgaaattttaataggacaatggattttttttatcaggagcattcataaaaaaaaatgttgtgaacattggtatacctatcttgctcctcatttttatgacctttttttaaaaaaataaatacgtatttttttatttcattatctaaaaatatttttttgataaataatgtatcacataacaaactcataactataatagtctcatgtgagaagcttttatatttttaataatgtaatttatgaatttctttattcatccaagggtaaaatggtcatttttatagaaaatatacggtcaactaacgggaggagtatgcaagggatcaaaatcaaatttttggggtatacaagaaagtaagcaaaattcaggggtatttcaggggtatataagagatctgtttcttatcattctgaagcagtaatcataaaaataaattctggcaaatttagtagtagctctttcgtgattggttcatttcgtatttatatgccatagtcctataatttccatctccatattttgctctttgagatatggaattctggcaaatttattagtagctctttcgtgattggttcatttcgtattatatgccagtcctataatttccatctacatattttgctctttgagagagatcattagattgtatggcaattctatgattctatcactactttgaaattaaccactacgcatgtccttaatctttcatttgctatgtccagactccagaaattgtttacatgattttttactgcatctgcatgcaaaaaatagccttttttctcgtttaaaattgccaaagttttttattattactgatgtaacttctggcttatcgtaatctctaaaacagaaaatcaaaggaaaacaacttcggaagatgaacgatagacagataacgtagctcaaatgaatcaaattgggagctgataacaccgaacaaatagggacacataattgaacacagctaaaaactactgccgagcacaattcatcctccattaagcattgaattttgatagcaaaagcatggttcaccagtgaagtaaccagcaacctatggctgcgttactacatatcaaaacatagtaggaagcatagtctttcctcaagtgttttcaacttaactaaagaagaaaagctaaaatcccaaacatcatcactctagtttcctgcgcaaagtctggtattgatgatagaagaggtgaccgcatcactcagtcaaacaaactgaagcccatgtcctgtaaataaatttgcaaacagttaaattagttaccattaggtgtatttgttctaataaactaaacatgaatgttaaatggcaataagaagcatagcagaagcaacggtttgcaaatcatacgatattatacattgaatagaagtcatgtcaaactaccatagacataatgaatgagcaaaatatgctaattgagacaaataagaacattggtcttacatcatcactttcttccttctcttcgaccttatcttctttcttcgcctcagctgcaggagcaccaccagcaccaccggcagcaggagcagcagcagcaacagctacaccaccaccaccagatggaactgaagcaaacttctccctgccacaagcgatgagctcagtgatgtccttgccactcacttgagacaacaggagttccatctttgcattgtcgatttcacaaccaactgccacaaagacaaagattgaggtcaaatttcacagtacatacagctataagtggatgactattacttcaatattatatttaatgaaagcacccaagaagataagaacgaaaccaatcaatctaaatatagtctaacatttagaaaggaatgcaaaccttagaatggtaccttctaatttaacgattaaatgctaagaaatttagaccaaaaaaactgctttctgaagccatggaattagccagattaagcagaagaaaatgtagacaccagttaagcagatttattggctagattacattttctgaacagtttcaaatatggacataaatcagggagatgaaattacctgactccagaatcgttgtcaaatcctccgcagtggggctggagttgccagccagataggccatcagataggcagaaatgaacttcatcctgaacaaatcaggacgaaatatggtcagactatgtaacttcaacttaacagatggatcatgatttgtagaaactcctcatgtatctaaacaaccaaggtgactaacaactatcggtaagcatgttatctcctaagaataaaggacgaacataggtgacaatgaccaagactgcgatgcaaagtctaaacagataaatggcattaactagccacaaaataaactatcacagcaaaagaatgaatctaacatataacactagcatgtaaggacaaagcaagtaaatgagcgtaacaaccaatcaggagagatagaatgcaacatatacaagtttgtacacatcccgtaaacgtggaactacatattcagatcctaaccatacttttgtccatttcatcaatacggaaacaaatattctatgattcacacatgaaactgtaacattaaaaaaacagaacatttcaagtaaacccaacgcccgctgctgcattcgatccaagaacctactgccaacgcgtagaagctaacactaacgacagcaagaccaattatctcacagcaaaaggatcacagatcgcagcactagcattagcgaagcacatttccagcacccgtcatcattccatcaacaagaaaaactctaccaaatggcaacctaagagagggagagatccaaggggggtgtgccgtttacctggatgggagatggagagagcccgacgagcggcggcggagatggctgcggcggcggcgcgctagggtgagctctagggtttctgcggtgaagggtttctcgcgctgcggggccgcggatttatacagcgcgcggccgccgcgggacgcgatctgcgccgtccgttttccatcggaaggcggggactcctgccctagctcaccctcgtcgaatcacagccgttgatcggggccgatggatcgtgggccggaaaaccaggcccatgggcacagacgtgtgggcctatagtagcgaacaaaagcccagaaggcccacaggtggttcagggctcaggtcgtcgtcgtcctcctcctccgatcccctcgccggcaaacggcgcgccgccgttggtcgccggccgccgccgtccggctcctctccgatccatttttggtatccatctctgcatttgattcgttcttttcgggcttcacgcctctgctcccgaagtcggaggctaacctgtattgtatttgttcctcttgttgctggagggagttgattcgattttgccgcgtcggattgctcgccggcgtgaaagcttactagggcatcatggacggtatgcacgcgcttgccctcttgtaatcccctttctcctactgctctctggttattatgtgttagtctggggggagtagaaagaacagtttttattagttaggggtataatttgtgtcttagctgatagaatgtgcagttggtgattagtgcggacctgggttgattgtagttgcatgacaggcaatttagtggtaagccgagttaattttggatttaacaactgcaactacaaggaaagaactctttttttgcactgataggcgatctgaattatagtgatgtgcagtgtgaaaatcactttgaaattcattattgtcagcattgtcatcctgagtagattgccaattatatgggtttggaggacaataaggactaagctctccagtccatttcttgtcttgaaaaatgaactccatatcatcctacagaatatgatggtaactttaataaaatttgtgttgttatctttgtattgtaagaaaggatgtaatcaaaatacggtgaacaaagcccttatagagtcagtccggacatgttcagtattgcagtctcatcgtatagtatctttttctcaggtgcctcttaagttttttctctctagtataatcttccattgggctttcaacttctggaagttgtgctgatttgctgcacacaatgatacccgagatttgttgattagctcagttggtgtctttgctctatttcccctccattcatgtaaatgatatcaagtttggtggaatgctggtaaaaatcctcttctagctgcataaccaataaagcatctgcaagatactacttacctacatgacattacaatcataactaatctcccaatatgctgtgtattcatacgtaatagataagagaatccagccttagattctaactttgtgatcatgtatggcttctgcttgtgcccgtgatgctattgtttcatatctgtttcccaatagtcgataaacaggaaacaatggaagagaccattctcactggtgatgatctcatgcgtgagccaccatcccctgccataccaaaagaaattgcctcgcatgtccttcaaggtgttgagccctgtgatggtatactcaggaatcttttcttatgtgagttaactgtttctgtgacatttaaaatcgtgtttctctttctctgtgtgtggaagtattattgcaaaaatattatacggcacaggcctgcaaatcaatgacatcgagcctttttgccaagatgaaattgtgttttaccgacaatgtgctgcaaaaagggtaaggttatgttgaactatttgaaactgcaagtggttttcccttttattatttaatatgttgcttttatatcctattttataggacaaggaaataagagagaagatggtagacagtgaatataaactgcgcatttcgatgcccctggaagaaggaaaggaaagaactactcaactccaattggaagtcacattgcttgaaaggtaacctaactaggattgcttcccccctatatatttccgtagcatcattctctgcttagcagctcatttttatttatactttctaaattaagcttcagtgaacccaccgaagtgttcaggctataattaagagatgatagcacactccaattgtatatgccttcgttctcccacatattttcttgtattaacaccaaaggaattattctgcatttctacctgttcttatagattttgatgagagcaaaggggttaaaaatgatactgtaaaccacatataagtagaagtcatgtagacaaacaacttatatacactatactccagtaattttcacattgagagccctaggtgtttactgtttagttaagttaagccgatgctctgtgaaacacttgtaaccaatactacgcattctgctgttctacaggcatacgagacaatgagtagcaccagggacaaagccaagcacacgttaaattgccttgtgaccactcttcagcaccgtataaaatgatttacagacttttgcttttaagaacactacctattgcctacagactttttttctaattgtattgattagattaaactggacaaaagaaatcatcaggtgtactgagtttttgttaataattcatcggcatgatttcatcagttctgcttgtatgtagtctcgtacttctgtaggcgcatgattcttgctagtgggcttgagggcatggagggatttcgccagagatggagcttgcatggacagctcgaggatacgaggtattaaatcttgcattgttcatgtgtttttatcatctctgtcatagtcgaatgggctcacttgtaacttgtgaacatgtacttcaaatattgacaaactagtgaaggaatggtgcttaattattgtgttatataatccatatgcatttgaatagtttctttattcacatccagatgattggtttgtattgcaatatgtaaacatctgaaaataaaggccttgtcaatttcttttacttcgcaattaagaatattcagctatcatctgagacagcaagaaatcccgactaggcctaaggggccttatcccacccatgctctctctctctctctctctctctctctctcttgaaaagagggcaaaagttttgcctcgtatgtattgatagagcagaatgaactgttacaacatatttacacccatgctcattaggatattgaacaaattatacactgatacgttaagtgcttcttgaatggctactccagatgaaaatttcaattgtttgagttcagaaatgggcttacatcttcgtttttgcgtgtcaagtttgcgttttcgctgttctgtttttgtctttgcaggaaaaggatggaagcactggtccgtgggatggagaagggagaaagccaaaattctcaagcgcaagggagctaagaagaggtggttgttttggtaggttagcacattttttttctaattgcaaaacagagcagttgacagtatattattggcaatgccatgcactggttccttcacctcttcaagtgcccttcctcaaaaccaaccactgaatcagtgaatctgctaatcaacggatttgcttacatacattacatactagctccgagtgaactgacgcaattttagcatattcttgtcggaatgtaacagagataaatgggctttttgatggcccagtaacactcgcttcagctatgggctggttcttcattggacttgcaagacctctgcaaaattaaatgtggcctttccctgaaggcccgcctgtccttgtgttcttttgcaaattgcaattgggccttggaagattatgtcgtctcaaaatatacaaggttacgaatttgctatatatttgtcgacaaattttccaccaaaaatttgacagatgtaattataatacaatcgtagtgtaattacactgtaactataatgtaacatgtatgtaactttcaaaaatctctccataacgtttagagtaaatttcacaaaactacacgttttgtggtccaagttgcagaaaaccgcacacactttgatacttgacacttaagtacatatattttggtagtgtagtttcacaaaaccacactatcaatggatagattcacccgcgaaatgacgcggttggttcacctaggacaaggacatggcatcctattaccagcctcgcacgaaattaataggatgccacgtccatatcctagatgaaacaaccacgtcatatcatgggtgaattcattcattgatagtatgattttgtgaaactaaactaccaaaatatatgtatttaagtaccaagtgtcaaaatatgtgtggttttctgcaacttgaaccataaaacatgtagttttgtgaaatttactctaacatttatttcggtaaaatggaggttgtgagaaaaaattctttcacatatgtgtgtgatgtgattttttttcttcctcaccggaacaaattttataatagatctaacgattcaaaattacgtgaaacttatatacaagttacactgtagttacatgcaagttacagtgtaattacactacgattgtactataattacatctgtcaaattttcaaatttttagaagaaaatttgttgacaaatgtataggcggtcccacaaggttattaaatcttgaaagaagagatctttttgcaactaaaataaacaaatcctaaaaagcatctctatgaaagggtacataatatatacactgcactattttgttgccaaattggagaggggaggaaatgccaccataattctttttcagccatattcatgcaataaaacctcgttctttttttttcatgagcttttttttttttcatttttcacaagaatgagaagcgcaggctcctatttattgcacactccaatccaatgaggaaatgacgatatgttgctgtcagtttctcctgcagtctggctgcgccgtccctcttaaattcagcaacctaaacgaatttcgtcctctctaggcagactcacatgaatcacctcacaatcttgagtgaccttctgatgaactactgaccattcctttatttgggtagccagcgtttacgtcttaagtaactttacggtgctctttgttggtaatattctgttaccagcgtttacgtcttaagtaactttacggtgctctttgttggtaatattctgttaccagtattattattagtagaagtgatttatgaattcataaattagtaaccactgattcatgaattatattatcaatagaattctttttttactaccagtagttgatgtggtagtatatatagatttgatccattggattagatgaaataaacagactaaaattggttgtactaagcattgtaacccacctcttacgttttcgattcgaaaatggtgcaaaattatgtgcctggagagaaagacccaacctgtccttgatttgggatcaattcctgtcctgagaggggaaaaatatactactattagtactagtggtacagtagaattgaggcaaaccatgcactctgacattcttcagtgccacttgtggcttgtgaatgtgatggatttgatttactccttcactaacagcgaggaaattcctcacttgccatactttgcactgaatcagagcactgtatccttggcatttctgatctctgaacaagaagcagtgattcattctgattttctgaaggattgtctgcctcgtgcctctgccctgcaaaacctgtagtagcaaatgaggtccactgaagctttcaattctaatgaagatttgggcagccaatttagagcacaccagtgcatgagaatctcactactgatgcagcgaagtaagtactgctctacttaatcgatcactggcaattcaaattatacatgtgtgctttgcttggcctgaacaatgctttgaaacattcccagcgaaaatggttacagctgtgaggtcactctctgaataactaaatgatcctgaggtcaggtggtcctaaccccaaagtttagccattgcctgaatgcctgacagttcttgagatttcaattcagagttaatgtgagtggctggagaattgagagcgacctagctttgctttgggagctcgatcgatcgattcaggtgtcccctctgaaactctgacagctgagaatttccttgggcgttgctcaactgatttcatggtagatttttgcctgtaaagcgacacatataggacgaattttttttatttataattttttttattaaaagttttacaaaaataattttccattttgaaaattgacggaagtagtcgcctaccgccctctgggagggcgatttttaaaaatcgccctcccagagggcggcgaaaataacgtggcagccggccgttcgctctcgggcgacggccgtcaacgaaatttgcaggcggcccccttgccgccctccgctagggcgattttgtactgtgggggggggccgcctgcaaatgggcggcgggggggcatggaattttgcaggcggcccccttgccgtcctgggggagggcgattttatactgtgctctatatttttgtataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcactgtgcaagtcgtcgtcgtagaactggctagtaggaccagtcctaccggcgtgagacgaagaggccccagtaccgaagatcccggctgcaaatcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52688 - DNA, 9451 bp, Oryza sativa
  unsure (1)..(9451): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaacttttaaaggctttgatgttttcaccaagaacacatcttccaattctgaagcaggactctgagaatcacctctttcagaaattttatgagtcttttcattgtctgtgttttttcaatgccacagttgtgtcatgccacactttcctacccttaggtcccacatgtcatactcagataactagagctaacattgccacacttgtggctaactatttcttagccatacttttgccacatgatacaacttgcctaagcttagttatggtaagcttaggcatcaaccaaataaccccttaatgaaatctcgtctaggctttcagaaaatgaaaaaaaaaaacttagactaacataacatccataagcgatgggggatattcatcgatcccgtggcgattgttgtttatcgatccggtagcgaggatgccggtaattgcagcgatgcgactgagcaatccgggcggccaactcggcgtcggtctggggacgatcttgccgccgctcgcccatgagccacgcccaccaccccaccggccgctcctcctcctcctcctcttcctcctcgcggtggcggcgaccccggtgattgcagcgattcgactgttcaataatccaagcaatccgggcggcgaactcggcgtcagtcttgggacgctctcgccgccgctcgcccatgggccacgcccaccaccccaccttctcaatgcgggcgtccacgaacgagcgcagcgcggcgtaggcggaggacaccacggatcccatcgcttctcgctgagattcaaccgagcgtccaaagaagaagaacaagagattaattgattgattgattgatcgatctggtagttgtagggggaaggggacggagaggccgtatcggaatccagactctgatcctaatccccgtctcggtttgagaattgagatgggccgaaacccactccttttttcctttggaataagtccacttaggctccctagagttataggtagaatttaattcatatccctcaaccagaattgtactctctccgtttctaaatatttaacaccgttgactttttagcatatgcttgactgttcgccttattcaaaaacttttgtgaaatatataaaactatatgtatacataaaagtatatttaacaataaatcgaatgataggaaaagaattaataattacttaatttttttaataagacgaacggtcaaacatgttttaaaaaagttaacgatgtcaaatatttagaaacggagggagtagtataccagatatcttgacaataccagtacgatttgacttcatcggtggttttgtaggtggctttaactgatttggcgtcgacaccctcaaatataggtcgaatatgattcaatatctcttaaccagaatatcaaatattctcgttaagcgatataaattatattcaacctatactttttgagggagccaacatgtacttatcctttttttgttttctcctcctgtgccgagacaaacggagcccaccaaatcccaccctttgtctcaccgacagtgggccccacctacagaaaccgcgtcagggcaagttttatagtacaggtagttgtcacatctaattttatccatgtaagataagaggtgatatatataagggaaaataatacaccacatctacaccacctctatcattataacccaaataattttattttatttgtttgtccaatcccctttttcgttcatttcctttttcttcgggtttatatggaggttgccccttgcatgagaggtggcgcaccttctcttttctcaattattactgccacctcatcatccaatcctacatgccatttttaggggcaacacattaagcatcatgttacttgccctcatcgtcatcaacagcaatagcatgacctatatttgaggtcatggagaatgcaacttggcaagtaccttctctcccccagtgtcttgaaggcttgaagctacggagaaatatatcgtgtacatgtatttcaacttcgactaaattttctagtgaaaccttaacctgtttgaatcttcattgtaaattcgagccaaaacgttggaaggtcatggcagaacagcagttttgaatctccagagatcatgaaatctgcattgctacaagtgttcggaatcatcgctatattcagattactccaaacattcacgcatcggtcggagtaaagcttttccatcttccaatttggaagcaggcatccaaaatacagaaagcagacgacaagcatgcaccagtttgctaaccaaaagaaatgagtgagacatctcattcaacctcacagctccacggctccacctgagcacattagctgactatgaataaagcgaaaagataaatgacaagttaaggaaaagatgcacaaacccacggaaacccccaaaagccgatacaaataaaatctccttatctccctagctgtgcacgctaataatgggctgggtttacatgatacgggaaaataattccgatgcatcatatgttggcatctaaatatccgcataatatcagaacataactcctattgacaagctgttaattgcctcacaacagcactgctagatcacagttctctatttgtacatcatctcgatggaaatcttatacaagaaatggggttacttgggttgatcctggcagtgcacacatccaaatcaacatgtcatctagctactacgtttaaagatgcatcaactattcaactggtaggtaatgattttgataatttcttcttcttggaagccaatgctgacaatatctttttccgaggcccctgaaaacaaatcaagatatctaataaatatggacacaaaatcaaggcatataatgctgcaaaactcaatgatatcgctactcataaaggctgacaaacttgaaaaataaatatatgtaagtagattgcaatcggaaggatagttgtacactagtacacaatggacactctagcaattgttcagtttcgttacggcatgcacgcataccatagacaagaaagatcaccgacatgcatctaccaagggcacaccggaattgctaaattttagagcttataggcagttagcaaagccaacatttatgaagtttttacgaaataataaaaaaccaaagtgaaggaatacttagctatatatacaaaagaaaacagggggaaataacacacaggagataaccacttgtacttgctttgtctgcaaccagacgcatgtcatctatgaaatatcattagtggaacactaaaccctaggataaaatctgaaagatgcaaaaggtacacaaaggcacatatgacagtacttataccacttcattcattttagagaatcatcatttaactctattaaaagctactagaaatttggattagtaaccgatctagattatactatctaacaagatgtcaaaagagagacaggtagcttataaagaatgcatcataattctaaataatttgaaacatcttagtaataattctgcaagacaacccctagccccaccccagctcacccaaacacacaggagaataggggattaaatcaagttaatcctcactcttcagggaagttatataacttaaacctgctctaccaacttgcatatttaaaattatgacagtaggaaaggtggcaatacagaggcatctagacactcatttgaaaaaaaaataataataaagaatggactagctcctgcatgtaaaacaaagttccaatccaaattcgtacagtaccattggaattcctaaagacttcatgtcttcctcattcatgtgaagcagagccttcatatcaacctgaaaaatgattaagcattaacaaaatgtagtaggctagtaacacatgaaaaacttgaatacccaaataagtcaaacatgcctcttcagcctgaaaatttattgagtacttctctacatcaagagacttcagtaatctatcaagagaggaatcagtctgcacattttaaacaaacacattattaaaatgttcaactgataatatttaatgatgaaacccaaagtaatcataaaagcatctggacagataattacattggtacaatactatgcagatgaagtttgtattttttaacaagcagtcaagcagattaaacatagataagattatatacaaaaagacaataattcagaataaaggttggagaaacattaaatgctcaagaacaccaccatcacatcattacacacgcgaaatacataaaagggatgtagcataatgatacattattgtcccattagtctagaacaaatatgaaagcatattagttgatcaggacgagagtttgtgagaagataatatgacagtgtcaccaccttttcctggcattgctttggtgcagatggttcgttcactttcttagtagcaggaagggccgcattaacagggggttccctcttttggacaggttccctcttttgaacaggtttagcgctcgttgatatctccggtacagactttgggatctgtacagtactattcaactgaggccgctgaactccagacaatttttcacgaagatctggaactgatgatttcctcataacctgagtgttttgctgcaaatgtggtttctggtttccttggatatttctggaaggaactccagcttcaccgtgcaaaacgaaagtaatacagtaatggtaaatcatcatgcaggaagcaaaaatgaattgtatgtttagaaaatatactatgaatgtcccttacatgaactttgaactcccacagagtccatataaagttcacgtctccaagtcccatctgcctgacgaaacctgtccaaaccacaaagtagaagatataagcaataggattgtgtttgcttctgtgctcacaattaatctgggaacatataaaccaaccgatcataccaaccatttgtgaatcttacacatcaggtggaaacactgcagtgatgcagcaatttaaacatgacttaatgatgcgataactaaagacaacacaagaaaagtgacaatactatagtaactataccaaggcgtgcatgcatatagactggcagatagtgataaaggttagctgcagcaacaacagacgacacggctgtccaaaatgctacactctccacagtttcaaaacgaatttaaagcaaatgcagtattctaaccaggtcactggctatcacatttgcagtaagacaaaaataaacacattttcctctcagtctgactaatcaatccgctggtcgcaaccacatgtctcccctctaagtgggtcaacctggaatcaacatgcaaaatgctcatttaagtgcgccctaaagctacaatcaccacgcacgaagccacgaactccctaatttccacgccctaagcggcatttcccaaacccacctcgatccccatacgatccaaccacgagtcgcaagcccgtaacatctagcagcgcatgtacagagacaaaaagcaagcgacgatttgagcctatagcgagctcgaagtcgcacctcttcacggagtcaggccgcgggcgagagcctccgccgcctccaccgccaccgccaccgccaccgccaccgccaccgccgcccgatccgaggcggtccatgacggagcgcttccgcccggagacactatcggagtacatcgcggcggcggcggaggcgatgccgctagggttttcgtcggcggcgaggggggcagcggtggagaggccggaggaggcggaatgggaaaagggggcgacgtggaggtgttcctcggaaattttccttcaaagggaaaaaaaacattaattttccattttttttagaggggaaataatataatgggcttgggcctaactgggctggactttgaaaattaaagcccatcaagtaaaatagctgaaacttatattctggcccaaaattagcccagctcaattggctccacaaatctaagcgcttgtttggtttgaacccaaattttgccataccaaaatattgggagtcaaactgctactcccttcatttcaggttacaagacattttgactttgtcaaagtcaaactgttttaagtttaatcaagtttgtagaaaaaagtggtaacattttcagcccaagacaaatttattatgaaaatatattcaattattaatttgatgaaactaatttagtattataaatattaatatatttatctataaacttagtcaaacttaaaacagtttgactttgactaaagtcaaaatattttataacctgaaacggagagagtacaatacaatttatactagtatggcgaacatttgatatcaaaccaaacatccataaagtacggttgaaactaccaaaaatttggtaagacataaattagcctaaatccaaacaagccctaggaaccaaattcaaacaatgcataaagttaaatcccttgaatttgacagtgagcaagaaaccaaactacataaatgaaatgggggtcaatgcacagtttgactatgcaaggtagaggtggtcaatggagaggagaggaggagaccattcaactcaaggcacttgttgtaccaaccaaccgtgcagtccacttgtatctacacttacgcgggagcattgacttgccatccatccatgcgtctcctcgtcgtcgtcgtcgtcgcagcaagaggacggccggtgcaacgaccggttgatcaatcgatcgattgatcgccggtaatctcaccgttgaatcagggaggaaagagtcgccggatgggaccagatgatggttaaattaacttgttaattaattacgaataggttgcagcagtgtacgtatgcatatagaacaggacagaattaatcgtgtggttagttcgagtaaacaaagaaaaaaaatgagaatgagatggaggtgtttagcttggaagcatcgaacaatccatccgtcgattgggaagctagaggaagaagacagcgatggagttggcgagccggcgaatggtcaaagatggccaactttggtttaaggtgttaattgttaaatcgttcgagctatagtgtgctagtcaactgctccatctgaccaatattttttcactaagaccccttatattttgactattttcgtgaaatgaacttggctctatgataaggatctatatgcagacgcggccttataattgctacctactggcgataagcagtgaactattgaagtactccctccgttacatatacaagtttataaaaacaatataatagtattttcaacacaaacaatcatattataaaaatatatccaatgttatatttaactaaactaaactaatttgatattacatatgttactatttttttaaaacgtaaagaagtttgattagaaaaaaacgacttaaaatatgaaatggaggaagtagtagtttttcttccggtttcgatgtgttaaacaaaattaaggttaaatatttataactttaagtatcaatagttttaagtttatttattttaaatacactagaataacatatatagatttaatttacaaagtattataataaaacaaaaacttgtgatacatatattataatagaaggacatggttaaagatatatatcagagaccgtatcattatttaaaacttgtcaattatataaccagagggagtaggtgttgccatcttccataaccactgaaaaattgcaacgattaaatattaatcatcatcaagagagactagggaagacttgaagtgacattaattacgaggactattaagcaaaatcagagaaatgagagggtacatagcaaagaagcgacttggctgggccttctgggtccctttcgtggagtttataatcccaggctgcagctgcaagccagccggcctgagagagaggagaggagaaggactccattggcgacaagctaagcttagctatagctatagctagctagcttagcccctgccttccaaggaggaagaaacgaggcatacatacccatcccctcctcctcgacggctagctgctacctcgtctgatcgatcgatcgatctcctcgtcggccatggcggtaagctttctttgctctttcttcttgctcttctgttcttgggcatgggcataccttgcaattgcatgcgaccatgttcttccatcgctctttctgccacagtttaccgttaggcgtaggctaagtttgatctgtccatggttttctggttcaatatctgaacctgaaatttctgaaggaacagttctcactttcttaataacttcagagtaactcgtttttatctgtccatggtttttggatgcgaaatctgagcctggattttctgaaagaaccgtaacaggatcaccacgattttgtttcttgtcatccagtgttagctagttaattagttggaacaccggtttcatcgcttggaaaacaaagtcctctgttgttgtgctcttgttctgcttgaatccacctagtttgctcaacttgaatggtatgaataacttattgcttgtgtgaacgaaggaatatccttgacgtgttcatctgcaagaagtctttcttgatggttgagatgtatctttccatcacattaagttgtttttttttctttgtgaataaacatttaagttgtagtattgtctccatagtattcataccacaattaatcaaactgccatagaagatagatgttgtctgcttaactcactggaatacgacgtcctggataatcaattgttctcccttaatcgattacattattcaaaatctgttctaacctgaagattgaatttgtatataaccaaaactgaagagataagggatgcatcatgcatgatgcatctgtgtctctttgacttgaaatttctcccactttttgtaatcttaatcaaacgtagggtgtcagcaaggtagacctaccttgcgctgtcatttctccagaagctttgacaaattggcacacaaaagagattaattgtcagacctgaacacccaaccgccgcattagcccggtcctgtctggccagcctgattaatcagtccaagtggtgaagccacagcatgtgaacgattgattaattccgattagaaaatcagcacgttccatttgattagtccggccatatacatcaaatgtatgcagtgtgtgtgcaattgaccagttcctggtctccatttttcttttgctaattttttgctggtcagactgctcatttacaaccacttgtagtaggcagtagtacat

SEQ ID NO: 52689 - DNA, 7502 bp, Oryza sativa
ctgggattcaggatccactatctcagtatacctaaatttcggatcggaaaaaaaataaacattaaacaaattctgatcgaatttaaatacattttgccacatacgcattttttttttgaatttttcgtgcgaaatagtttcatgcccgggccaaaaaatccccaaaattgtgagaaggggaagaaaatgcatggcggcaatggctgatcatatatagctttgcatttatgcagcagcagcagaagaagaacgcgcacgtgccgaaattcggcaactgggacaatggcggcaacgtgccgtacaccgtctacttcgagaacgcgcgcaagggcaaggtcgccgccgccggcaagatgttcaaccccaacgaccccgtcgacaacccggaggccttctcctcctccatcgccgcgccatcgccgagccgagcccctcctcctccgccgtcccaccacgagcgcgccccgagcgacgcgccgccgccgccgccgccggccccctacgccggcggctcgccgtaccaccgccacgccgctggtggtggcgagacgccgccggcaagaagaggaggcgggcggacaagcggcggcggcgggtcgtcgtacagcgtcgagcactcgccgtcgccgtcgccgctgcacccctactccgacagcgggagcggcagctacggcggcggcctcgtcgccaactcccgcgccaagggcggcggcggcggcgccccgcgcggcaacgagacagtaagctagcttccctccgctccgctcgacctctccgccattgatgacgcttttgcaagcttcgtgaccttgttgttgtgatcgccaatggcagccgacgagggggtcggcggtgccgcggttcggcgactgggactcgaacccggcgtcggcggacggctacacgcacatcttcaacaaggtgagggaggagaagcagaccggccaggccgccgggaagccggcggcggggctcggcaagggcggcgccgccgccgccggccacggcaacgccgccaagcgataccacgacgacgacttcgcctccacggtgagccactccaccaaccaaccattgcacataggggcctcatttttagttgcttatatttatcagccaaaatttaaattttcaaccttaaatttagctgattttaaggttttttatcaaaatttattttttagcctttgcttttaaatcgctagaacacgtatataaaagttttattaacaaattattttttgtttgtaaatatagtgtttcacttattccgcgaataagcgaaacgatggctccgctaggttcttgatttcttttacatttctgatctcatttgagctctacatttttttttaatttgcagaagtgctcctgctttggatggtgcaaatagagatggattttgaggctgttatcaatgtacttgtaaattgcagagaatgggattttcgtttccccagtgcgattcatcagcttcgaaactgcatttggtcatagattatttatttggaagtggggaaatatacattacagtatagttcatgcctgctgtaatggtagattacgtattggattgtttggttccttctgtactggatttacatgcttgtaatggcaggttaaagcttgggctgtttcttgttcttatcgtcatttaatttgtcccttgtcaacacagaaagtccattatgcacgtattaatctatgaaactagatttctggtagatttggagttttttgttttttggatagctttttattgctgaagctggcagtctgctgcagagctcccttaatctgaagactgatgaacggtcgcatcacatgcactctgatcctcaaaagttctagaagcaatctgttctttttccttctgaatttacttaaacaaaacagtgtaaattgaattgcttgaaactattatcatacaaaaaagaaatgcacatacggtgcgtactggatcaagaacactcaaaacccaggggctattcagattgtagccaaaataaaccttaccaaattttggcaagttgacaatattcctaaaattttagtagaatttcttatatatttaccaaagtttggcaacaaactaaatatagacacttttttggtaattttatctaaaaaaaatatagtatgattgaaaatggtatcaatctaaacagcccccaatcggatggcctagtgagcgtagctagtccatctggattcaaatctagttttacagttttatccggcccatctacgtgtgtgggccgtgattgaggcccatcaaaacgagtccgagacgaggagtggtcagcaccggggcccacctatcagaagcccagcgcgggaggagaggaagaggagggcgccaaagtccacagcgactcccctttccttccgatccgtcccgaactcgaagcgaaaccctagcgagtttgcgccgcggttcgttttggttgttcgttcgagaccgattcgggtaaggtttccccctcgccaattcaccccttccgtttattaactgctctgatgatttgcctcatctgattcatctgttctttgctctgggattccgccgcggaagcaagctcgtccggtttccatcgtcgtctgggatcgggctcgctaagacttttcttgatttagtaagctgatccccctcagttcgttgtgaattgtgacggattcgggaaaaattcaggcactcttgatcagggtttggggtttagcagtctcggtgagcatttgtttccccccaaatctttctttctttattgttgttgcgcatctgtgtgttgtgataagttctgcgaaatgtgatataaagttatgtgtgtatagatcgtagagagctgagattagaggatatcattgtaattgatatttgacaacacctaaaaaagaagttttttaagtcggcaggagcatgagaattgcctgattagatgatctttacaggttctttatataccacatacttgaaatttcccagtgcttgcaggcatttctcatctcgactcttgttttgccaaagtattgttgaattgttcccttccttccaaatttccagggttctcagttttgtttttttccccctcttttgctcttctggcgtgcccaggatcgcaatctgcgttttttttggtgcctatctatctttaatgcaatgatacgcaaatcttgtgcatgttgccaaaaaatgggcatttcttgtagaaactgttaagggaattagggtacttaagctgaagattcagcaataagtaattgtggctcactgatttccaggttattccaaatatcataagaatcatgagtactgcaagtactgcacgctctaggaagcgagcccatgatggatccagacaaaaagttgatgttataaacttggaaacaactgctccagtggtgaacactgggagccagcatgaggctctgatccttaggggtacacggacctcacccatcgatgttgaagctctagatgataaagtaagcttttgctttcttctgtctccaattaagcgaatgaataactgaaacctttacaagaagctgaagctgatgtttctttttgatagaggaggagcagaaaaattatgaggcgctctgtggctgtagtggatccggagaaggatactggtccgggaggtaagtacattacttatgtttgaactccacatagcttagtctaaaagaactatttggaagtcttgtgttactcagaaacatttggatacttccaagtgacataagaaatgtgcaccattaattctaacccatagttctgtactgtaggtgaaactgaaacttgatagtacatcggtgtactgtcttatagattattattacaagacactacaacatatacaataattatgattcatacctcacaaatgttcatcatgattccctgttttccctgttccccaaggttatggcgttgctggagctatattttcccggggcagaaattttcagggtgctgtacatgttatatgcctttctccagatagggaagaagggaccagcaaggttgttaatctttttaagttgatcttctttgtactgtgatgataattgcaattccgcattggctggtgtatgtatattgttttcttaatgcttagtattgtactcctacatgcaactcataatatgctctcacctttgcagccgaaaaatgtggcccaaaccagtacgacgcatgccaaggttgctccaaaggaaccaacctttacctgtcctgtgtgtctgaacaaactggacaagccatccacgacaaattgcggtcatatcttctgcgagaaatgcatccaggcatggctcaaggctcagaagaaatgccctacttgtaggaagagtctagggatcaagagcttccatcgtgtttacctccctactcctgctgattatgattaattagtttctgctggcctgaacctcactagtccactcctgcacattcatcttgtgtgcaaaagaacttgagcagtagttagagttagacatttagtctttgtttgttagccctgtaggctaacaatgtggtaagaagtgcacaacacgattcttagctcattgactacatctgatctgatttgtatgtaatggcgtgcatttttctcctgtgggttctgaaaaagggaaaatatctagttttccatgacggcatgacccatgaggttcactataacaatggccttcctttacaagtgttacaaaccgctgttctgactcgatcgtgaattgattcatgatttaactactgtacagccactcaatgtgatgtgagatgctaaattctactgtaatctatcggcacaaacttgttgctcgctttcaccatcttcattctacctctaatcgatgccaacctgaactgaaaacaacctgatattcaatgtttgagtctttatataaaaacaaaaagaattgtgggttttatgatgaactcatgaactcatctgagttcacggagcagatagccggaagaggcgccggggagggtcagagatttaggggcgtttggttcactccctcactttgccaaactttgccacactttttaggatatttgtgtatgccaaagtttttcgattcaaaggcccacatgtcatacactcatcttttagccaaaccttgtctaaggtgtggccatcaatttataagccacacatttggctagttttggcatggaggtttggcaatgttcggaagtgaaccaaacaaggtccacaggaaccgtgttggatcgagaatgtacggtccagatgcaagaggggtaaaaaaagccgctgatgctggttcacgggagccattggatcgcaggaatcgtccgatcgagaatgtgcggtcaaaaatcatgcggataaagtgcggcgatgcctccgaaccccttgagtccatgaaatccgttggattgtgatgatgcggtgaacaatcaggcacacagtgtccgtatatttcttgacttcttgagtactgataacttaagcttgataactatactttgggggtttgatgatcttctgattccacagctaattagggattaaatcgccgtgacctgcatggaattaatgcagttcagtcaatgcgagatatctcaagctcattgtggatccaaaccgtcggctctcttttatctgcttctaggctccaagctccagcttccctgaaatgatgtgagagtaggacgtgctcagtacttaatccaagaaaatgacattggtgaaggatcattcattggtgtcatttctgtccatgcaccatgcatgtcggtgaacacaaatcaatatctcctctttgtattatcttcttcttttcgagcagattaacaggttcaggagaagttgcatgatccataccttttcttttccattttgtaattttcttcatctttttttttactgtatcttcttattttcctttgagtattggcatcaagaaagaagagcaaaagactagccggatgcagcataatttcacatgacaatatgcccttcctctgcaaaaagtgtcaggaaatactagtccatttcaatcagcaacagagctaagtacaaggacaaccctgtccggaccagatactgcattggatttgattgggcttgtctggatttggacagccatgtgttggccggagaaaccaaacaagatcaagagcaaaatgaaattaatcattgagtatacactccttggatggatctttcactcatcatgattcatgcatccttgctcatgttcaccaatgcaaaatgcatgggcctgaacctgaagcttcttccacaacatgccatgagaataatagaggtgggatcaatggcaccttaagatcaacattccatcatggtctaaagaacagaaccttccatcatcaacccatgaacccccaaagctgtgggccccggccatgtgtgagcctagccagtgggccacccccctgactggtgacctattgctcctctcatcaggcgtcactacacactacaacaagtgaaaaaagtgaaaaaaaattctacttttaatctttgcatatggcatcaacattagcaaaagtggacatgttgccaggatcatccacgagtcttgtacatcggccaatatattcagaactttcatccacgttaatctggcagatgagctttgtcaaatgcagttctaacactagagttcagctccattcatggagtgagacaggagcggccaccgacagactgacagaatcgctcgtagagaaagagtgcagttcagatgattaatgttccatctgcatacagaattccaaatactagattatggcctagtttaaaatagattattgactaatttattatagtagattatatgatataccacacctgttaaaatatagcaacttttagctatgaatttagacgcataattgtctaaattcatagctagaaatgcttgtattttgagacggggtagtaagttaaatgttttgataaataacttaacaaacgacttagaacaaatgcattagaacaagaaatgcatacaatgcattaggaattttttttaagaaacatttttagagacgtggatcaaatttttctctcaataataatcatgtgagtattccctccgtctcaatatatagtaacttagaatcgaatttgatatattgtagaattataaatttggacaaaactatatctaaattcatagtcccatgctaagcttactatacagtagaacaaatggagacattgagtagttgaaaagaaatagaatggagatcgggtccacagcacatcactagcagctgatccagaaaatatagcaacttttagctataaatttagacgcataattgtccaaattcatagctagaaatgcttgtattttgggacggggtagtaagctaaatgttttgataaataacttaacaaacgacttagaacaaatgcattagaacaagaaatgcatacaatgcattaggaaattttttttaagaaacatttttagagatgtggatcaaataa

SEQ ID NO: 52690 - DNA, 11804 bp, Oryza sativa
gaaagaggttatcgactgttcgagtcccacgaacgtccgcgaactagacccaccccgattacgtggtgtcaaagacgttaaaatcagccctgttatgtcatttggccttgattcgcacgcagtacacaagttcgtgcatcagtctgtgcactattgcatataccttgcgtcttcatgtactgctaacttcatttactcaataagcatgggccagtcagacattcatcatgatatgacgacagtttagttcatgtacaatataaactttccaaagtgtttatacagtatatatagtcatagctatttcttaaacttttaataaatgcaaatatatacaatatttaaagaggcagactaaggagtataaaaaaggatgcttcacaacacgattgtcacaagatgaaaagttcatcttgctctccatggtagatacaaggaattgctttggtgcagctcctgtcctgctaatgtaaattggtgtttttcatattattaagagaaaataaggaaaatgccatcgaaaagatacaagctgcaagatatcatcgcctatgagaatggcatgtggggaatgtcaataacatatatgttggcattttccaactccgttattttttagatgccaccaagcaagctgtcattaattaccacgttcacattcaatatgtttcctaactacacactagcacaagtgttgcaaattttattttccctaggtatacataacaaaattgaaaaaattacagggtagacatattctattcaagcaaaattttattatgagaatcaatttcatttgctagattttaataaaacaaatactcagaaaatagaggacaagttcattgttcagtaagtatgtatttttttatctgtccaattaagtttgaatttggactagaaattttgtctgtcctagcttggtaatttctagaccgagttgaaatgaaatttgcaaaaagtgtaccatttccacatgatgcttccccacttaattctttaaattgttgattcagttactcttctccagaaattttacatttgtaaaaactattggatgatcttcagccttcacattatcaacagttcaaatgcttaaaagtatccagaaatatgcagtttatagacatgtcattagggtaatgactcaccgaagtgatcttcaatcaagcctcagctgtttctgggagtgtaatcaatcgggatgcagaatcgtataccaatgaactgctacaactgataaacatacaaagtaaccacattagttaaaatataagatagaatgcatcagaaaccgaggactagatttcaaatccatactttgcacatttcacactgtttcttgcaccaccgctaggcacagacagtatagtcccaaagaaggaaagattttcattgccacagttcgggcacggtccctagttatcaaaaaatttgtcattttgtaccatacttaacatgcccacgatgtatgataagacaatgaaaataccttcaaaattaaaaagtccttcactatggcactcgtaattgcctgtgctacccaaaatattagaggcagtgcggcaaaccatgtgaagatgaaactgaaaggctctggcaactgcatcattcatgaatgtaatcagtaaataacaatgtttattatctaaaaaaatcagtaaataacaaagtttgttttatggcatcagatccactgtaaggtctgatgtagaattagacagtttgttccaaaagtgacgtatgatatagaattacaggagtctaccatgctcagtattcaaaaacaacattgtaggttactattagatggttatcgtggcactgctataatatttattttctggaaaaatccatacatggcatggaaagcatatatcaggtatggcatcatcaattgaagcccaacagttaaaacaatggcgttatttgaacaagccaaactccaattacaaggaagatgtttcgtgaacatatttcttatagcttgttggaaaatatggaagaagcataatgacattagcaggttggcaaagaacagttaaagatatttactctgcttatgtagagggtaaatgatgttcatgaaaaaaagaccaacacaatttctgctatattataaaccatttattttttatttttacttttctacctcccataggtgcctcactatattcccatactttccatattacccttactggtgatgatgcacgttctactgtatgagggcccacattgcatggatgctttcaaacagtgccataccactgtcagatactacatcggatatgaatacagtgtactctaattagcatcagatatgaatattacatcggatgcggatacgccatcaattattcttggtcactaataagaggtagcgaacataatgttcgatgcagcatgcctacatctatgtcccaactggttgtgaaccgtgaccttgtgttgttggactaatatgttatatcaaggcccatgtattgtaggaccatataatctatgaacacttcatatattctatcaactatcatccctaaggggcaatcatctcctcaaacctctgatgtaagtgacaataatttgtgatttctgctctacttctactcatttatgaaattgtgtactgttgaaataaagttagatgaggccaccgaccataactttgatgtcaaaaatgcttgtgcttggtcaccctgatggactctctctctccctgtgcagtgtgcacagcctgcaccgacctctctctgtacatgcatgaagctccctttgcaaccttcaaatatttttttctcctaaattactaataatctaatctacaatccaattagaccgttgtattcatcgcaattaaatcacgacaacaagaccgtacatgattgtattatgatgaaaaaaatatatgtatgtttcaaccattgtaatttgatgtttcatgtacaagtgaatgtttcaatttgaattcaactgtattgcacattttaagtctttatgttgcaacgaatctgttttatgttgcacatgatgttatttggatgtttcaatgagtattttctaatgtttcactagttcatttgtaaatgttgcacatggtgttttttggatgtttcagtaaatattttgtgatgtttcaacaattacaactcgatgtttcatatattatataaaaatatttcaataaggaatataatattttctattttttcatcaaaaattaaatcatatgtgagatcttgttgtaaaaatttaattacaacaaatataactatgtaaattggaccgtagattgcataagtaatttaggagaaaaaaacatttaaaatttgctaatgaagtggttagaggaggggtaagtgggagagaggatggagtatgcatgcaatatgcagaggggcagaggcagcaaagcatgcggtgcatgtggtagtggttagagggtgctcaatctttcccaaaattcaggtgcttgagtgagacgatgaaattgaaaaccatgtatccaccacccattacttctatggaaagatgggcccaaacaagcctgccctcagccctcccctcctgtctcctatgcaaattacaaattctgacccctcactccctccatcatatcactcctaactctcacttcctagctggaattaccccccccccccccatcatgcacatgtcttagtgcgcacttaggtccatgcagcaaaccaagccgggcagccaaatcgtcgtctttaactgccacctggcccattgattacggtaaaatagaggtataaaggtcgcacctaattctgacttttcaaaatctattcaagtgagtgaacaaattataggactataatgtatgtttaattctttacatgtataaaatcctgaggatgtcatatatataacatcctcagaattttatacatgtaaagaactaaagaaacattatatattggtgacttagctactccctccatcctaaaataagttcattttttacccatcccacacatacaaatacaaaaccaaaaaagattataatactctcactttaccaaatcccagtgcaattataccctactttcacaaattacgatacaatgattgcttaaaagtgaacttattttaggacaaatgggaggcaaaaatgaacttattatgggaaggaagaagtattattatgagagagggccccacagaccctcgggcccacatgtcagtgagcagtactgtatggatctcaattggtatattatcttgaatttgttagaactaacctcaagaagatatgtgatctcaaaacctgtcaaatcatccaggaagaagaatctgtgaagacgaaatctagattagatataaacacagtatttagtacacataaacaaaactgccaaaaacaataatgattcttcatcgaagtgaaaaatgaccataaatctagtcaagaaaaaatatattaaacatggcgtaatgcaaaaaaaaaatgtatctctgacatcatgtcatatgattctcacagtgtcagagctaaaactgctgctggaacatttagcaggaacatcttgaagtaatcgacagtcaagtcactgtagacctgcgaaaataacaaatttgttactccaggatagattaactaaacagcatcacattagcacccaaaatagtgatgatgtgaataaggtcatgtctctacaaaatagttctctaagctaaactattcttgttttaattttgacatgacatggtttttgacactagatcatagcatgttgctggaaatattcttatagatatctacacaggggaagctccccatgtagggagatgtgaccatggttactattaatacaaccgtcgctcacatcaagatcaagttgaccaagttctggaatctaattcggccacctgctacagtgctgacttcaaactaccgccaaatgtgcatacaagctctgttttgggtccatgagtacttgatggaaagcatttggaatcctctttccaacagatccaacctcatctccaaattcctagcaagtcatcggcaaatagagaaataaggtattgcgccacttgtcatgggcctttgggcttgtaactttgtttgggaccctggcccaagtgaggcccatgtggggtggaccccaaccaggtggaacacgaccctaggggcccctaggtcgtcaacccaccgccttaaatagctaggtaccccttcagggtttatagggttttgtttatattaaagtttagtttcgctactttgctgtgtaatcccgtgatcggttaaatcgctgatttgctcattacgaaaccccaacttatcatttgtattcaattcttatttgcaatttagattgcttttagcttgttcttgcttgtttcttcgatctacttgcaggattaaggttgatctacaccagctagatcaacaacccacggagagatgtatcgatcgctaaggcgcaacacaacaatgtctcgtacggttgtagggggtcgtcaacgtttctcccaaatcgtagttatattcaactcaccgaaagatcgggtcaatcatagccatgagtgtctcgaatggagcttaggatttatcatcgggaggattggctttcgtgacctttcttggccccggtttcatatacttcttaattatactaccctggggaggtatttccctttggggccgagttcttcgaagaggcataatttaaacacaatactttttgttaaccagatgattgcagcatgcttatcaaaatggaaattgcttaccgtacttttcatgttcaacagtttttattccacaacaatggactgctatttggctaactactttttagggctgctaaactgaagctttactattgtaaattccccatatctgttatgttcaatagattagtgtaataactaaactgcagtttacaaaaaaaaatgaattagtataataaaacaaataagtcaatcccaacctttcgacttcgaagactgcatcttggaccttcttgtacgatttcacttccctctttctggccaagagaaaaaaataataacagattgacaggtaagttcagtctcggatttacattactgctacaatgtatgtcttttatatgtatggtttcatctttaaatctcatttttacactgaagctaactgacaaccaaatatcatgatagaaattactaaaatttaccgtttaactcaaaatgctgagccttataactcatgttttttataaggcaactttagcatcattaccatgctacagcactgagaagtacaattagcggagccccaaatctatcgctgatattaaataataaggtagaatagcattcattttttacagcacttaatattacacattttagcaagtataaggttactagggacaagaaagaccaacccttaatctcagctttagttcatcaaattcagcatctgtcataatggggttgccagccacataagccatggatgcttccaaaagtctttgctcatcagggcctgacgaaaaaaaatattaaataaaaagcaacgattaagcattaacatgacaacattagcatgactgaattaaaaaaaaacctctcctagtattttttttatataaattggacacaaacattcctctgtttgcagttcatccattttcctgtctctcctatcgttttaatgttattggagaaactcaaaatataaagtgtgcagtgttgataagaatgcttacaatcattttctctttttcctgaaaattagcagggatgtctcgcattcacttaatgatggatatatgttgtcttaagaattgagcttccaatgttacttgcattgggtggacataatataacggcaccaatccagcgaacgctatcacaaactcactgtcgtatatcgaacacaagacgatatgaactagtatatccagaacacaaggtatttgtgctgcgataagatggccattttatgtttctcttccattgcgatatatgcggatgggcaaatcgccacgatccacaccttagtgcaccatgatcggttctcagtgtgtgccatcccacacgccccgatcacggcgcatgacacgacatgcgcaaccagacagccagaaaatgatagcagctaaataaactagctacagggatatagataggattatctctgaatttccaacaataatctttttcttttcagcggcatgcacacttatagtgtacagtaagggccgggatctcgtacaagctagaagaaaaggaatattttataccacttacttagcatcacaacgctgcttccttcccacataagctcctccttgaggttatcgaactcctcattcgacattacggccttcttgtcgtaataaaaggcctaaagagaaggaaaaagaggaatctaatcgaattaaattgtgactcaattgacttgtaagtatagtgtatgtaaggtaggaggtagccggattcaacaagagggaagggcagggcagggcacgggcctgcagcgcctggagaaactcctgctccatctccccaatagtcttcttctccttccggttgatgctacagtaggggagcacgttgctgtcgactacaccgtcttcattttcttcttgttgttgctgctgctgcacccctccttgctgatcagcagcctgggcggcccaaacccggtgatggagtctccagccctgacagttggaccaaccgtgcgccgaagatgacgttgtgatgcggcaccggcaccggcacctcgaggacgaggatgtggacgccgcggcggcggcggcggtggggaacaccggactgggtaggagcgaggccatgaaggcacgcgacgccggccaggccagcagctagctaggcgaggcaacaggtactggtagtacaagagagcggcaacgggggaagcggccggatcactgcgcgtgtgcgggagatgcggtcgtgcgaaagggataaggtggtggtggtcttggtgaacgggggagcgatgtgtggtggtctggcgctcccctcctttatactgtgatgatcggaaaattacacgccaacgacaaaatcagacattgacgattggaagaatcgcacggacgaaacggattgacggacgagaaatcttaatcttaactaataataataataattaataataattattaaaagattgatatttttccaatcgtcacccaaaaattatcgtccgtaaatccgagtggcatcctccgtcccgcacacatgtgttcattgcgtcgccaaacaaaaaaaaaacagagacagattcaaaatccttcgcgtaaataacaaattttcccgttcgtcacacagaaattttcgtccgtcctccaaaattttgaccgattcagtgcgcatgctttctgcacgacttgtaggagtccgcatcaaatacaaataatccaaaaaaaaaacaaaattgaacaaatcgatttttaatagaggcaaacaaaaacaaaattgaacaaagacaggcagggaggataccagattcaacaggaaaggaagttggatgcggattcgatttgaactcaaaatcgaataaaattaaccccataaatacacgaaagagttactacaagcaatcgaacaagtcacggagcaattggtgatatctgacctgatttcacggaggcgggtttaattcatctccccatagatgggacaggtcgtaggcggcggttggttcgtgaggaggtggagggggttcggtgggcctccggcgaggaggcggcggcagggctccgcctccgatggggcggaggccatgaggacgtggcggccctcaacggcgagctcctggatgttggggtgtcgagggagccaggcaatgattcctggaggatggcgcattaggagcggcggctcccacatgcgaagacgtcgagaaagcaggcggcggtggcaatcgtgtgaagcggaagcaaggcggggaaaaggactgtaaagtagaaaggggatcgatctgatctaatcgaaccaaggagtggtttttcttcaccgggaaaattaaaaccgaccagttctttttttacaacagaccggttcttttcagaacatggaaaccgacccattatattcctgttctttttctattattttattatgtaggctcccacaaagtaaaaaactactgcacagaaaaaaggaagcaaatcttatcttatcgtatttttctgttcatcacgaaggcgctttcgtccgttggcggggcgtcttcgcagcctccaaatcaatagctctgagtcggatacaggaaacacatcccaaaatcgacacaaccaaaactcaaccactctttgcccaaaaaaaaccaccacaataatcaccaaatcacaaaatacgtcacaaaacttcacaaaaatatacataaaaaagaagaagccgccggatccgccaccagccatcgccacagccaccctccgccgttgccatagccgtcctcggccgtcgcaaccgccgccgacgccaccacagccgtcggagggagtcgccgttgccggatccgaccgcggccgccgccgcctttgccgtgggaggaaggcaaacgggggtggaggaagccgccgccgatccgcccgcggccaccatcaacccgccgcaaccgccgccgtatccaccgagggagaggagaagggggcgagagtggcgagacagtgtagagggagcggctgccggcgagggaggcgagacagcgtggagggagcggccgccgccgccgctcgcggggagagggggaagggcgccacagtagccgctcgtggggggagggcgccgccaacgctgctcggtgggggaggtcgccgctactacgggggtaaggccgccatcgcttttcgattcgagggagagaggggatcggggcgagtggggaggtggggagggaaataaaatctagggttagggtttggctacagatatttatgtaggtttggatcaatctgaaccgtccattcgatcggatggttccgggttctcccgctcgggccgtcggactattgggcctccaaatagacctgcaagtttgcgcaatcagagaaggagttaaaggaggtaaattagactttatttacgggatgagacagtaaaaagactaaaaatggcccatagagaaattggggtttttatttacatttttatttaaataaatgctgaaatgatgtttgtattgtcaaaattagcaatgaagctccgaaaattccaaaaaagtttcaaagagcgttattaatcatggttaatttaataaaaattaaatccaaccatatcatattattttacgacctgcggtgggaaaaggcgcagctactgtcgcttacgttgggagagaaggggtattgtttatgtctagaactatatcttataactcccatggaactataaaataactgtaatcattatcataacagtatttttttcccattgcaacgcactattaaataataatttattatgagctactatattactctctgtcattggagacttcggttaaaaataactttggttaaaaacaaatatttttagtttttttttgaacttaaatatttttagttttaatacaccgtaccgaagcacgggcatttaactatctggtaaaattactaataatcttttaattagttaagattaagattctccgcacgaatctcaatgaacattgaacggtgtagatatgagttgggtttgcaaccggttgcacaaaacgcgcttcccaactccatccatcacggtgcgtcatctcagcctcgcgcatgtagcccgtatctaggtagtttccaaattctaaatttcccgagttaaacacgaaactgaaaggaatcaaactctaatccacccaataaaaaatcagcacaaggatacataggagaagaccatatccaaatttccatctggaaaaaagaaactaaatgactaaatgaatcggactctaatccaactaaaatcggatatgagaatttccaactccaccttgacctccttcttcaagcttgctgctggatcgatggtggctagggatcgcttgatgccgcggtcactagccgcatgcgccctcctcctccaccgctgcccatatcaagagaagatcgggtggtcgccagcctctgcccatcgccagctttgcattgctggccgccctccgtcgtgggcctccactttgcttgtgagaaacttgagaggtgaaggatgggaggaggaggaggaggcagagtgtgccggcggctgctcagatgctcgatctggggttggcaaggttggtttgggaaagatccgggtgagtgtaagcgatagggaggttgaccggtcgcttttctcgccctttatccacgcacgcggatacatcgacaggatagggggagaaaacggtacggtttcccttttctatttttcctacttagttcgcgaaatgaaaatttttatgtgtcacatcggatgtttgactgaatgtcggaagatgtttttggacacgaatgaaaaaactaatttcatagcttacctgaaaaccgcgagacgaatcttttaagcctaattagtccgtgattagccataagtgctacaataacccacatgtgctaatgacggcttaattagtctcaaaagattcatctcgcggtttccaggcgagttctgaaattagttttttcattcatgttcgaaaaccccttccgatatccggtcaaatgtttgatgtgacacccaaaaattttattttccccaactacaacacaccctccttaagctaagcattcaatacagtcagaaactcgtcaaaaaaccttgaatacatgtggaca

SEQ ID NO: 52691 - DNA, 7191 bp, Oryza sativa
acgggacccatttagctccccaaaaatttttcccaaaaacatcacatcgaatctttggacacatgcatgaagcattaaatatagataaaaagaaaaaactaattgcacagttatggaggaaatcgtgaggcgaatcttttaagcctaattagtccgtgattagccataagtgctacaataacccacatgtgctaatgacggcttaattagtctcaaaagattcatctcgcggtttccaggcgagttctgaaattagttttttcattcatgttcgaaaaccccttccgatatccggtcaaatgtttgatgtgacacccaaaaattttattttccccaactacaacacaccctccttaagctaagcattcaatacagtcagaaactcgtcaaaaaaccttgaatacatgtggacaaaaaactgatctctgcaaagttcagaaaacgatgaacagagaaggacgcgttctctcgtacgatcctgaatagtaaacaacaagcaccataaatggactacgtgtagcttatgcaaatctttacgcattaggatgtgtttagtcacactaaaattaaaagtttagttgaaattggaatgatgtgacggaaaagttggaagtttaagtgtgtggaaagttttgatgtgatggaaaagttggaagtttgaagaaaaactttggaactaaggctatgttagatccaaacttccaactttttcatcacatcaacctatcatacacgcaactttttagtcacatcatatcagttttaacccaaactttcaactttagaattaactaaacacaaacttagtttagctcgatcaacgtaccgaaaaaacctactactccctcagtcctacaatataaaggattttgagttttttattgtaacgttgaccactcgttttattcaattttttttttgcaaatataaaaaacgaaaagttgtgcttaaaatactgtagataataaagtaagtcacaaataaaataaataataattttaaaaaattttaaataagacgagcggttaaacattataagaaaaacttaaaatcccttaatattattatgggacggagggagtattagagtttagtggtaatctcagaggtcagcgacaaacatcccgtgtagttttgctttgttgcctctgaaaagcgcgtcagtttctgaaaatctgaatctttctttttttatttcttgagctgctgtctgctgctaggtgagtcctccgagtgcattgaatcgatttcgacgcgcatctcgccttgtcgtttgcgatgtgcatgagtgatctctacgatacccgagtgatgtctgtctctgaatcttcagactttggaatgagctgtaatctgtaggtccatcacttctcagaagcccaccaccatagtagaaagagggttcagtagaatgtattctggttcgctaaaatatcactctaaaataaaaataatatgttagaatattagttatgaaggtattttgtaaatgacacgctaaaaagttgacattccgatgaaatctatgatagcataatatcgattttgtccctagctacagactttccctggatcaagaacagcaaaatgattcagaaaagtgacaagtttttgtgtgagcactggaggcagtgttcaagatggtcattgaagtgattactgatcctgacattatgaaggatttattggccaggcggagaggaggacgtatgctcagcttgacagcttgctgtagcaaaagaaggaagatgcaattggttaataatggccctgcctaactaattcagacattgcaatttgttgcatgatacgactcttatggaccatcatatatatcgctacctgttgtggtctcgccttctttttaatttggtcagtgccatggtcgatcgatcagcaatgatcatcacttcatcagcatgcatgcatgaccgtgccattataaactaaactataaattctcagaaactaaggtcactatcactgccttattataccaaggtctcatcaaccacactaatatctctctgtagttaattcagacaatcagttaccactggaagcactactactattcacctttgcactatggacgcacggtgatagagccagcgacacgccaacaccgttgaacctgaactacaaatagtgtttttcgatgatcagccattttttttcaaatatcaacgatattcgagaaaatagttggcagtgaggacgcaacgacaatactactaagtattttgtagtcacaagaaacatggtcgaatgtagtgttcctcgagtccggaataccgtcccaaaacacgggggacattttcatcccatcatgtaaaaacatctcataagtagcatatcacttttctcgatcccaccaacttaggaatttcgtgactatacacggatttcttttttttctaacagtcaaaccgttaccgacattttatatatagaagaagtgtcccattttaaggagagaacgggaccaaaccgtacaatgcaccattaattagagaaaactaggtaaaaaccacaactattacgacattccaccaactaaactaagctaccaaaaaaacgagagcaggacaaccgagctctacgtactcaacaaaagccattcatgtacaacaagctaaaagaaaacagggctcccatacactggcaaagacgcaatgttatcgtcatcacaccaatacttgggcgactccgactttatcagaaaataccagggttaggacaacaacctagtccatactgaagcgcaactcaattagggtgtgtttagttggggaaaatgaattttttgagtgtcacatcgaacgtttgaccggatgtcggaaggagttttcggacacgaataaaaaaactaatttcagaactcacctggaaaccgcgagacgaatcttttgagactaattaagccatcattagcatatatgggttactatagcacttatggctaatcacggactaattatgcttaaaaggttcgtctcgcgatttctcccataactgtgcaattaattttttttatctatatttaatgcttcatacatgtggccaaaaattcgatgcgatgtttttgggaaaaattttcggggaactaacaggcccttagactgatgtcatcgttgccacacaactcaactagaccatacactgactatagttgcgtgcagctagctgtgtgttggatgcacacggactacttcagccggcggcggccggccgccgccggtctgatatcccggcggccaaccaccgtctcccgtttccggcgtgcggccgccgcgcgcgtggggtcgcacgtggctgcacattgcgatcgatatcgatcatacggcgacgacagtaatggcgctagcttagtacgaagctagctagctattaccacgtatataccacgtaccaaccgttggatggatgaagaatgctgtagtacatgcgtgcatgtgagttgctgacctttgtcatcaaatcgatcatgaattcaggactagaataccaatttttggagtcttggaagagcaactactaattaaatcacacatcagtttgacataaagaaatgatacagaaatgcagaaagtttcttcagagtcgcattgattatactaaacaggagtgatttacaagtgagtccatcggctcaacttgccctaatttgctagcccattgccatgatgtgattaattaagcgctgtgatttattataatcacttcatgaactcaaagctttgcataggggcttaggctatatactgatactctactacttgtcctgactcctgtatggcttgtcattaggattatctaactttgtcagattggcctatgggaagacactttcccttttcgtgttgatgaagtatggaggtaaatgtaattaaattaaaaggaaaatgcattagaaaatccggccagcaaattaaaccatgttcaaaagtctccaaagcaccatcagttcatccgttcacaccctttccaaactgtcatccaactcatcagagttgaatactgggcaaagtacaacgtacatagtatgcattgcatgttaagaaagacaagtacttttctgaaagataagaaaacggcaattatttagtactagatactcccgccgtttctaagggtgtgttagttcacgccaaaattgaaagtttggttgaaattgaaacgatttgacgaaaaagttgaaagtttatgtgtgtaggaaaattttgatgtgatggaaaagttggaagtttaaaactaaacacagtgaaaatatttgacgccgttgacttttttaaatatgtttgaccgttcgtcttattcaaaaacttttgtgaaatatgtaaaactatatgtatacataaaagtatatgtaacaataaatcaaatgataagaaaataattaataattacttaaatttttagaataagacgaacggtcaaacatgtttaaaaaagtcaacggcgttaaatatttagaaacggagggagtagtactgagtatatattccctttaatttgggttttaatgtttgacgccgttcagttttgaatttatgtttgaccattcatcttattctctttaaaatataagttgtgtttatttttctaatagtaaaataaattaaatataataaataataataacatgatcttttaaaataagacgaataattaaacatatgtctaaaagtagataacaacaaacattgaaaatcggaaggagggagagcacgattaatcacaaagacgaggataagctagctaattataaggtagaccccatcaatgctcaccatgttatcgtgggctatataccaaatggaaaatttcatattagtttggacctttccactttgatctattttattcacctagatgtcattattcattaagccaattaggtctagatcaagagatcgcttctcaggtactcgattgatctctccattctagacgctgttcataatgctcatagttgcactggcaatttggcacctaaatattcatatatgcacataaatacttatatttcaacttgtttaatgagtaaatgatactgttataactacatgatgtttgccttccatgatgttcatggagtttggtctgccaatagtcattttgcttttttttttatctctttgtttgtaactatcccgtagacgaggtcatcaatgaagacctgtggaggtttgtctatcgggtcgtcgatgatcaaatcggtggtgctaactttgggttcaggtttccaacttgttcaatgacctcggtttgttattctgtcgaaagaataaagacggtggtcagcgtttatttatttggtttttcttcaaaaaacttttttcaggtgctagatcaagtaggttaatgtctcttataggttgtgtttagttcataccaaaattggaagtttgattaaaattggaatgatatgatggaaaagttgtaagtttgaagaaaaactttgaaactaaacacggcgatagtatctcttgtagcattctgagatatggaggccgagtttagttctaatttttttcttcaaactttcaacttttccatcgtatcaaaatttttctacacacaagtttccaacttttccatcgtgtcgttccaatttcaacaaaacttccaattttgttgtgaactaagggtgtgtttagttcacgtcaaaattagaagtttgattgaaattggaacgatgtgacagaaaagttggaagtttgtgtgtgtaggaaagtttcgatgtgatgaaaaagttggaagtttgaagaaaaagttgggaactaaaccaggcctaaacacacccggagtctctttgtcctattttgataaatattttctttctattcctcaaaatggtacaactgttatcgacctcacttataatccatcctaaggctgagtttgagaggagcgaaaagttgatacgtaaattgatatgagccattagcatattattaattaagagttaattgtttcaaatttaaaaataaattaaaacaatttttaagtaactttactatagattattttttaaaaaaccgcagcctttcaagagtttggaaacatgcgcagagaaaacaagaaattttctcaccatttcttgctcactccaactctacccaacacgggaaaaaaaaagatataactacattttcatcaactcagaaatgaaaccgcgttggactacaaaactacaaggctcatgtccaacctgcttttttccccctctttttgagagggtgtatatgtacagtactcctacgtaccgtgtgggcaagtgctttgagttgattggccggccactacctggcaaagcaacccagataaatccactctcacctcgacgcggtgatttctgacacgcccgcacgccgcagctgcgcgtctcccccaacccacacgcacacacggttgcgtcgccgctgcacccaaactcagcttgttttgccggtaaaacgacccaaatccgcggtccctcccgcgcctcctccgcccgctgcccaccacgccgcgtgttattatagccaccacctctcactcacctcactccactctcactctcacactctcgcgcacgcggtcgaacaccttggcagcaaacagcagcagcagcagatgatgccgcactccggcgtggtggacgcggcggcgaagggggtgaagctggggggcggtggtggcggggcgctgatggtgcgccgggtggcgagcggcaagctcctgtcggcgtcgtcgcacctgctgttccgggcaaccatcctggcgacgctctgcctcgtctgcctcttcaccgtgcactacccgtcgctgctgtcccactccttccacctctcctccgccgccgccgccgcgaacgggaagcacagggcggcgtcgcggtcgtcgcaccggagcttgcttgggtcgtcggcggcggtggcgtatgggggcgcggcgtgggagaaggaggtgaggaggagcgcggcgccgaggagggacgggggcttgtcggtgctggtgacgggcgccgccgggttcgtcggcgcgcactgctcgctggcgctccgggcgcgcggggacggcgtggtggggctcgacaacttcaactcctactacgacccgtccctgaagcgggcgcggcagcgactgctggcgtcgcgcggcgtcgccgtgctcgacgccgacatcaacgacgccgcgctgctg

SEQ ID NO: 52692 - DNA, 8459 bp, Oryza sativa
gcccacgcgtacaaccacatctacggcctctccatcaccggcctccgcttcttcaccgtgtacgggccgtggggccgccccgacatggcctacttctccttcgcccgcagcatcgtcgctggcgagcccatcacgctgttccgcaccgccgacggcgccgacgcgcgccgcgacttcacctacatcgacgacgtcgtcaagggctgcctcggcgcgctcgacacggccggcgagagcaccggcaccaagtccggcaagaagcgcggcccggcgccgctccgcgtctacaacctcggcaacacctcgccggtgccggtcacccgcatggtcgccatcctcgagaagctcctcggcaggaaggcgaacaagcgcgtcgtcaccatgcccagcaatggcgacgtgccgttcacccacgccaacgtcagccacgccgcgcgcgacttcggctaccgcccggcgacccccctcgacgccggcctccgccgcttcgtcgactggttcgtccactactacaagctcgacacggccaagatcgccaagggcaagaggaaatccatggccatgtccgccgcgtcgtgacgtgtccacccaattgtccttggaggctagcactcgtcctgcaacttttttcagtgctaatttgtttaaaagattgctgctttgtttctccatgatggatgcaatcaaccatgctgaattttgcttatgctgcttaagcaaaatccatggctagtagagagaaaaagaaatggactggagtatagataagatgacagagcaaaaaaaggaaggagccagggcagaagaagaaagatgatgtcactggaatccttctggtttagaatattttcctctgaacttattcttttcagttaattaccatcttgttcttgttcatttggtctcatttggtgtgattcctgaatgatcatgccagcaacaagaacacaagatgctgtagtgggtgtaaatccaagcagcttcaggctgccataaaaaaatttatatatatactttaaattttggcggtggactttgctgcgatttctttctgcatttataaaacctgtccagttttgggcactgttctctgaaccagagcatcttactgcatgtggagtgtttgtgaattctgtgtgtgtgtgacttgcttctgatttctctggcactatctgtgagagattggtagtggaattggatagttggtgatggaatggaatacaatcgtttgggaatcgatgctgctgctttttagatagcatccatgaaaggttgaagggagcattgagcattttggtacagtgactgactacagtgatgcagcccccagttcatgctgttcagaaagcaactcctgatgatgtgtccatcatcaaaaatctcctaccaaatacagtaattcttgagcttcaagctgttttgtatgttcatttcggccgtgtttagttccaaagtttttcttcaaacttccaacttttccatcacatcaaaacttttctacacacataaacttccaactttttcgtcacatcgttccaatttcaaccaaacttccaattttggtgtgacttcactatctatatttaacattctgactgatgcattagtgtgaattctgaattcataagggggaagtgtgagtggaagattgctgcaacgtgtgtacacattggattcctgcttaacccaatttgctcttgtccactcctgccttcacagttcacaccattgatcttagataagcttagctaatgtgttcatgtcatgctgaggcaatcctgtgaagtgtgaagagaaatgcattgggcatggctagcaagataggaccacagagaataatacattatgcacaaaaaaactacatggagccctctgaaagtctgatgagctgtggtgatgatgaagaacaaaatctgcctgcctgcacatctttttcagcatatgaaaaatggaatatctatcagcagctggccagggagacaatttggacctgatgcttgccatccttaaaaatactaataaaaaaagttcaggtttggcattgtgctccaggacaatcactttattagttgaagtaactgaacatgttattcacctgcttcatgtcaaaaagggtcctgtttttattacagcattacttctataacctatcacatttcaactaaactactcaataaggccaataaatatctagtatcacctcttgaactgcattgctcaccggattggtactaccgatctagcctggctgttactgtatcataagcttggtccccatggacaaggtgagctggagaaattagccagtcattgactagtataagcataaggttaggcaaatattgacctcatccagactttggtcccctttgtgcctcaccacttgcaaatttctgaccctttttcacaggtaggagacaacttatgtactgctgagattgttgcttgtcttttcctttaactgcatccagtctaaattgatttccctcatgtgctgttcatcctaaatctcatgtgataaattggttgtctgtacctcggcactgtacatatggagccagattgtgaaattgtggccagctccctgacccattgatcatcaaagaattggttaatggatttaactctgtctgtactgctgctactacagtaccactacctgtgccttccaaacagcattcaaagctcaccttttcttttcttaaccatttgctgggcaggatgaatctcatatgttaactgaaaatgactcgtacatctttgatcgcatcctctctgtatccgagaagcctagttgcaaactacatatctttcagaaaagaaacatcgtactaggagttgcttttctgaagctttaattcttttttattagctaatttcaggattccagcttccaagatcaccatttggacctgcactagttgagtggacagtggcaaaagctaagatttggagccttttcttttggtgatattgtagtacacctatgctctcttgctcactcatcttgtaccattatctcgatcacaagtttcaagccatgcatcgatcggtgcaggaatgggcaggctcaacctttcgctttccctgatcgatcttggatcaagggacaccactgtctgatgaaaaaggatatcctaattcatcatctacagttttaactatctagatgagccaccttccattttacctttcgcttttgctgtcttgctatcttctctttttttttcatcttttttttttcttttgtaaagataacccacgttgcaatgacttcttctagacgttcatgacttcagacttcagagttcagccccatctgtcaattacggagctaaaatgagtgtgttttcctgcaggacgatttcttttttctgaaacatgacagtaatatttttttcaggttttttttctcttgaaccctaatctctgaaacaatgatggttcgtctgtacaatggagtccatttagccaatgaaataaaaagcaaagtgatcagtcagaccgacctcccagatctcccaactctgaatcaaaattgactccgtgagattgtgctgtccatcctaactgtaaattgaaaacaatgaacatgatgcatctacttctgcactctgaatctctggaggaaaacctggggagttaatgagatctcaactgtcacacacttggtagttagcagaggccagcaaagccaagccaagccaaattttccctcctttgaacacataaccaaactcatctaccatcacagcctgttctgtatgtcctaactggcctctactgaatgtctgaatctgcattggttattcatgtttctgtcccttgaaaacgaagcgacatcatgaatcacagagcatatgtcaacgcaatcaggagaccttttggtggccatgattcttggaagatgcagccttgatatctgtcactcactaactcagtcactcactgatcagtcagaagccactactggtagtgagaggagttgactgtgagaaagtaaggctcagtgctgtggctcaccgtcgttttcacctgagatcatcatcatcatcaccaggtgtccgtacgccggaggcgccgccgccgcggtgacgaggccttggcacgattgcaaggtggagatgggccggctgggcctgaccgtggctgatttgacggcccagattgggtttgggcctccatggtattagcgtggcgcgcaataagttcactttgggtccctctatttgtcgcccagtccaatttatgtcccttgctaaccgggtaaacaagtccctcggcggttttgaagacgattttgactgacgttgcgcttacgtggcttgtttgactaggtcttcgtcccacgtggcattgatgtggcgcttacgtgtcaattatatctcggaaaaataataaaaagcgtggtcccacatgtcagcggtacacaaaagtattttataaatggtggggcccacgtgggccccacatgtcaacctcacacctctcttcttccctccaccttctctcacttcttcctttcccctctctctctctccttcccgggctgccgacggcgcgggtgggcggaggagcaggcgagctccggcggcggcggcgggatgcggcggcgagcgtggtcggcgccgccccctgaccgaagcgcgttggaggcaaagaaggtttcgagggaggagcagttggcgatggcgtcggggacgggccatggctggatggggaggttgtctatgctgagatactgcagtgaggtgaggccaaggaggaagtcgggtggtagggaggtgaaggcgttgccgtcgagggcgaggcgggtgagggaggccatcccggcgagggaagggacggcgccggcgagcgcgttcccctggagctgcagcgcggtgagcgaggtgagggaggagagcgtgccggcgagcgccctgtcggcgaggttgagctccgtcaccttccccgacccgccccgctcgcaggtgacaccctcgaagctgcacacgttgtcgccatcccaccctagggccgggaccgacttggccaggtcgtggatggcgtccgcttcggaagccgactcggcgacgccgacggcggcaacgacgaggaggaggaggagggttaggaggtgggggaggcggtgggggatttggggcgaagagagagagagagagagggtatttttggggaggaggaagggttggtttggccgattccgacgtcgcggcgctcgccgactccgaccgcccggcgtgcgcacttctccggtcacccgccgccaacgccgcgctttccgcggcgctccggtcgggggcggcaccgaccacgcccgccgccgccgccggagctcgcctgctcctcggcccacccacgccgtcggcagcccgggaaggagagagagaggggaaaggaagaagagagagaagggagagggaagaagagaggtgtgaggttgatgtgggccccaccacttataaaatatttttgtgtacagctgacatgtgggaccacgctttttattattttttcgagatataattgaaacgtaagcgccacgtcaatgctacgtgggacgaagacctagtcagacaagccatgtaagcgccacgtcagccaaaaccgcattcaaaaccgccgagggatctcatttgcctggttttagtaaattgagggatgagtcgtacccggttttacggttaagagacgaaaatcggactaggcgacaaatagagagacccaaagtgaacttattccgcgtggcgccgccttcgtcgtagtcctaaatcgtacggtcattcgtccgtagcagcgacaagtctacaccgactgggttcttttatactttagtccttcctaaaacttacaaataatccctcaaaaaaaatattgctctgcgttcatgtaagaaaaaaatatttacattctaatcattctcagatccatttacaaacaaatctgtcactggtatcaatcccttttcacaccaataacatatctcaggagaacgaggatatcaacgagacattaaatctcggcgtcaataacattacactaaggcctctcacggtgcactgagctggcgcggaacctcgttacgccagctcagtttttggtcgacgtggagggagggaccgcgcctttgctaggtttcccgtcccctacctaagcggcgcaatacttcgttgcagcgagggcgcgagcggccggggaaaagggaggcacgcgcgctgtgggcatttcttcgctgccccatgccctcgcgccgaatccacctgtagaaaaccccaaatcgccctccaaagaaatcattgacgaacagaaatccccccaaacgcgtaggaaaatccccccaaacgcccaccacagatttggtagagaaaagcaaagcaacaaaatttctctgagtcatttggtagagaaaaggaagggggaaatcagtgaggtggagaagccgtccgctcccgccgccggccgcccgtcggcgtcgcgccgtccattcccgccgaccctggccagatccaacgctaagccgccccacgctctggctgctcgccgccacaccgcaccagcagcagccgccgccggggacacctcacgctgtcgccacggacaccgacgccctactccctcgcccgcatgccggtgagcccgatgtagctggtgaccaacctccttcggcgagcgagcggcatcagcacgagccggggacgcctcccgccgccgcgccagccgccaccgcaggggacgcctcccgccgccccgggaggagaggtaggcgacgagatggagcggaggaggagaagaggttgagaaagaagggcgaggaagagagaagctctggaggggtaggtgaggaaataaatttccttgcgcttcaccggctgctcgccctagggtcacgccccactgtgggctttatttccttcatccgtgtctccattcaattaagccacatacatatgggtgcttgcactgtggggtgactgtctttggaccaattttttgtgttaggggtatgggtcccatagtttgcactgcgagaggctaaggctgcgttcctcctcccggcgcgcaaaacgaaacacacgttattgcataattaattaagtattagctaatttttttaaaaaaatagataaatttatttttttaagcaaccttcatatagaaactttttacaaaaagcacaccatttagcagtttgaaaagcgtgcgcgcggaaaacgagggagaggggttgagaactcgaaggaaagaacacagcctaagaaaagagtctatttgtaaaatatttttttttctaaaaatttatttataaaataactttttatagagggctactgtataatacaactccataaaacatccagtctacagtctaccatgcaacaaaccgaatgacggaaggatgatgaatcactgcagtggtagctcgacacctgtaacccaaacatggtgttcgtccgcttcctccacgtctcctcctccagcagcagcagctgtagcaagtagtacacctcacctcctcctcctcctcctcctgcgtcgccgcctcgcactcgcaggttttcgctgcggcgaagcaaccaaccaatccccaaagagagcgagagaagaagcgaagaggaaagtctcaggaccgagagagataggcgaaatcccgctgatcgagttcgcgttcttgggaaatttttctgggagttcttcgaagaatccgccactgaccacgacgacggattggaggcgtggagtgccaaagattcgctagatcggggggcctcttcctagtaggttttggttcaagatcgagaggaagcagtttgtgagggtttccggtgcccgatacttttttttttccggaagcttcggcggcggcggcggtggtgttgatgcgctgcgtctccggcgccactgctgcggtcggcggcgccggtggagattgcagcgactcagatcgcggcggtgccgtgccggggtttcagtttcatctgctgtggctgtggttggggatcggtggtggggagtgagcagatggaagaggattgcacgtactgttcatgccaccacttggattctcctcaaattagagagtaatcaagagcaatctggtgtttctgagagctggatcgctccaagcagtcacagaatcgggagatttttttgtttaggtctagatgtagtattttgtgttttgaggattgatttgtgcatctgagtgtttggaaatcggggttacggcgcaccggcctcgcgcagttgccggcgctggggatgatatgctagagaggggatatgttgcatgagaaagaattcaagcatttgttgggagaatctgttgagctgctttgctggggattcagttttgtgattgatcttccaggaggggcacaatgtccaggtgtttcccattcccgccgcctgggtatgaggcgaagcctaggagtgagcataatgatctgctaaagaag

SEQ ID NO: 52693 - DNA, 7876 bp, Oryza sativa
tggtttagatattaaattctgttttatatttatgtattgccatatcatccaccaccaaacctggtatactatgtgcattccgatttaggttccttcattaatgataaaaattatgattaactggttactaggaaaatggtttgcggtaaacatgtgaatttcatgtttatttcttctgctatatgtcaatcaatgttgaatatgcaccacgttttttccagggaaaacacaaggagaagaagcacaaaaaggaaagtaaggaaaggagaggacgagaaagaaaagaaaagaatagcgatcgtaggaaagataagcacagcaagaagcacaaaagagagaagcacaaagataagagaaagaacaaggatgatgatagatacacaaatcaaactttggaaaaagcaactctgaggaatgcagatctcgacaatggaaggcttaaagaaaaaatacaacacgaagctgtcaaagatattaaacctgcaaatgagttggttacccaaatcctagatcaagaaggtcatgcaaaccacacaagcagtagtactggcaagttgctccctagtaccaaaagctttggttctgcaggttctaaagggaagaaaagatctttgagcagtgtgattgagaaatccagacaacccacacatctcaatcatgagatgatagagaagaaatatagtgttgcttatgactgtgctagccttgggtctaaacctcgattacagaatgggaggagccttcaagttggatctgccgaaaagcactcgaatacaaatagaaagcacagtcataacagaatggaccgaccacaaagaaatactgaaggtacaagtactattaccacggttgtatcaggtgcagagagggctccaaatggcgtagttacaccaagtccaaattccttgctgagaacagaacaagtgggccaagatccagtggtttcttcccattttccttctagaaatagtgacagcatgagccccagagggctgatggagatcaggaatggaaataatagcgatttccagatcagaatggatcggcaatcagtacgcagtaaagctggagcagttaaaaggaagggaaagactaaagagctgaaaagtaatgatcacaagtatgttgaagacaaagatagggatcggcttgcaaatgaaagaaagactaaagacagaattgaagagaaagaaaaggtgggaaaagttgttgtaagtaagcaggaatgcaaagaacttgattctcttggcgcaagcaagaataagatagatggtttgcagcggcagttgggtcaacttaatgaggagttcacttctgatgatgtcaagaaaaggaaagatgccgaggctaacagttctctacttggtaagatcctcttccttatgagtgcccaaagagcatttcttttcttgttatcgataactgaatcatttgatgtttgacacataatagtatgtttgaatagtccactagatattattttaattccatttactctcacaatatgttggcagtggcagagcatagtatgcgaatgaataagttgccaaggatatctcctactgatcctcgtacaaatggtgaaatattggactattctcaagggagtggacctagttcacctgttgggacgaatacttataaggcagatagatttcaagatagcaaggaatgctacaataacggcgtcactggttctcatcatctcaaggaactgaaaacttcggtttcttcatccaaccatggaagtagccaagtctctccgaaaccgcctcatcctgatgccaagtatctgggccaagtgtactctataccagcaatggatgactggtctaagtgcattgatcaaagctggctattgtccaggggtagtgttgactggaaatcagagatattggaggctgcagaatcaccccgagtctgggctgaagcgcgactgatcgattccgcagacgtagttgccttgccttacgttgttcccctataataatgtggtactcccatcatgatgcacatggcgaaaaacttccagattttgtgatgtgatctggaactcgcctgttcggtttgcttcctgctggctgtacacatgaggtcattcaaaataattctaaattcccatcgcatcgcctaacgaagatcgaagatcagagtgttatacatcaaacaacttctcagctgggagtgttactcctgcattgctctacaatttttgggtcatgtaatttgatctttcacagaatctatagcgaggtaagaaagcgaaaccggcgccgcaaaatatcttgaaactctgcttgttcatatcctgttcttctgattaaagaacagcttagcttgagattgttctgttcacttgcaatttgcaggagtaacaaacgcttatttttgcatttctgtatcttactatcctttctacataaatactgtgattatctgaacaagattccacgatggagtgtctggacttctggagatgtttatcgatgtgatttctgattctgtgatatatgaattgattcatgtgaaactccaataaaatcggaaagcttcgaacaagcattaaaatccagcacacactctattgggccggtctctgcaagcccaaattcaaattagcctgcaaggttacgtgcctgtaattgaatctctcccatatttttttgctaaattttgtttcgttttgaattcaaagcttatctaaaactatctcttcctaaaaatcctcagaccgaagtgatcaacaacctaccaataaaatcataacaacttaacaaaacacggaaaagaaaagaaaaaaaataaattaaaaaaaaaaagcagagatgtcttcttcctccctcgccgccgccgccgccgccgccttcctcctcgccgtcgccatgtcgtgccattgccatggtgatgatcacctcacctcgcgcctcgacgatttcatggcgttgagctaatgcctaatggcttctgttgctttgcattgcagaggcgcgagggtggggcggactcggcgtcaactacggcacggtcgccgacgacctccccacggcggcgcgctccgtcgagctcctccgcgcggcgggcgcgggggcggtgaggatctacgacgcgaacgcggacatcctgcgcgcgctcgccgggacgggcgtgccggtgtccgtcacggtgccgaacgacgccatcccgtcgctcgccgcggcggcgtcgcccgccgccgtggacgagtgggtggcgcgcaacctcgcgccgcacatcccggcggcgcgggtgctgtgcctgctcgtcgggaacgaggtgctctccgaccgcgccaccgcggggaccgcgtggcccagcctcgtgccggcgatggccaacctccgccgcgcgctctccgcgcgcggtctcggccgcgtcaaggtcgggacgacgctcgccatggacgcgctcggtacctcctacccgccgtccgccggcgcgttccgcgacgacatcgccggcgccgtcgtgcggccgctgctcgagttcctgaacgccacgggctcgtactacttcgtcgacgcctacccgtacttcgcctgggcggcgaaccaccgctccatctcgctggactacgccctgttccagggcgaggcgagcacccactacgtcgacccgggcacgggcctcacatacaccaacctgttcgaccaaatgctcgacgcggtcgtcgccgccatggcgaggctcgggtacgggaacgtgaagctggcggtctcggagaccgggtggccgaccgccggcgacgcggacgagctcggcgcgaacgtccacaacgccgccacctacaaccgcaacctcgccgcgcggatggccaagaaccccggcacgccggcgcggccgggagccgagataccggtgttcctcttctccctctacaacgagaaccgcaagccggggccgggcaccgagcggcactggggtctctactacccgaacgcgacgtgggtctacgaggtggacctcgccgggcggcggccggcggcgtcgtacccgccgctggcgcccacgccgccggcgccggaccaggacgggactcccgtgtggtgcgttcttgccggcggcggcggcgaggcggcgaacgagacggcggtggcggccgccgtggagtacgcgtgccggcagcggagcgggacgtgcgccgccatcgaggccggcggcgagtgcaaccagccggacacgctcgccgcgcacgcgagctacgcgttcaatgcgtattggcagctgttcaggaaagctggtggcacctgctacttcaacggccttgcagagaagaccaccatagatccaagtaagttactgctccctccgtttcttgttataaatcgttttgaatttttttagctaaactttttttaagttagatttgtataaaaaaatatagcagcatttcaaacataaagaaaatatattatcattatatattcaatgttacatttaatgatgctaattcggtgttttaaatgttgttaaaattttctataaaattcctcaaacataaagaagtttgactatgaaaaaagtcaaagttattaattatccatttgtgttattcaaaacaagcaaactaatctatagaaattggtgattgctatattgatattgtttgctgtttaagctaatcttcaagttggtgatttgctagttagattggcattactgttttagatttgtgctcattatggttagtcgatgaagtaggttaaattcggtgtttattagtgaggagaaggttttaatgtgttaatgccttctgcaaaacgtaaggaccaattgcagtatcataaaataaaaattatggatcttgaggctaagaaacaaatatagttgagcctccggtgcccatcactcttcactgggatgttggaagctggaatgagcacagctgcatcaatctaacagaatcatataattagtggctgttgctttcaactaatatatagatagctacatgtttattatcatgtactgtatattaatgccgtgccatccactgcttcatttcataaattcttgttggaatgtggccaacttgcaacctgcaaatgtatgcttgtatttttaattttgcaaagggcatgcccaaaaactaactatgatggatttccaattgatcgaaacggccaacagtctatcaattgattttagcattttagtttagttttagtgtgatccaatttgccttgcacattattcttgaaaccctgcctattcctaatttcctgtcagtggaaagtatctgctgcaaagctctgctaattaatgatttcaacgtctttccgccttcaatgagatcaatctaattgctggcgctcatgcattagtgcattagcttgttagataaaagtgaaaaaaaaaacgcgaacgttaggaaaggacctaatatcaaataattagaagaagtgatatcgtctagaccaccatcttatgaagctagctggaaaactcctgaacttttctgtgtctacccaacaacttacaatttatatgcatgtcagcctttgcactcagaagtaaacatgcaaaaccatttgttaacctgcaatgtgatcgcgcagttcctagcttggtggaattcagagtttcagctctaaactgtgctcagaagcaaaatgtatagaaattttatcttcagtctttcactcgtatgctcttatgtcattgtcaactatggtacgactagatctgctatttccatgaacaattttttgtcctctagagaaaagggaaaaaagaccggcaagatatattttttaagataatagaatataatatcccgacaagatatttatcttccgtttacatccttactggttaatgattggttgctaatgtagtaacaagggtgtgttttgcaggccatggatcttgcaagttcattagttctttggattagttatatgcaaaagaagattgacagagcacgatgactggattaggaggaatgaaggtcattgcctatatgacctcagattaattgttctacatgcctctgaagcaagcaaagaatcacctgtgattgatcagcttcaaattgatctcagtttttaaccaagtttttttataactttttttaaccaagttaaattttgtttcctcatctttctcctcaaaaagtaaaagaaaatgttagttcaaaacccaaaatgagtagctttaattatatgtcattcacttggattcaagttctgcttgtttggtagataccaggattacccttagacattgttcggttaatccccaagagaaaaagattagtgtgactgatggaaattaatgtggaattattcctctctaaattttgctcaatcctcttattgatgggattaaacaattctcctcaatcctcttataataagaaaagaggagtaaggttgtgctagtttgtgcctgttgggagcctatccctccggcacgaaaaacgaaatagcttattatcgcataattaattaaatattagctaaaactaacttaaaaaatggattaatataattatttaagcaactttcctataatttatttttgcaaaaaacataccgtttagtagtttgaaaagtgtgctcgcagaaaacgatgtagattagttgagaacaacccaaaagaacacagcttaagtctgctttgcttagcaaagtaaccggacaataaccgtatgtaagggaaacctagttgatacgcaactttgacacaaccaaaataacataaacaaaactacaaaagcgtagcatcaaaaacaaaattgtgggtgaccgttcgttggttggaagagtaggcaaatcaatcgaacaatttttttgtactttacaaacatggccaaacaatctctgaagaaactttgtcgtgagctgttgcaacgtgacaagactcaagctgtccttgccggctccaatggctgtccccatgtttcctccccaatcacatggagagtgatctgatgcacgctttgtagggccccgatccgacggccctcgatcgttggctgtttgatatccaacggcccggatggcgagcagggttcacaaatgcgacgataaccgctcaattattgcacttgcaaatttagaaaccactcgaaccggtcaaatttaaactaaaaggttgacaaattttatccgaagttaaccctttttggtcattaatggttgcgaaagagtaatgtcataatgcacttttaaaagaatctttattaaaatcttggtaaaaaataatttaaccattgaattcaattaatggttggttgaaaatcaagattcagttataatataccacatcagttttttcaaatttttgtatgcgtatgatttccaaatacaaacaatgtgagacgcacttgatagtgaaagtgaggtggcaaacgtgtgactatagggaagcttctagctggagcaatttcttctagaatcagaagctcccttaaacagcccaatttttagtctaaattctaagaaattataatcgtagaatccataaaataaactaaaagtcataagccagaaaacccaggtttttcagattctcagaagctggttatcaaccaattacttctcagaattttaaactccccaaacaggctcataaattcttctaattatttggttgccctattttgtttttagatacgaagaatgcaaaatcacgagacaaaacacaaagcaggacacagtcacacaggctacctcaccaaatcggccggagcaaaggatcctcccttctctctctctctctctctctctctctctctctctctctctctctctcttttggctgcctgtcacgtgggccccaccgtcaccggtgaaagaatcttgacgggttagttacttggttggttggtttgttaccgcctttttgacgcccgcat

SEQ ID NO: 52694 - DNA, 18471 bp, Oryza sativa
agggaacccacatggtgtgccacctgtgcgggtaccagtacccgaacgcgcaccccagcgcgaagcagcggcgtgcgcaccgcaagaactgcggcaacccgtcgtcgccgtcccccaccgccgccgctgcccacgccgccgtggaggagggcgacgggaagaggctgctgctgctgcgaggtacaaagcaagaactgctgccgccgccgccgtcgttcgcgggtgattgatgcggttttgcgttttccagatgacggtgaagaggcggcggcgggaggaggaggaggaggaggagatgtgggagatggcgcgagcgcggtggcggcggattccggtggcgtcttgcccggatctgcgcgggaggttgggaatgtagcggatgacgatggcaatgcaggttctttctggatattttgctccccccctgaatattcttgttttttctcctttgtttttgttggtttctgaaaaggaaaattttggtagagattcgatttgtgaagggtttgttgtttgattcccaattatgtttttattgacaacaacttccatcaatcagtgaaattgtactgttgttgctgaggctggaattgaggtctgtggtgaaattttttattaccatatgcaaatgttcagagcatgtggggtgttcttgtcatcttcagggttaggctaatgttctgttggattagtgatgatttggcatggcttagtgtttttttatatatttaactcccgaactgtgcattgatcttggcggaatagtacttcattaatcagtttaatcagtgaggctggttcagcttgtttcttgttgcttagtgtagttctgtatactttagtagtactagtcgtaggattttcaccatcttgcaaaattgtccccattccgtgctggtagcttaacttcactcgcataaagtcctgcatcaatgtaaacattcattgtgctacatacgtactcccctacgcattcttgaatgcgttttgctttcgcaagtgcgtataacttctttgtatacattgggcactatagtacaactctcacggcatatacatgtgctcattgggttggttgtcttctttcagagcgttcttcttctcctcctcatgttagtgaggttcaagtcggcctcagtaaatgcacggaagattgtgtcgtcattggtgaccacatccctccttccggaaacgactctaaggccagtggaactgagaatgatgagattcagagtggagtcgttacgcggttaaccgaaaatgtaccacatcttgaagatgggcatcactctgagtcagctgttagttctgatcagtgtatgggtagcacttcttgtctggtgcctgagcatggagatggtgcaagattgagctcagagttctctgcagatgaaatcaataagttaagtgtgatgtctctagaaacagttactggattaagtaaagatggtattggaaacaatgaggatgatttctccggtgtggagagaccaaaggcagtggaggaagatcgatcagtcaatgattctaatgtggtttccaaagagcaaatcccctgcgaagaaactgtgtcatccatggagcaaagtgaagttatgtttactattggaaacaatgaggatgatttgtcctgtgtggagagaccaaaggcagtggaggaagatcgattagtcaatgattctaatgtggtttctaaagagcaaatcccctgcaaagaaactgtgtcatccatggagcaaagtgaagttatgtttactaactcagtggaccatgtttctagttcaaccaaggaacctgtcaatttacttgaggataagatgtcttgtattgagaagcatgtatgcctagacgaaactagtagtaatgatttattccaacttgctagtggtggtagccattcagaggcatcaggcattgacaaaccccggcatcaagctgattgtgcctctctgacgccagatcagttggtaatccccaaggagatggatattgatgaaggacttcattgtactgatgcaggtgaggatttgagttttgactgctgtccttttgttctatgtttgcggagattcttttatttagttgatttagtctattttggctatcagacagtctttatgttactcgttatgctcatagcggtaacagttgtgaaaatgcttagcctaaatacaccaacatggccaatgtcacactcttattatccagattaccaaaatcatttcttgaattttatggcatgccagctcatggtgccttggtatatataggcaatcatggtgccccctttcttatgtaaaagttgtctatgttaggtagaattaacaacttcttctgccttaaatttgagatctctgggaacatgtccatctgtacctcgcagttattgtatgtcccatatgttccttgtttacgtcctgaaatttcatgatcatttttcagatgtgggcatcaaaactttgtcaagtgcagttggacatgctgatgaagatattactgctgttaacctttcaaagaatgtttgttcacctcatttgacagtgggcgatgacatacaggatagtgtcaggcaaacaattgatatcactcccatgccacctcaagttgatctagcagaggttagcacatcctctacttctcatgagatcgataaagtaagtagtaaagatggtattgatgaaagaaatccaaatgtaaaccttacttccgatgaggtaaatgaggtgcatggcatagatgttgaggaaattccacatattgaagatattgctgcatataatgattatcaagagcctaatacagtgcgtggtactcgtgattttgaagaagatacgcagaatgaagaaattattgcagaagctagttctcacaatatcactgctgtacagagcacatgtaatgttgaagaaaaggaacagattgaagaattcgatagcaattcttcctgtaacaagatccatgagataagcagcaggggcgttgaagaaacaaaactgactgatgttaatgtggaaactgcagatgagataaatgtggcaagcagcctagaaaatgttgaagaaaagcagagcaatagagaaaccattgcagacccttcagttgagattgatgtggcaaacttgccaagtagccttgaattaagcaagcttgatgtagaaactagcacataccatactgcttatgaggccaatgcagtgaatgccatggaaaatgttgaagaaatgaagcagaaggaagaaatcgctgtagcgcccacttctcatatcaacacgatatcgagcaccactaatgatgaccagaagcagagtgaagaactctctgttggccctagttccgatgagattactgtgccgcatggcgaattcagtgttaaggagaagactgaggagactgtgtcagaccctacatccaacaaaactgatatggtaagcactagtggcggcgttgaagaacagaaccacggtgatgaagtaacttcaggcacgaatactcatgaggaaagtgtaatattagtacacaccaccgataatgtcgaaaagaagatgaacaaagatcttacttcagaacctgcagacaatgttgaagaggaagtgcagagtgaagatatcgcaacagaccctacttctcatgagagcagcacgctacatatcacagacggtgctgaaagcaagaaacaggatgcgaaggtcgctgcagatctcgctgctggcaaaattgatgtgccacggagcgcagatgatgctgaagaacagaagcatgaggcgaccgtcagcacggatgatgatctcaaaggagatgatccgagcgaaagcaactcgccgcagatcatagacggtgctggagacaaggaacaggacgcagaaaccgctgcagatcctcctcctggcaaaaccgacgcgccacccagcacagatgacgctgaagaaacgaagccgaaggaggaggagttggagacggtcggcacggtggtcgacgatcctaaggaggaggacaaggaggagatcgccgacaaggaagtgatcgtgaattcagacaagaaccacgtctcactgaagtccctcctctccgagaaggccgcagaaaccaaggagtcgaagaagccgagcaccaaggatcgcgtgctgtcgttccggcggcgggtgtcgaaagacggcggctctccggcgaagccaggctctcccaaagcggcggtttcagggcagcagcaggattggaactctccggcgaggttaccggtggagaagaagcctaaggggaagaagcagcagtgggtgcccttcatttgctgcccctccatgagctgatcgatcgatgatgttatatatgaatataaatctttagtgtgccacattcttgtttcgttttttttttacccattttgctcgtggactaagaagaattgcattttgtttatgcacgctacatgctattctgcctctgcatttcatgcaagtattaaagcagtgtcagtttatacgtaagctgtctttggtgatctaatgttgcgcaactgcattgatatctcgcattagacatctgcacttctagttcacatctcagctaatgctctcttgatctttcgtggcaaactggacccgacatggcgtatggttgtaacattcatccagaaagacactagaaacttgacgagattggttcaaatatggattgcaatttgaaaatctcaacaagaatcatcatcgcccgacaacttgggaagtaacgtttctcatcagtgcaccactagaacaaagattagccagcacacaaaatctaagatatgtcgtgagtgtcctgtccttaggcagcagtaacaggttccgatccttgcttcgattcagctccagatccagctttctgcgaatcagaagaaaaccgaattagaacagacttgagggttgtgaaaagtatagagcttcagagtttcgcaattaagatgggacgagctgcttacgccgtcttcggctggctgcttggtcatcttggcgaacatattgctgtagaatttggcatccttcttgttgtactccttgaccttttccttgaggttcttgtatgtcaacttcacatccctgaagataagcagtgacaagatcagtttcaaaatggagtgactactaaaactagtatgcctcccttggggagacgcatatacaaaacttgcctgttatcaggatcaatttcaagtgccttcttaatatccacctctgctaactctaggtcagcaagttgcatgtaagcttgggccctcctgtataaagccttgacattttggctgtcaagttccagaacctggcaacaaacaccagaatgttaccttggtttaccaaaacacataacaaatgggtcttttgcaggaagaactgaatgtaccttggtgcaaagcttctcagcttgcttgtaatctttcagcttcagcttgcaggcagcattgttcaagttgcaggtaaccttcagttgcttggattgtttcttctcatcttcgctaaatgagctgtcatactcaatgaattttgcagcctggaataaaatagatagatcatcagtcagtaagggattatgaaaacaaagaaaatcttgacgaaagattagttatttgaacaagtgttcaacaaaagaagcatgccataccttctcataacgctttgaagccctgacatatttgcccagcttgaacaatgcattcccctcttctttctttgccccagcagtctcaatcttctcggtattgttcaagtcccaagattctttatcctgtgtaccatgaataataattggttttcctgtgcactcatcatagcaactaaaagaaatgcaaacaaatatatagcataaagagaagcacaccttcacgaatgatacaagctcaacctcataaatcacagtgctgtttggtggaactacagcgagatcctgctttgactcagtagaaccaaatgcgtattcaggaggaattgttacaagagcaacctcgccattcttcatgtttagcacagcacggtcaataccatcaatgacctcctctggaaggaaagtaaatcaaaagggaacaagttgttactacttatcagagtaagaacattatttgtttgaacttaaaagtgtatggccagcatagaggaagttgacaaagcaccttcatcagtcttgaattcaaatggctctggttcatcatgccccttctttgtaaatattgtaccatcctgaagttttccagttattttgactgtcaaacagtaaatgcaactttgtcattacaggtagtaatcagacactgttgacctctatctgacatataggaaagaaaatagtaagatcagtaagcatcacgctttggcatacctttaacaactgcaccttcattgggccgctcataccctgtaccctccgtcagaactttcttcaagattttcttatcatcacctatttctgtgactgttttccatgaaaccaactcaagattaacaagaagagtggcatttggtggcacagcaccttcctcaccagctgctggtctaccattctcaccaaatccatctgccattacaaagttttaaatcttttcaatcaactcgaaggaagagatggaaaaccatggaaaaggtgtgaaaccaaagaagcttacattgtggcttaactgtaaggagcactttctctgcttttttcatggttttgacagctttcgccagcgcagggcagaagaaacctggaaccaaactttatttcgttagcaagcagctgattgctcaataatgaacaggaaatgttgacaaggagattatgggtaatcaccatctttaacagtaaattcagcgccctcagactttgatataacagtgccatcctcaagccgagcctcatatttcactacagcaatgcaaagggtcagctacagggcaatatataagatagcaatatgtttcaatgagcaaatattaccaaatacttcatcaagatcttttgggttctcccatttttctccctccttcagtatcttcttgaatataccaccatcttggcaaatgtccttgacacttgtccaagaaagcaactcaacatcaaactgcagtgtggcactggctggaatagttggaggtgaaccagattcaccataggccaaatcaggaggaatggtgaaaacagcattttcgcctttcttcatggtcttgatacctagatcccaaccttttatcacttgacctggatacaagttcaagaaatagctggtgagcatttaacagaaaaatagattttgcaatcccaccatcacaagcacatagcagagaaaaaaaagcttgtgaaatggtatgtgggtctatactgagaataaaacaatattggtctcttacttaatttagagcaattttttaaacagaaacagtccattcaacctctagtaaggtcaacaagttaaacaccactgctgctacattctctacctaatgaaaaagctgatccccaaaattgtaatagcaccagcaattgacagactaaagtgatcagtgcagtgttacagttgagcatcactgggtgatatcagccacagggccattaaacatgctccgggactggaaacaatcacggttttacttcccagtgaaaaacgaactaggtattaagagcccttatctcagaggtatctgtaatacagtcatttctatttgagaagaataacatatcaaaagattagtaaacatcaaaactagtagcatgtaaacagaaatatgaatagatgactgaaaccatgcccaaaaatttgcacaaaatggtgattggcacaagttgcgatcacattggctatgagatgtgccatcaaaaagtaagaaggcagaatggagaaggaattgtaccttgtcccaacttaaacttgaagggtgtcccacggtcacggcttgaatcaaacttctttccatcaagcagtgtgccagtgtagtgtactgaaacatagaagaaaggttcagtccgattcagttacacaaattctaagataaacactaatgacagggtaaatctgatctataaatcaatccgctatcatcatggaacaataaagttgttaaacagcaaataatacaggcatttagtttttccctaaaaaaaaccatacatcagcaacaacattaacattgtaggtatgccacaatcatccctccttcagaaaccatctccccgaaactgtaaggtcacacaaccgtacaagcaaacaagcaattgcaacagaatttatactctctctgccaacataaactcacaataatgtcgcagtgtaagtgtaactagcaaaagcaaaatgcgtaatcagattaaacagtaaactagattaatgttccaatctagctcgaaatgaacatgagatcgatcagacaagtggtgaagatggcaccaaatttcacctaaatataaactcgcactgttgcaaagctagcaaaaccaaaacacatgatcagattataaacactaagcagatgtcccaatctaactcgaaatcgacatcatcataagaccaagcagtgaagataacaccaaattccacctaaatttagcactaattccgcatccaaatatcccataaaccccaacgcatggcacgccaaagtccaaaactaactctgcatcccacaacgaacacatctaaagttctaaaccccaacacgcaaggcactggttggatcaactccacgatttgaggaggaggaggaggcgaggaaccacgcaataccttcgacctcgtcgccgacctcgggggtctcccacccctcgccctccttgagcagcttcttcctgagaccctgcttcccgatctccttctcctctccgaccttcagcggcggcccgtcggcgccgccgaagtcgcccatcccgtcctcccccatcatcaagtcgtcgtcggcgccgggcggcggcatctcgaagtcgtcgtccatggcgcggggcaaggagaggcgagatctgcggctagggtttcgaggccgaggcgaggtcaccactagggtttggactttggaaggttcgagaggagcacgaggcgatgatgaggaggaggagggggagggtttaaatggatgtgagagaatcaggtggtgggcttctagagtgttccgaggaggaaaataaaaacggaaagcgaacggcccggatggatgatggatggatggatgcttctggatctgactcaagtaatcaagcaaagcatcaattaataaattgtttccgattaatcacttctttaaatatcgcatcaaatatttttgattaactgagcagccgctgaaaatatgagctgaaatgtgttggttagggtcggaaaatcctcaacgtcgggcgcctgatgcacgcaaaaaaaaaaaaaatggggtgcccccacgccgcggctcccgcgcgctgcccccaccacgcgcgccccattgtaacaaccgtccgaatataacgaaaatgccctattaaaaggatttgttttatatttttttttcaccaatagtgtttcagctagtgtacttatgatatttcactgtgtatgaatcatgtaatggattttgatattgtttaataatttcatcttgatggacacgttggttgttgatgtacacggaatttaagtgttggaatggcttcaaatcgtatgttttcactttttttaagaattgaaacattctttcgctatttgctaaaacattgtttttatataaggtgaaacaacatttcatacgttgtagcaagatgtttcatgaagtgatttggttgcgtttcaactttttgaaagattgaaatatattttttttgactagggagactgaaacatttttgatctatttagtgaaacatattcgatctacttggtgaaatagcgccctattttttttaaaaaaatcgggtgcccggtttgtaggtgcctcagttaaggtcatactaaactttgcaagagtttcgataaggaacaatttcgaaaggagtaaatgtgaagtattttttgcaagaatttttgtaaggaacagttccaaaggagtcaatgtaatgttgccttatgataagcattaaggcaattagattgcagctaagattagaatatgatgaaccacagtgtaagaggtatagtggtaactccaaagttgagctgattagtatacatgcaaaatcagtttctctaacatttggtagtaagaaatagtagggtacctttaagacctgattaccaagcataaagaataactgaaagtaaaaaagaaaagagaaaaagaaaaagggaacaaaacaagatcgtcagcatcactcttcactgcatcatttacatattgggttctgattgcaccttcttcaacatccagacatccagtatccacattccagtactgcctagtgcctactttagcccactctacttcccagttttgaaggcatgcctaaatctgctatttagtgcaaccaatgataatcacagttcacaaggattatgcttcgctgtttacatcaacaattcctcatagtccacactcacctcacttccttacaagattgtgaaaattacattaatgcacaagacaacagcaaccaaatgaaaattttggtacaataaggaattcacccttttctatgacttgctgccagtctgatcgattcatttacagtgttatcctattggatgcaggatcaattccatagaagcatcacaattctcgtgattatgtttagctctagaacatccaaatgtaagaatattctaaacggcacgagcaaagtgcaacattcaaacatccccatcaattgcagataattatggagtcctcatcaagccaacctgagatcctgccaacaacataatagaaagtttagcagaatttaggagctatgcacaatattgtacaaagaacacaacatctgtaatgatttcaaaagaaaacaccatttcatggactatgttgatttatagtgggcaatttcattctcagttccaacaaagagtgctgatgatgcagtgcaagagatgcatgaaccaattacggcatgagaccttctacaatatcatgtattcagcaataagggaaattaaagcaaccaagaattctaaatatggagcttatttttagtagaggcattgcaactcaacagtgaaatacaacaccatatccttctcaagtctgtctaccttaaatactatatagtacattgaatcttaattagatataaaaatgcatctggattaaactgggttctctaataataatacaaggtgacctgttcccaggttctctaataattttcgacaagtccagaactggtgttaacttgaataggaaaagcactagttccacacttccactgcgctgctgaacatcctaaggacatgaaaattttaaatcccactgtgggcatgaccacaaaccttagattattcattctgtttgccttcactacacgactttaacagattagctgaagccaagtgtggccttagtaccaaatattgcaaacacatcacaggcatattaggcatgatccaacggcataggattcacttatggcaacacgcagaatttaaagaatttctaaatatggagcttatttttagtggtggcattgcaactcatcactgaagtatattaccattcttatctagtctgtctaccttaaatactatgcaaaacataggagtacattgcatctcaattagtataaaaaaatgcatatggggttttgacaacattaagctgggttctctaatataatatgtggtgacttgttcccagtttcaagacacatgaattttcaagaagccaagaactggtgtttaagtaaatagcaaaagaacttgttccagtatgctgctgaacatcctcaggtgtcaggacataagaaatttaaaatctattgtgcatgcaaccacaaatctgtcatcctgtttgccttcactacacaatttctaacagattagtgaggttaaccgtggccttactacaaaatatagcaaacacatcagcacatcacaggcatattagacatgctccaacagcatttcttatggcaagacatacaatcaaaagaagaggaaatacaatattccaatcatacctggaaatccaggagcactgccatgccatttgcaaggcccaatggaaaaagagaactggatacagttcataatccattcaattcccattcatcgacatctcaagctgctccatcctctgagctagatcatgcttcccacaatgccgcaacccgtcaactacagaattaaaggtcggagcacgaggagcgaatccagcttcactcatctcaacaaggtagtttgcagcctccacgaaccgaccgcctctcacacacattttaacaagcatcacatacacaggacgatttggcgggtgccccttcgacttcatatcaccgaaaaatgcgaaagcatcggcgaatcgccccgccttacagagcgccttgataatcgctgcatacaggctggggaatggccggtggccatcctcaagagctgcatagaacaaccgaaatgcctcatcaattcggccagccttggccacagctggtatcatcaccttgtaggtggagatgtccgggcacaggccgcggctggatgcatcggcgagaagcgccacggcgaattccacatctccagagctgcaaagcgcctcggcgagcgagttgaatgtggccacatcggggaggacgccctccttggtcatccggagcgcgaaggccttggcctcctcgaggcgaccggcgcggacgaggccgtcgacgaggagatccctcccgcgcaccggcgggtggaacccgcgctccgccatgtcgtcgaggaacgcctgcgcctcccggagcttccccgcggcgcaccaggcgtcgacgagggtgctgaaggtggcgcggtcgggggccacgcccttgcgcgccatgcggcggagcagcttgtacgcgccggcgaagctgccgttggcgcagagcgcgtcgaggagggcgttgtagacctgggtggtctgcgggcagccgaatcgcgggaggcggttgaacacctcgacggcctggtcggtgaggcgggattggccgtaggaggagatgacggcggagaaggtggagggggagagcgggaggccgagggcgcgcatgtcggcggcgagggaccagaggtgggtgaagaggcgggcgcgggcgagcgggaggagcagcgcgtcgaagtggtcggcggaggcggcgaaggagggcttggcgcggagccaggcgaggaagcgcgcggcgtggagcggctccgcgggggcggcggcgcggatgacgcggagcgcgaggtccggcgggaacggggacgggaggcggaggcggttgagggtgcgctccaggtagaagtcgcggcgcacgacggtggagaggtggtgcaccgccgcgaagtaggcgtccttggaggtcgggtgctgcggctgcgcggcatcgggcagcgtggccaggccgcgtacgccgacgccggcgccggcgccgaggccaagtccgacgcggcgcagcaacgcggcggcggcggcgggcggcggcatggatcgaagtgggcggcggcggtgtaaggttaggattgggcccattagctgagaagcctaaatgggctagtaggcttatatgggcttcgaacagtttggttgatgggccgtataagtctatcggcctgtctaacagattaacagctggacgatctggccttattgttgtggaataagttcactttgtgaccttcaaaagtcatcgaaatctaatcccttaccctaaaccacaaaatcggatatctcgaacccccaactcttaaaaaccggtgtaatttgactccctcggcggttttagagggaggtttcgctgacatagcgcctatgtggcagtattgactcggtcttcttttcacgtggtgttgacgtggcgctcaggtggcattagaaataagaaatatgtgtgggacccatttgtcatccaccaaaagtatgggtgggacccactgatatgtggcgcccacataaaccactcctcatcctccctccctctctctctcaatcttcggcgagcgacggcggcggcggtgggagggcgggcgggcgagggcggcggaggctcgtggcagtgggagtacgacgggaacggcggcgggcgggagaagcaggctgcggcggcggcggcgagagggcgggcaggcgagggagcgtgccatgctccgccatgcccagcagctggtacgaatcgttgctcatctccgccacgaacatgcccatgttcgacagcgccgccgccgactgcacccaccacatcagccacgtgtcgccgagcagcttcgcgatgtccgctaagtagccgtctgtccactgccccctgtcgagcgagacggctcctgtcccggcgaggagagggtacaggtaagcgaccaccacgaagatgaccgcttagaacagcgccttgggcagcgtcttgccgggattcttcacctcgccggccaacgtgctgatcgaatcccagtagttgaggttccagaacagggtgttcaggtacagattccaatcgacattgtggaggtcgatcacaagccacctcgccggccggagcctggggagagcaatgagccccatgacgaaaaaagggaggagggagaagacgcccaggcagatcgccacccatccgacgacggtgagcccccgataactcagcaatgtcagcacggccatcaggccaacgacagcgaacgccctcgtcgcgcctctgccgagcgccgggacgccggacttgaggtagtccaagaagaggacggggtagaggacgttgtcgatgacgccgctcagccacttcatccacccctgctggaacccccagtacgggccgagcgccgacgccacccacacgatgtacccgccgttctccgggaacatggcgcccagctccgccgtgatcagcgtctccgggatgctccagatgacgggaaggaccaagaagccgatgatggcgagcagcagcctggcctcgcccatgctgtcgcctgccgccgtcgcccgccgctgcccgccggctgctgccgccgctaggccccgtccctcgggcgccgctcgctgaagagaaagagaaggatgaggagtggtttatgtgggtcccacatgttagtgggtcccacccgtttttttggtggatgacaaataggccctacacatttttttatttctaatgctacctgagcgccacgtcaacgccacgtgaaaagaataccgagtcaatactgccacgtaggtgccacgtcagcgaaaccgcccttcaaaaccgccgagggagtcaaattgcaccgattttaagagttgggggtcgagatatctggttttgtgatttagggctacggattagatttcgatgactctagcggatcaaaaagtaaacttattcctattgttgtacatgccgtaaaaggcaggcattgcatccagctgcacagcacgattggtcagggaatcaagggccgtcgacgcatcgagacaaagctagcaaagttgcatgtatattttttttttaaaaaaaaggttaagtttcatgtacatatgtgtcaccgctcttataaagtttgtttattttcgagacgaagaaaatatatgtttcgtgtgtaattgatataaatcctatattgtactgtatatatagtacttggtaggtgtcacttacgtataggactaaagcatgtcaatgacacatatgcatattactgtagtaattcgaacgccacacccggcatttgctcagatctccgggtctctctctctctctctgctcgtacagtcttatgcctgcctctccccacaattattgctccccgcgaccgtcgtcgttgcagaagccggccaagcacgtatgtcgtcgctggccatcgccgctgctcgctcgcctgcaaggtaggtcggccccagttgcctggctagctgctgctacactgttgctcggctcgtcactgcgtctatagcctatttacctgagcacctctaccatacgaccaatgacagatctaaccagaaataacaatatatctaaataaattagataaaactatagcccgtgttttcatctgcgtatagcaaggaaaagaaaagatttagtgagaacttcacggggactctcatgattctcgcgtgggcaatacaggcttgaaatcccgtccttaattttcatgctagatcgccacccctgtgttacaggcatccgagtcatggtcgtcgtcgtccctgccgattggatcaagcaagctatagcagctagctttggtctttggagctttcccattgttggtttcttcttgtcgatgccagaactgtgccgcccctgctgagctagggccggcctcatcacgttgcagcagggagccctggttttgtttcacttgacttgacacggatcgatcgatgcacggtagaaagtacgtggaaattttaagaagtgaaaaaacgaacagcgtgtgttgtgtgtttgctgttgatgaacagcggcatgcaaagatacgctgcagatgagggcgcgctttggtcgcgatcttcgcgccatatgcttgcagatgaggagtactccggcctatagctagagtcaacaacactgcgacgacgtgtatgactagtgttgccaaaaaacatctgcaacgttctacagcttttctctgtgacggcgtggacccacatgatcaacaatcaacacacggtgcagctgcagtatgtataattataatggactataggagtacaacagccagctcacgcttggagccttgcgattgttgatttgttgtttgacgagtcaccaacatgtatatagcttatttgtctagggaagcttaaaattctgataaacatctgattgctttagagtctaaaaatactggcttttaacttctagtttattttctgaatttcataactatagcttctcagaatctagctagataaaaagctggagtgtttggcggccatcattaaatttagggtgtaagcaaaatgagcgtagcttttaattgcttatcttctctatgttcaaacttacctatccaggtttaagttctaaactttaaatatgtgctcgtatttatggttacaatatatatttttttcaatgataggtaacatatccaccgatagtgtggtgactttgtcgatcctcaagatcgatcgggaagcaaaatcatttaacgttttgctcctattatgaccacttctagatataattaatgtaaaaaatattgtatattgaagcacataatagtacacccatatggccgtatcagctcgtacatgaaagtttaattccaagatccaacccagaatgttcactggaatggaactgacgagcttggtatgtaaataactgtattaatcattcatcatagttaaatctatgtccatattaatttacatatgtgtgcacgtgagagactgcttttaaattaagtaaggttcgtcttatataaacgtttgttaaattagaacgaaggcgcactttagctagatgtatgtcatgtatatgatcgaaaaaggaaaacagtggagccacactctcacggcattatatgtgcagggaagacgtgcttgatagattctcttgggtccgagctgggcatgtgtatacacagtactgcaagatctatgaaacatatcgttgtgttgtatctcagcgtttcaatttgtcgtccaaaccaccatatatatattccaatctttttttattatatacatgacgctggattcttccaaagatcgttgatggggattggggggtgtttatggcagcttgacacacaaggtggctaaccattatacgcaaatagtacttgacatcgttaattttatcatgcaaaatttcgtcgctacgtttaattacttagtactccctccgtttcatattataaatccttcaacttttttcttaatcaaaattcgttagattttatcaaatttatgggggaaaaattacatcagtggtacacgaacttgtcaagtgagtgtaatctgttgcatgaacttgtttggtgcgtgtgaacaagaccaaaatcgtacggcaaggttaattttactgtttttgttattgatttgaatgctatgtaaacatgtgtctcacgaaaatatcacgtagataaagatctatttagcaaaacatataataaggtatattgattgcatgaagaaagagataaaaaatcgagtaacgatgcaaggaatagaaacaaagtaagataaagtagaaaacaaatttataaatataaccattctaccatacgtgcaccacgcatgtcatgtaataatttgtaatgttcaactttgaagaatcagccttgtcgtgccattttggttttggtttgcacgtaccagacaaattcatatatcaaaataagtgttttacaagtttatgtactaaattgcacctacctgataagttcgtgtatcgctgatgcaatttacttgatcaattactactaatttgtatttaagtgtg

SEQ ID NO: 52695 - DNA, 4266 bp, Oryza sativa
ttcaaacagtttatattctcacttagattctgataaaatatatggaaatatatggttagagaaaaaaaagaactaaaaactagaagctaagaaaccaagattgtttagattcttagaaactgactaccgactggtagtttctaagaattttaagcttcttcaaaataggatctatatatataagataataagaagtaaaagatgcataccaatgtgacgaagatgatgttaaaggtcgaatagccttaggtgagttgcttcagtttaattgactttgtgttcttgccatgtttcttgttaggcccaaactgagatatcatcatcatcagaaggagaagcacggggaggcgggagcagccgggcgtcggcggcggcggcggcgaggaggatggcgatcgggtcgagggctccgacgtgcacctacaacgagtgccgcggctgccgccgccggtgcagcgtgcaggaagtccccgtcgacgccggcgatcccatgaacagcgcctaccactacagatgcatctgccacctctaagttctgattaactagctagcatatgcatgcgtaattgttgttgtgatcgaccgatcgatggaggccgccccgggtgtggttttaataaaagtttgtgcatgctaatgccatggcacttaatttagtttggacgtcgtgcatgtcgtgtggttcggttcttgaataattgtggtcgataagacaattaatcacgctttgaacatccagattcctgcaatatataatatgttcatctagttacatatcttctccatgtaataaaatttagaatttcccaacttatctctcactgacatacatgtgagcgagcaataaacccagaaatcagaatattttttaaaaacttcggacctatttggcacatctacaactccggctctagctctagccaaacagtttcagctccatttaaaatgaaagcggagttgagtggagcattctcacaatataaactagaaaggtggagttggatttaggctactccataaccctattctagacccaattcttgaaactaaatttagaagttagagctctatcaaataggcccctcaactccaacttcacccttttttttaagctagaatctaacagaatgatcttagcttcagctgaaaaggaaattaagtaattgtattgaaatgacgtagatgtagatttaggagtttgagccctgtcaaatactgctccatcaaataaaaaaaagttaataaaaaatcaatcctagctatgaatctatatacgcatatattgaaactaggtgataccccgcgctttgctgtaggattcatggataaatatatgttaaatattatagaaatgatgatagttgaaatgttgagaaaataatgtgaggaagatgatttgacacatacttgttgatctctataatataatattgtagattatatatcatgcttgcatggattaaaataggttagaatagtaattgctagtgggtgatgatgtggcatgcttgcatgttgagatttagcttctaataattgttagtgggtatcaactatatagaaagtatagattcgtagctaggattaagtattttatggaatagagagagacccctagctacctgcagatgaaggtatgaccactttcaataagagtttctttcctacttcctccgtttcataatgtaagactttctaccattgtccacattcatataaatgttaacacacattcatatagatgttaacacatgtgtgactagatacattaacatccacgaaagggcatgtagcctagtggttgcagtgacctgagtagtaccccaaggtcctgagttcaaaaatccaaaggagcgaatttcagattgggttgtttgcgggactaagtttcctatttcaatggccgtatatatccagttggatgtagaggccgggtaaaaaaaaacccttttataaaaaaagatacattaatatctatatgaatgtgtacaatgctagaaagacttacattatgaaacgaatggagtattaaataggaaaaatttgacttacattatgaaacaaagggagtattaaataggcatgacacgcaaaaaacgtgtaattggctgagagccatcgtgaaaacatgacacggctgatggacattacaaaaaacgtgcaattggccgtaggacaccggtcgcattattttattatttccgggacaaaagaggtggaaaattttcaaaatgacaagattgcccctggagccatattcccccgcgccaggagcggcagacggcgagagatcctgtgacggcggcgatggctgctgcgccgcccctagggttcttggacacgtacggctccatctcaccgtagagccctctgatccagcccatgtgcttctccgtcgccgccctgctcttcgaccagaacccatagtactggatgttgtagagcgcctgccggtgcgggaacgacatcaccactggcgcgacgtggaccatcttgccgccgtaggggtcgaggatgagcagcccagcaccgtccttgaggagctagctccaggtggtctcccagacttggctgggcatgttcttggacgtacggagtcggacttggccttcaagtacttgtccggcttgctagtgcccctgtccaggagcatctccaatggcttccccgtgcagtagaacgcgaagtagagcatggactggatccacatcatctcgatgcagtcgctcgccgtcaccccgagctccgggaaggtgtcggccatggcggcgacgaggccaaggcgtgtgccgactaccgaggtacagggactcgaactgcacgttctggttctgcaatacgacgcggagaagttcccgccgctgccgcctcggatggcccagaagaggccctcccccatggcggccctgttgaggagcctccccctcggcgttcaccatgttggcatcgacgacgaggtcggaggcgaggccgtgcttccacagcatcaggctgaagccgccgccgctgaggaacccgtcgacaccgaccgtcctactcgggccgtcgcgctgctcgcgcgccgttcctccgctccgctgcgtgtgtgaggaagaagaaggataggagagcaatgtgggccccacttatgattagcaaatagtaatcaccctattaattaggtacaaattagtccatgatgcgtgaggccaggtggttaaaaacctattaaaaattagattaaacctacactgtctatgacatgtgggacccactggtgtttaaagaaggaaagaaaaggggcaatctgggcatttagaaaaatatctcacctcttttgaaccagaaataataaaataatgcgaccggtgtcctatagccaattacacatttttgtagtgtctatcagccgtgtcacattttaacggtgtctctcagccaattacatgttttttgcgtgtcctgtggcaaatttttcctattaaataagatgctatgttagcattttttataacatgacaagaacatttcgtctagataaaatgagttttacaatttatcccttaaaagtactacttacgaaacaatacaaacaaaacaatacattatattgtatgagttgtttcaacccatcaattaaatattttatttattatgtaatattttaaaaaacacaaatatattatgtaatattaatacaacgaagtggcctttgacgcggccggcggcgagggagacgagctgtcttcgccgcggcccgcggtcgccgcgttggtctggtcggcacgataacgacgacgaggcgccaactcaacaaagcagccagaaagaagcttggcgtgcgcgcactacctcctcccaacccggtgaccccacccgtcatcctcctcacccccccacccctccgcgtcaccgacacctcggccccaccgccaacctcacaacgcagtgggccccacctgtcagcctcacccgcctcgccgtcttccacccgtgcgtgcgtcccactcgcctcccactcacctcctctgcttctcccaccacctcactacctctcgccgcgagagcagcagcgctcgtgttcggtcaaaagcctcgccgcggcgagctcgagctcattcgcattccggaggggagggagggatgggggacgagtcggagggggagacggaggagtacctgttcaaggtggtgatcatcggggacagcgcggtggggaagagcaacctgctgtcccgctacgcccgcaacgagttcaatctccactccaaggccaccatcggcgtc

SEQ ID NO: 52696 - DNA, 14077 bp, Oryza sativa
caattcactgtcaaatttgcgaacaaagggagcaccatttttgggttcctactagatagtgatttgcatgggttgttttggggataggagtgtcgctacacaccggacggattgcaggacctggtctgaatctggatctgaatcttgatgcttaggcagcagtggtgtgtgggggaatgttccaggaatgaatgcgaggaccactatgagggtgtggtgtgattatgcgatttactgatttgggagtgtagtgattgtagacaatttttttggtaccaaattatttgggtgtccaaggtaggtttgcagatttatgaagttaggaagctgattaacttcagttggttcatcagtgcttgagatgttaagcgtagtaattgctgtcttggttcgtgcaatattgaccctgctagaaatgccttgaccctatgagtgatatatgtcctccggttattccgattaagttttgtcaatatggttgaagcagcatgaatcatggatagttggataccgattttcttagtcacaactcacaataggatttacagataagatcatgatctcagtcactattagtactctactttgataaatcggcagttcggcacacgacctttgtgcttgtgttgggaaccttttggttccgtctttcctcttgttggaggcaaaaatttagccttttgtgctggaacttggaaccaacatggaataaatgcagtaatgtactgtctaggtccttcccttttatgtatcctttatgtaggatgcatgactcttatctggaaaggtaaagttttgtgtaaagcaaaactacagtactaatgcaatttatgaggcaggtacaaaatttatccaaattacaaactgtggcctaaccaacagtcagctagtaatgcaatgaacctcaggatgatacattgtaataattcatgttgtgtgctagtttttttattcactgtaagaaatttcagaatactccagaacacaattttgtcaaactgcacattacttgtgtgtttcttcctgtattttctcagtcggcatctatccttctgtagtgtccttcactggctcgtgaacatacatacaaccttacatgtagtgaaattttggttctatgtatcttgatcataaacttgtagcctagtaagttatcttatgagcgctcaagatgatgctatgtttgtctatgtatgctcccttatgatttttttggatgctactttattgcaccctttaaactactaaggatatccttgattatctgttatcgatttgcttactgaagaagtctaatattgttcgtcaggaattaatattgtactatatatatgttctgttctctgttccgaagaatctcttccttttttggtagacttcaagggaggactcaaaagagctctaattaataattccaaagcaagtaatactcactgttttctggaagcaacttactatgcactcataataatgtgtcgtgcataagctttggtttcttgccatcagagtgacagacgcatatagtattatagtgctacagctattgtcttctcttgtttgatgcttttacagctttgttccatgcatgctcaccacccactcacaagaagtcatgagttgcacttatggttgtgtgctgttgcatttgttccacaagatttttctatctgaatatagcttcttttcattcatatgtagaaatgtattttttggctggagtagcgaataactgttcttatattcaatgcagcacattcggacacgactgtagccaagatgttggtgggcaacaagtgtgatctggataatatccgtgaagtgccggtagaggaaggcaaagcacttgctgaagctgaagggctgttcttcatggagacctctgctctggactcgacaaacgtgaggacagctttcgagatcgtaatcaaggagatctacagcaacgtgagcaggaagatcttgaattcggactcctacaaggcggagctatccctcaatagggtaagcattgagggtgattcgaaggatgatcagaaacagtcaaaccggtttggatgttgctaggggttttagtacattattattattggattcactgtgatatgaaggttttttgttcattaatattattattattatctgtaaacttgtaatccaaattgttttttggtttggttactctggtacacactgtgacactgagatacaaagtgagagaagaatagttgctggtaatgaatagttgagaggactgctttgtgctgttacctgaaaaattcatgatccccaactttgtcaatttcttgcaaaagtgtgctagccttttgtatcttccctcacaactatatttcactgttcatacttgaaatcggtggatacaggacacctcttgtgttgagtcagttttttctatgaattttgtgtagttcatggattaacttattcctaacttttttttacgtatgttaaaaagaccgtacttgcgattgtatgtgtgtagtgccgtatatacgagtagataaaataaactggtgtgtatgagtcttcagtatttgtttggggggaaattttcagttttgtttttatttctaggattggagcaaatgggctgaaaaatgcgtgggccgtcgattcacgggcctggaaaggatggactgttgttgttgtgttgcgggcttggggcatataccagggtgggccgattggagcacaaagcagagtattcgtcataatcaacattttaatcactccttaattgcattggagagctataggaccaataatattactttcatttggaaatatatatgagttgtagagttttattgcgtttgaccattcaaattatttaaaagttcactataaatgtctgattaaaacgcatgtaaaatatagaacaaagggagtgattaaacgtgagatggataaattcaagaaatggataagaaaatggttggacagctagcctgtcaacaagatggcattgcctgtcctgtcctgtccttcctcctcccaacacatacctatatatacaaaatgcaaacacaattaacaaacaaacaaacaaacaaacgtgcatacgaaatggtacaagtagtgccaagcacgaaccctagttgacttcttctatgattccacgaactccatcgcatgtctggctctcctgtgtgtatacatactgatcttcgttcgatcatgcaggatgcgaaacattgcatgcatcgtcgtctccagctccggtgaccgacggattgatcagatgcagaagggtgggggtggcgcgtcgtcgtcggcggtggtggtgaggatggggccgtgcggcggcgacggtggcggtgcgagggacatggacatgcgcggcgtgggtcgcgtggtgagggtggccgtccggcacggcgccgccgtggacgccatgtccgtcctgtacgagcgcaacggccacgaggagtggaccgacctgtggggcggccctggtggcacactttccgaggtactacattactctacttcatttatccttaaaaaaatcgcggaactttggactatgaatgtgaaagctagaagtttattttttatagaatggaggaggtatacacaatcttaattgtactataatttcgttgttaattacccctgtttcaggttataaaacgtttgtcaaagtcaaactgttttaagtttgtctaagtttgtagaaaaaattagtaacattttcaatgcaagacaaatttattatgaaaatatattcaattattgatttgataaatctaattttaatattataaatattactatatttatctataaattttcaaattgatcgaaaccgtttgattttgaccaaagttaaaacgaacctgaaacagagccctaaattcttaattaccaccgttccgttgtagtgctagaatatggaaggaggacattgttgtatccggatgataattaactctctttttgtagttcttttggtagctgcatctaattaatccgagaatctttagctaccaaaatagtttaaaactttattttagtttcgaaactataagcatttttcatattcttactagctggatactcacttaacacctataaattgtggtttagtgttttggtaacaataaacaagtactccagtctttgagacgttgacacatttttctcatgtaatcttgatcactaatgtcaatactaatatatgtctatacgagccactatgttaattactaattagaatagttgccgacactgatactcaaaatttgaagagtttgatgttgtatttcgaaacaatctgatctcactcaaattcgtgatgaaactttctctctgtttttcatttttctccccagataagcttgcagccgggcgagtacttgacgagcgtggcggggcactacggccgactagacggcgacctcgtcgtcaggtcgctcaccttcgtcagcaacatgcgggcgtacggcccgttcggccatgaggacggcgtcgcgttcgacctcccggccggcggcggcggcggcggcaagatcctcggcttccacgcgcgctccagtcgccgtctcgacgcggttggcacctacgtcaagatcggatagatgacgaccaccctggcgtcacagctgagcagatctatctaagttctcccctctataacaatttttagtttttaaaatttattttaaaatataattaacttattcactaacgatctctttctaatcaattgtaactctacaccattcaatgttacgggctatctacatttctcatccaattgtaattttcctccatttaattttatttttttaataactgtgtagctagtttcaagaatatttatagaattctaatcatattttataagatctcccttcgattttaattaattatgaagtaacttggtataaagcgaaacctatttcaatatgtcctggtgcaaaatgaaaagtgaaagtacatgttcaacctagcgtaaattatatgtcctggtgcaaattacaatttactctttttttaattacacataaacttttctttaaaaaaagagtggtcataaaaaaatgcagtgaaaaagaaatctttagtaccagtactcaaagatgatttttagtcccggttattttaacctagactaaaaatacctatttttagttcgagattatacgtctcgattatacaaatgggcttaaaatgggttgtcaaccggaaataatgtatctttccctagcaggatcaaagctgatataaagtactccatccatctcaaaatataagctttttttagaccctgacatggtctccgagatactactttgaccaacaatatctataaaaataagatgttttaaataaaatgggttgcatattatgatagtttgtttaataacaaatctagtaacatcaattttacgtgattaatcttttttatttttttctattaataatcaaagttaaaaatatttaacttgtcactatgctaaaatgtttatattttaggatggagggaatagtaataatactccctccgtattttaatgtttgacgccgttgacttttcaaccaacgtgtttgaccatttgttttatttaaaatttttatgcaaatatgaaaatatttatgtcatgcttaaagaatatttgatgatgaatcaagtcatgataaaataaataataattatataatttttttaaataagacgaattataaaacattaaaatatggaggtagtatcaaacaagtgtacatggagagggggagggatctcacatgcgcgtggccgcatcaaccaaccaaccaaccaaacgtacatgtacctgcagacgagtcaagcgtacgtagtcgcacgcgatgctagcaatgttgctatcttttctgtaaaaatatttccttggcctggacacacatgacatagtactgaaccggccggattgtcgatatggaccattacatgcatacaacaccgaaattaagcaaatgatcgaggagagttaattagctcatgctcatatgcatgcacgcacgtatacgcccctctctacctaaccctagcttagctttgccccactactagtctcacaaatggcacaatgaccaaaaagaagatgtgaaagtgtggctcacgactaaacacatgttctatgtgcgtatttattatgtccgttctgaaatatatatagattcctcgcagcctaataaggctctagaagtaaaaaagattaaagcacatttcattaatagaaaatgtagtttggtggatcggtagagatacatagaacttcttgatttatggttcaatttgttttaaaacaaattttaaactttaaaagccaatttattttgagacgaatggagtatacaataacaaccttttgaatatgtcatccctgtgccacgtttgcgatccaatgggcgggggttccttgaagatggtcatggtcccaagctctgtatataggagtgcccctacctacctagctagaggtaaaattgtgacaccaaggtaggggaagaaatgtggtgcaatggactgagacaccataccagagaatttaacatgatgcatcactttcaaattcagttattatatcttctcatccttagcgcattagacggtagtaataataataatggagtatagcacaagtacaagctagctaggtagagtagtggtaggttgttccttgagacatgcgtgggggatgtgtcaaatgcatgcatgctaattgcaagctagagtggtgtgtgtcaatcgatcgccaattgtgtttgtacaagtgtgcgcccactgcaatattgtgggcatatgcatatggttgcatatatctccggtagacaagtctaacggtagcgcatagcccactgattttcaatgtcttgttcaattcacgctgtaatttttaaggcactgtttttttaagctaatggaggtatggattatacttgtcacgtttctaaatagtacgattttaacatgcttttattttatcttataagcatttgttaactttattttaatatttaagtaatctttgtatcaacttatcaactaatcagctgataagttgaattgaacggggcctaattcaatatcatgctgggactctccaatatacatgtaaagataaccttaagcaaaaatttaagagcactactacatatactaaatttttcttactaaacttttgctaacaatcatctcaaccatttgatttaagtagatagaagttataaaaaatctagatgcactcatagcatgacacatcagtgttagtaagaatttagaaagaaaaagtttgtatgtgtagccttttccaaaatttaatatttgtaattcaattttatgccttggaagacggactcacaagagaatatgtttatggatgttggtattgaatcttcatgctaatatgatgaatatcaattcttttttcttggtgggccctagcttaatgtcaagaatggacataaacatgatagcatttggtataagtaaaaagaaaacgtatgcttgtgtgtttccatcttatagccattgtgtgtctcggtcttaaagacgtcctaaggctgaaaactttagggccggttattttgaagcggttcttccaaaggatgaggacgcataatctggtaacaaaatacaagtcattttggatatatgctaagttatttttacggaacaaatttttggtatgcatggatgtcgtttttacgtgcctaattgattgaaccatgaatgtggacatgaagttttgtggcttcaattcacacatttgatataacaaaacaaaatgtaaaagaaaaagaatcaaataactgaagtcttgctaatgtctcgcatgcgcatcatacattatattagggagtagtatgaattttcaaggccagaaaaaggacacaactatgattcagacaacatagatcataatgatggtaatcatagcatcattaacaaaaagaaaaaggagagaagaccgacccatgcataaccctcgtggggaagctaaggggcactctcagcaccccaaagacatgggagacaggacacctatcaggcatgaatgatcatagatcttgaaactttgaaccacataactatatataaattacgtacagagtgaacaactaccttaaatagatatcgacatgattccaatccattcgactcaaacacacaataatatcaattaaaaaaagagtcattttgctcccatttttgtgtgatcaatagagacaacactcaaccccaatcctagcggataagggcatcatcaccaaaatgatccactgaactcaaacacacacaaaaaaaagggaaaaaataataataataataatagaggttcaccaaaataacatatatattggtcctgactcccatttttcggattgggatcacctgcagtttgaatagcaactacaagttaagctactgcacgcaatggcagccctccattttcttgatgaacgaaccatatcattagctacatatcgatttataagtgctcaacaattcttgcaatagtgatctacagtactcagatgcatcttgatcctcggtttcggatctaacagctagcagtggactgcataagttgcatcgacactaccaactgcaccggatccgaataccatttttacaagagcaatagggaagccatacatccctagctagcactagtggataagggcatcatcatcttggtaggtcacttgatctcccatggcgtccgcacttggtccatgggccatggcatcacaggaactatagttggcactagccccacaggccaggttaatgcaagcttaattatgctgccagtagataagctgccaattggctaccccactgcccttttaactctttaacatggcatcaatgccccttgtggaccatatatacaatagcacttaaagagctgatattttagcataacaatccctttaaatcacacatacatatcactctcaactccggatcatcttaaagtaatacttcaatatctggacctatctgtcagtgactgtttatagtgatctgcgcgcgctaagacaaaaaattcatggctttgcaaagagtgtagctagcaaagaaccttccaaatgagaattagctagctgtggcatctcaggattccaccaaaatattgtcttactttgggcacagagtagaagaggaagacaattagttagttagatgcatcgcatgctgtcatcagcagggaagaagaaccgatcgaatcggttcgatggcgacggccaacctaacagccaaattcgcagtcgatcattgcaactcacaatgattataccttcgatccatccggtttttttgggttttttttcctctctttttgagttttttccccttcgttttcttctcttttccgatccttttgcgtggttggacacatcaagcatggccacgatggggattggtgctagctcagctcgatcccctaatgcatgccctgattgcagccacttcatccgggttcttccgaattatcctcagctggcctttttcctgtaatcaatttaatttcttcactggtccagtcttgtgattattaattaccgtttagacttgcagcaactggatttctggactagtctgaatctctccaagccgccattgctgaaatttctatgttggatttctgggtactgcgttcgttcagccagtttccaactctcccatctacttttccgcacgcacgtttttcaaactgctaaatgatgtgtttttttataaaaagtttatatacaaaagttgcttaaaaaatcgtgttgatctatttttttaaaaaagctaatattaattaattatgtattaataaaccgctatgttttccgtgcgcactattcgtgttgggaagcagaacgaacgaatggagcctgtaagtctagtttggatcagtgtgtgcaatggacggttcacaataatttggtgagccttaggaaaatcctatgcagcgaaaaaaatatatgtggtgaatcctatttggtcgtttccgatggtttaaatgattttcacacgaaacagttcaatccttagttccctacagatgggctagctagcaaaacagaaaaaatgttgtgttccagataggaccagattctgttgggatcaaacaatcaatcaatcatccattgggatcaagatggctatatatgagatgatgatgaggcaattgcaatgcatggggttcaattgaattcttgatggattatcatcaccatctcatcgatcagagagtgatgagaaatgcatgagggccataccctctcagatctagcagccgatatatcattcatttatgagatttactccggtccaacaaaaaatatctcgaggtatagctatctcacggtaccaaatcatttccgattgttgaatctatctgggcaggatatgatcgttggatctaacaatatacatcctaggatatgatcgttggatctaacaatacacatcctacccagttaggtccaacgatcggaaacgatttggtaccgtcagatatcggtacctcgagatactttttgctggacatgagcaaatctcttcatccattcattcttcaccagctcaattgttaatatgatgcatgcaacagtgctgtgtgctgcgtctgagtgcatggaccgatcgacgaccgttttggatcatctgcatgctggggattgctactgctgtacctgcaggagcatgagcatccatgcatgatccatccatttccatggccaatccggttgccgtcgccgtcgtcgctttcaatccaacccggccggcccgtcgacagcagccgccgacgcccggattaattcacaaacaaataaagcttgatgcaattgccattatatatcatctctgtttttaaatgtacaacattgttaattttatcttgtctttggcgtattttcattaggatcgatatgacatatggtatctaccaaaattataatattataaaattagttataaagaaattgataactatgtttacatactaaatatttgacaattattgatagtaatagttttagatgtttgaccaaataaagtaaaccatgtatatccttttaaatgcatgagactgaaagaggcccgcctttagagcgcatgaattttacatgaattaatcaatatacgaatccgacaaatgtatttcgagtggatattgtttaggcaacatcagaagtgtgaacttaattaggataggcaacaaggctaggagatatgcatgcgcatggcgatcgatcgattagtatggttggggttgagacttgggaggtggtaagggtaactttatagggatgtccttggacggcagacatggacggtgagtggttatacaacggcgttggcgctacagccatggggtagtaggaggatggtaggcgtgaccgacagtgaggatgttagatctacaatggttagagagtcgaggaggcggcggcgcaaaccaccaaaggtgaggaaaacggacaggagaggaacaccttgctgctgcttgggcatagcaaggaggaaccggaaggagggaggaggccggtcgggcagggtttgctggtggcttccggtaccggagagcagggaggcgggggttccgtcaagcatcacacgtcgtgtgaggaatgaggggagaaagagagaataaggcaattaaggtgggagagatgttactaactgcacgaatctagcttggcatgatctgaattttatatgtatttttggtcaacggaaaagtaggtgatcccaatatacatacatgcatgcatccttgtaaacacatactacggccgtctttagaatacaggaattttacacgaattaatcaatcagcgagaatccgacaaaggcattctcgagtggacgatgttgatgccaacatcagtactgctctaaaagtgtgaacctaattgggatatactccctccatcccaaaatatttgatgccgttgactttttaaaaaatatttaaccgttcgtcttattaaaaaaattaagtaattattaattcttttcctaccatttgatttattgttaaatatatttttatgtatacatatagttttacatatttcacaaaagtctttgaataagacgaacggtcaaatatatttaataaagtcaacggcgtcaaacatttaaggaaggagggagtaggcaacaaagctagcagacatacatgcagctactggtgatcgatctctctcgagatccatccatggacaaaattacgagagaccgatcgatcgtacgagctgagtgcaagctctgctccatgctccagctcaaccgagacgtacacatacttgccagtagcttcttcttgttggttattgttgttgttgggtcgagatgagcatatcatgtgatgcttctgccgatattcgcaacgtagctggatggcaagggctgtgtttagattcaaagtttggatccaaacttcagtccttttccatcacatcaacctgtcatacaaacacaactttttagtcacatcatctctaatttcaaccaaaatctaaattttgcgctgaactaaacatagaccagggtttggtttctttggttgcctttcttggttgcatgtttccggcagaaagcagctggctcattgacttgtgataaatctttgcacgaattcagtactcctcgagaaaataatgggggatctctgacatgtatgtctaatgtcttggactctaggcaaaaggcaatgggttgtgttaagtactgcttttgatactgctccttaattccattttcaaatataaggatttcttgtatttaagttttagactataatataaaagtatttttttcttgattttccacgatttctatcatttcaataattttaaagccaatcaaatttcgaatcgaaatgaaatctacaccatccaaaattcaaaatttgacaatcaatttttttaaaaaaaatcttttgatgtaacattaacatttactaaataacctaaaaatccttatattatttaaactgaaggagtagaatgtttttataatgctactccatccgttccaaaaaaaaaccattcctagcatcccaagaagagactagtgaagaataaaaataaccaaaatacccctcattattagaaaagtagtagtgttaatagataggtaaagggtatttaagggagaaaacttatcgttttatgtaccgaggttagatatgattgttgaagttgattttttgtaggagaaaattcaaactccagaagtagagttttttttcttagaacggagggagtaaagtagtagatgagatgagtgcgaaaagagagttgaaatttttgcacactagaggcagcttctttgttactgtactgacaaaggtacgagtgtatcgttatgtctgtcagggcttaaatcttgatagcgagctaggagatgatgtgttcctttgaaaatgtctttttatattcagtttgatatggtactataagtttttcttgcttaatgtctatgagttttggcatctctattacgtgagaaataaaaagatgaggatgggcaatttacggtgactttctttttatcttggcttttgatttgcccctcataattaagtggatggcatttttcttgttttccacataagtgtgtgtgataatatgacatgttgtccatgagtctagttgtcattaattatctggatacggtaaataagcaattttaccgtaaaggaactaggtctacacacttgacacaaaacgtgggggtaaatatacgatgggaaccatagctaggtggataatatgaaaaccacgatatagaagttctcaaataatttgaaataaattcttgcatatatccccctacatgtgtgaaatttttttatatttttttccaaaaacttctactccctccattttaaatatgtaacgttgttgacttttagacatagcatttaaccatttattttattcggaccattatataagtatcatttattttgtcgtggactattttagcattaaagaacgctttaagcatggcttatattcatattatatatacatactaaaaatttaaatgtaacga

SEQ ID NO: 52697 - DNA, 4931 bp, Oryza sativa
cattttcttctgcacagcactgctcgctacatcatccatcacctgcttcgtcttataatcagtctcccatctccatgcgaccaaccaaccaaacctcatcagatcagggaattaacaagaagaacaagaagaagatgagaagaagaaaaattcagaaaaatgggcaggcagcagcattgatcacgccactgtccggcagctttcgcctctgcatgataaattggtgcagagtttggcgcctcacagcgatgtctaaccttcagaatgtcgagcaggataacgacgcgtctctccatcgccatgcatttccagctccatccatggctaaaattaaaattaaaagaaaaaaaaaagaacccttcccaaatcaaccgtacagatcaggtacagcttcatcaagcctttcatgattcgttggagtgtaaagtcttcactcagcgatagtaattaacctgtgataagattcctagtgcctccatcttgcctagctagttactcctacttacattttgtgtggcagtagtagtttgatgctgatggatggtgaattgctgtggagtgaagtgaggccgagtttagatccaaactttttcttcaaacttctaacttttttattacattaaaacttttatacacacataaacttccaacttttctatcacatcgttccaatttcaaccaaactttcaattttaacgtgaactaaacacaccctgaattttgctagtagctccaagctacggctttcagagtttcagtgagaacaatctttgacggcatgttcggctagtgtccattaatagttatattaattaactactactccatcggttccaagatataagatgaggatattaggatatgtcacattcatctaaaatcatttatattttgggacggaggatattacttaatacgaggaattatattcaccgaattgttgctacggactatttattactacctccgttccaaaatacttatagttttgaatttttgtttgtaacattttaccattcgtcttattcaaaagattatgaaattattttttattttgtatgtaacttgctttgttatcaaaagtactttcagtataacttatcattttttatatttacactaattttttaaataagatgaatggtcaaacattgcaagtaaaaaaaagtcaaaacaacatctaattttggacggagggagtatcccaattttttttaataaccgtcaatgtttcaactcttatcattaattacccataaatgattagactacgatgaatgagatcatgtttatattcaagacaacatacagtttgattatatggtgtttttttagtatctgtaatgttttttagaacaataaattaaagatgaatagtgcctccctcgcaaaaaaaaagatgaatagtgcccaatattagttatttgaaaatggaggatttaagaaataaacctacaaataacttaacttaggataggtgacctaaacaatacaataagaaaattttcctaaaaaatcgtattttcactagtgtcgagcgaataatccatgtcaataatctgatgagtaagttgaaaaaaactagtaggatcaaacatacatggacggttaggtggcgctctccactatatgagactaagaaacagggcaaagtgactgttattttcccaggttcgaatactcccttatatattaaatacggcgtttggcgaaaataattcttatttctttacaccaccgttgttattaaggtacaagatggatacgagggtgacgcgaaacctaatcccagaggattagtaggggaaatacataagcttaattgctttttttttaaggtatctcgaggagattgggcacatgaggttggacaaagacaacaaaaaaaaaccgacccttgatgctgacacgagcgtggaacaccatttgcagaggagcttagcctctatgcttgccggtgcaaggaagccgtacatattgatccggacacgactataacttaaaagaatttcaatttttgcgagtagtaatcatcacgtttattcttgaagaaatatatattgctcgtcgtgacatgttcagatcatgattgtactctcaacgagtgtgacaatcagaattcctttttttttaaaaaaaaagactagtaaatatgtccgtgcccatagagaatgggttggttgtgaatttgtaatctattttaaaagcacatgatcgttttaagaaacattttccctttcttgtttttctcaggtatttttttctcaaattaaccaggttttcttttttttttctctggtaacttttttcttgcggcgatgtgctatgtacaggaaggtaggaggacgattttgcttttgttatgactagtaattgtatagagatatgactatacataccttatttcagggttataatcttataatttttttctaccctatcaatataaacgtcgcactgtctagtacgaatcgttaaaaaaaaatcttgcatcatcttaaagttgatttttgagagttttttttcttcatcgtgatttatttttagcattacctttgaaatgagctccctgaccacaaaaacctgtctaaaatcccgttcctcctgcatccattggcagctaatcgtaaataatgccattgcataatgagatccagccaggtatcgccgaatagcgacgcataacctaccgccgagaaagtcatttgactacgtagacactagacagtcgaaatcattttgtacggaaaaaaaaaatctaagggcctgttcactttgatgccatttttgtcaaaaaaaaatggctacatttagtttgttaccaaattttggtaactatataagaaatcctgccaaattttggtaaggtttttttggcagcaaagtgaacaggccctaatactttttttttttgttattgagatggaaccctaattgcctttcttgtggttaatctacatattttttgcatgcataactaatctcttaatgagcaaattcgacctaaagcaatgtgactgactgtatgggccccacgctgatctgcatctgtagttcagttaagcaacggaatataatatcagatctagaaaaataatgtcaaactgtagctaagttcgaatggaaaaatgatggggacaggcaatgaaatgcaggaccatcagtgataaggtgaggataactatcatcatagacaaaatgcaacagggtaatacatggtccatccatccagctagctgctaattggccagctcatacataatcagaaagaagaagaagagggtgctttgtaatatctgcaccatatctttatacacaaattaactattttaatttgttacggttatatcaaaatataatcatctcaaatagtaggtaccaaaagaatcacatcgccctacaggcagactatgattaagaaatatcctctcttaagagcctaatgatgactgttagcttcaagagttcagagagcttcactagctttgccaatgggagttttgcacttgggtctcttccctatgtacagattgtcattcttttccttgatcagtgtggcctaagcaggttagaactccattttcatgtggcctgcttgctgctgacctgtggcgattcaatgattcgcgagtcgtcagtgaaatgttattagccaaggtatgcaaaattgagcagagaattatcagttagttttaccaaccatggaagtttggtgctgaaaccccattctcctggctctgtccattctcaatatggaaaacactttggagatcatcctcccagaagttcctttgctgagagaagtacaccagctatattgttaggatgctatttctaatgattcttggttaagttacttggatgataagtagtttaggcgcgaataatcacctgcaagtttgcgccggctgttccatcttgaaaagcatactgtgcagcatttgtagcctgagatagagccaggtccaactgattcagggtgcactggctttccatgctgttttgagcaaactgttggaaaacatctccttgttcggcaaaccgaaaagcagaattggagctttctaatgagaaaaccgagctcgctgaagggccgcatgcttggaacatctgaattgtatcatggaaaatgtgagtaattaacaagtcattgagcgcatcacgaaggtatgacaagcaggagatgattcaagctcacatctttctgcagcagagtaggcaggttactgaaatcaagtggattcacagttgctagcttcatggacaggaactgaagcgaaaaaagtaaatacagcaaaattggtcagaatttcgagttccgcattccatggcatgtaacaatttcagcacgcatgtttatgactattacctcaacttgccgttgaagcgattgcacgtagtttatgatctcatcaagcatgagtgccttgccaattacctgcaattcaagacaacatttaggcgcgtcaaaactacaaaacttctacaaactttgctggcaaacacttgctccttttcttctacagattctcatcctgaaatcactagttagtcgatataccttgttgcatcctggaaccaggtcctggagaaccttcatcctctggctgatcctctctcttctgacctaaccaaatgtaacaaacacacaattcagcacaaaccgcggaagaattcgatcgaaccgggtcgaaaatcgagcgaattcgacagcatcatgaacagaattgtaccctctcagcgaggctgtggctgtcagtggcttggcctcgcctcgcccggacatggacatagtccttgggtggctccaccggcttggcattcttccccttcccttgcttctgcccgccaccgccgccgtcctcgacggagctgtcgctcccggcctgctccgccttcggcttcaccgagctctccttctcgccattgcc

SEQ ID NO: 52698 - DNA, 10998 bp, Oryza sativa
cttcatcgccgaggaggcggggtcggacacggaggacgcctccctggagccacctccggcgaagtcgccgggagccggaggaggcatcccgaagagccccgcccccgcgccgccgtaccgctgcccaacaccgccgccgccgttgttgaagctggacagccgcgcggcgcgctccgcgaaccccgggtcgccgcagagcttgtcgaggccgcagtcgccgccgccgccgccgcctcccggcgccacgatggcgtccagcaccggcacgccgaagtcgagccggggggaggagctgaggaggctggaaatgtagtcgcccccgaccctgccgccgtccatcgccgccgccgtccaagaaacggcacggtgccccttctcttggctcctgtaggggggagagcttggggtggtcggcaatggcggaggaggaggtcaaagaggcggaggcggtgaaggtggaggttcagcctttttgggttagaggggagaagaagctgtttttccagactgcggacactgcccccggtgccttttaaggtcgggggtgggtctcttccgcttccgctgccacttccacttccacttctacccaccgtaagaacaggtacaatagcggctataagccaactataaacatattttaaagaaataaagaaaaagagagaagagcagcgggctacagatttgtagccagctgcagcatggactctaagacgtaacgtgtgtatgataggtgggaccagatattaataatatagtaagcaactattgtatgaattggctattacaatgactctagatgatttggagctagtagttagctatactattaaacttgctctaacgggtggtggtaaattccggcgcacggtgaccgagctctaacgtctggtggagatggagggatcaggctcctctaccgtcaaaggtaggtgcctttatcaccgatatgtcgcatgtaagtgacaaaggcacgatgcctttgaaggcaaaggatttcaatccgagatggaggggattaggatgggaggcaaaaagatcgtctaacttactgctctctgattttgagtagatgacatatagatgctataacttgtgggcctatatgttagtgatccatgttagagggcagtatgttagatgagtttcttctagagtgagcgtagagaaagaaatattttggcatctgacactgagtggttgatatgtggtcttcacgactagttggtgtacatgtcactgtcctacgttaatcagatggatctctttgtgggagtagggggacgaaaacggttagaagtgatattaatttttaagaaatgattcttgattggtcgttatttttattatatttattaaattaattgtttcagagattgtactataatgttgaaagaaatttatatgtggccaggattgaaaaataccgttttatgcacaaatgatccttggtcagttgagagtttctgataccgttttcatccctagatggaagagtacgttggtaataaatcttctatctgtaggagaaaaacagagccatcgcattcgttgtgaagatacattgttctatcacaatatagattgatcatgtacaatgcaatgatgtagcgtttataagacaatgtgcagttttgcacacctttccctatattttagccctcactctcctagcttcctctttaatgctcttatggttagcgagatcgagacgaggaaatgttagctagcagtgagctcaaatagaagagaaggtgcaaccgaccgtaagctcgagtagaggaagggctaggtcaccgatgagcttgagcaacgggggttggccattgtcaagggttagcttgagcaatgaaagaagagattgtggccagcagtgtattcaaatgacaattgacttcggatgcaacgaagaaagaagagaagagagtgggagaagataataagaaagaaatatagaataagagagagaaaaagtatggcctttcgtctaacgaactagatagcacaacatcgttcctaaactacttgatggcaaaagagcaaatacacacaaacttaagttttgtttggaacaaggtatcttttaagtaatttcggaggtttgcattcctttggaattatcttttttttaatataggtttgtttggggcaaaggaaatgttgttgaattcctttgaaaatgtagcaattctgcatttttttttgggaaagaaaacatccaatgtgagccaaaggaacttttcctttgcgtcattcatggctctgcatctatctctttcctagattttttttcactcatccaaacaactcaaatttcaccattcgcttggattgaattccttagtttccactttacaccatatcctaattccgtgtttttcatttctttgttccaagtagaactttcgtgttatattatcaattttccttagaaaaccacatcatgccttcaaggttatttcaaatctctttaagaaaaaagtaaattggactaacatacacatacctcaaagtacttcaagatgtgatttgtgtattacataaaataagaaatagaattttttttagataataaaataagaaatagaatggaaatgaagaagaatggtgttgtaaaacaccggcagtcttatccctcaagcacactgcagacatccaagttaattgtattatgcacaagctacatgcccctacaagtactttcataaaggatgagccaaatctatgcttttccttccgttttgtatttattagttattgcagatctgaagtgaaatgcaaaatgcagggtctatttgtatatgagaaaattaggtattgtatgccaaatttgtacatgcacgataataggcactaggcaatagtcatttatgcatccttataggcactaaaatactagaccacagaatatagcatcagcttaattgtctaccattacttctgaacaacagaaaattgatggtttttggcaaacctattgcctaattgtttagccaaaagtagcatttagaaaaggaccatcgatttctttagaattcaatggctcacatccgtttcaggtttatcctcgtggataattagatctgcctaacatttcaccatcttcttatcagttccttgttttcattaaagagatctgcattttcgtgcatgcattatgttgagattcagagagctgccaatattactcctattatcaggaatagaaagcccatgtaggcttttcttttaaagaaactacatctaggcgcacacgcatgacgcatccatactcaaatattatcggaggcatcagataccaccccgcaaagcacagtcatgcaacacactaaagtctacatcgatacaattggtgaacgccaacattaaccgctgaagcggcatatttgcaaacgaaaaataatttatgaataaagcttgtatataggtgttcttagcgatctaaaagtaaaggctagaaaataaacttcgatgaaaagaccccaaaatcaacttcaaatttaaagttaaaaatttaaattttggctgataagcataagtataagcgaaaagatgaagccataaatctagaatctgaattgtaatgagtttgtaacacaattgtactacttagctagcagaccacgggttaaccccatgaagattcaatctcacggctcccatgactccataagctaagaaaatagtacaacaaatgagatagattatgttttcaaaaaaaaaatgagacagactattgattagattaatatcgtggattatctacttcatcgtacaaatatattaaatattttgagaaataaacttaacaaataatttagaataaatagtctcagcaatatatgagagattttgtttttaagaaaacatattttagaagagttggtcaaataattcacgataataattcggtgaagtcattatctttttaaaaaaaaaatcggtgaagtagctggtatgaacatggtcctctcacacaattacttgaaactgttattataaagagaaaacagagcttgatcgatattacaattacctttgttccagcagaaatgcagcgttttggcttcagcgaacctcagcctagtttataatgttctgaaaagaataagttagaaggaaaatcaaattgtccaagttgcaatgataagggatcacattttaccacgacattgttctctacgggcacaatcattttacttcagatatgttcttgttcccccaaatcatttcacacctgcaagatcatgactaaactattttcaagtggctttgagcatctaatttcctctctagaaaacaaatgtgaactgcgcgttcaaaccaagtttagctgtattagtttcctacgccgaaactgcaatgagtttcttgccaataatttcaaaactcacaagttgccttcatttgaatatttgtccctcaaggcaccatctatacattcttttgtcaacggaatgcagagccagagtcgaataaacaaacgaactgactatagaataaacagatctttggcccaatcaaaactgttcccaatcagagctcacattattctagttaatcactgcatctttattctaatctgcatcgggatcgctgcagcagtcacatgcatcaggacgttaaacaagtcgtcgactgtactgacaaatactaatttgcaaactgaagtagagtagtatattttgcttgtggtcacaatctcgaattcacgaactgtatatatacgactgcacgattaacaattggggaaaggaaatgtcagtcttgagcaatgtaaattcttctcttctgaagaataatgaggtgcaaaactattgcgtattccagaagaaatgtctttctgaagcaagggcagacaatggtaattcattttgtaactgtctctgcatttcgattgtaatcttggtttataaatcagtaaagcatgaatagatcctgatttcaaatgaaaatgaaactagagattggcaaatttttgtgctgatcaaaaactaaaaaagaactggattttgtcgatttcgaaaacgtgttactgatgaatatctgaacaacactatagtctacagatgatctgaagtattctgaaccgtgttctacaatatattgccaagaatctaccatcttagcttgcaaactcgcattgccagctactgctaccactgtccaaattgaagactccattttttttctcagggaaaaattaaggctatgttcgcagcaactacccgtcgaaaaactggacaagcaagtaggtgaaagtgaatttgacacggttcttgattataaattgctcaagggacaattacaaccaactgtacgatggaacatatcttctaggaatatacagtaataaatagtagtagattagggcatcttatgagctaatatagtacaagcctatgtacttgtttaatcaaggagccatagaaaaacttggcctctagttatttactcctcctgctcaatcatttgaggcaaaatggaatccatgggcgtccaagaactgcctgttcctgcagttccttccaaaaacaattttaatagttttttccaatccaatttcttggcattgcaaacaccacagatgcatggcaacacaatgtgagcatcactgacatggcaagttcatccgagatggtaagagagagtgtcggattgccacattggcgccacgtcatgcagagacggttggtttctccagtttgtgtgttgctttaacgttggtgtttgttttgtagttgttggatctgaactttgagcataaagtttggtggatctgaacatagaatagctgcagaggacttgcatttccccaatgtatattctctctcgagatgaggtcaatgattgctgccattttctacctgtctcggcttacttcttggtttccctgtcgggctcatggataatctctgcctttctttcgctgaaaagttgacagttaaagacattaacatatcttcatatcagaaagacaattttattgataaaaacctgggtattatgtgatccaagttgcataaaactacaataattttgatacgtgacccataatctttgatattatggtcattatgatcttacagttttataaatcacacagttaaccaaattgacttaatattataaaaaaaatatagaatatttgatacaacatttatatgacgaattaaaataactaatacattttgaacacaagtttagagatcaatgaaaaattggttaacgatatgttttgtcaaatctcagggctatatgcgacactctaaagtttgggcatatttggtaggtcctaaatttaactatatgggttgggtctagagtggagttatggaactgcctaaaccacatctctagttcattttgtgagaacgctccagccaacctcgctctctttttggatggagttgaaaccatttggttggattctagctttagaagagttagagctgtaccaaacgagtccaaaactatgattttatacaacttgaaccgtttatggtgttgagagatttactctatcgaaaaaatccccgatcctatcctaatcctaatataaaatgcgagtaaatctccatcaacaaaaacaaacaaatcaaactaaagatatgctatgcatgcaccagaatacataatattcagtcatatacatccaacccttcgatctgaactatcactgtaattaatttccaaccgttctgacggacagagagctcgatcgccattgatacaccctcccgttctcgcgctcgatctcccggcgtccgtacgtaccaccgccggcagcaatggcgccaccggctcatcggccagccagctgccggacttcgccggccgcctcgccgtgctgcgagtacagtgccgcgtgcgccttcagggcaactgcgatgaacatgcagagaggtacactggtactgcgtacttcgccggcaataatctctgaaaaataaaataaaattttccattgctcgcagcttttgacttttactgttgccctgcactcgtaaagctggaaggacgataggaaaaagaattaacaaaaagtaaagcttttcctacgttctagatggtgtactagctaggaagttagtcagtcactgcaagaaatttgatggtctttttatttgaccgtaactaagatttcatgatcttggcctcggtcaatatttcctcgtttttatgagaattgaacggttttctgtgaaattcccgcgttccaaactttctgatagtctcatacagtttaatttgtggtcctccatctgtttcaaaatataaggcgtattttgtttcattagaagaatggtttgacctacaattgctctattacgatactataatttatgtgatacaaaagtataataataagtaatccgttacgaatctaataaattcaagtacttgaaaggagtgtttatggataggttgtccctgaaaagggagattttttcagacaatgccctgaaaaaaggaagaagagacagggaaagagagcattatgctgttaagctgttgcccagaaaacattatgctgctaagctgttgccaccaccactgcaggaattcagaggacactgcaatgttaggcatcagcacaggctttgcacactctcctttattccaaagggagaacaaaaaaaaagttggcctacttattacttgaaaccttatgccaaactgctgttctgcatttgctgcagtagtagttgtagtgcttcatcctgaactgtcaactgaagctttggaacaaagaacaacaacagcattggccagtgtggccttggattggattgctgaaagctaaagcgttggattattacctgcctgtgcaatccaaggaagagagaatcggaggaaagattagctttggtgtcgagctgtggaagaagatcacctttgtgacagagagagagagtgatggtactgtagctttgatgctgtagcggccgtggaactcccgtcagaaagctgtcattctactcgacctaacatgatgttttctttgcaaagagtgaacacgaaaggtgccctttattggattctctctgaactttgatttattattattattatttgttcaaaggtagtagcttctgttttttttttaacttttcctactgaatttgatcgttgacacgagctgaattgctgacaagtcctttctgtcacctgctagtgacagaaccgtaggtaagaacaatatcacgattcacacaggaagtatgccttttgagactatcgtgcgagttgtaggtatgagattattcagtttcaaagctaattatgctagtacgatgtactgaatttggaggagcaaggaagaatgatggagagatgtacagtagtaaactgaagagaggtgaagcaaaacaaacctgcacctgtttcttacacacaccacaaaaatgagaacatttgtaaagatctaccagttatgtttgccatcctgagaatgacctaaaagatggagaaaatttatagagtaactgaaatccaagataacctgcaaacagcacttctttgcaagtttcctctgatactgaatcccatggcctcttaaagctcaaatccatgtaagtagccgtcagtaagcaacagactgtctactactggtatctaaaatcctaagcagataggctggttatggatgactaatgggcttgtctttcttaataagtatcactaccgtcattagagttccaagatgttcttttgagtcatccaagcccatatatagatagttctccgaaaacccatttgggtaactgaccatttccaagttagtttcacatatgttgctgccttttgacgtggtacacaggcaaaactcaataggatactgcctgaaatttgttgtatccagttgtaagcctttatgtaaatgtcagaaaaaaggttgcatggatgtagatgccaggtaaaaaatacctttctctaaaaaaaataaatgtcagaagttatatgttactaggctattatattttcagcttattcaccggattattaaatgaatcgtttgctctaggcttcgttacggcttcttaaaaactatattttactgtattgtttagatcacttattttaagctatttgtaagttaatttctcaaaattttattaccaaataatcgacaacaataatctaaatagaataggaccaagaactcaaagtgagtcctgctggagttttctagtgatgtataatgggcaatccaatgatgaacgaacacgtctacctgaatcatttttcctggtttacttttgaaacgaaattgtttgaatccgttcgttccatgatattattggccggcctccatacattcatcaaaaactactagtacgagtagtttaataaaacctttaatggcttggccgtgttcttttttcaattctggattctgaagttctatttgcattcatgaaacaatcttttgttgctctttagtttcagatggctcattattttgcaacaatcgttcagtccactggcacccatcaaggtgccgcctgcggttcaactcgaattaccatcaaaactaaaagcttctcggtaatgggccatacccttcgcggaatgtccggggtccagatttatatgggccgatatatggggcacagcatctgtgagtcgaaccagactctaacggcccaaactttactggcccaacgggaccatttcactctgtattaggcctggcctattgggttccctgaattgggcctcgatcaattatcttgggccgcatttattcgatgaagcgccacgtcaatgcgagtcaaattagccacgtagacgccacctgagctaaaaccgggtcaaatactgccgagcgaccttatttgttttgcgttcaagggacgaaaatcagactagacgacaaatagagggacccaaagtgaacttattccgactcggattgcccaaacgctattcctcttgtatcttgctttgctgatgctatcggagggcgaaggttacttggttggctacggttttgagcaaggtttacaatctcgagcggtatcatcggatttcatgggatccgtcaaaaaaaccgatgaaattcgaataaatttttatcaaaaagttaaaattcagtttaattttttaaaacttgaccaatagatgactgcaaaatttgtatgcgaccaatcgggtgaatataacatggcagctgatggcccactagatagaattgtgggcttgtggcatctctattcttaattgccgtttaatagcctggacggaagtttgagccttcaaaattttctaggctccagaaacccaattggaactacgcaaatcacgttaaacagaatcaaacgcagctgactagataaccaatgcggccaggccactggcaggtgatcccgatcctacccgaacattatagccagaaacatgctgatcaggacgatacctcaacacaataaattcaacagatacaatacagcattcatccagagcaaaaacgcaaaatgcaggacatgtaggctaatgatgcgatagtaatttggccacattagagtagctgctggtagcaaaaaggttgacataatagttatctttcacagtaccacatcgattgaaaggagaatacttggaggcgcgacagtttcctacaatcaaaccagaccaaaacattatactgataaaacagcctactcgtcctcctggctacggagccttgcaagcttgttggtgaccacgatgtcgagctgcgcagcacgctcaacgatctccttgcgcttcttcgtagagacgttgtgggcaatctcggcacagtaggtcctgtttacaggagaattagctcattagcagaaagtttgtaactgcagctggtgctgacaacagaaaacagcaatgctgaacaccaccccgctgaaagtaagcttggtgaacaaagtgattacctgttgtgcatcatgagcaactccagctcagagacattgtgcaccacaaacttcttgaacttgttggggaggtagtgcctgg

SEQ ID NO: 52699 - DNA, 3948 bp, Oryza sativa
agatcgacgatgcagcaagcaacaaatccaaccagctgcgtgaagaaaaatcttgattcctgggcaagaactgacgctgtaccttcggatcggagagggaagcggagcgacgaatttgggggaagaagacgcggcggcggtggcggtggggaggatggcgaagggttcttatacggggggagaaaccctagcgggctcgtggccttggtcgaatcgacggctaggatctcgtgagatggaagcggacggccggatcaagttgtatgggtgggccgtcctggcattccaaactgggctggatttgctgggataaatgggccacgtgcgtggttaggcccatatgatctgaactgggctggttctgctcggataaagctgcttctgggctcgtttgatgggcctcatcccacccggccacttagatgggccaggaaattctggcccaaactatacggagattcgtgatgtccaagcagcttgtctgttcccgtttggatttttctgatttgcagaattcagtagaccgaggagaatttagtagggtgtggtccgtagatttggaaggattcttatcaaattttcggcaaaagcgtctggataagacaagccaaatgttaggtggaaaagtataattttgccattgttgtttcactttgaacaacatccattttaaacggcatgagtcaccaaactataaatcctaaatttggtttgtataattgaatcagactgtgccaatgttacagcccatgtgcagtgtgcacgctcctcacatcttggtaggagtagctaggagcgcactcagctgtcgatcgcccttttcctgcactccagtgaagggggtccaacacaactttagaagaagaaaacgaagaaggaattttcaccatctcggcacatgatagacggccgtgccgggcccgttcacttttgccgacccatcctcttatcacacacccttttctctgatccattgagtgctcatcttgcttgtgttcatgcatctacaactcctcatcctatattcctatcttgatttctgctgcatcagtgcatacacgattcggtcatttcagactgcatgtgcactcattgtactctcgctgtatttggattgctaccattgcatttttttttgtcagtgctaaaacttagttaaattttgacactactaatttttttagggtaagattatatttggtttgctatcatataaagccaacttatgaattctagttaagattgttctagatattgatgtcaaatctagcatgggcattaccaataaattggttttagtccaaactaaacacatgtactatttaaactaacaaaatattggtagggctaagttttggtagcaacccaaaatggctcttagacttatcctaatgctacaaatctaaggtatatttagattcatagtagttttcatccctaattactactgtctttatcttaaattatgaaaacctaaatgaaatactagtattttctagtagtacaatctgaccatgaggtagtactgcatttccttttcgagtgcatgctgctgtactgcatcctcatcgattcagagacacagtacacatggtagtacgaaagagaaataaaatgtgcgtgacattatcgccgttttttactgcaaccatgtgtccatctgaacattcatgctcctgcaggtacacggtatatgtacacactagctgctactactagtacagtattagtaggttattttgtgaaggagacgagacgcaatctggaccgtccgatccatggcttcatacaaaccggtcaaccgtgtacgtttggcaccgtagcagttggatcgtcgctatcatcggtgttcgtttcggcaagctgacaattcctgctgctactggtgcgaatcatcctgctcgtagcgtccctgattctcagttacaccgaaaatccatactactttaacaagactctaataatgataacagtgaatctgtcactccaactgcttccatcgtaaattttacaaaccattcgatgaacttctttatgttaaaaaccaatcaatctaaatggatagcgacgtatagaatcaaattgagacaaatattttccatagcagaacgacgggtagaacatttcaccaaaaatgcattttatccgtagtaaaacacgggctttagctagtctaccaaaattctctactaaagcatgtacatgtgtgtgtggaaatatatttaccactgcctttatcttaaaatatgctccaataactttgtctcggttcatagttgctatattagctattaataatttggataagtcagtatctagattaataattaaaagttaatacttccttttggaaagaaagttgaattcttggctatgaacttagacatggcacatgtctatattcctagtcaagattcatttgttttggaattgagggcgtgtatatctaataggacatactctctccgatctttccgtttcaggttataaaacgctttgactttaatcaaagtcaaattactttaagtttgaaaaatataataacattttcaacccaaacaaaatttattataaaaatatattcaattattgatttattaaaactaatttggtattaaaaatattactatatttgtctataaatttagtcaaacttagtttgactttgaccaaagtcaaaacatggagtaaatctgaacatagctatatccatatttatagctgaaaagtgagtactattttgggaaaaaaatacatagtactacctccgtttcaggttataggactttctagcattgtccatatttatatagatgttaataaatcgagtcacatatatatgtttagatttatttatatatatatatatatatatatatatatatatatatatatgaatgtataaaatgctagaaagacttgtaatatgaaacggatgaagtattattagtatatcttgttaattgctattgcacggacgtattactgcaaaggattaatcctcagtaaaagctggcatttacactccctcccaacggtctccagctagctgggctggtgaatagcgtaaacaaatgcaagctcacatgcacactctgttcagacattcatagttgcacagtccttgtacctactgcagtcactgttgccaacctcactgacaagaaatacaagacaaattcatgggtaattaccccccggcaacacataattatatcgcaaatacataatcaaatccagataacgcaactgcacagtgcacactcttccctgccaacgcacaggatgttaaaacactgtaccacactgatccggagatccgaaattaaataaccccaaattaccaccagatcaatggcatgtacaacaatagtaaaatcactgtactaatctagtgccgaattaacaacaagtgctgtgcaccaaccatttttttattgcaaatggaaaaatcaaagaaaaactaattataacaaaaaaaaagcaagagaaaatgaaaaaaaaaagaggaaaggaaacaagaacagtagggaaataattgttcaagaaatgattcatcatgcaaacatcaatgaacaccactaatcatggtactaggacgtaggaacgtagctgtcaataatctttatcatacaatcgccaagaaacccaccaacgccgccacggcgagcgccggcgccgacacggcggcggcggtggtcgccgcgttcttgccggcggtcggcgcgacggaggacgacgcgccgctgtcgctgccggaagagggggcggggccaccggcgacgggcgcgggcgccggctcggacgccggggaggtcgccgtggcggccttgctgccggcgaggaccagcttggccttggaggcgaggttggccgggccgaacgcgtgcttgtcgggcgcgcccccggtgacggaggagccgacctgccacacctggttcacggact

SEQ ID NO: 52700 - DNA, 5295 bp, Oryza sativa
ggtggggttcagcccccacgccacccacccgccggcgcccgccggcgccgccacgaacgccaccgacagggacgacttggacgcgtcgtacgtgtagtgcagcgccgcgccgaggctcggcaggtcctcgcacgccgcgtacgccctccccgccgggaacttctcgccggcgcacgccgcctccgccgcgcgcattgccgccggcgaggcgaggaggatcagcgcgagcaccgcgacgagccgatgcggatgcgccattgccgagggcgagtggatctggagctcagtggagggagaagctcaagtggttggctgatttgctttgcttggcctcttcttctcctcctccttgaagtgtgggagtgtgagggtttataaggagtggaagtggggttatgtgtgattatgagggttatcagggggttatttgttaatgttttttgaattttttgaagatggaaagggcaaatttggtccgtatttagaggggtgtgatatcatttggttggtgacaaacatgcatgagacatgaatcctgactcccgtgagtttgttgcgtgtgttatagtagccacgaggttgtggggtttgtactttgtacctctgggttttattatatttgcaaggtgtcatttgtcgttagattcaattttgtttaaacactactcctagtactttagaagtacattctcacgctataaatattaatgactagggtaagattcggttaaactttcaaaattccgacgattggtaatttttagaatgtttaatttggaaatagaagaaatggtatacatatatttgtcttaaaagcactatcatattgttagtattctaaatatgagatatcatatacttctcgctccacatatgtactagtattagtggagcccactatataccaaatcatatacggaatcaatactgctatggcaagtgtaataagtagataaggaagtagtcatgtataagaaaaaggaaacagagtcctatttagatctaaccaagagtccaagactacccgaattgtatacataattgattttcctagttttacttgatcaagagggtatttataataacagtataaatacaaaacctcacagaaggagaggagacacgaatccaacaaggagggttctagagccacctctcaatcttgccaagtttgttctcaaggaagccgatatcaattagccatcaagcacatgcctgagcttcacactggtgtactagcaaactagattaggttctactccctattatatttatgagagatattgatatataatggtaacaccggtttcggtcagtaggaataggaatattacttgtcaataggaggttggaacccgtatacttttagagttttgtttgcattcccatatcagttggtccctacgttctcaaacatcctgtatatatatatgaataccgtgatcgtggtataactcgtcgacgaatactgtaataattttttactagattatataaggttgttttaaaatagatgatcggaattttaaaaggcaaaccaaatcaatttgtccaaattttcaaatatttgccaacaaagcactattttatcataaaggtgcggtattgataaataaatcaataacaccctctctgaaacagatgaattttacaagcactaccaactactactacacacgtccaaatatagcaacttcctggatataggatatagatctggaaaattacttatacttatccacattcatctcaatataaactaacttttacgcatgaatttggatataacgtatatttagattcatatataaaagttagtatattttgtgacggagggaacatattttaggacggatggagtattttccaaataaacagtaaatcttcgtaaattccaaacaggacatgaatatttgtcaaaagagctttgaatcccaactcacaagtcatctaacttcacaaagctagtccaatattgacttgcctaactccaaatccttcaaaaccgtgtgcagagagttgacggtgggttggctgaaaaatgtaaccacacacgtaaatgatccatgttaggagcaccgccactacagagtgtaatacacatgcgaatttttttattaccaaccaatcaatggtcaatgcatcttggttaatttgttactagctggccaattttttttttgtggagatccaacagaacagaacaccaagtctgaaacattcagaattcagacgagcagctctgaatctggccatgtgtgacccatgtgagaacttgacgcgtgctcccaacggccgggtgattagtagactgaatgatcagtaaaagacttgcaagcttgctaatcttaatcagtctaaattaaccctgaagctagtatatcattcttgactaagggcacatgaaccgatgcatgttcaactctgcacaggctatgacaggcttagggttaatttgattctgaaggttgacccgtgaatacgagattgcatgacgaatgggatgacaactaggtgatgtaattacaggatacacatggaagcattcaggatggagtgattggattaatcaactacgataacatgaaacagaatgtgatagcatgaagcgtacatgtgatcgattgattggagattatgttgtctgaaatgaacccggagatctcaatgaacctgtgttactgtgtacctatagatttggcagatccagaaatcaatacataaacacatcccttcgccatctcacatgatacgaagtatgaaacgtatccaaccattttggattcatctcaacaagctgctcaaaaaaaccctgtaaaattcacactcaaaacaaatccttttgcctctttcacctctgaactctgaacatgtctgttgctaactacaatactgtgtatcatgccatcatgcaaatcaaatcatcgtactctgcgcaaattgccaagtttgcaacggcaggggtcagcaataataggcaagaaaacaaacacatcttccattttagtattaccaaatactacattggagtacttaaattaatctgaaactataaaccccgtgatcattgataaccctatctgcagtactcgccaaacggccagctaggccatcagatactaaagcttcacgcaacgccatccagaagctgcaaaaaggtgacaggctacacacttgattattgcaaggcgggttatgaacttaatcagcatgaaatggaaggagataaaaatatgatatactcgattagatgagctattatacgggaagaaaaagttcggaggtcactgtcaattcagtataagtaaagcactagtatcctaaacacatcttgtagaagcaactcaatgatcttgtagaagcattgcatgtgattgtatgaaaaatgatcaacttttggtcatcagagtggctagtgttttacagggtgtaagtgaccccatctcgcaattggagatagcttcaaagggaaaactgaacaggatatgtgccaattaagtgattaggtgcctgcatatatacgaatgaatcatttcttcaatgatttgtgtctggtatacatgccagtattgaaatgattttggattcatggacttttcagtaactatcttttcatgatactgtatctgccagggtctgttttggattgcttagcttatctgaataaattcatttcagttttcaagatggcatatattcatttgaggttaggaatgaaagaatggacgcacttctcgagtaccatgtgattttcgtagaaacttttgatatatgatttttaaaaaagaataatcagttttaaattttataatagttaattcattcgtttgtactctcgaatagtgatcacaaaatcattcagccgttcagctctttagggggggggggggggtcactcttagctactactacttgcataggagagattaggattggaaatttgagcttttcaacttagctgaatctgagtctacttctgcaaaacagtcggtaaaacctaataaaaagagatgggccagagtgtcctatgtaagttctgattctttctaaacctgaagaaagctgttgaaaagctcctcgatggacgatgccttttggtacaaattaatctcttttcagatccaagcgttcccatcctgttgggtggttaggtttcacattagtagcaagctctgcacgttcacaactcttttgtgctggtcacagcgtttctttagcatcctatctcctgtgttttcggcgtgattttcaggtttcaggttcgaacaattagctttttgataggaccactctgagactatctaagtgggcattagccgttgggaattttggtaatgacaggttacaagcatcagaattaagacatactccttccgtcccgttccatactataagttattttagttttatcctaaatcaaacttcactaagaactttaattgagtttataaaaaaacactaacaattacactaacaaataaatgcgctgttaggacacattttctagtgaatttaatgaaaccaattcgatgttatagccgatcaaaggtaaagaagtttgacttatgacaaaatcgaaaatgacttatataatatatatggaacagagggagtattagcttatcttaacttttttttatatatgctagcttatcttaagtttggtttagatagtgagggagaagaagaggaaaaagaaaatgaactgatgacatgcatagtaatggtaatgggccaacttccataaacgttggatttgggccaaatactttaggtcaactgaacgtggttgaccattgatgggatgatgaaagcttcaaagccaccaactttttttctcctcctaacatatgggtgtgtttagttcacaccaaaattggaaatttggttaaaattgaaacgatgtgacggaaaagttgaaagtttgtgtgtgtaggaaagttttaatgtgatggaaaagttggaagtttaaagaaatagtttggaactaaactcggccatattttattccaacttccatgtggatgagagaaaaactggaaggactttttattcggctgtagtaattctgaagtgaaccacacttcaattttcttcaggtaataatgcccaagtccacaaaattgtgctgaaacaagtaataaaagttcacacgcttgactttgataaatcacagctgcggtagactgtatgaatcttttttagataatgaaaatggtttgtgctagtatagaaacaaattattcactgggttattcctacggattatctactttattgtagagatgagttaat

SEQ ID NO: 52701 - DNA, 4923 bp, Oryza sativa
acgtttttaatcgtcgtaatagttgctagctcgggttttttatttttctttttctccccctctcccggcataagccagtctgactgtttgttttgtgtaacaaaaactcttttcctgttaatatattgatgtgcaatctttttgcgcgttcacgaaaaaaatatgggtgcgacagatattattcccttgatctcaaaaagtcaaaataactgtatttttacactgttcatctccaatgtttcaccgtttgttttatttagattttttttgttagtatttttattgttattagatgataaaacatgaataatagtttatgtgtgactaattttttatatttttttcataaaatttttaaataagatggatggtcaaacattgaacacggatatactttgatcattgactgaatccgatagactttgaacctatatgtcagcaactaagacacggtgatttcgaagatagaaattcttgatccgtgaagtgaacggcatggagcgtgaataatatgggccaagtgtgaacctatcttatgtgggagtgggacgacgtgctgcacggttcgtccctacatatgatgcaagcaacagcaaacccgacgctggaggatggatggatggctggctggatgctcattctcattctcattctgtttctcctttcacggctggtgtttcttttcccacggcctcaggctggctatgacctcgtttaaacgagtttttttttttacgaatcgacgaggctgttaattttattgaataaaggagacgaaaaatgtaaaaaaaaagaggtaaagtatagaaaataaaaaacccagggccgtggccctaactataggcagttacattgtcaaccagacggcaagattttttgcgcccgccaacccccatgtttttgcttcctcctttgtcttggctagcagagttagcgacgacagctccttgtgctggaaagtcctccggttcctttcgttccgtttaaacgagttttacactataagaagcagcggatgagaatacatagaaaagaagaaaacaaacatttaacttctaatttatcttatatattttaccattatagattcttataatatagacaaatagctaaactatttgtgaagaaaaaaattaaaaaaaaactgagctaccaggatatctctaaaggtgtgtttagttcacgctaaagttgaaagtttggttaaaattagaacgatataacggaaaaattggaagtttgtgtgtgtaggaaagttttgatgtgatggaaaagttagaagtttaaagaaaaagtttagaactaaactcggcctaaacaacggaacctacatgtcgtgtcataggagccctatgacatcaaccatctcctgcatctctatgcacagatggctgatttgatctcatcttttcacttatatttatacttatcaattaaaatttaaatttttagctttaaatttaaagttgattttgattttttttttatcaaaatttatttttcagtctttaaatcgttaaaaacacttatataaaaaagttttaggtataaattattttttatttacaaatatgttgtttgaggccgtttttcagtgcgaagtgaacaactgcatgccaaacgcatcgccggagaaggaaggggaaaccggtgacggtgagagtcatttaaggcgttctggtagcctacgctttttattttttttggcagttggcctgcatcggtgaccaacccccgaatgaaatcaaccgttgcaatctcgcaatttctttctgttggaacgccattgatttctttctcccccaagactaattaacatgtggatgtggtgtcatctttcttccagccaccaacccaccgcaggagaaactctccagtcaacttggttttgaaaaacgcgatgagtgttctgatgatgtgtacagtacgtgcttcgccccgcacgccgcggcgccaaggaacttcgaataatttaccgagttgtatacaggccgctgccgctgctgagactgagaccgtgcttgctaaattgatcgtcctcattgtgtcgcgctccttccacgtagggctgatgtttcttttcgtatggcctctgactatgacctcatttacaccgtgtttagatccaaagtttttcttcaaattttcaacttttttatcacatcaaaactttcttacacacataaacttcaaacttttccgtcacatcgttccaatttcaaccaaacttccaattttagcgtgaactaaacacacccttaaacgagttttacactatgagaagccggggaggagaatgtatgcaaacaaagaaaacaaacattgatcatcatatgataagaatccaaaatttctcaaattgatcatcatataactacatgaacacggatttcgtcggaatataattaatgcaatataagtgaatgtgtgcatgctagagtgtaattggcatggggttttaagagcatgtacaatagtgctattaagaaggctccaaaacttattaatcagcctaatacgagattagaaaaagaaaatcgctaggagagaaacaaatgggcgcttgttttagcgctagcgcttgcacagcaccccatgcagtatcggtcacgggagatgagaaaaaaaatgctaggtgggtcccacacgaaaaaaaaatgttatatttaatgtatgtatgctttaaccaaggcagcttatagctaacttgtagttaattagcatgttgtatgagttggctttgtaagttagctctaccttgacatgataaaattttggagcttgccgctagctgcactattgaccttgctctaatcaatgcatgtattgtgggagaatgtgtgcatggtgtcttcattgatgtgattagttttggtgtataaacttatatgatgatcaatttgggaaggagggagtgctattcacaaggtttttcttaggccctgtttagttcccagaacaaaaattttcaccctgttacatcgaatgtttggacacatgcatggagtattaaatgtagacaaaaaaaattacacaaattgggtgtaaattactagacgaatcttttaagcctaattgtgccatgatttgataatgtggtgctatagtaaatatttgctaatgatggattaattaggcttgataaattcgtatcgcggtttctaggcagaatttgtaatttgttttgttattagacaaagtttaatacttcaaatgtatatccgtatatccgatgtgacaccccaaaacaaaaatttttgtcatctaaataagcccttacttcctccatcccagataaacaaattcatagtgtatcatatttgtttattttaagatggatatagtcttgttttaagatgggtttaggaaagaaggttagaaacttctcctatgcacctaaaacagggtaactcattaccacatgattaatacttactaggtaaaacaataccgaaaaatagattaatatgattaaaaaaaagtcttccctatcaacttttttactttttattaaaaacatacctcatccgtcttaaaatataagaacttttagttggatggacacagattcaacgtactaggatcttatattttgggacacagaaagttattatattttgggacgtagggattatcttctaaccgttcatagaacgtttgcgtgaaaaacgagaaaatagaagttgagacatgtactttcaaacatatctttattctccttttgaataataggttcccaactttaattagtcatgacttaatgagttactcgttccatctacttttgatagtcatatttctaaatctgaaaaatttatttttgataggcatatttcaatccaacaacctatcatcttaatgactttctcggatttaatacatgactctctattatttcacacatgattggctacaagagcattgagaaatgtaaatattaatgaattgcttgtttacgtgattataaaagtagatagagggagtatttcgttttctatacggagaaatgatttacgaacacatccaattgtattacggttaccgcggcgtgctgactgaccgcttaccaaccacggttcacacccatcttcctggatcaaaccggctagtaagctagttctgtgatttatgagtaattaattaagaagcatgcgattatctttctcatcatgtgccaaagattcagggcggcgaggcaatctcatatattctcaacggacaaataataacaacgctttatctgcagcagccatccgaatccatcggcgatgcacagcgaatgcattgactccgatgagtactactgtacttgatggtgttctagaactgaaggaaggaatgaattcggtttgagtccgtgagtggttgattgatacaggtagtaccactgtaccaccatttgtggggttcagtttggcatccaagtgattgtgctgattaattgtctcattgttcagccaatcaacggtacaagatgagatgagatgagaggatgggctgttatctctgatgtgttttctgcctctcatgtcatcatcaactcgcccataacttaaaccatattatttttagggatttagggatattcagtttatttaccattttcaagcctaactaattttagtaatattaaaattttgtaaagtttgataatgccacaagatttggtaataaggtaaaattatgtatgcagtattgtttagtttgttaccttgtaaagaataatttggatgattaccaaattaattttggtatggtaggatgtgataggttattcgagacatgtttggattgttgtcattttaaattttggcaataccaaaatttaatatgtttgaaaatagtaaaaaaaaagtgaacacgcccttagtttatttatccgattattgaaatggcttatttattttatgctttgaaaaccaa

SEQ ID NO: 52702 - DNA, 3430 bp, Oryza sativa
caaaaaaccttcctcaaatccaacctccgaccgcgtcaatggccgcccaatcacacgtccccacgtgtcccccctcacctccgccttcttaacctcgccacctcctcctctcctcccacctcgcctctctctcctctctctctctctagtttacttttcttggagccaccaagaaaccagccatgtccgtgctcggtgtcttcttggcgtcgctgcttctggcggcggtggcgccggcgagggcggcaggaggggggtgcgcggcggagaggttcagcagcaaccgcgtgtacgcggcgtgcagcgacctgccccacctgggcgcgtccgtgcactggacctacgacgccgcggcgtcggcgtcgctgtccgtggcgttcgtcgccgcgccgccgtcgcccggcgggtgggtggcgtgggggctcaacccgaccggcggcgggatggccggcacgcaggcgctcgtcgcgctgcccaaggggggaggaggcgggtacgaggtccagacgttcgacatcgaggggtactcgctctccgcgccggggaagctcaagtacccggcgaccgacctcgccgcggaggtcgccgccgacggccgcgtcagcgtcttcgggaagctggcgctgcagaacggcaccgccgaggtgaaccaggtctggcaggtcgggccggtctccagcgggtccatggtgccgcacgccatgagcagcgacaacaaggccgccatggggaagctcaacctcctcaccggggcagccacctcttccggcggcggcggcagcaacctcaggaagaagaatgtgagcactcttcaatcttgatttctagtatcattttgtttgcctttcttgaattcctaatcaaatttgagtgcacaaatcaaattgtagttagaaaaggggggcgatttcagctcgaattccaccagggaacttaactccaaaagctaaaatcctggggatttttttttttagcaaaagctctcatattgttgttttcttttattgctttatgaattagcaacagtagtggttactgaagtctgaagcggtactggtatgagtcaatttaatttgaagtatatgcttatgaggtggtagagcgttgaaaagaaagaaaaaaacaacacattttttaatgcttaagagtcaatctttggttaaaataatctttcctgcttctgttgccatgtgaaatgctcaaatgtttatacatatgttcgactgttatatcctggttggtttgagatgatttcaactgtgttaaaatctgtaggaataagatgacgtttgctgactgattatgtgtgacaaaatgccttctttgcttccgtactacacactcaaatttctatgctttcagattgcaattttcttgcctgtattggtttcttcctgctttggtggacttcagcacgatttgtctttcctgttgatggctacatcgaaatgctcatttcacacaatgcaaattcagtagagagtagggagccgtggtgttattgatgttctagtgaagggatcgatctttggttgcaaaccaaacaagctttttcttcttctgttgattcacattcacaaattgcttgaccatattgataatgatattatgatgtattactaattggttcaaacttttttctaattttatatgtgcagacccatggaatcctgaatgctgttagctggggtcttctacttcccatgggagccatatttgctagatatctcaagacattcaaatccgccgatcccgcgtggttctaccttcatgtagcttgccagctgattggttatggtgtgggagtttctggctgggccactggcattcatctaggtaacctgtctaagggaatcacctattcgcttcacagaaacatcgggatcacagtatttgcgcttggtaccctacaggtatgttctattgcacacattgttatgacctctttatctgccaatatttcaagcccattttgtgcaattgtacgatcatactgattgttctatgtgcactctttcttgaagatctttgcgcttttcctgaggcccaagaaggatcacaaataccgtatctactggaacgcctaccaccactcggtcggttacaccatcatcatactcggcatcgtcaacatcttcaaagggatgtccatcttgaacgtggagcagaagtggaagacgggctacatcatcacgatcagcatcctgggtggcattgccgtgatcctggaagctgttacatggagcatcgtcttgaagaggaggaaggaggagaacaagtcctataacggcgcttcaaacggtcacttgccactctctatgtaattcttgtagaggcaggagggacttgtgatccctacttatatattcaggaggctatattcagttatgtttatgcttataggattaggccttgtgatcttggtatctcttcttttgtatgatatttgtatactgcacactatactggagatgagagatgccagtacagcttgtttgattttttgttctgtttgtgaattgctgagttgaacatccactttgtatgattttggtgccattacaaatgttccttttggaaaagttgggcaaaggtgtcccaagtggttggtgaattggagaagaaagatgcaagaaaatgcttgctagtggaagcatgatctctctagaaagtttgatgctcgtagcagcctagcagaaaggaaagggtactgaatactccatttgctgctatgtttttgtgttgttcaagaaactgaagggagtgtggtgatgtcagatttcactttgtttcagtagcaaggaaacaaaatgtttggctattgtttcttcaattattagcttcattcagaagagtggcatgtgtccaaaacatgcaaatagaatccatctaaaataactgtgaacatgcaaacaactgaataattgacatatcatggcagttttaagtttgatgtaatagcaatttgtctgctttccatgcagacaactttattcaagattttgtgccaactggtccatgcattagagtgactccattgaaagaatagtacaccctccgttttttttatatagacggcgcgttcacttttaaacatatgtttcactaatcattttattcaaattttagtttacaaaatgtaaaaaattaagtaatgcttaaagtaccttttatgataaaccaaatcacaacaaaacaaatgataattacttttttttataagacggatgatcaaacgccaaaagtctacaacgttatctattaaaaccagaggaagggagtagtagttagagtggagtgtgtggttcaatcagactcagctaggagtcctgagcagaaaaagggtttgtggcgcgtgatttagtgcaggtcagttcacaactttcttgcttgcaaataggagaaaaaagatgctagatgttgtggcaaa

SEQ ID NO: 52703 - DNA, 6703 bp, Oryza sativa
gatcatttgtgagtgacacaccttctaagtgaacttggccaaactcaactactcctgcattttctgaactattagtattaagctgcagcaaaatcaggtagaaaaccaaattatgaccaaatctctgcatcactgaacttagatgacgaattgacaatgcagtccatatgatttgacctagcctaactcattgatttttgtcatctctgaatctaaacgtcatgtagctctcaactcaaacccttttcaattttctaatcgttagtcatgttcaaaccagaattccatcagattgtcaaagctaccaaacagtttggttgtgttgagtatgacccatcatcactcagtagggttcatgcaaagtcagttttgcttgagcttggctcaaacttccatcttagctcaaccagaactttttgggtggtctccttcagttgagtaggtagaactgcatccatctctggaacaagttgcaggtcagaaggagagttgagctgtattaggcctgaaaaaatgttcagaagtgactagcaagcatcaaaagcgactcatggattagaaaagcttttgctgctttatggaaggaagcaattcttgttgagctatagtagaacagtgcaatgtgtgcagtaggagcaaagcatcaactaactccaaacatcttattctcaacagcagacagcttggatggtgctatcaagttcccagcaatcctgcaaagctggtatttgttgaactgcctgaatattagtttctggaagaaaaaaaaaaggggaagatatgtgcctgtttggatgctttcagacagattggaatcttgttaacaaaggacatagcccacacaaattgcatgtaccatttgctgtaaaacaaagtaaaagaagattcgcaataattcattgaagtaaaattatagtgttgatcggtcacaactcacaacaacttctgaaaggaaaagactcgaagtaactttctttgtattcaacctgtaaagaatattttgtatcaccatgtgtcctctataaaaagaagaggaaaaaaaaaaactacatgagatatcttgtaactatgcacacatttcctttctgatgttactcaacgaatggtgagaagtcagtggtgaatatctacagaattaacagtgggacaccttaattctccctttggtaagtaacgtaagactcaactcctatacagaactgctacaccaaacagacaaaaacacacagacacactcatttttacatgtttcacaaggggcacaaatcatgcacctctgagctgccgaatggcttaaagtcagaacgttgcaaataattcaacggattcttctttgaacttcttgtagatgcttcacccgatagaacatcaacggatggggttgtgatagacggtggattgatgggcggggatgcagaaatcgttgagcagcaatgcctgacattgatcctgtgtgtaatggtttcagttgaggtgctacctgttacattgaccaaaagaacggcctccttatctctggtgacttcgcaccaacagttctgcagtactccattgacaaatacttcttgggtgtaatagtcttcatggtgcacggtaacttccattgtttgcccaggttcaatgagaccaactgatggttcaacctgtaaaacatagcacgatgaatgattaaattaccaaatattggtactgtgaaaagcaaaatggaacatgcaaagcactgaaaaatataataaactagtataacactcaagtcaaaaggcttgttatgaatggttagtggtagcagctgttcttgtctgttgactgtcatgacaaactggtcagtcagcaactccactgagatccatatccagtttaggcttatatggatgggttaaatggcagcccatccacgtgtatgggatgggttgggaatttgagctaaaatcctagcccatagatgtggataggccaggatttgggttcatgcaaatgaggcattaggatttttggctgaaacacatttatgaactgagcactgacagatatgatcatatgatgttgtctatcaactcatgcaaagtttggtatgattttgaccaaatatatgtccacaaagagtatcctaaatgaccactagaagacaatacatgcaaccaaacctgagcccacctccatgactgtctaggtacaaggtgatcgaaattgtgtttcatctcatttgcttttgcaatttttttccttcagtttgctttctcataattaaaagaaagtctgatatagttctcacaaagaggttggagtgcagctgatacagaaagtgcatgtcatagaagtaaaatactccatcccttctcttttacattatgtgaggggagtatataggttccatggttgtccaaaattcatattctagaatgacaagatatcttctatatttatgagctaaattttattttaggtcttgcaaactgaatacataatggacagactttctatggttttgaacttaacaggctttctatatacaagcaaaagaatggtcaacactacagatagaaatagaacactcaactgagagtgtaacactatgggttttcttttttcttaataagggaaaaacacaatgggttttaagactaaacaaaagaaaaaaatgaatgcaggaataaacaaataaacatattaatgcatacctcaagccaaagcggcaacccaaaggatgcccttggaggaaactcggatttagttccatcctgcttgctgattgactggctttcacacaggatttcaaaagcagccttgtttctttgacaatcatttgttatccggaggacaacatgttcttggttttccaaaattatattgtttgtgctgattatagtgtctggaacaaaatgggactctcgaagcaaactgtgtaatcttttgtcagattggagtatttttccatattcctgtcttcttgtaaactcatccactcttgcaatatcaacactaaatgcacacctcactggtttatgatcactatctgtgacacccatgcaagcttcatacctaccagaagagcaataaaacatcaaattatgtatgagggagtgattatgatcaagacaaaacaacatgtgtgtcttagattctccttctcaaaacgagtggtaactggtaagttgtagaatcttacgatgtaattttagcaacaacagggcattctaatgagcactctgctgttaatacatcacggctatctcgatacagtattctgtcgcaccaagcaggtattctcttcttctcacccgagtcatatcctaattatttttggtgtggaaaaattagctccaaagcagttgcgtcaatttaatcagcacataaaagaacatttgaatcttgtgacagaactggaactatttaattaaggaggtgccgctagcatcaaaagtaaaaacaggccatacctgcaagacctggtaggtgtctttggaatttgtaagtcggaggaaatctgatcaaaccttcacgcattccttggaaaacctttcctgccctcatttctgcttgaagttgatccctttctttaagccagtcaaagctcctttgagagaccatgtcccttgcttcatcataggtgataccgtaaagtcggtagttgaaatcaccaagaaagacaaccatatcagcttctgccatctcaggtatatcttcatcgacctgatttccattggcctgccattatgacaatagctataaataagtattctttatttccacggaaaaatctgcaatgcagttcagcgattacatacattcacggttttatgcaattgaacagatgtagcagaagctgtagaggaaaccaaaaaaaaaagatgttatagaattcatttacaacaaactagtatttaaatatacttataagatgaaagttgagaatgaagtacctgcagatccatgaggtttgttaaaagtcatcgttcgatagatatgatcaaaatcagcattacgacggctaacattttctagatgtgcagcaaaatgattgttcacaaaacatatcctgcgatcatagactctaattcttaaccctacaccaccctgcaagaagaatgagatatcattattcaatgcaaaataggaaaaagaatagagcaatatattgctaactattaaaataattttcctctgaaaactgcagctgcacactttcacctctaaccattgcacgctcacaaattgtttctagttggatgaagtatgtgaagaaaaacatattttgagtatcccatgattatttatcacagcagtataatgttctttgcgtgaacgaaattcccagttggtatagtgcacatatgatacgctcaagaacaaacagttaataaacattttgacaatcatgtaccttgttgccaatagcacgcccaaagccacatggtactgcagcagcatcaacatcaccaacatgtggcttaaggtccttccttgcccttgaaattatcatgatgtacatgccatacatatcgtatgagaaaagtacaaaagtgcaaaaaaaatgataattatataataacagaaaaatgtttcactaagaaatggttttaagataaaccagtaccatgcagcaataagtaatccagccagctgccttgaaccaactcggtggaaggatatcccctcatcaagggtcctgccaatattgtctatccaccactgaccattggcactaccctcaagccctacctaaggccataaagcaagaaatgttgaataaaatgctcaaaactcacatagcaggcatgataccagtacaggaaatagcccagtgcagtctagatatgaaaatcagacagaaacaggaagaagggggagatgatgaccagataggaaattaaattaaattttccttccagttctcagtggtagctttattataccaataaaacaccacagcaaacaaactagcatgaaagcaaatgcattgacttcccaaacatacagctgcaataactgtaaaagacaactcttaacttcagtttcagtgttcatcatttttatactaacagaaatatacacagttctcctgtgccttctcacaaaaaaaaaactgtaaaaaggtaatctgcacctagagctctagaatgaacccttatgcttaggtatatgcagtatttgtttcaagcagctaaattagaatcatatgagctccagatagagataagaaggataaaaattaaaatgtaacatagtacaaccattttatcagaaagacaagcacaccacttgtgtttttcaaaagacagtagcgcagatacagtcatattatcagaaataatacaaattaagctgtaatgcagaaataatcttattgtgctcactagtaacctattttcctatctcaataatagtttctttttccttgattgaaccgagcaagaaaacaatgaaacaacgaaatcaaaggtagggttgagtatttcatatcttacactttctttggctgcagccatggcaagaacaccagcacccatctcgacctcttgtagaccaaccaccaccaagtcaacatcaaaaaatgcacgacccaaccatgacatgagtgattcataagatgctttctcctggccaacattccaagtcccaacaagcattttaatgttcactagccttctatacgacaactccctgtttgacaattcagttcgcagaatatcatccagagggccaggggaagctagaggccatcctctaattccaccatgatgagcaagagtaaagacataagaaccaccaatcgccatctgtatgaccggacagctatgcccagtccattctgccagaaggttaccttccacatccatgacttgaataatgccactggcatagcccacccacaccctttctccaagtgccttcatgcactgaacagaagaacaatgatgctggaattcttgcagtcggttcccatttccatcccacataatgatcaaaccatctgtgcaacctgaccaaaccgttccattcattgcctgaaccactgcttctgttcggcgattatcttcaacaaatgtcccttttgtagcaactctgcgtactgcaccagctgctcccatcagggcattccttgatttctggaaaaaattgaaagagctttgtggtttatccttcttcacgggttttgctttgatttcttcctctataaattgctctggcatcacaggtgcctctaaccgagctgactcaatttggccgtccatgccaaacacttttagcagttccctggtccgagcatccctacaggaaaaatatcagaaaaaatagttcctaacttttcaatgggccgatgaactcaaggataatgcaatttatttatgaaagcataccaaacagcaaatgccatgctagttaaacaccaaacttttgcccgggaatggtcagcaagcatgtgtttcacatcagcagcggggaacgaagatatgttgccagctgctgcattgttcctaaggtcaatatatgacctttcaatccgtaaagcagccacatgtttttcttctggcattagtgagagggacttagcaatgacgtcccagggccatgcctttataacacccccttcggatcctgaccatatttcacctgtttccaagatattgaaatgaaataaatcatttttgcaaaacgttctacctcttttagtggacattgtgaagtttaaatcttgtatgga

SEQ ID NO: 52704 - DNA, 1061 bp, Oryza sativa
acttaacaaacgacttagaacaaatgcattagaacaagaaatgcatacaatgcattaggaaattttttttaagaaacatttttagagatgtggatcaaataattctctcgataataatcatgtgagtacttcctccgtctcaatatatagtaacctagaatcgaatttgacatattgtagaattataaatttggacaaaactatatctaaattcgtagtcccatgctaagcttactattcattagaacgaatggagacattgagtagttgaaaagaaatagaatggagatcgggtccacagcaaatcactagcagctgatccagaaaaacgttttgtgcacattttcatatctttggcagcgatcacaatgcccaataatatcgttttcaccgaacatagtataaacagtaatactatcaacattttcttttttactcgagagagcctaaaaaattactggagtacagtaatacaagtacacctttagcaatcgaggcaaaccttggacctaaactggagttaagtagatctcctagaccgccgtgttttcacagtaacacgctcttggtatgccctgtgggacagagtcttcatcatcaatcatgtcattaccacccacaagcgagatttttgaagtgcgggaagattttcatgatcgagtgatagaggtatgggataagccggtgaaagggcaaaacactgtccaaagatggaacaataagatgaatgccttatggcgccatctaaaaggctgggcaactaacactagtggcttttatcatatagagaaaggacaattgcaacacaccattgatactcttgatatcaccgcagaaagtcatgtcctagctaatatggaaacagacactttcaatccagagatcggttggcacacctacttgggggagaagaaactaaatggtatcaaagggctaaatctaccgatgttcttcttggtgataataatactaaatattatcactagattgctaatagcaaacatagaaagaaacagattattagcctagaccgggatgaagaaaaaattgaggggaacgat

SEQ ID NO: 52705 - DNA, 1014 bp, Oryza sativa
cgcgacgggcctggcgacgctgtacaacgcagcgaagcagcgcccaaacgagacgggtcccgtgggaaagttcgtgaaccgggtgaaggtgaagacggccctgggcgcgcgtggcaatatggagtggaaggagtgcagcgacgcggtaggcgcggcgatgcatggggacgtgatgaagagcgtgaagccgaaggtggaggcgctgctgcggggaacgcgcgtgctgctgtaccagggcatccgtgacctcagggacggcgtggtgtccacggaggcgtggtgcgggagctgaagtgggacggcctggccgtcttcctcgacgccgactgcgccgtgtggcgcatcggcgaggagctcgccgggtatgtgcagcgctccggcccgctctcccacgtcgtcgtctacggcgccgggcacctcttgccggcggacaacggccacgcggcgcaggagatggtcaaggattgggtgttgcaggcggggctattcggccgccacggcggcatgaagcgcgcaggctgactccgcactcccccggggggggggggggggcgcaacctgtggcctcatctctcgcggtgtcaaactctaatctgatttgagaatcgagcagagtaaatcgaggaatacaattcccgggaaatacaagcatttgagtttataatggttcttctggtgtggttgaattcatcgtggtaaacttccctggtttcattgggattatttcctccagaaggtagcttatccgggattgtttttgttcagtccaagatcagagggcaataccgaaggatcacttggtaccaaactaccaaggcagtattcagtaacagggacttaaaagcaattcgcaaatctcagaaacacgaagctcctcatttcgaccagaaaaaggcccatttggctctctggtactctggagcagggtttacgaaaacgaaaaaaaagccaaattcatcgcgcgggcggacggcggggggaggagcggcgcgcgggctcccccgccggccgccg

SEQ ID NO: 52706 - DNA, 3411 bp, Oryza sativa
  unsure (1)..(3411): unsure at all n locations
atatttttaacccaagataaatatattatgaaaatttatttaattatagatttaatgaaactatgctagtgttgtaaatattactactttttcctatagaattagttaaacttaaagtagtttgactttgaccaaagtcaaaacgtcttataattaacatgaaacggtgagagtagtacttcttgcattcttgcataatgctatctatttcaaatgaaaagggcagttttcatgactagtttttctttttgaaaaaaatatatgacagaaactcgggctccttcctgcatgccattatattagttgcttaagaaacttcgactatatatactgaaatgagtncaatttatcatatgcggtatcatatgatcactcgaactgacaagtaattaaaatgcatttttagcccatgatctagtttaagcagctagctagtttttctttagtttattagttgtaacttccatagagagagcaccagacccaaggtgcagtactgagcaattataatgaactctgcaatacaattttgcttatagatgtgtatactcgtactatatatatatatatagtgatgtaccaaaatatcgactgctaaaactttttatttgtttttcctagatctaattaataaattaaaacggctgtacaagtgctttgatcaccatgttttacagagaagaattatgtggaatggactttaatcaatgctgatctgaagaattaatcagaagaatgccttctcttttttacgagaattacatacagaaaaataatatttttttaattaaacaaggaagaaattcattcatctgaatttaactcaaagtcgatgatacaaatagatatatctgtcaaaaagacagggttgaaattaattaaaaaaacacacgcttcaattttctagtgctatattatagcaactaaatgccccttgatgagatcggagagctaatctgaaattcatccatatctcacagcttgcaaataaaggaacactaggtcaaaatatcaagttcggatgactccgaatccgatacgtgtaagcagcacacaaagccgatgcaataggctcagatggtggtggggcaatagatggtgtggcgcgaaaaagtctatcccaggatagctacctcccctgcggtactcctcctagaaagaaaggttgggaggaagttggaaaaataagtcttgaactattagagcaagttcaatagtatagtccactactagctccaattcaactatagctaatttaatagccaattgataccatagttgcttactatactattaatatatggtatcacatgtcatacacacattgcgtcttgaagtccgtgctgcagctggctacagatctgtagcccactactcttctctctcatcgtttatctcattaaaatatatttatagctggctaatagcctgctattgtacctgctcttacaccaacaaatcctacccggtgtatcgtgtgaggcctgcctatcagttcattgcggcgacgcggtggatgtgcaattacagtgacggtttttgtggcggttataaaatagtttaatttaccgtggatgaggccagtgaggtggagccagtcctcgtcggggaaatccttgcggatggcctcggcggtctggaggaggtgctcgatctgcggcatgtcgaggtccgggtcgctgtcgtcgatgaactcgttgagcagctcgatgcactcccagatccccatctccgtcttgtccaccctaccgtactcctcccgcatccgcctcacctgcaatgttacaatgcaccaaaataatggtaaatctcatatattaaagctcccgttcttttttacttgtcgtttaggatattatgagtgtatttttttaaaaaaagattattagatacagaatttgcacttacgaaatcatatgtctggttgatgtggttgacccggtagaactcctccaccgtctccttcctctcagactcggcctcataattcctggagatttaaaacatcaccatattattccggttaattccttttttttaagaaatatcttttactaccaccgttgaaaaagatttcaatttctagattatgaccataaggtttttatttttcgaacacaggtagtgttttatttgtccacgtgttggactttttaaagaaacatcaaattgaagtacagaattcctgaagaagcgaaaatgataacgtgcaaaaaaggaataggcaaaaggccatgttaatgcagccacagatgccacgtgggacattcactgtgcatagacacgcagaaacctttgaaatcgtacaagaaaagataagtctttattttattttatttgaccagtaagtagctggccactttggtcagcaaaattgagtttacgtttaagtagtcaaattcatcttcttcttgtccagttttatctgaaaaaaaaacaaaacctgggtttggacgtttcaacaaaaactaaaccaaacggctaatcatggaaagacaacttgaagtaatgggacaaacatgtattgtggcttgagagagaggtatgtacgatttgaatgcacaaccacaagtttcaagaatggccacacatctctttcatttcgagttgtgcccatgttctagtttactaatttcgtacgaaaatatcatgtctgtcttgtcagcctgctcgcattgtcctaaaaataagccaatcattctaatataacaaatctaaatataacgttgtactaaaatatatcatatcttaatacgatgttggcttattttagagggagcaagtaataccaacctctgtttttgcaaaggagaaaaaagaagacattccatatgcaaaatatatgattatttgcacatgtccacttgaaaaaaaacttgctgcccactctgttttttgcaaagagaaacaataaccttcaccatatttaaaaaaatactacatgattaattaaattccctaatccactagaaatattttaaatattttttcttctgaggggataatatttttaaccatagttgacactctgttttgctctgtttttgcatgatgctctgtttttttcctatgcaggaatatgtagctgacctgaaggcgttgccgaaggcgttggagtccggcacgacgaagccgccgtcgagcacgagctccgccgcgttgtcgccgccgccgccgccggcgaccttccggtcggcgatagcatctgcaagcgaaccatgtcagaacttagaaccttaattagttccacgatccatccatccatccaggaacattgctgaaccttttcttcctcacggactggaatcaagaaatcaagagagagagagaaaaggatcatgagctcaccaaggtgaggctgctcaatggtgatggtcatctcgatctaatcactctttagacagatcgatg

SEQ ID NO: 52707 - DNA, 744 bp, Oryza sativa
actataggaatcttttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattctaacaagataagattggccagaaatggtactcccttaatttctattctgaccgaggggctatgttgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatctgagcttctgcagcagcgacatgatttacacgagccttggatgctggtacagcagagttattctgggcagggacaaccttcacgcgacggggcttcggacacttgtcagcataatgtcctgggtctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatgggctggggtc

SEQ ID NO: 52708 - DNA, 1723 bp, Oryza sativa
gacatactaaatttattttattgcagcaagattaaatacaacattgtaaaacttttgctggtaaatgagccattagtacagtaatagatgtacagtactaataacactggaataaatttttaatgagaaccattaaaaaaaaattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagtgaataaaatgtcattacagaggtagatagttcctctcaaccaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggttgcatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatacctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacatagctttaaataggatcaacatgctcaaagggttgtttaggatctgtgtgacttgccttgctggc

SEQ ID NO: 52709 - DNA, 730 bp, Oryza sativa
acaatcaacaaataagttaatacttaaggatactttatgaatattcaacatcagaattggataacatacctaaggtccagttgcagcacagggtattttgacttcggatttgatataataaaaacattatcctggatttgcaattgtgtcaattcaggacagtaaatcagaagataagaactggcacgttgtgcacaagtggtagctttaaagtcaaataaatccttcaaccaattgcagtgcttgtaccttccgatcaatcaatgtgggaacatcctcttgctctggccgatccaagaaaacttccttaaatgggaatgacctagggggttaagatcatagatttggggggtttaataaagagtaagataaataatataggataaaatcacttaaacaaggaatatcacaaagtcaaattttgatcaataacatacttattgtctttggtctcattcttctttgttactcttctggccacagtttccaggactccctggtaggataaagaacaagatgagcacttctacagagacacatgtgcgatgtatacagtatagccaacaatatttcacaaaaagtaatgaagacattgaaattcagaagaggaatataactagtttaatacaaggaacttcagaagaagaatataactagtttaagtttagtaagatttttcaagcaagtaaatacattaacctaggtacaccataaactaatattagttgtg

SEQ ID NO: 52710 - DNA, 756 bp, Oryza sativa
cacttaaaaaggcggcacgcgaaaatcgattttttcgtgcggtcctcttaagtcgaccgcacgggataatgaggaatatcatgtgcggcgacagcccggcgctggtcccttattttcccgtgcgatttcagttactgtccaccagaaaacaaaagggcccgtcaccccggaaaatcttttactgcgtgcgtgcgggcatcaggtcattggatcttagcgtagctagctatcatcatcatatcaactatgctcatctgtcgcccacagctctatctggatgcctccatgcatacatgtgtgtgaccgagcagcggaagaggggaggtccaatgggggagggacaaggggtgcggcgctgatctggttgccgctgggaacagatagatatcgatcatcgcccgccgccgccgccgccgccgccgccgtcttccaggcgatcggtcgatctaggtgtgcgtgccgcatgcgcacgcgccgtccctttgtcgaccggtagatcggcggtggtccgtcttgatcaatttcttcttctcctttcccggcgcgccgtgttgcatgctgcaggggttttggctctattcgactcctcgtcgtcgtcactttgtcacaacccttgcaacttgcattgtcacattgtctcgtctctcatgtcatcgtatacaaacagcggcatgcagcgccagccatgggtgcctagctagatagcacggctagctggcatgcatcaagatcattcctcccaactaaactgacgaa

SEQ ID NO: 52711 - DNA, 1172 bp, Oryza sativa
ttgattcatctcatccgtgtgggtttttctagtagatctcgaatgacggcattccccgttagttttttttttttttttgactttgctcggatgaaatttgctcgttttgtttcctgttcttgcgattgcaagtcattagttgatgggatagtgaaatccctgacgcgcattggtcgtgtagggagctggatctgttccatgcgttgctgattggatagaggggattagagtttacgatttagggctttcctctgcaaaaactccttgccgcagcacaggaagcaggtctcctccaaccgctccacaggcggactgctcgtttcaatatggccttatatgcagatgacgctgtagtgttccttagaccagataaacaggaactccaaaaggtccaaatgataattcaaaatttcggcctcgcgataggcatggtgaccaatttatcgaaaagcgaagtctatgccattagatgtgacaccctcgacttacaggatattctctaccccttcccggcacagatgaaacacttcccttgtacctatctaggacttccactccacatcaggaaactcagaaaatcagatgttcaacctctcatcgataggttctcagctaggctcccaacatggaaaggaaagttactaaacaagactggccggacggttctgataaagtctaccctctccgccctcccgacctatcacctcactgttttcccccttagaaaatgggctgaaaaaaagatcgacaaaatttgtaggggcttcctctggacagggtcagaacagacacaggggggacactgcctagttaactggaagagagtctgtagaccataaaaacatgagaggccttggtataacaaacctcgaactttttggtcgctctttaagactccgctggctttggcaggaatggaccgccgtcaacaagccttggcagggatcgagtcttccttgtgatgaaacagacaagcagctgttcagagcttcgaccacgataacccttggaaatggcaacaaatcaaaattctggcatgacagatggttgaacggatcacccctgaaagaactttacccttccctctatcagttggccacgagaaagaacagatcagtggcataggagatacaagggaaccactggttgaaacagatgagacgaatgaatac

SEQ ID NO: 52712 - DNA, 801 bp, Oryza sativa
cacttgttctagtaaaataacacggcatcgcatgccgagatgttgaggttcacaaagacgtcgtggttggtgaagtagcaaaacttgcgaagtagcagcaatagagtttgccggtgccgaagataataaagatgaagtcgctccaccatgatgacaaagttgcattgccgtgatgaagtgaacacgagttggcggcaacaaaagcaaaccggtagcgaagacgcgcagctgtgaagataaaagcaccagtcggcggcggcataaccagtcgacgatagaagacgatgatgtccatcagtagtggtagcggtataaaccagacgtagaggcgagggcactagtcagcagcagacgagacgaccggcgatgaagacgataagtccaatcaacactggcagaatcatgcagccatcgaagtgaagaaaccagtcggcagcagacgtagacagcttgcgttgaaggtgatgacgcctatttgtagtggcggcaacgtggccagccgtgaagacgatagcaccagctggcgtcatacgaggcggccgatcggtgaagatgtagatgtccaacaacggcggcataataagccagccgtgcaggcggagacacggcggcataataggccagccgtgcaggcggagacaccagtcggcagcggcggaggcaagccagcggtgaagacgtagacgcccaacaacggcggcataataggccagccgtgcaggcggagacaccagtcggcggcagcggaggcaagccggtcggtgaagatgtagacgcccaacaacggcggcataataggcc

SEQ ID NO: 52713 - DNA, 761 bp, Oryza sativa
tgaatcataaactgaatcattttcttcattcatgcaatcttcaaagtacatcaatcaaaattacttcaccgtcgaaacatgaattcggcaataataaaagggggtaacgcacgagacctaaaagtagatggatgcggagacaaaggatttagataggttcaggccctctcaatgagaggtaatactctgctcctgtttggggatttgaatccgccgggtgtattatagatctgacgatcatatgtgctcatgccccctacagggcctcctacccaccttatataggatggggggcagaattacaagatagaaaccttaaccaatacggtatcggtttcctaaatctattttacaatattatcaaatcaggactttaggctgctccataatataaaaggaaacgtaatacccaagtcatgatttgttacatattccatagatataagctatcccctatgactagtcggataaccatgccgtgtgggtatggggtacccataatctccacagtagcccctaagaccttcatagtcgaaaagataatcttctctcgaactagattactccaaagccgagtgcttcaatcatcgttgctatggtctcccgagtacttttaccaaatctgaagactgtggagggctgaaaaataaagtcaggtgcatcgactagatgcacctaataggtgtagccccccaactatgtggtcaattgaacaaaccaagcatatagtcaaggaaaataatccaaccaaccgagtggtt

SEQ ID NO: 52714 - DNA, 807 bp, Oryza sativa
tctatccggattgatgaccttctgcgaaattgcgttcatgaatgcatatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatctagatggtacctttatgctctccaagcattcaaacatactttccttctctgccttgctaagagtgtagctggctggactcaagtaatggcttcctttctcctttagttctgggtgaaggtcgccgcgttgttccatatgctttagatcattacgtgcttccagtgtatctttcgactttccatatacacctaggaagccaagaaggtttacgcaaaggttcttagtgaggtgcatcacatcgattgcgtggcagacgtccaagaattcccaatagggtaactccacaaatatagagttctttttccacatcaccgcgtgaccatcttcgctctctgtaggctggcttccaggcccctttccgaacactactttaaaatctttaaccatagcaaacactgttttcccactacgatatttaggcttcgtacagtggtccgccttatgttcaaagtgcttgcctttcttccgtaccgggtgggttgcagcaaggaatcgacaatgacccatgtacacaaccttcctacaatgcttaagatacgtactttctgtttcatccatacagtgagtgcaagccttataccccttgttggactgaccggaaag

SEQ ID NO: 52715 - DNA, 1257 bp, Oryza sativa
caagaacacttgaacatgaacatcaagaatattcttcccagccactgggaaccatcaaagctactcatccccatcaagaacacaatcacaaaatacacatcaagaacatatagataacacaaaaggctgccgctcaacaccaactccgctgctgccgctcgacaccaccgcccctgccgctgcctcccctccgccggatctagcggagaggagaccgctgggaaaaaaattgtatggcaccccatgccacaaagcatgcgtggcacccctatcaagatcttgccacctggcgtgcacaaatcttggagcactgatctaccttcaaaaccatactagggcaaaaactaattaacaggctatcgctaatctcgcgcgcgcggaaggatggcggcggcgatgcgcgtgacggcgacgcacgggcaggaaagacgacgtgcgtgcaagaaagggcggccgctgccggcaacggcgacgcggacgcacgcagcaacacggcggaaatcgacggagctagcgctgcccagattgatcgcgcggcagaggtgcacgggttgatcgatcatgactcgaggacaaacttcgctgacgatgccatgaaagaccaagccactgcacatcatcagttcggttcagatgatgaggatcttgaagattgcatgaatgaagaaaatgattagtgtgtgagtgtggagattatgggtacgccatacccacatggcatggttatccgactagtcataggggatagcttatatctatggaatatgtaacaaatcatgacttaggtattacgtttccttttatattatggagcggcctaacgtcctgatttgataatattgtaaaatagatttaggaaaccgataccgtattggttacggtttctatcttgtaattctgccaaccatcctatataaggtgggcagtgtcacgtcctgataaattcatcccgaaattaaaaatcattcgctaaaaggaataatagaattaattaaaattcggaaagaaattggcaaacactaaaatacgtacaagaaaaattcgaatgtggcccggagaatttttgttaaattctccttggtctaaaaaggagccctcaaattttacttgaattttcagagcaccggaaatatttattaagcaacaaaaacaattatcagagtttattaaaaagaaaaacctaaaaataatctctctccccccctttgggcagagtctggcccaaagtcctccctctctcccctcggcccgcggccg

SEQ ID NO: 52716 - DNA, 2071 bp, Oryza sativa
  unsure (1)..(2071): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacctaattacaataatccgcaaatctccatataacagcattaaacttcggatgatcatatcttggtcatacgagctctgaatcgacccgttcaagtctcctaatgtttgtataacctaaagaaccctgtgctttcttcttatgtattgttattgcttctttttaggcttgtagctttgcttgtgtgcttcgcgtagtcttcgtcgttccggaggttcccgaagcgtggttcgcggccgtcgccgaaggttcggaaggccgttctctctgagcaaggcaagtcacatcatcctttagcatattgaatcccagtttataaaattattttgatttaaattaatgcattatcgtttaattcccgcgttatcactgttttatctagccatgcctatttacctttgttatgaccttatcattgttgttattgttactattaccttgttcaccctagaataaacaaaaccccaactagtgggtactctattcctggttccactagtatgaatttaggtagatgcttcgctgattaataggacaacattaggtggtttttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggtttcggccgtaggtggggttgggtcggtactcttgtttatggctaggatgggttgggaactatgtcacgtcttccgtccgtataccgtggtggtatgtggcatgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacctagggtcgggttgccagttcggtctgaatcatcgtaggccttgggttaaggcaggttcgtgagggttcacgaccttgattaataatactgtgtagctctaggatcgtctttttaaaatggctttgggcaactaagtgacttttaaatgctgtttactgcaaaacttaacccttattattaaccccttgtacccccttgcattaatcatgcatctgccggtgtgacttgctgagtactgtggttgtactcattcttgctcaatctttccccccttcagtaagagaagcttgggagaagaagtcttaggtggagtcctggcttataccccagttgagcgcctgtgaagatggagccgtaggcccgcaagtccgctgctgtttatttttgtttgtcaggcctgaggtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgaca

SEQ ID NO: 52717 - DNA, 1205 bp, Oryza sativa
tgagtggggcccaaattggaggtagattaggatgagtggattacttatttttttctacgtctaatctaatggtcgaaaaggatgcacccatcaatttaaatgaaaatcaagggttagatgttttttgccacgtggcagcttagtagcgtttgtagagtgtcatgtgacgacataggagcgtttgtaggaagttaatgaacttttagtatatcctccctctgtttctaaatatttgacgccgttgacttttttaaatatatttagatgttcgtcttattaaaaaaatttaagtaattattaactctttttatatcatttgattcattattaaatatacttatatgtatacacatagttttacatatttcacaaaagttttttttaataagacgaacggtcaaacatgtgctaaaaagtcaacggtgtcaaatatttagaaatggagggagtaatagatatttttaatataaataaatctttatttaaaaaattactccacaaatttatttttcctcttttttgaacgagctgaccatcaggagacgcttgtgggccatcttttccatgctccattttcatcgttttctattgtccgagtatgcacttgcaacctgcaagcaattttttgtctgtttcggtgggtgcctccgtggaggccaaataatccacgattttaagacttgttcataaatactccgtatctagtgccaaaaatagctggggctggtgatttgcacatgtatacatctggacaggggaccttgttagggaaggttggtgccgtacgcagacaccgtcattatcacgattaggatcgagattttcaacgtcctctcctaattactatagtgcacatggatgctaaggcatgcaattgatgtgacgtgatagtgtaattatacaatcattgagacctgcaacgcgcacattgaatacaaatatatgaacgcaaaatggatatctaaaaagaaaaagcctaccgaaagcaagtatccaaaatggcatccattttgattcgattcgaagtcagtaatagaaacggacaaggttagataatggtaaaaggtcactagttacaaactacacagcaaaattcgcgatgagaaacgcgtacacaagcgctgacaaaatgaatacaatggcatggtaacgaccaagccaaactaaaccctatctcgctaatccaatcaattaatcagcataca

SEQ ID NO: 52718 - DNA, 2712 bp, Oryza sativa
tgagccgctccttcaaatgtttgctgagtatcatttacagtgagaacagaatatagcttaaaaagaaatgaagcgtataggtgcataccagactgagtgcagtggttccaagaagaagcagataaagtttgccctgaagaaaagcaattcagctatcagatgaaagtacacgcacctcagtgctcacaagacaacatatattatcataacagaacagttaaactattgactactccaaaagcaagctagagcaaaattagtcagaagctagctagaactgagtgtaaccatgagagtataaaacaacattgacaggcaggaagctttggagcaacacatgataggaacaaaatatggagaaataacctcaatcagatggatgcttgaagcacggcttagaagaacaaaagcaaactctcctatttgtgcaagagacatgccaacctacaaggaaaataacatgagatcagtgtaactgcatgagcaataacagaagggagcacatgtaaagcaatcaagacttacaagaagagatgttttgttgctatagccaaaccctttaacgacaacagcaacaataaacgtctttacagttatcaccaaaatcacagctgcaaggagtatatcgacatggttccaaaggaaatggacattaattagcatcccaatgctggcaaggaaaagagcagcgaagaagtttcgaataggttcaatctgcagaaacaacaaacctgaaataagagaacatataatgaatcattaactacatgaatctagctaaaactttgactaaagcagtaaaagaaacataaaacaaaaaaaaagtgcattgtcattcaaattgtcacagaactgacaaacttcacccaaaaaaaaaagcatataatttcacggcaaggaattacttgttcaagtgtgtgttgtgcaagatcagttgttgatatcattactccagctgcgaacgaacccaactcaagactcaagcccaacttatcactgcactgcatcatagaaggccgcacatgagtaaacataagttttaggataccgatagaagagagcaaatagaactgttaaaaggataaacataactacattttcttgcaagaaaactgtgcatgagccataacagtaaagaaagagttgctgaaaactgaagagcaaaacttacaaagattagtgcagaaacttggaacagaagaaagatagaggcaaagcactagagtctgcactacacattcactataatacatgctataaatcaatctagaatagtgtaaaagatcaagtttagcaaaattgttactttcacaatttttctttgaataaatttaatgtttagcatcctttaccggatccagttagagtgtcacaacttttggccaggtttagtacatgtaacagttatctgcactactccagtcatccagtgtttaaagaaaaatagtttcccattactgaacaattgcattcgatactaacatacgagcagttaaagaaactcacccaagcaaacaacaagcagaatgcaacagctgccaactggtacagttcatttgtctgcaagaaatgcagaaatgttaatgtaggataacatgatgatctgaaccagaactaaattaaatgcaaattaaatgctcaacaaaactattcatgtagtgcctgtcgattatattcacctgagatgaaagacttatcatcagcttaagaaaccaaggcacaccagttcgggagaggatggaaaggattgtaaggaatgttatcaataccaccaacctgagaatgtcagaaattgtgacaaaagaatttaatccaacacctgattatattatggaacaacttcacagacaataggaagttcaaatatacataggacaacatgatgtcattatgaagatataaggcaaataaacttttgtgctgtcatgatgtaaaggcagggtagcactgctattttaagtaccaccatttagaccttgatgtggcatgaatttactgcaggagacatgattctagtgtacagattattgtagtggtaaaaaattatatgtaaataaaagtttcaagccaaaaacacactacacttacgacttggccattgatgcaactccttgaagaagaccagaagcgccactcagaattggaagaagtgcaaaaagaagaccaacagcacagtcctgagacaaaggaatgtcaaatcaccaatacaaggaaagtagtgaagctcagataaagaaagaataatcagtccactcgttcgattcttaagaagaagcaagcaaaacgtgcaactttacgaattcatctccccaaacaactcaacaaatttagaagatggtatccatttctttcatacctgcaatatgagtgtgccaaccgtaacttggccatgaagggcattgatgctatttctttccatcagaaatttcaaaacctacatagaaaatattttcccagaaaagttaagcaaaaggagatggaaatgggatttacaacacgaacataaccatattgcaagttatacgacattcaggaaacagttggcacatgagtcaagcaccatctacgaggtaacaacgtgctaaattgaaaaccatttggcatctatcgtctatgaaaggggtaatggttccactacgaaccaagacgaacagttgatttacaacaaaagctgcttgagaggatgtgtagcaaaacactaaaagataagag

SEQ ID NO: 52719 - DNA, 753 bp, Oryza sativa
taattatataatatatagtgtatataacataaaattgagcataagtgcacacattgatagaattgatcatcacgtgaaattgtttaacatatagaaatactaattgataaacatatcaaagtgccaacatatggaatataaaaatgatagaaaatgataaattgggaagaaatcttacaatttagagattaacttttcgacgcttgatattttgaaaataatcgatgatgtccttgtccttagcttgcaaaaagaattccctttcaatgaatgtaaccaaacaatcattcaagtatttctgtcccatcttggttctcaacttgtttttgatgtagttcattgaagaaaagaccctctcaacaccagcagttgcaacagggagaactagaaccaatttgagaagtctataaacaagttcataccgacgaaccctctctgttttgacaagcatcatggatagttctgctagacctttcaaattagtgaatttctcatctttggtcacatcactaatatagcggttgagttgaaaagaaagctggttcatttcttcgaaatcaaaatcatgaggataaaactcagcaagcttaactaagctctcaacattaaaagctgaaaatcctttggatggattgaatgatgccatacatctaaggagttctgtgtttacctcatcaaacctgttattcaactcttgaagttgtctatcaatgacacccaaaaacatatcagcatgaaaccgatggtaattaa

SEQ ID NO: 52720 - DNA, 1193 bp, Oryza sativa
gcccggccgagagagaaaagcggggaacggagggggagaaagaaagctcgcgctatgccggtttagggaggaaaaagaatgggagcgggaggcgctgcctccggtttttggacggatgcgggcggcgcggctcgggccgcgtgctggcttgcggggcaaggcgcggcgcaggcggcgcatcgcggcagggcgcggggccggacggcgcaagcacgggcagcaggcggctgacgacggcgacaaccgcgcgggcgcacgggcgtgaagtaacggcgcccggggagcttgccggggatggaacggggaaagagtgcgggagaaccaaagagagagggagagctcggctcggcgtcggctcacaagcatgggcacgcgcacgcggcgcacgggcaaaacgaggggagaggttaggaagagagagagagatgggccgagaggaatcggcccaccgaacctgagggaggcaaaatagacttttgcggaggaatttgatttgggaaggatttggattcgggatttgaatttgacgatagatcggggattcgagatcagggattggcacggagactgacaacaagcaaagaaacagatttcgcaattagggttttaaatttaaattttcccgctaggcgccacgacggaacgggcgctacagtgtgggacccaccccttggagatcgatttcctcggtctaggtctcggtctacaggggatgcggatgccggccaccccgacggcagcagggatattgtttgatggtgcttccacgctagcgccggctgaggatgagtttatggcaaacgtgggcgacatctcgttcgccggtagcaactagtagcaaaaacaaataagtgatttatcgtttctagaccgatcctgaatcaaggatatactcctttctgtcaaaaaaaaaatcaaccttgctagtattggatgggacataaactatacaacgagcttgtctagattcgttgccctaggtcatccaatattagatcttttattcaatattagatcttttattggacggagggagtctttcatagtatcatttcgtttatcatttcaattcgtttcatttcgtgtttcaatcatagctagctagaatgctagaaaaattgtcatagttcattttcatgttttatcagaaccgaggctggcttgcatgccagcagagtatgtctcgtccattt

SEQ ID NO: 52721 - DNA, 7215 bp, Oryza sativa
ttaggcctataaaggagtagaatgttggcggttgatgggattctaaaaactataaacaaaaccccaaataaaatcccagtgatgatgggcatgccgttatgcaacatggtcatgacggttgacgggacatatggagagtaaaataaaccccaataataatcatgtttgattttaaattctcaataataataaggaggggaagcaacgggcgggctgtagagcagtatagtggcgaagccactaacgatttgacgagacttataaaaagtaaaaaagaacacaaacaataattatgtttgatttttaaaattccaatgacaataaagagaggtggcagcggacgagccgtagagcagtaaattggcgatgtttgacgatacttctaaaaattttgtaaacgaaatccaacaagacaatgaactctaaaaactataaggcctattttttaaaaaattttaaagaggatgaatagaagttgtggtaaatcgagtaagcaaataaaaaggtgacaaatgagtaaggggtagtgactgatgtggcttttaagaatataaaattattagaataacggaaatgataattttaaataaaatcatgtgtaaaaaaagataattttaaattgatgctacccgcgcaattgcacgggccgcccaagtaattaatattattcatgtttctatttatgtttgcaatgttggttaattttgatcaaaagtatgttttccgaatgtggattttaggaaccagggagcacatgctcccgtcatttgcctgctctttccaaggtcgacgatggaaggctgagcctgactaccgaaggaggggctaacatactgaaaccaatcacctaagctagctagctaaacggactggtttcggaattttggagcaaaattcgtgctaattcgatccccaatattaccaacagtgctaaaaataatttgtcagaataataatcctcaaatttcttcatattttcttggttccaatataccgttatatatattattgtaacgcgtcaatatataaacataactatagtgatgacagaattgtcaatctaaaatgagcaaaatatattgaattagttctcagtatcggcttgatgaatccttgttgcatcaaatagttgtacacaactcattggcatgtgtgtgacgcagttaaccacgacatcaagtactatagaatgcagtaaactaatttcgtgtgcattcgacttctttagaaaaaaaggagagtaacttcatttcctactacatcaaataaagctgtcagagaattgtgctaacgtcgatgtatggtactgcgaatggtggtgatcagcccaaaagggccatcgaccacaataagcataaggatctccattccattatggataatgcagtatttataagcttactttgttagaatataattggttctttctagtgtttagcttttttttttctttgggtagctggggttttctcccatcacacttagtttttttttaagtaacaaaaattttattagctttgtgccatacaatatacgccgagaatgcaaaacattttcattattaaacatgtatatacatattgtcgcgttgataacttgatatatacatctatgttcataatgttaaccatacatatcttaatactccatctttcgtgttgttctaaacagattaccacatacatttatagttgaataaacaagaaaatatatcgactaatgactaggagatgtgtgtgtgtaatgtgaacatgcatgattaacgcctctatgatatactcctatgttagtacatccatgaagagttggagaatcgatggatggccgatgaaattatctatacgtactactccttccgttcagaattgatcaacatataaggtgtttacaccaagaccaaagaaaacaaaattgatccatacttcatttaattagcgtatcgatgaaagaaaaaaattgttttggtaaacgcgcaatgtactgcacaaaggtaaaacgataaagtacgtgacgcactgcatgcaaacgtacggtcccatgctcatgcattcaccgattcatttttgctactactcgcatagatagagacagaaaggtctcactgtgttcggcagcagcaaaaagtgagagtttgtttagttttctgtgcgcacgcttttcaaactactaaatgttatgtttttttaaaaaaaatttctataggacagttgttttaaaaaatcatattaatccatttctaaaatttaaaataattaatacttaattaatcatgcactaacagctcacctcgttttacgtatcttcctaatattctctatcccctttctcaaactcagttgtttctaaaaaatatcaacgaaaatttatatgataattatttatgcatggagggagtacttaatttcgtagtgcaatttagttaatttgggattagcatttatgtttcaggtgactttttatctctaaccgcgtgaagagatgatcatatagctaactttagcaatcagtttatcttctcttaatttgctgcttcgtttgcattcagtagtcagtagtgatatgtaatagttaatagaggtaatatttgcactttttaattaagaagggattcccatccaatttaatcctagagagtccgaggacatcccatctatttataaagggccctagatgtacagcaccaaaccacaaaacacacaccagagggagtactcccccacaaaacaccgcagaccgtgcaagcattttggccacgaagtccaccaccatggcttctttaggcaatggagcaccaagttttcggccaccgcgtgcaccggtatctgccggaaggctatatcgttgtccggtgtgcccgggtcctgtgatctggtattcgtgcaagatctagggaccatctatgtataatcaccaaacgaggctgtagagttggtacgccgtttatgcggtacataaaggcttctaggcgtggaagggtcggcctcccgccacggccaccgacctcggccccagtggtgccacaagcacggatgccaaccccaacagtacaaaactcgtttgtcccacttcctcccaaccttgccttctgggaggagtaccgcaagggaggaagccgtcctgttgagatagacttcttcgtaccagtcattgttgtgtcggcgcttgagctggttgcaccggccatggtgagtggctcaaatttatcagactcagagtcatctgaacttgatattctggtctagttcctttgaaagctactagatccagaattcatgttagctccccgaatagggatatttagttgttatgttgtagcgtccagaaaatggaagcatgtatgtttccttgattaatttcaatcatgtcatttttacagatatatgtatttgtatcatcaactttgagttaaatccagatgaataaatgataatctctttcatgcatgtttcctaaaaaaaaattctaatttgctgtatatatgtaattttcgttaaaacagaagacatattcttctgattaactcttcagatcagcataaagtcgattccacataattcttcgtaaaagcatggtgatcaaactaagcacttgagcggccgttttaattagatctagtgacaaacaaataaaaactttagcagccgatatatatcttggtatctcgcgatagtgcgactatatataagtatccaaaattgtattgcataattaattaattgttcactgtaccttgggtcttgcattgtaccatctctttggaagttggaacaaataaagaaataaaaatagctgcttaaacaatttttttaaagatcatgggctacaagtacattttagttgacagttcgagtgaacatgatatcacatatgtaaattgaattccatctcagtgtatggcatgcatgaaagagcacaagtttctgttatcaataacatcaaggtaataaaaagcacctcccctaatttaaattctggcagatctcctgccgtcgttctccttaaaaaaaataaataaaaagcacttagctagcatgcgtactcctggtctcggcataattagtctgctctttttccgttatatatatatattaaaaaaaagtttgctcatgtcattgtaatagatagcattatgcaagaatataagaaagtaaaagaaaaaaaaagaaaagaagctagacataaacacagaggggtatatggcaatagatatttgtccggtctgaagcaagtgttgtatacatatagtgtatagttttcacctctcaaatttataaaactagtaccgcgtggccagtactccaactcactattcagttcatggtgaatatatattaaatcaagaaccaaattaaatcagacgtagcgatttttcacggtcttataaaattttcaccatgcatccatatcatatctcctactagataaccaacatctcaaggctggagatagatttgtaagctttatccagataatcgtccatgaaaactgttaattaatatgatatatcaatatatctagctaccacattacatgatatataactagaacaactctaagcaaataaaaaaatgctaagaatatgacggagaagttctttgaagaaaaaaggctacaaattccctcaaaaaaaaagaaaaggggtaagaaagcaaatgtataacttaacgttattaacttgaagcaacatatatatatggcacgtgaaagtcacttccatagtttcatgaacagaaaaaaataatagtggacgctctggtttcactttcaaccatgtcccgagttagtataacattgtgtgtaatataatactgtaactacaggatatatatcattctcgttacattatattacaaatgtgcatatcttgtaattgtcatgtatgataaactgaattttcactaaaaagagaagaaggcaccatattactttggcttgcatgttcgcgccattttaatttcctagctttcaggtaagtatttatttttgtttagggtattcattacccatcacaggttgaattctatattatattacgataaaatgaagattactaacctcaatttataccctagttacacaaagtaaattctgttacgagtaaccctcctttttcagcttttttccatgatatcataataacatttattttcaatattgtttaaaagtctaattagtatgctcttaattaaatgtagctgatcatcattgatgcaaccatgcatagtttctggctagatggtgctagagggatgggtaaagggctaacgggctaacgggccaacgagcacgtgcggctgcgacaaatgctccttgacaactcattttaatttttaggtaacaatgtcgacacgtgctctttttttttcatgcaagtttatacacccaaagtgtgtatgcaaaagaatatacatgaatatttatgcaccaaagagtatacataaaagttattgcatacggaagtttatacatcaaaagtttatgatataaagtttatcatggaattttgagtaattttttgtggtaaaaatttgctaactgtattagcccaaattatacaatgacctaaccacttggtttataggtagacatctacatgatatggatgcacagtcaccattggatgggcagaaaccatgcatgctcagttgctcacccataggaggggccattgttccagtttatttcatgtgcctctcacattgggcctctctaaattaggcctaatgttaattttaattttgtgaattgcgcgggaagggaacttccattggaaatctgataattaccttcgctcctttaaggccttttgctaaacctttttttctagattattattttttgagctgattttattcagaaccatccttttgttttttttacaacttctcctaaactattcaaacttaatgttgtttattgtaatggatttgatcatatatgatatatttttttaaaaatattttaatttaaattgtagatctaaaatttcaattccttgttgttttgttatttttattttgtaaattattatttaaagagaaaaaatatgtagttaacacatcgaggaggattatgtaaaagtttcatcctagtcactgatacagtgtgtgtgtgtgtatatatatatatatatatatatattttctctttaaataatatatatatatatatatatatatatatatatatatatatatatatatatatatatatatatatatatatatatatatataggacactcatatggggcaccatggtgcccgggcaccatggtatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctaaaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttaatatatatatatatatatatatatatatatatatatatatatatctctatctatgagctatctctctcactgcaacagacctctcatcactcacggtctcatcactgatggctcaaaattgttgtttgtaatgagtcagccagttgttacagaattatagtcaatgatgtttatagttatctgtaacggctctaatgatgagtctttactgatgcagaattctaccccaaagaggaaaaatcagccctagcccatcaccatggcattgtcatcgaagtagaatccaccacccgatgtcgtcctcgttgtgtcgaagccagatccttcacacaccgttgtcatcgaggctggatccaacgcacgctgccgctgaagctcaagcggcccagtatctgccgctgagcatatgggagcacgatggaggaaaaggagtcacactccccgccgttaccaaggttggatctccgccatggactgccatcgccgaggccagatccatctcaccccgccatcatcaaggacagatccgccactccttgtaactgttgaggctggatccgctgctccatctagttgtggtgaatctg

SEQ ID NO: 52722 - DNA, 3254 bp, Oryza sativa
tttctttttcgatgtattggtttacacaatatgactcccttatatactccccatattcaggctcgtaggcccatgcaacacctaggctctcataggcctagcttacacagcctaggcgacaccaccccaggttatctacattcttcaagtgtgacaaggcagcgatcgacgctagggacgggaagggagcaacggaggcccgacatagagaagaggaggaggagtcagcggcgctccttgcttactcacagaggtggccagggcggcagagaagacgacgtagagaggtaatggtagttgcaaatacaaagatgattactaccatctgtaatggcttgaaaaaaattgacccattatagatgtccttaggtcatcaataatggctcttaaataaggagctgttatagataacatatgtaatgtggcaaattatcacattttttagtgtattcggacaaattcactatcttatagtgttcccagtaaagatcgtattttttaagtgtcctgtgacaaattttacccatgcagtaccacataattatgttgcaaacatattttttcgtgcataaaatagacaatggcgaacataaataaattcataaataaaacaagggcgtataaatacattgtgtctatatccgtgactagctaacttaaaagggaatcaatattaaaacattggtgcatatccagctaatccattctcttcaacatatggcgtgcattaacctagcgagtaagcgagattatatagatgtcaccatttagacacactctgttaattaacaacgctgctttggcatgtgcaacatcaacccctggcgtcgaagatcacgaatcctatctcacattagacattaatgtctcgtcgaaacattaattacatgtttcctgtttgaacataggagtagagtcctagctatataaagccggcatgctcgtgcacctgagcacctcgctagctagctaacgctgcttcacacctcggcgccgtcactcgatgggcagcactgtcagcagcgtcaggttgaatgttatatccaggataattgtcatcctgaaattcttttatgactaactaatgaaaagaaggaagtaactaatgcgcgcattaacacatgaattaatatggcgagctagtagaagttggtttaaatcaaaggtaaacttgatcaatgataagggggatacaaattttattatgaatagtgcaggtatatagacatatttatctgcatttatttcttaatggatgggttgtgcttgtttgaaaaactaaaatatggtggcagacacaacttatattaggataatttgtagacatggaaggcctaaatgtgtgcaatacacttatacttggccctaaacaaggaagctttaaatgtgtgcaatacacttatacttggccttagacatggaagccttatatgtgtgcaatacacttgatcgataagtactgtcttttaattttcataattttgtgcataatattcaaagaaatttcaggatttatcttttaagtatctagatttagaaaaacctatcacttttcaggaagggctctcacacacaacgatggcatcccatcttatgagtcattttacatagctattacgtattcagagatcatagggaggaagaaaagaggtccttccaagcagagaccacaaatcgatcatctaccttaagcctgtctgcccagagtgttgcatcctcaatacatttcactagcaatcgatacaaggatacagtttcatttcggaacactactccatgacgatgattccacagattccaaaagcaaaggaggtagaagaccttgtagtgtcttgctgggatttgcgcaggagggagtagggcagctagctgcttggtcgtcgagatagaaatttgaatgttgaggagctcccataattcagcagtgaaggggaaatgtaagcacagatgcgaagcagtttcagttgctgaattgcacagatcacacgaaggggactgcacaattttcttcttatgtaagttgctcttggtatgtagcctttctagagctaacagccaagtgaagaattgcactttcagaggcgctttgttattccaaataaacttccaatttgcacaaggctcaatatcattacatgcagcaagatagatttgtttcgacttcaggatgccacccccacctcgcttactcctaacatcttgatctagtgagctgatgtgtccttggaggagagtgcaaagctggaggaactgatcctctgccacagacgagaggcacgggacgaagtgattccgcaaatcttcagcaagaacctggaacaccgatgcatgtttattcggggagtgggtatagagaggatttaacttatatgccagaacgtcttctccacaccagcaatcatgccaaaaggaggtgtgtcggccatcgccaatctgaattgaggtgagatcctgcaagactgggagaagaagcttcgttgattcccagtgaggatctagctgtttctgttcgttgagattcggacttgcatgttccgcccatatccatttagaccaaggcaagtctgaagagtgaagatggtgcagccttttaacgagcagagcattgttctgtcggccaacatccttgataccaaggcctccaaattgctttggaatgcagattgaatcctaggccactaagcatctggctccaatgcagctatcctcccctgtccagagaaatgctcttctcatccaatctaagtcttcaatcgttccttttggaagcttgatggctggcatcgcacatgcaggtaagctgtcaaggatcaggtaagctgacatcccatctatttaaacaaccccaactagggtcagtccgatcacccaaagcccttgggcataaagctaagggcttattcggttcacaggatttccaaatcacaggaacaggaaaaacgtaggaatagtgtaggaatgcatgtgcaaaacaaaggattgcaacacaggaatttttactacactgagttaaacaaaagatgatagagtggatgttttcattcctatggaattagtacattttggaggattggcatagtgttcctatggaaaatttttctttgaatcctacaaaccaaatgcatgaatagtgattattccaaaggaattgagatttcctttaggaatccttcaaaacgaataaggcctaagttggctcctggcatccgctaccacggatgcttccaacaattgtatagcacaaaggctgcagg

SEQ ID NO: 52723 - DNA, 19641 bp, Oryza sativa
cctggtggcatcgactgtggtatatggcttataattctttcactcagtaaagtcgtcctccaaccacgatgccacatttttaacaattttatccttttaaaatttataagcatgtctctataaaatttattctagacataacccaaagctcggcgtcgacgatccttgtgccaagttttggcgctaggttagggccaatggtgacccttggcatggagctagcatagatgcgggtcgacattagtctcattgacaccaacatcccacaccttcggtctcacacatactcccgcttatgaaacaaacacttcctagggtttcattctgaactctaaatccaataaaaatgaaaatagattgaaataagtggagaggataccttgctttgtcaatttcactataacattcaatgctacatcaataggatgtgtgaatagactggttgaggagagagggaatttgtcccatctcgaaggtaaagttccatcccaatctcaaacttcatccaataaatagaaaataattttgaaaaccaattttgctacaaaatcaattgataaaataaccagatttgaagagagagaggagtcagtcccttctcggaggtcagcaccaacgacgttgtctcaattggatagaaataaaaaaaacatacaaattgaaatgataatttagttttgtgccgaccttagcgtcaaagagacgggtgccatgcaaatgtgtagggcggtattgcggccacgatttaggtgccaagacgttttcgggcaatagggtcctaggcaccgtgctatcttttttttatatttttttataagggcttagttgtaaaaatacagcctttttgccaaggctaagggtgtcttcggaactatatgttgtcaacttctactcccttgtttttcttaagcacatgcttctcaaacagtacggtgtgctttttactagaaaaaatataggaaagttattgttttaaaaagtcatattaatccactattaagttataatagcatttaattaataatgtgctaatgagttaattatcctattttacgtgcgtagggaagaagttcacaaccttctatccgaacgtttcgaacgttttggagccagcacaacttctcttgttctctgtgacctttgtgtgttttggacctttggtactactgcacagtgcacattttagcagaccccatctctcaaaagtaacagcacaaaaccttatagagatattggagatcgaccatgaatgacactaacgaaggtatggcaacctaacgaagaagcatattctacccttgtagagtgctgattgcttgaaattaatatatcgaacactgcactaatccaaaactagcgtatacatgatactaaaattctgggactgatgaaggatcacctgaactttcgaaacttccatccgtcatggtcatgcaaaggcaaaaacagaataaatgaacaaaataagacgaacaatgcattatcagcataagaacagacatacatcggtatgctttctcgttcgacaagtacaaattttaaaggtatccgggtggaatgtttcaaaagtttttgccatttttcacaaagtgcacagattacacgtaggctaccaacggtgataaatacaagaacaagtgtagatgcgatcattgggcgtggagaaaatcaaataagtcattaaggtaatatatcttataatgtagcaacaattacttcccattacaatgtcaaacattataatcgctaatattcagttacttgtataacagttcaaagacaattagtaaatcagtaaacttagtaaaacaaaagaggcaaacacagacaatctatctcctatatccacataaagaaaaaccaaaaacctttctaagttggtataagagttccactctctgcacaaaggaccaaacacgtctgcaacagctaatagaaaaccatcagtttaactgctaaatattgtataattctacagttgggacatttagtagaaagcttacatatcaacttgagtcaaaatactgttgctcaatcaggtaacgaaactggggtttatttagttctttttacaatgacgccactgtagtcaaagaaatccatgtcagcaccaattacccttcattgcatatatagcagaataaatgcagaaagcacaactacttcatcaaaactttaataacttggattcatctgagagcagccaatactatgcattgtgaagtatgattaatcatggtaccaacataatgttacttgtggttcgatgtcgtatccaaaacagccaagatttatcatagaaagatctctgaaggtcatttattcttttataaataatagtgttacttcaacctttatgtgtctagtgtatctactgatcgatttgtcgcaatgagcaaatgcagaaacagtctctacttaataaaaacatcatcacatatttaatagaaacaattgcacatttccgctccccaaacatccaataatcaaatttgcatgaactatgtggcaagcatggaactatgaacctatgacataatcatgctaaaaaaccaaatatcatgttctgatgtcatatccgagacatggaaaaaaaaattatctggcctcctggagatatctcaggaaccaatcatcggcttacattatgctacttccacttcacagctttgttataaaatctgcagatggcaagtgcatgaagaaacaaccacgagtttatctttaatttcatatatggtaagaggaggaaccacatattgtgcatgaagttacaaaggaacgatgcaaattacctgatatgatgtttcaatttcacatgtatactgcatcaggaattgcacaagtaatatttagcattgggcaattgttttatgctatcacactgaatacacaatagctgattcagagatgcaaatgactcaaccatttgttgagacaagactgaccccctatgctgatccgaatattttctgagacgagtaaaaacaaggaaaaagcttcttgggctaaagaaaggtatgcacatgtgcaaaacacctatcaatcacacataaacagaaaccaatgcaattagcaatcacacggtggattgagctggctacatacagatacatatacaggtttatctggagcagcatcacccatgacacaccccagttccccagaagtacacagacaggactaacaggcagcagaacactattctgaaacaaaaccagatgaggtgcctagttcaatcaggaaaagtgtttgtcacactcagaatgaatgatcacctccatatagtgggtggcacacataacagcttgctaatctcagaaaggacataataccagggtttttttaaaaacaaaatgtctacaaggccgcttacgtatacaaggaacaggtactccaaccttgtaccgcttaagacacataagcggtcgattataccgcataagcagccagttatgctacataagcactacaaggtggggtaaccgaacgaaaccgcttaccgctttttaaaacattgcataatactctacaatcatttcacactagcatgacagacaatataatgaatgaagcatctggggctgcaaaatctagattaccactatgttcacacttttcgttggcaatagcataagccagcagcttctagagaaacactgtttttctactaaaattttcttatcaatagcacacgcaagcagcttcaaggggaacaagtgcacccacaaaaaagtactacatattagctgagcagcagtaattgtcactagaaactaacgcaagcacacaggtaggctgagatgagtactacaggtgcagataatggtattagaattgaaaattttgcatcattcaggacaagattgggaagcacaaaacataattcacagcatattttagtagcggaaccagtcgggaacgtcacgtcgccttcttcttcttcttctactcggtcatggcggccccttcccccttctcctccagctccacccccttgccctcgccctcctccaccggggccgccgccgcggcgggctcctcgacggccctgtccgccggggcagcggagttctcctcgtcggggtcgcgcgcggggtcggtgttgcgggtgagcgcgccgcggaggcggtcgaggaagggcttgaacgcggactccatggtgaaccaggcgaggacgaggccgccggtcacgaccaccgccgtcttcagcgcgttgccctctcgctgccctcctcctcctcctctcgccatggctgctcgtggattggattgcgatgggacgggtggtgtgggatgctctccgcgctcgaggtttgggggggttttgttgtgagttggggaaggttttttttttttttttttgtcttgcacgaaagggaaaggcgagacgaggaagaagaaagaaagcgacgcgaggaaggcacgtaatttcgcggaaacgtgaggggcaaaacggaaaaaagtttagcacgggaccaacgtggcacaccgctaccgcgatcaagacaaaaaaccgtcgaaacgggacagcgacgcagcgagcaacgtgacgcgagagacaagaactttttttccaaaaaaaaaaaagaacggaacgggggatatggaacaacgtgaaaggaaaagagaaaaacaaaaaaggaagtgtcatttcccgacttgggctgggttgggttgggttgggccccagctttcgtgcacgatccattttggaagccaggagattggaaattttgtaaccagttgggcctggtttttatgggccaaagtccgttcctttctccatcgaaggctggaggaatgcacgagcaaaaagtacagcatcgcctaaatgaaaactgtgccactctcaccgaaccactaattttcttgtgcttcacaagaggacactttcatgatgtaatactaacacacatggtgacagattccgacctcctgcctacctgttcagtcgtgacacctcacctgtaatctccctttttttgtgagattaattgttagattcaccagctattcttgatcttcatacaccaaacacatgtaactactcaaagatgctaaaatgatcatggtaaagagaaagatggtagctcattacaatgagaactcagatctgagctgaaactctgcaagatcatcccaagaacaaataaacaagcaccatatttcattagctttttatttactgcaggaggcaaaagcataaggaatttgaccggagacatttacatcgcccaacgaactccaaaaagaattgaaagaacgaacatacattcggcctctacaggacactagatctacacaaaaaacagatcacgtagtgagctacaatttttttttcatcattcatcaaatttaccgtgtaattttacatgtaatcgtagttgcatcttcatcaccatatattatatcaatctccctgagcttcttcttcatttggatcccatggagacggcgaccaagaaaaggtcatgtttctcactggaggaacatgtgagaagctctcagtacgccatggcggtttgcccgctgtggaagctctgggtgtagttgaacgtggccgccggcttgcactgggccgacgccgacgccgccgccgccgccctgtgcgtggtgggcagcgagtgcgaggtgacgagccgccggacgccggagcgcatcttgtagaggatgtggccccagctgcccctgctgccgcggccgagggcggccacctcctcctcgttcatctcgaggtcggtggcgaacccgggcttcttggacatgagccagccgacgccccagtcccaccaccgcttcagcgggccgccggcgaacgcgcccagcgacggcgccgacttggaccgccggaacgcccactccgccgacgcggaggagatgggctggatcttgtcggagaaggaggacagcctcttcctcagccccatcaggtggctctcctttccacccccaccgccaccgccgccgccgccgccctggaacgtcggcagctcgtccttgagcggccttgtcggcaagaacctcgccttctggatgttctccaggatggtcgccatgtcccaagaaagagaagatgaatggaggaagaggagaaggtcaggtggcaatggcctcctacctcttcttctccagatctctccttctcctcttcttgagaatgtgatggcgcaatgtttgtcttcacagctatggcctggacaggctggttttattcatgcaagaggggtgggtggggccacgacgaggtgtgtgtagttgaaagctttgtgctgtgcagttgcgagcatgtttacagagaggcgaagcgccgaagccggcgatgtgaactgaacattttggctgttttgtttttgttttcttttttttttaggcagctcagataaactggagccgtgttggcgaaatgatgggtgggtggcagctgccggtgcggtggcgctgccaccgtgccatgtgtggggtggattgccgatttgctgggtgctctggggctttgacatccatgatgaattccatccaccatgtgggctgtggcgtcttgcctgcctgcccatctatttgactctcttgcaaattgcaatatgttgggttgattctggccaaatcgatgcaaagcttcccaatgtggtgaaagagcactcaatgatgtagtgtgtgtcctaggatacattatcaaacagcattgatgctcttcataatctacattgaaataccttaaattgtcttttagaaaacctgaaactgaaggttttcagtccttgtctatcccattgcgcagtttttatcataagcttcctactctgattcttcttggagggtcacagtgtgatatacctttgtgctcggtgtttttaactgtgttcagtgttcataaggaggcaaatgtttccatttgttcttgctagtttcactggagccttttgattatcactaattttcagaaaggaaagggtgttctgtgtttggttagcatctaatactcaaacaaacgggagaggcagctgccgtgtcaccaaaagcaaaagggtatatatcacatgagaacatgggggaaggaatcatccaatgaaacatttgctccctccctcttcctaccgaagctgtttgtcatcttccggttgcacctagacttttcaaggccttttcagcaattggactctgccttttctacgcaggaaacaatcaaacatgccagccattgcaaccatcacaaacatcattctcatcagtacaatgcaaaaactgaaactgcatgcctacatttctcatcagcacaaatgcaagcgtgtgtcacgttttgttcctacgatatgtttctgcccaattctttccaagatcagaggactttgaccttacttacaccatatattccttgcggcaacgtgcaatcatcccattcagtcaaaccgaaaaatcaatcgacagaaaaattatctcatacgccaattcattcgacagaaaaatcatctcatacagtcaaaccgaagggacctgaaatgtgatctggaagaagcacgcgagccacacacaaatcgacggattgcgcggctgcagttcacaagtcgttcacaagtccaactccgataataacactcgggcctcacctcacctattcttcttcttttcattcggttgcttcctctcgccgccgacactggcttttattaaatgaagggcaaaggttggttgcgaggttggtagaagaatcagacgagtggaggggcacaacacagctgcaagcctgcaacaactcatttttctcatggaagcagtttaactgacctgtcgtcactctgccatcaggctgtaatatgcttgtagttcttgggacttccagttcagaggtaggtagatagctgcagagaaggaacaaagaccaatccaagagtactccagttctgcattggcaaaagacagggtttgtgctgtatatgtacgtaactgacaggcaagagaagctggcttttgttcagctttccaattattgatttatagttcagtttcaaagcataggaggtacagtatggtatagcctccaaacatatgccaattgtaacaatgacaacttacaactccattatgttcaattgttctctccagtcccaaaacaaatgccatctaagctaatggtacaagctgcaactctaacaatgtgctgtgtggtttggcttcatgcaagatcgaaaaccatggctgaatacctactatcatagaagaccatgggttctgcacactctgcttctcaagactgacagaagtcacatatgactcagaaaaatgaagttccacagcagttaaaagtgcatatgctgaggcatttcagctagaaattactgttgaagatttcctgacaaagtgaagggaataacagcacaaatctactctctcattctcttaagcagataccgaagagaaaagaacccgagcatgaatgtttgccaaaaccaacctgtagcattcctcgggtcatacttctttgccaagaaccaagcataaacagcttcaccaacgtgcaatgcagttgctatcacaaagactaaccgaatcaccaactttgatcggaaaacaaataaatggaggtcaagcacccatttcaatggaccgacgggtggaaggtaagcagcagaaaacaatgccagcatgccaattgttacaaacagccaaggaaatatggttgggccatctagttcttttctcttcctctcctgccagtaggaaatagttgcagccaatccttctcgcgggctcaccataggtacatagccgatttcctctctagctttcaaatatgaaaagtagtgtgtaacacccacctgtcacagcgaactatcaacattagcttcgactatgggtttgacatcatgtttattcccactcagctataaaaatagaattgcaattatgtaattctacatttctacttgcctagtcaagaaattactaaagatcaacagaaaatgattaatttatatataaaaaaggataaaatagctgtaagcaatactgcacatccatcattacatcttagcactatattacgcttaacaagattcaaactcctaccaaacaaattagatcttattacccctcactcatcatgattaacaacagagttgccgtcacatgagaagatagtaacagtgtaaaggcatatttccataatggactacattaggtaaagtcattggaacatgataaataagccgaccttgtatacttcagcaggaaggagaagaggctgaggaatccatttactatccaaccatggatagagtagtgtatacatgaacacaaaaaatcttgagatggcaagagcaactgaggtatccattctaactcgtggaactgtgtaatccaaactttgaaatagaggactgagaaattcaaaagtattgacaggcgatcctgcaaacaaccaatagtttcttgttaagaaaatgcaacatttctttcaaattacaaacaacaaacattaagagcaattctggtaaggaatataagtgtaattgctcaagttgctaaaggagtaatggttcagtattgaatgtaaatatattcaacagagcatccagtagactcattacgtatgatctgtaagcaataaaaatttcaactccctctaaaagaaaaaaggtttcaacctcagaataagcaaaacaaataatagctaaacgagctatgcagtaaatcattttgaatagatatcctcaacaaagacaccaatgcagaacacaagagtgtaaactactgtttttttatggtagcattcagcttagtagtctagtgttcaacagtcagctttatcaatatgacaagacaaaaataaaaatggctgcactcctattcaaaagatggaaataaaattcagaacatagtgccatggtatcagaaaaggttaaccagtaatatagttgccctacaggctaactgcacttaccatcacatatgaaatatgcttgaccagcagctacaggaattcccttcctgtcaggaatatcatctaaaagtcccatgcttgccaatatcagtgcaagaacaagattatccacatagacccaatctgacttcacatttggatccccaatcttgaagaatgctaatcccaacttcgcaagggatagtatccttggaagatgccgctcttcacctggaccatagatagcggcgggacgtattgagcatgtataaagacgactgcttttatcactcctgtataaaaacatcaaatcagtaagacagcctgtatattaccaatgttcaacttaagtcccaagccaaaatgaaataattggtggtggatcttgacacatggaaagtagaaaatacgctcatcataggtgaaaacaacacatttgaagatattatatgaagggtatcggccgacccggcaaaattatatgaagggtatgtaagtggcagatatacatggcaatgaggcagacataagaatcatggcaaaaatggctcaacttacttagtttgccggccattactcttcagcaccaactgttcagcaattgatttgctacgcgcataggcatcaacatggtcttcaacagggaaataaggcagcgcctcgttcccattgacaatcggctctcctccaaaaaccacattatacgtgcttacatacacgagccttctaacaccatgctcgtggcaagcgtccagcacattgcatgtaccatttatattgacctcgtcggctcgcccagcctgtaccatttccttccctgacatgccatacgaagcgagatggaaaacacagtccacaccgcgcaaagccttccccacatcttccttctttctaacatcccctgcaacacaggttcaccgatcaggtatttgataacttaattcgtgcatcggaaatgcagagccgactgcaatggacacacaagttaacaagctaaccaggcaattatgcgcagtacatcatgggtattgttggtgttactaacttactgtcactgtgttgagaaaacaaaattcaagattccctaactactccaagagccaaaacatatgtactagctaatagcacagaggcagtagtttactccaatttcacactagttagcaacaaatccggaggtagaactatagccaagcaaagcagcgcagcgctagcgctccagtgcgtcttacttctaagaaaaaactcagtgaccgcgtcagttacagtgaaggaaaagccaaaaccactgtagtgaggatgaactcgagatggcggaccttggaagaagcggacgccggcgccgagcagctggtcggaccagggggaggaggcgcggaggtcgagggagcggacctcccgggcgccgcggcggagcagctcgaggcacagtgcggagccgacgaagccctggccgcccgtcaccgcgaaccgcacgccctcgatcccctcgttctcgctcagatgcatctctgactctccccccaagccgccgacgccgagatgcgctcggtggcggagaaaacgagggcgagtggaacagtatggctgtatgggtcgccggcgacggcgaccgcgctttactacctgtccgggtggagatcgtcggatgggaactcgaaaggcctatctctcatgggctcatgggccatggcccacgcggaatgttttttctaaaaaaaaatataaacaaccaacctgtttgtagaactaggcaagaattattttaagagctattttttagataagaaaataaccctctaaaaaaatagccctaagttgtttggattcaagggttgcttttatgtatcttcctatggagagagatagagagaaaagacgttttttcagtgagccccacccgaaataggctcaattagcaccccttgggtagaataattttttttgagtgggttatttccaaatagctcacccttttggatctttttggctatttggactattttttagggagggctaaaaaatatcccttggatccaaacagggccattgccactgtcttttaacatacgacgttattaacttttatgacattcgtcttatttaaaatttttatgtaaatattaagatatttttgtcatgcttaaaaaatatttaataataaatcaagttttaaataagatgaatgtttaaactatcttaaaatattaacagtattatatgtttaaaaaaaggaggaagtaaattggaacgtatcatggctttcatatcagaaaatttcattgcaaatgattgcatgattgcgtcactgtagcagacgctggagaaaagtagtggtgtggataagattttttaaataaaaattataaacaagaactggatgtgatttttaaaaagcatgtctgggaaaatgaatagacgagaaatgtgaaaagtggctgacaattttttttgattgacctgaggaggagaaaagagggaaaataaaatgtgtaaaatataggctgacaatttttttattgacctgaggaggagaaaagagggaaaataaaatgtgaaaaatatacggaagagaatagacgagaaatgtctgctgagaagcaaaaaaaataaaagaatatatcaaggtcccaccgagatttgaactcgggttactggattcagagtccaatgtcctgaccactagaccatgggaccattttgcttaaaaacccaagctgtcattatataataaccattgctgtgctgcttaagagctccactccgaagcatccaggaattgcacagcgttgcttaggccggttctttcttgtcagagacaaatggattacaagatcgcctacaaaactagctatgaaccccagccagtgacgtttttggttgggtaagaagcaatcttgtatatgtcacagactccctccggcttgccggtgcccctcctgatcctgaaatacccttgctctccccagttcttgccccacgagttcttcatgatgatgtagtcctggccgtagtacgagccgtagcccacggccgtcagtgcatgatccggttgaatgccacattccccatcaaagatcccctgcatccagtattcagatacacccattttgtcagtttaatgtttttgtgctgatctgtactgtatcatggtgaatgaagattgaagaacagctgataattttgtttacccctttgtagaactgaaagtctctgctcccagctgctatccccacactgacaggctgatgagccagtgccttcagtaggcttgtctcgctgttcgccgggacatcctcgtagccggttatggtgatgactttggaatgaggctaaccaccagtcatcagttcatcacagcagataaattcaactgttagagatcctgctagatcactacatgtgtttacagctgaattgcctctgaagaagaagtggttttcatgtttctacctgcttttctctgcagtagccttcttccatgaggtatgggtagtcttcctctgtgtagatcccctggttccccattatgtatgcgaaggcgaagtccatcagcccacctcgacagccatgattgaaggtgttgtcgcagtccatcagttcctgctctgatagtgataccaacttgccggtcacaatctggtttatcccctcaacagctgccaccgttgaaaaagcccagcaacttcctgcaagagaccgttttctcttacagcattttcatggaacaaattgcatcatatcatacactatttcagatagtgatttagtattaatatgctgaaacagactgtgtgcactctcagtttcaggcattgagtatcgatgcgatgaaatagattgtgcacattttcaggcattcagcattaatatgctgaaattgattgtgtgcagggattcagtatcaccgtgctgaaataaattgtgtgcattttcaggcattcggcctcaatatgctgaatagatcgtgtgcattttcagggattcagtatcactatgctaaatagatagtgtgcatttttcagacattgagcttaccacattctccttggttcttgaccggtgtcactgctcccttcttcctccagtccactgcccagggcaagttaacggcgttcgcgtacctgaatgttgttgaaccatgtggctgagcatcccttcttgctaaccctggcttcagtcccaggtaactggccttgaattcttcatgtgcaatgtcagcaaaatgatttaagccgagccaatagctgccatttctcctgttcgtctccacaatgtgcctcaggtttcgcttgaagatctcatacctcttgaccttctcctttgggcttgcatagatcttgctatgttttactgaccatgatgtgaagagaccaacaagcttatttggcaatgcaagatcctcctgcgagtatccgacaacggaaggatcatggtgactagcagtggcagaacatgccacaaagcctagcaacaagaagagcatggagagcttggagtccatggcaagaaggctattgtttcctgccatggcatgcctagaattcatgaacactctttataatgaccagccatgtttcttgcaagtaattcactacacctgaaatctgaatacctgacaagggcccttctggctcaagctgtgaaggagtggtactagtaccttgctttatgaagaagctgcagttgcaggtatacttttgctctatagtttattcagaaaattgcttgatgtattactttattgttctattgatgacctcttatcatgtttaaattttgatttatgttaaaatagaagtttcttatgcttgcagccttgcaaacctctgaattggagataacttgctcaaccatgcgaagcaggtgcacaggcagcagtggatttttggaaggatggacaagtatcctttgcttatctgctcaagtcatcaccaaacagaagtacaccaaactattctattaccagatcaaccaaccattagtattttcccagttcgagcttggtgtacgtgctcataggaatgcagaattggctgggatgagatatctaaaagaatatagagaaagagaaatgtcttgaaaaaaagaagcaccatgggaaagaaagaactaaaaaatagacgcggctttgcctatgaaatactccatccgtttcatattgatcatcatttaacacaaattgaattttttaaattgatcatcatgttatcatagccccttcgtttgacgtgtaatattattgcatttaagcatgaaaattgagtatgcatgcatgtatgtaggaattcgaggtagtaaagctatcgtttcttagagcaagtttaatagtatagtcaaccactgacttcaaatcatctatagtcaatttagtaggaaattcatatactcctataaacatcactacacaatttatacttggtcgcacctgtcatacatacatgtatcttggagtctgtgctacagctggctacaaatctatagcccactgctcttctctcttctgttttatctcatcgaaatgtgtttataattggacctgctcttatgtatggggcctaagaggagttaaagtgtgcatgtttcttgatttttccctaccacatactcacattaaatgaaatataggaaagttaatacttttttttgtcttggtgaaaaagttatatggtaatcaatatggaacggagggagtaaatgatatggtatgataagtacacttaatttctttatctatttaatgcctgaaattatggaaactatgcccttttattcatatattaatttaaagcagcgagacattgaattcatagacataagttggaagtcgaatatatgcgcacaaattccaaattccaacgaaaccaaagtaatgaaactacttactcccttcttctaaaagtctaaaacttattctattctttggtttttccaaaagtttaagtcctatttatagtcattatgttttaaattaaattattgatcggaacccaataaaccattttattacttattggttacatgcttattggttttgtcacattgtaaataaattaattactccttggtcttggtgccaaaagaaataattcctccatcccaaaataaacttaattcctgggtttttgtgtctaacgtttgatcatccgtcttatttgaaaaaaaatatgaaaaattttaaaaagataagtcatgcataaagtattattcatattttatcatctaacaataataaaaaatagtaatcataaaaaatatttcatataagacggacggtcaaatgttgggcacgaaaacccaagaattgagtccttttggaatggagggagtaggtcttagacttttggatggagggagtattttcattttatctcctggcggagctaaaaagattttttgagcccaagcaaactatacttctagtatttattatataaatttcatcatcaattcattcaataacatataaatttaatggagtttttgtcggtgagtttgcgcggccgcctgcgatagccaggtgtggcttcacccctgcctccacatgtctgtaaaaatcaagaaaatccttttttaaaaaataattttatcttcttattctttaaacataacgttctaaaagtgcataacattaaaaaattctatttgcacaataaagaagagtaaggaataaattatttgtttgaaaatttggaattgcgttgagctcaagctaaagcaaaagatactggtacctccttattctcttctactacttaattatatcctggatactccctaaaaaaattatatcctggataaatgattgcaaagaggctttatctgcccattgcaacttgtatgtgcagccgaactgtggtccgcatcgtttgcttatttcctaataagccaaaacggcttattagaaaataaaaataaatttgtaggtaaaacttttataaatgtattcttggtgacttaaaagccaatgttgaaaaagaaactacgttgaaaatatctcaaaattaagcttgaaaattcaaaatttagttttttctttagctgattaggccatccgatgggagcctgtaagtgtcaactgagagcacaatcaaatgatataataagatctttagtttttctcccccacactatctgaatgtaatactcactgttttttcatttagatggcaacgtcatgcaaaaaatcagagccgtccgtctgtacattgatctagccgttcgtacgatgtcttcagttgcaggcttgcagctaaataaagtcatatatatatatatatatatatatatatatatatatatatatatatatatatatatatatatatatatatatatatatatatatatatatttgtccttcccagtccccagccccgttcctagttgggacgactccgctgctctccagtctccattcctcaatctgctccttgctcctcagcgtctccatcttcgccacggtgccgctgcgacaacggacagtatatggcatcctttgcaggaagttcgatggcgcctgtgtctaaaagatcgaagtagcgccgtcaacatgagcgaggagaagtctgcgatgcgctccctgtcctccacctcctgcaatccctcctgctcctcgggccgtcgacgggtggttcgccgcagcgtcatagccgcgacgtgcaggtgacagaggatccggcgcgacgccaccacttacccgtgcacgccgcctcctctcctccgctagctagcgccccctcccttctcctgatccggcctccgggtcgacggccaccaccgctactcttctcttcattgggctcaatggatcttgccgaagtttgtatcgtcgacggctatcgcgtgcttgaggtgactcctgcaacatggcgacaaccccgcgtgtcaaggaagggcagcagcatggcggcggggagcgcaggggagggcaaggtggccgggtggtggtgaagaagacgagcccgcgccttgagggaggacatgagtgggtggtccgctgcggcacgcgggtggcggaggatccggtgggcggcgaggcgtgcatcgggaggagggatgggtggattaagggtcgagcgcttttgccagaaaaaatcaagcttcgttggtccatcgcagtgaactttcggagagcaaggagacacatggcagattttcggagatgagaagcttaatttataggacgccacatggcccaatctctaaccagggatagagccctgatatcggtattagagatgagcattatagaaacactcggaatgtcacctcatgtgactaccccatacttaggcattttttacgtttttaatccctgtgaatacgtcttacctcaaccgaataaatagtatttaaaagatatcactatgcgttgtttaaaaaacaacactatgctgatcaattaaggttttggttcaaatggatttttttgcgtattattgagggagattatatactatattaacaagataaattaatactccctccttctatttatatatatgatgttttttagttaaaaatgaactaaccaacttcatatataagtggaaggatggagtaatttgagaaataaaatttagaaataacctagagcaagaggtacgaacaaaacaataaaagatttgttttttgagaatttgtatttgtataagcatggagaatatattgatatttgtaaaagcatggagaaaataatcattggcaatttttttaaagaaaaagtgaaaagaacagggcctagactcaggtttttccatcgtcacggacaatagaaaatcttggcttattcctagcactaggttagttttaacccaatatattaattaattccaaactaaaagtgatacaatgttttatccttaaggcccacttaaattatcctctgaattattactacatattatctgcctgattatgtgaaaaataaacttaacaggtggtatgaaacaagtcgactaggcattacagtagaggaaagtattttgaaaaaaaaacatataccaagtaatatgtgtaataatttgatgaagtggcaaaaagaaagaagacattgtcagggttatggataccacatacctaatagtagttgactaaatctcagcagtatccaccacataccatgtcctatacggaaacaacctgcggatataggaggagtttcggataaggaaagacaaccagagttctatatggaaacgacaagaactactcggattgtatccatattggtttccctagttctacttggacaagaggacacctatgggtataaatacaagaccccctaggaggagaggggacgccacaaagccataagccaatacaagccaacatacaccaagataagacgccggatatcgacttcagggataagcacggctaggatactgtcaggagagacgaaagcgctatctctgatctcgccgggtacggattcgaggaggaagactaacctgttgtcgaccacgagttagaccttcagatcaccatgccaacaacagttagataggctaccccaaatattgtactggtgtgattatggtgaataagagcaataccggcttcggccaacaagatgtagggttattgcctgataattcaggggcccgaacctgtataaaaatccttgtctccgtctcttttacctcagtctcgcgtatatcctaataccaacgatcctcatactatgcaaataccggaatcgcgacatcaaacgt

SEQ ID NO: 52724 - DNA, 7254 bp, Oryza sativa
aaaaagttaaaaaatttaaagaaaaaagttcgaatctaaacgataattttataggctaaaagttagcctgccccccaccggaacccctcattttttagtttcctaatctcaacctggccgtggtgccaaaatttgattggtccacgtggcttaatcaattgcgaatgaattggtgaatcaggggtcgttccttgaaaaaaaaaacgaaaacctttaaacaagggtaaccaaattttccacattacccaagggtaaaaagaaaaaaaaaaaaaaagctccgagcactagttgggcctagtagcccagtcgctcacctggacctgcccactcggtgcccctccctatgttgatgtatgcaagtgacgggttgccaattcatttcctcctttctcccttcctccttcccttcttctcttcctaatatagtctacagtataccataaaaaattttaaaaaacaaaaaattagaaaaatttatgtatagaaatactatatataaaaaaattaaattcaaattcaaatttaaatcaggtatataaacttttaacttataaactttgggtctataaactttaggtgtataaactttagatgtacagaaatactatatatatagaaaacatttgaattcaaattcaaattttaattagatataattcaaatttaaattttaatcgggtatataaactttaggtctataaactttaggtctataaactttaggtgtataaactttagatgtatagaaatactatatatgaaaaatatttgaattcaaattcaaatttgaatcagatatataaacttttgacttataaacttttagtctctaaactttagatgtgtaaacttgaggtgtataaatttactaaaataggaaagtaatgcggtgtaaaaaaaagaaaccaagtagagagaggggggggagaatctcgcccagtagcatttctgcctcaacagttgcgtgcgtgaacaaggaaaaggaattatgaggaaaacgaaaaaggaggaaaaaaattaaatacaagaaagaaagaagtaaaaatattttatataaattatatactatggcttgaatcggaaattgaggcagctaccctaacttcttcttcttctttttttcagggaagctaccctaaccaaatcgatatatttctggaaattaaagacaacaaaaagaatgagaggaacaatgcgaacttatatcataatttgttgtcacgataaccatgttttaaaatatgcatttttcacaaatacactacacatttgataatctctactaatatagaaagtacgaattcattaaacacctctctttcctaaccctcagatttagggcattcaacccatagtgtccataagcagcaatgtctatggtgccatatcaataagacatcacaatagaaactatactctacaacccatggtttcttaaagtgggctattaataaatacatcatttctctcctctacccacggattgccatgcatttggcactgactttccccgccctttttcgtaacaactccaaataaagatggcaccaaaatgatagttaccgccatagacaaggattcatttgtgaatgataaataaaagttacccatatcaagaccaaataatggatcaatgaaaaattgatccaaggggcttgaaattattggtccgccgcttccagggataactcatatttattcttcatctattataaagtcactattcttttccaatacaaaacttgatagtgtctagtgcataggttctcatgttgaagctgtgtcttgcatgagatccagtttcttcctctcttcactctctcttaattaatatagtgccacataagataaaagtcctacatggcaatatagttaatgccatagacaccatcctaaatggagggttaggaccgcccttattcatccaacgaatttatggctgtgtttagaacttcagctcccaacccctctctcgcgcacgcttttaaactgttaaacggtgtattttttaaaaatatttctatatgaaaattgtttaaaaaatcaaattaatttattttttaaaataattactaatatttaattaatcaagtattaatgtatcgctccgttttcgtgctgaggatttgggttcccaacccgggctgaacaaacacagaaattagcgatcccactccgtgtgaacggttatagaaattaattagcgatccatctccccctcccctgccccgccacctctccaccggcgccgacgcctcctcgcgcctaccccgtcgcccgccgccggcagccgcgaaccccgccgccgacgcctcctcacgcctatcacgccttcatcgcctgccgccttctccaccgccgccgtctcctccaccgccgctccttgccgccactgcatcctctacgtctccccgcacgggtggacgctcgccatcgaccccaccgacctcgccgcgtcgctcctccacctcttcaccggagccgtccgcgccctcccgccgctcccggcctttttcgccgagacggacgacctggcctgggactggtcgccgcatggcgtcatggcgtcctgcggcgagggactcctcttttacgcctccgacccgcccgccgccgcctgggcccctatcgccgccatggccgactgcaacgcgagcagcatcaactactccggtggcgagttctttgtcttcgaggacgacgtctgctactgctgcaccaccatcgtcgacgccctcaccctccccatcgccgccgtcatcccggtgcccgccgtcgagctccccgccgaggcgcgcatcgcggtggcaggcgacgagctcttccttctcatcaagtccaaaggatgtacctcttcggcgacgacatcgacttctccaaggcttccggacagctttgacttggcctgacaggagctcaccggcatcggcggccgcgccctgtttgtcgattcctgcacggatttgccatggagaccgcgggattcgagaacctcgagggcaacaccatctactcggtgaccaccaaggaggtgaacgatcggcattccaccacgatgaagtacagtcggtgttcagcctggagaaccggagcttcaagaagctcgcctgctgcctcaacaagctggagatggccctctgcggcgagacgccgtcctggatcataccaagctggaacgaaggatgaacggaatcagagattgccggattggtggttcttgaagcaatggtggtcgacaaatctctgtctcactctcagaggatggattctaatctctcttttcttgcattccacttaaataattatgaaaaaattttaaaaaaatttacaagatagattaatacgtaatatattacttcacaaacatgtaagttcaagttcgacttctataagttgtaacaaaaataacaaattaaactctaactagtatatgtatatttacagtcaaatttgttatttttgttacaatttgtagaagttgaatttgaacttgcatgcttgtgaagtgatacatactaacctatcatgtcaatttttttaaaattttttcataactatttagataacattgataaccgcagcatcactattgcataggacgccggccaccttatcctccagagcaccggtgcgcctgacatgccttccgtcggcaaattggtaggggagaattcatttagatcatcagaatctgttggaaagaccactggtttgcccctgcacatgcatgttgtgaaacagacagcgtcaaacagcattagttacctactaggagcagtaggtttgcatcagcgtgtacagtaattaacaaagctattgcattgaacatacatatacatatgtagtttcataaagaaaaatgtgaaagaaaggctctcgttaattacagtatgtggccgcgcgatgttcccggatcaatacacatggaggtgccgtcaagtccgaagaatccaatcgcgacaacctccttcccagacaaatcagcctcatcggagaatcccagaggaatgcagttaggcgccccttggacacggatcagagcaagatcaacgtgttctgagacgtgcaccaatcgagcagaggcgatatgatccgcaccaaaccgaacggacagttccttaggctgtgttcctcctgacacggagaacaaagcacacgatttagtgagattaattaagtattagctaaaaaaaacttgaaaaatggattaatataattttttaaaacaactttcatatagaaaacttttaaaaaaatacatcgtttgacagtttgaaaaatgtgtacgtgaaaaacgagtgaagggagttgggaaagagggaaaaagaacatagcttactccgcttaggatcgattacgtgggcacaggttaataccaagcacgacgctccatcgttgtgaacaacaaagccagttcccacgccaagtttcctgccttctttggtaaccagcacgcacgtcacctggactaccgaaacgcggtgttcgtcgtacacgcgctgttccggcgtccgcgacggcggcgaatcaccttggtaagcaacacaagagcaaaaagaagcggtacgttaaccacaagcaaattttttatttttttttaaaaaaaccattttctttttttgcaagaggatcaatgaaattaagaacaaagcgctagttgcaaaggataggagtgcaagatttgtaactaacttctctgcaagagatcgaatgaatgaaagaccagttaagttgtaaatgagtgcagattcaaaactagcagcgccccagtaggatcttttggccttaattcaacagtaaatgggagggaaaaaaaaaagaacagctggcctacctgttggcgctgatgaggacatcttgacttgttggacttgcggaagaatgggacggagtatcggcatgtagagcgctgtttgtccttatatcatcgcccgccggacagagctgtccaaaaggctcgagacgcaagctagttcggctcgtttcaagcttgtttggagctcggctcggcaagaaatcaaacgccgagcccgttatgctgtgcgctttaataacttacgcttttacccccttcatcagccaagccatccaccccacaggccacagggaggttaagatgttgggttattaccccctttagtgtgctcaacatggacactgtcgatggccgctattgtcaccatatatacgagcccccacgtcgcgcaggaaccacgcccgtctgttcggcgccggtgttccaggaggtgcacccgccgtctgaggctaccatgcagtggcggacgcaggatttcaacaatgggggtacgaagttacagactacggactgtgtacatagtaccaaggaaacagttcgacgatgaaaatatactcaaaccactaatgaacactcaatcgaagcgcaggcatgcatatataaacaaagtatatctcaatctttatacataacttgttgtgaatgatttgtagtgaacaatgaacgaaaaaaatagtacagaagacacaactaaccgttgcgattgtagcgattatatggctgcaccacccataaagattggatccaatctagaggaagaaaataccattgaatgatacccaattatctctattatctagaagaagaaaataccattggacggatggttgtattgcttttttcaaagcctacaaatattttggcctaatgatctgtatacatagtatatattatcttttttgttaccaaaaattttgggggtacagctgtacccccatgtcccagtgtaggtccgcccctgctaccatgcatcctgcagctgcttttttgcatgtccagtccttccattgtggcattgtccattctagagtttggaaattaacatgaccaattgtacataagttttttttctttacacgaattgtacataagtatgttccatgaaaccatggccaagttattttgcaactcaactacatcaattgtgtaaaattgtaagttgattgtagtatttgttttaataggagagaaatgcgcatcactacttcttagagttgtctatttaggccgtgtttagatttaattttttttcttcaaacttataacttttctgtcacattaaatgtttggagacatgcatagagcattaaatgtggacggaaaaaaaaccaattatatagtttgcatgtaaatcgcgagacgaatcttttgagcataattacgtcatgatttgacaatgtggtgctacagtaaacatttgctaatgacggattaattagacttaatagatttgtctcgtagtttaccgacggaatctgtaatttattttgttattagtttacgtttaatactttaaatatgtgtccgtatacttaaaaaaaatttggcacaagaactaagcacagcctaaaccagcagtgatgcctagctagcaccaccgatttaaaaccgatagtaaatgtcccggggcatcattgtcgtatgcctcccacaggttctaaattaaaaccaagagcaaatcctattacgaaccgatcgacaggtctgtactagtgttcagcatcgtccatgatgagtactgggctactggcgcagctaggagctcttggaacggcaacgaatgcagcagcaggctatggcgcttcaccatgctctatgggaaggaattgaagaagagattaagttttttacacaaaacgatatggtatcaacatatgattgattgagttttaattattacaaacttgaaaaatatattaatatgatattttagagcaactttcatatacaaagttttcgcacgaaacacaccgtttagcagtttgaaaagcgtgccacgaaaatcttaatcttcatccaactcgtcacaataattaatatttctatgagttttccgctaaacccacaaaataaacacagggtagctagctagtctaatagtataggcaccaccataacaagactccatgtcgagactgtttggttggttcccataacatatacttcctccatttcaaattgatctacatatagtttttttaggttatttctaaatgatctacatatttgtatgcatttattaaagtctatttgttatttgtgcattggagcaaatggagattgatgcatgcatccatactgtcggtgacatggggccgggggtatcgtgactagaggcttcggtagccgcggtcacccacgtggcctgaccccctcgggggggggggggtcgggcccgacggtaacttggccacccctccctctgtctccccgagggg

SEQ ID NO: 52725 - DNA, 14802 bp, Oryza sativa
tggtccctagccgaagccggcgtgctaattccggaagttggtatgtcagtcccggtcagatccattccaggcttcagcgcaagtatggcaaggaagtcgctggccattaaatgaaggttgaaatgggcgtccaccgaaaaaggggcgagcagagcagaaaacgtgcgctctgcttgtcagaggtcactttgggctgtagactagccctcattgtaaaagcatgttcctttcttaggtggcaagaggcccttgtggggacccctgaccaaaaaaaaaggaggcccaggcctagaaagaaaggagagagaaaaaaaagaggagaagagaggggacgaacggggctagagcctgaactctttctcgctctccggctctctgtattccttcactcacagatccaccagaacacaggagtagggtgttacgcttctcagcggcccgaacctgtctacgtcgcccgtgtctcgcgcatttcttctctcgctgacgttcctcagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcttcgcccgctcagcccaatggccgaacgggcagtggcgcacagcctctctccgaacgctagcggtgacgatggggagcagaacccgcgccgtcgggctcgcaccccaccgtccccctctcgccgaaatcttgggcggggggaggcgctcagggaggttggaggatccgcgacttcgccgcccgcgggcgacgggggaggacggcgaggcggggcgcgtcgctgcctcgtctactgcgatggcggcacgccccagggcgcgctccaggctgcgggcgcgctcctgcgtcacccgcccgtcgtccccgatccaaagactccagcccgacgttggctggatgacgtggccgaattggtcatgacggcgcagcagcgactaggcgccggcgggcggtcctccgccaccgaggcctctggcgctgccgccgccggctccaagtcgtcgaggcggagggcgcggcgagcgggggccgttgcccgccgttcgtccgccattccctcgtcaacgcctccaacccaagaagatgtgagtggggggccggatgcccgcctcgatatcgagcgccggcgcgacgctcgtcacgccgcccacgcaacggagggcgcttcctcgtccggagcgccacttcggtccgggcacgggggccagccccccgtgtccccggttggcggtgccggctgtcgaacctttgtggcgagccttcggaacgtccgttggcccccaaggttccggcccaccatcaccgaaaaatacgacggaagcgtcaaccccgccgagtttctccagatctacatgaccgggatcgaggccgccgggggtgacgacagggtcatggcgaatttcttccccatggccctgaagggtcggcgcgggattggctaatgaacttgccacccgcgtcggtccactcttgggaggatttgtgccagcagttcaccacgaacttccagggcatatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcatgcggcacaaccgcatgctcgagaagatcgcctccaaggagccccagaccaccgcgcagctttttgagctcgcggaccgtgtggctcgcaaggaggaggcctggacctggaactcctccgtttctggtgtggcagctccggccgcccccgggtccgccgctcggtcagggcggcgggacaggaggaggaagaaggggtcggcccgttccgacgacgagggtcacgtcctcgccgtcgagggcgattcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgccgaggacatcgacgatggcgacgatgacctagggttccaggagcctgaggccaccgtcgccaccgtcgatgggggagcgtgcgctcacgcttctcgccggagcctcaaggccatgaagcgagagcttctggccacggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctgggcaagcccgcgttggtgaagttcacggcagcggtccactacgcctacctccagatgaagatgtcgggccccggtggccccctcaccgtccatggcgacctcaaagtcgcgcttgcttgtatggagcagcgcgcggaccaccttgccgcggcgtccaagcccgcgggtggcgacgagaggctcagcacctccgtctcggccgccccaaggcagcggatggtcacgtgcgatgaggtcccggtcaaggaggttgccctgggcgacggcccgtccaagaccacacgaatcagtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccgacagaaagtgcggcggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattatccccataggaacttattgttatacgacaatgcctttcgggttaaagaatgcaggtcctacttttcaacgtactactcaaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctacccgaggcatcgaggccaaccccgagaagatacgagctatagagcggatgcgcccccccagcaagcttagggatgtgcagtgcgtcaccggctgcatggccgccctaagtcggttaatatcgaggctgggagagaaggcgctacccctatttaagcttctcaaacgctccaggccgtttacctggacagaggaggctgagcgggccttcactcagttgaaagcgtacctcagttctcccccagtcctagtcgccccggagccagatgagccgttgctactctacctggcggcaaccccgcaggtggtcagcgcggcgttggtcgtggagcgcgacgaggacaaccctcgccccgcacatcccagtcctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctctgaccccgaggttgtcggcacagaagccgagtgcgccccgcgtggcctctcggacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattacttccaggcgcatcgggtcacagtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggacttcttgcgggactcagagtggcagctggactggggatccgccgcctcctggtgttaggcgactcctcaacatcctcaagaagcacggcgactcgtggatcgaggagctgccagcggtgctctgggcgaaccgaaccatgccaagccgagcaaccggggaaacgcctttcttcctcatctacggcgcggaggcggtcctcccatctgagctcaccctgaggtcccctcgggtcaccatgtattgcgaggctgatcaagatcagcttcgccgagacaacctcgactatttagaagaacgaaggcggcgcgcggccctccgagccgcgcgctaccagcagagcctgcggcgctaccatcagcgccacgtccgggcccgatcactctgcgtcgacgacctcgtcctaccccgcgtccaaacgcgtgctggactgagcaagctctcaccaatgtgggagggtccgtatcgagtgatcggcgtcccccgggcgggctccgttcggctggccacgggcgacggcacagagctgcctaacccgtggaacatcgaacaccttcgtcgcttctacccctagtgggggtcgggcgtcatgtctcgggctcgggccaaccccgcaccccccctgggcgtgcaggattggccgggggctaccacatgcatatacttaccttttttctcttccgaatttcaataaaagcattttcgacttcttgaggactgtgtctgtgccatcgtttccttttgaagaatcttggcttgaattagcacgctcgtgctcgaccctgccctcggcggcccgggccggctaaaatcgccaaacggggcccagaaccgagccgtgccccggggcgtggtgacctccgggggggaatcggcaaaggcccacaatcgggtcatccataaccctcggtcaccgcgctcccggcctggccagtctcgacacgaggatctccccaggcactggctccgacccgcgccgtttgaggctgggacctgggcacgagcccttgttcaagccaagacaaagaaggaccgcggcaagaaccatcctcgtctcatacacacaacaaacagaactgacgtggaaatttcctctttacttgattacagattaaatcagtctatacaagaagggggcccgaaagcctcggaagaagaagcaaaagttattaagattggcgggggcctgggggctcactccgacgcgcccgggacgtcggcctcgtcgtcgctgtcgtccgcaccgtcgtcaccgccctcctcgtcggagtcgagcgcgaacgcgagccgaggggccgtaccctcgaagctgtggacgatatggtcggtggcgtcccggaccttcgcgcgcgcgccgtcctcggttcctggagggaactcttccagcgctgcccacggggaaaagtcagggtccctggcctggtggcttgccagtacgagctccaccgccccccgggcgaggtccctcgaggatgacatgatcgtctcctcgagctccttggggagccgctcgagggccccggtcatctctgagaggcgctgggcgaggcccccctggttggcggcgtacttcgcgtgccgcccgccccagaggcccgcctgccgcccggcgcggtctagacgggagacggcgtcccgaagcatgccgggccctacttcgctcgccaaacggagggcctcgacctccccggcggacgagtccagcgcgccctgcagctcggcgatggtgtgttcggcggctgcgaggcgggcggctaggtcgccgtggcccgcggccgccccgccgctgtgcgctctcacgtccagctccttcgcccgcgcctcgagctcagcggcccgctgatccagtgctgccctctcggcgcggacgccttccagattgcgacgcgcctgctcctcccgcactgcctcgcggaggaacaggctgtccgccagccgctgcgccacggcctcggcctcctcgagagctcgcccccactcggtgagcgcgtcctcgcggaagcggagtgcggactcctcttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccacccgccgttcccgggcagcggcggcgtcaaggactccccgggcggcgtcgagcttctcctctagctccgccgcccggctcccgtattggaggcggaggtcgtcccgcgcctcgtcgagcacggcggtggcgatgagggcagtctcccgctcctcctccacctccctggcgatctccgccagctccctacgacgggcctcgagctgtgaggtgtgccggcggtgcgccttgcggcccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcgaccaaggcctgcaggaagggctccgcactcagtggggcagcggaagacagaggggagagtcgcctcggtgtgggcgccgcgcggctcggcccgccgatcgacgtgccggactcgggggcgccccccgaagctggctcgtcccaagcgtcgcccgaggggtcaggcctgagcggcgcgcccacggcttcgtcgtgggtggcctcggaagtcgtcgtcgcctcgggtggagtcgggtcaggggtttggcaggccgcctggcgtgcgcgcgccgcctctgcctcccggacggactccccggcccggcggagtctggcctcctcccgagcggcctactcagcctggcgaacccggacggcctcctgggcagcctcctcggcttcccggaagcggtccacggcttctcgccggtcagcttcccgcctccggacctccgcggtcgccgtctcctcggcctcagaccggcggacttggaatggcggggggggggggggggcgacgggatctcgctgaggcagaagaaaaaccagaagacaaaaagaaacgggtgagtgaaaactcgccttgggagatgggaggatgaatacggccgcggtgggcatggggacgaacctgcggggaggtcggctaaatgaccacctcgggggcgagatgaggttcccccggcatggcacgatcccccccatcttgcggagccgtttcttctttcgctccccctcgggctgcggcgtcggcgcggcaccctccgagcgcctgctgctggcacgcaccgccccgcccccttggggaggagatgggggaggggtaccctcctgcttcctcttcccccgggcgtcggcagggtggctgccccccgggcccccgtcgcggggcccagaagcacgaccccctcccggggtagattgttcccccctgcggctcccacctgcgccatcgtggcctcggggggcccgctcccccgacgccccgacctcctgcatgatggtcaggatgttggcgcgctctggatcgcagcagagggggaggaccccttgggggatgagggatgcctccacggagctgagattcagcacccgttggaccaccatcctgaaatcctcagggtcccagtcccatttgcgcccctggtgggtcctcatgatgtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccggaggctggttcggaagtcggaggcgcgcttcgtcggcgaggggggtgtagaaccaatcgctcttccaatcgtcccactttttgcgaaggacgcagggaatgtagcggttcagcacctgcccccgcggctggaagtagcagccaccgactaccgtcggcggcgacaccggctgtacggtgaagaaccaccggaacagccggagagatgggcgcaccccgacaaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgcggcgccgggcgtccctcgcccagcgtgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgcaggaaacggagagtcagagcacaagtggcaaaggcaaggggaagagtggtgagaggaaggaaacaaatcccttccttggcgtctttgtacccttgccaacgctatgcccggctcctggcttcccgcgcccactacctcgccccctcgtttctcgcgcccacgcctccactaaccccacttgcccgtttgcggcgcacgcggcagatgtgcggccgtggcgtttgagatggggcagatcgtgcgcgcattaactgcgctcgccaaccgcgaaaaacgccatcatcgtgtccccaggcgaaacaaaccggctcgtcccgattcgcgcgctgctcgagtaatgtagcggtcttgaagaggccgctcattattgtcgatcggtttttcccttgccgatgcgcgcgatttgcgaccgttgggtttccgcccgcctgtggggaccggccccacctgtcaccgggcctaaggagtggcatcacgcccgagcgcctccctcgaggggggcggtcgccctggcgtaacgccgggggctactgtcggtgacatggggccgggggtatcgtgactagaggcttgggtagccgcggtcacccacgtggcctgaccccctcggggggggggtcgggcccgacggtgacgtggccacccctccctctgtctccccgaggggtcgggccgctcccgtttcggccccgagggctggggtgccccgaccccctgtggttttggcgccacgtgtgtgggttaggtgagcacaccgggctcacctaaccgcatttatagcaggttggacgagtgcgccacgccgcatttaatgcggcgcagcgcacgcttatccggtccgtgaccagtcgcggtgtgtgaccggtcacagaccggtcagatcgcgggttaggtggcaacaggcagcctgtcacacgcctcgccccgtcccgtcggaatgatgagagcttcgtggctctcgtccctagccggagccggcgtgctaactcctggagttggtatgtcagtcccggtcagatccattcctggcttcagcgcaagtatggcaaggaagtcgctggccattaaataaaggttgaaatgggcgtccaccgaaaaaggggcgagcagagcaggagacgtgcgctctgcttgtcagaggtcacttccggctgtagactagccctcattgtaaaagcatgtttcctttcttaggtggcgagaggcccttgtggtgacccctgaccagagaaaaaggaggcccaggcctagaaagaaaggagagagaaaaaaaagaggagaagagagggggcgaacggggctagagcctgaactctctctcgctctccggctctctgtattccttcactcacagatccaccagaacacaggagtagggtgttacgcttctcagcggcccgaacctgtctacgtcgcccgtgtctcgcgcatttcttctctcgctgacgttcctcagatcgagggcgaagaacctcacttagcgcccccggccgaaccggcaaaggggggcctgcgcggtctcccggtgaggagccccacgctccgtcacatgcacacaagtatttataacccacatgcaatatcttgatttgctattggctagaaaatattggggatgatgcatgcattgagtttgttgatagaataaatatagtatgagagagttattagtttgtcttggtcttgatatagctatgaaatatatagattaatttggaatggagggagcataaggttgccacatatcttgcgttagacaaatctaactaagttaggtggattagtcatacttaagacaagattctttcttcactatataggcttcgcatgccattgagataaaaagatgtggcaatagtggcttatgctaactaaagtgtatcttcaattttgttagccaaaccttaggtaagttggccaaaatattattccatccgtgtattttaatgtatgacgccgttgactttttaatcaacgtttgacaactcgtcttattcaaaatttttatgcaaatataaaaatacttatgtcatgcttaaagaacatttgatgataaatcaaatcacaataaaataaattataattacataaaatttttaaataagacgaaatgtcaaacgtttgtcaaaaaggtcaacggcgtcatacattaaaatacggaggaagacaagcttggtaataatttgaagtactgaactaattagcagtccagttatcttggtgtatgttcttgcgtgccttgttgattatgagaaggaaaatattgagacaatgtgttgtttcttttcctttggcgttgaaacatgtcgtctcggtgtactgttgattatgagaatgaaaatattgagacaacgttgtttgctctagataaacttaattgtctgttcatgttttaacgagctcagacgaatcgagctggagcctcgcagaggttgagcctgtgttaagctcgaaggtcagccttggctcgtgcgagctcggcttgttatagcagccggacccggttggtaaatgcatgggcatccggccgttgatctttttgaaagtgtttttgacccattctaccatttgaagctccatggcaagtatggtcaagctgagctgctaggcagatgtacaaaagcgtttttgactcatttctgttttaggcaatgattccattacgtctctcgctgcaacaagccagatgatgggccagtcgctcatttgggccggatgaaatgcatgtgacccgctagcagctaggcggaggcagtcactcattcgggaaggtagtagtagcgttgcttgtaagccatggaccatggtcacagcctcaggatgacaatgcatgtgaatatgtgatgtaaccgctagcagccttttccccgagacaatgccggaccgcggaccgcggaccgccgcacccctcaatcgacgcacttttgatgaggaatgcatgtgatggtagccatccatttttcctatggagggttcagatttgaagctgcattctcactcacccgataggcacagacatttgtgttcgtgcatagccgagttcttagcgggcatttgtagggaaaaaagaaaatctcaatttggtttcttttgaatggccaggtcactttgagattcctttatgctaaagcacctccgctttatccatcttccccctcttctctacgagccattgccgatatcgtacttcttggtgagccattctcctgctcttctgctcccgttttggccgaaactttttggcaacattgctcagactcacttcttttcttggggtttagtgtctgcttctttctctctcaggtagtagcgaagaagaataagaccctgtttagatgggattaaaaatatttttaagtctctatcacatcgaatgtttggacactaattataaatattacgtaggttattaataaaaacccattcataatcttggactaattcgtgagacgaatctattgagcctaattaatccatgattagcctatgtgatgctacatattaataaaactcatctataatcttggactaattcatgagacgaatccattgaacctaattaatccatgattagcctatgtgatgctacagtaaatattctctaattatggattaattaggcttaaaaaatttatctcgcgaattagctttcatttatgtaattagttttgtaagtagtctatatttaatactctaaattagtgtctaaatacagagactaaaattaagtctctggatccaaacaccacctaagtcattccttacgaagaagtgcttttcatagctctgaagatctgaataattttagcactgaaactttgtattagtttcaacaatgtgcagaaggaacatgacagtttgttaaacaaaagtacgaatttcaaaagtaaaaccccatactccagcaaaacagaagagaaatggaagccccaatctttttttttatatcgaagtagtagtaacaagttagcaacagatcaaataaaagtactgttagattgcgcaaatattacacagagaagagtttgtgaagtgcaactcaccagcaatattcaatagctctcagcatattgcacattaaggccttgtttatatcttaccctaaaattttacaccatattacattgaaagtttaaacacccacctcataaaactattaaatataggctaaaaaacaattaattgtacagattgcggctactttgcgagacgaatcttttaaacataattgctccatgatttgacaatgtggtgctactaataacatgtgctaatgcaagattaattaggcttaataaattcgtctcgcggtttactgacggatactgtaattagttttgttattagtgccggaacaccctttacgacatcatatataatacccgatgtgatatgccaaaactttaccccctagatttaaacactccctactgaaaacaacgtgtaacgcgctatggtgtgagaattctatttacaaattttgcatcacaaacgaatgaccaaacaaattctaggcctcacgaattcacgatcgaaacagccaatgaagcactgaaaaactacatatttcagatccaatagcaatttggaccatcaaatgacgtttctgatttgggggtttgttttgcagatttttcagaatttggagctgctgacgaacttggaggtggactagaaggacaagatcaaggagaaaccggagaagatcaaactcaagcagctgccttaccttgtctgcatcattgtcgaggcttgtgcttgcatcactttgcattaacgatgaaatttcatgttgaattagagggtaggtctaatcggcgatcgatcgcgattcggtcgccatgcacgaccacgtttccatgcagagcaaccgctttagccgatagcaatcatttcccattccgtatctctccaccgagccttgagtggttcatcctaatagtgtgatggtccagcccaaaaaatttatacatacactttatatgcaaaataattaatatataaaacttcatgtatagacatattatatgtgtacaaattttgtaagtacatgcgtacaaactttttatgtacaaattttgcacatataaatttgaaacaaattcaacggtgtgttaaattagtctcgagaaaaatatatatatagaattttattacatcagaaaaaactatacatagcaattttgtacgtatatattttacatatatgtgcatttaaactttgcacgtgtaaagtttatatctataaactttgtatatgtaaatttaaaacaaattttaaagtgatatatgtgggtttgaggcccatgtgcatgctg

SEQ ID NO: 52726 - DNA, 5295 bp, Oryza sativa
cttgctcctgttaaaatcatattcctcaattgtacaaccagcgagtaatgtgactatgaaccgcgccaccgcaaggtctggcacctggaacgatggtgtatattgcatccaatcccataaaaacaacttatggggaagtgggacagagagtattttcgtagatctttcaaaaacacgtgtataaataaaaaagtttaaaaataatgtaacttttaaatttttattcgataagcaaccgcataagcaaaccgatgggggtgttatataatccaaacggaggatgtattaaatacatgttaacagaatgaaaaactaaacctgttttttttactagacttcccactaaaacacgtttcacaagaacagacaacactaagcgagtagggcacagggcaacgcaagcatcaaaaaataaacagttctgcgggtcaggcataaagaaaccaatagagtatccggaatctgaaatctgaggaagcataaagaaaccaatagggtatccggaatctgtaatctgaggaagcatatcaccacacagctgctacaatttgaaagcttgagaggttttaacagccctggattgcccctagaaaggaatcacaattttgtggcagccacctacaatccacaagctggcctccaaaagattttccatcagccaaatgaaaacgggtgaagaagcatcattgaggcatgacgagtcatagagcatgcgaatatccacgcacaaactgcaagtatataattaacaaaaaaaaactaaattgatgaaaacgaacaaaaagatcagaacaagatgtcctgacatattgtgatgcactagaaacttacgtaaccactgtctatctgttagcttgcgccttcatcttttatgtgcattgctaagggcttttctcttttttcgaagctctgatagactgacgctatcaacgtgtggttttactcttttttgaagctccggcactagtatcaactggtggcttccttttctctaataaaacattcttttggtccataaaaggctgcaaaatgtccttgattgcctacacaaaaaccaagagattgtaaataagagaaatttgtgatgttattgattgcaaaagatttcaaaatactgcaccttgctttttatctgtgtttgaatcttctgaacatgttgtataatagattgcaccttataggcccggacagcacctctattgtcgaagcagatcccaaccaaaagaccatcaacagtaaagacaggggacccaaatgaggcacaaggaagtagcacaatcatgagtaaaatccgcctttcttacaaacctaattaaacatttcataagagcctataaatataatttaatcatttaataggactaattaagcatttcataagaaccaacaaatctaatataatcatttaatactccctccgtttcacaatgtaagtcattctagcatttcccacattcatattgatgttaatgaaacagaggaagtaagacagatgaaattagataaaaataaggattttagctcaccggaccgatccaggagataaaaggtacttttggattctgatatcccaaggtgtaaacatcctcattaatcaacggtccagattcacagattttcacagcagctaatggattagtgcattttggtttgcttagcatgaaagagacaactatcagcaattgatacatcggtaaagttaatcgccacactctccatgttcaagccaggaaaaacagcagcatagagcccttcagaaccataacaaaatgtccccttgtctgttatgacgtagcatgatagcttcttcttcgcaataactattcctggagcaaataaagtcggttttcctgcactcatagctattatcctaacgaaacacatttgaaccttggcttggagattatcaaaagtatcctggtaatgaaacatcatattaaaaaaaagccattaggatcatttgatatctacctcctataaagaaacaagcatacaaccatatacaagaatttgaaaacttgagatcatgtacaatgggaggtatataaagaacttgaggttatgtgaatgattggtgcttataaatatggtgcctaaaagaaggatgtgtccatatcatcgagaactcatatataatttatattgtctactgcaaaattcttttctcaagtgtagattattatttttttgataagggcatgcccatttctattgaagtacagaaaacatggtaggaagaagggagaagtttaggagacaagacattacaaaagtcaatactcctacggtaagtagtttccacacacacacacacacacacagagccagcggaccagatccttccctcgacacactagaactactagaacagcagtactgagccttcactaactggagcgtagcctagggactgcatctacaggattgcagcatcgtgcagactcctacttgatacaaaagcaaagagaacccagccatactaacaatatagccatattaacaatactacaagtaaacaggacacgatcaatcactactggtaccacaagtgctcagacaactaccttttcctattattttatacataaacaactgccaagcatcacacacaaaaaatatgaacaacacaaatctgattctatttactatataagcactccatgtaagcacttgcgcaattaagcatttataacaacagaaccaagaaaccaccacgggctgctgcaggcaggggttcagccaacttatttcgagaaaccaaagagagagcaagttcagtacaacattagttttgcctagtgccttagaccatgcaaaacatcaattaatcgtaatgtatagaaaaagtgagtgaccgattcaagcacatacgaacagaaaagaaaaaagaaaagaggaggggaaaaaagcaagctcaccttaggcagcattttgcaaatgggggaaacaatacccaagtaaagggtgaatcggtgtagcaggtagccaggccaccgggtggaggtgcctaggaagagagatcgtcgcagtagcttatgaagtagtggcgtaacaagaaattttcgtccggtggtcctgcttcacaagttcacatcacataccaaaattttgtatcaccgcaaatcccatgagtacaaattcaggtaaaaggcgaacaaatataccaataatatcttataacatcagtaatcaactaatttaactagcaagttcaaaatgtgcacatattacaatacagatagttcaaaatgtgtactccccactcctcttcatgtctttaccaatcctacaaactaaaataagtccgcggcacatcacaaatttagcaatggcaaatgcttccttgatcaaacacagtgagaataatgaagatatgagctagaggtataacctgtaggagcaggagacggcagccgggagccgcggcgcggagggtagagaagccgcgaacggcggtcgacagcgacgggcaggggatgagggtcaggcgacagtgcgagagggagccagtcagacggggttcccgagctcccggagctggcgaccggtggcggtgcggcagatggacgccttcgctcggcggtggtctgtggctgtgccgatgcggcgccgcggcggggaccggtggtgtgcgcccccgtcctccggcctacgcggctcgggacaagcggacggcggcggcggcaccgagacccagtgctcagtggcgacgaggagaggcagagagaggctgcgaggagaggcgaggcaacggcggcggcgcggtcacgcgcgtgcgagggagcagcgcagcgccgccgcgaagcgcattgccttaccgagacctaagcgcagcgcccgcttctccttctgcttattgggcctgagtagctgggccaaaatcggggctagtcccgaaccaaccgggagcgtttgccatttggaaaaagtatatataagatccctcatcttgtcaccgaattacaacatcgtccctcaactgaaaaaccagatatatatgatccctcaacttacaaaaccggatcaccctgagtcataacttacaaaaacagattactctgggtcattaggtggttgacaccagttttgtcctacgtggctgccggtgggtgaactcctcaagcgggggagtgaggccccctttgttaattcgggcggggggtagcgggtgagaattgagggtttggatggatgtgtgctgtagagggggtcggggcccctcaagagcaatgagataaaaggagtttatacaagttcgggccaatgagaagcgtaacactctactcctgtgtatgatgatttttttgagctttgaaagtctctgaatctcggatgtacaaactagagttggtatgcaaaagctaatcttttgatccccccaccaaggacatgggcctccttttatagcctaaggaggcaccacaggagtttaccggattacttaggggagaaggcgaaaaggaatttatcggaggatgaactcctcgagcgggggaccgtgaggctcctcctttgttagttcggcctagggcagtggatgaaaattgaggagctggaagtatttgaagaaatgagggggtcgggccctcgagaggggtgagacaaaagagatttagataggttcgggccgctaaggagcataataccctactcatgtgtatgataatttttctaagattacaaagtctctgaatctctagcgaggaagctaagactcagcttcccttcagaatttttaggtttcaaccacctccttcgtaggcctggacctccttttgtaccttaaggggttaccacatatgccataagagctacctagagaggagggaaaatgttctctacattaaatgcatgtcttgtgccttagctcggaagccatatgcacattgccttggtggtgagcccattagaacaggccacctgacacggggggtgccctcgtcatctcccatttaagggatggagacttctgggctcctgttacaccgggaaacgggatcctttctttgaccagagcgggcggaccgactccagctggaatgagaggctgaaagcctctcgtcattatgatgagacggggcacttcaaggctgtaggctgcttgacagacggacagtgcgcaggtgcactacccctagtcccatcggttattcgatcggtcacggaccggtcagacgcgctgcatgccgccataaatgcgggtaggtgggctcttgggggcggccacctaacgcatcgcacgtggcgacccgcggagggggtcgaggaagcccgacccccggtcgcggaaggggg

SEQ ID NO: 52727 - DNA, 8249 bp, Oryza sativa
cccctaccccgggcccgaccccgctcgggagagggccacgtgggcactaggggcagcctccttcctctagttttgataccctcgggcaaggaggggcagctgtcactccaccccgggcccgaccctcctcggggaagtgctacgtgggtttaggggcggcctcctccctccaaacatgatacccccgggcctatatcatcgacataattgattatgctaaagagcacgttttattctattgacatgacgaccacatcctcgaccgccacaacatgggcccatcaaatcgagccgctagacacgagggagcattgtgtcattcgccaattaatggatgaagactcttaattgggctcctgtttacaccgggaaacaggaggtcggctttagaccagagcagatgaaccagctctgggcggatctaggggctagaaaaaaaaaccccaccatcacgatgtgatgaggcggggtaacttgccgccgcctgtcacctgttcattgactgggcggggcaaaccgtctgccgcatgtcactttgtcagtggctaggcatggcaagccacacgcacatcggctgccatatggggcccaccacatcaggccggctgacatgggggacgcctgcgtcattcatcatttaatggatggggacttagagtgcaggcttgcaccgggaatacaaactcgggcctggccacaccggatgggatgagtggctaagagcccctcatcattacgatggaacggggcataacccgctgcacgccgcctgacatgcggtcagggcatgagcgctctgcagtcgtcccatccatcattcggccggtcatggaccggtcactgaccagtcacaggccggtctggcgctcggcacggcgtggaacgcccgctgcaactgccttaaatgcggttaggtggacgctgtgaggcacccacctaaccatatacacgtggcggctcgacccctcgggcttggaggggatggccgccgcccatccttgggcccgaccccctgggaggagtgccacgtggacactgggggcagcctcttccctccaatctttgtacaccctggcccatatcaccgatagtggtggccatacctgggtgaccatgtcatcaccctctccctctctctcccctcttctctcctttcctcctcctccttctcctctctctctctctctctctctttctcttctaccctcgtctaggtgggccggccagccagcgggttcgaaggaggccggctgaaaggtcaattaggcctagaggggggtgaataggctaatttaaaactttatgcggaagctaaaactgaaataaggtcggaaagtctgatccacagtcagactatccaaaaatatcagatagtctgatgttggatcagactgtctgatccaccaatgaagcacaacaagtagatctatcacacagacaagagtaaagcacaaacagcaactagatctatagtggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttcctcaagaggttgcactaagcactcctccttccactaaggggtatctctttccttgcggaggcgagatccggccttcacaaacttctcccggccaaccacacatagatcggtggctcgggagtgacacctagccgtctaggagtcctcaacctccaagagtaacaaacaccacacaactcttggtcaaaccctagtgctcaatatcgagtgaaacacacactaggccctcaaacaccaaatccacaaccaccaagatccaccacacaaagaacaaggagggatttgagagagggagaaagagctcaaagatccaaagcaccttagcaccaagttcaacccaaagtgaatgagaatgaaatgagttgggtaaccctagaaaagggttaggtggggggtatttatagacccccccccccaaaaaaaatgtggtcgttggagaggaatctttcagcccacgtcggatagtccgatacaagatcggatagtccgatattttaaacctccaaggcaacgagaaacagagaacgaagttccatgaaatttcggactttccgagacatcagactaactgatgttaaatcggagtatctgatattttagaagcaaaaacttcgtcctcaaacagagactcaagttctatgaaatttcggagtctctgtatcatcagactatctgatccgacatcggatactccgatacttagaaaaactcactcgataggattttttcaaatcaagacagagagtgaagttctgtgaaaaatcggatagtctgatttcaaatcggatagtctgatgttgatcaagtaaaactacaataactttttactccgaactccgatttcgaagatcttggactctatgaaaagctagtttcgtgggtcaaacccaacataaaacatggtccaaaaccttcaagagatgttgaaaaacttgcaaagaaacccggtgtaagtgttgtgacaagtgaaacaactcgggattgaaatttttacttaggtttttcaactcacacaaagatgaagcattttgagcactagtattctaccaataatatgcatgtggtatcgctcttaatagtacgacattcctacgacacaatgtaaggtaaaagatacaatataccatttgatcattgccgcattgcatcgtgatgtcgcattcatggggtatgcatctcattacaacatgtcgaggacataacaaccttcacatttgcttgaataaaagtgttagtcctctctaatcgcattgtaatcaatcatcaaaatcattaggggcctagatgcactttcaccggcaacgggtgatgcggtgggcggccttgttggtgcagtctaggagttgatgaccacacgtgccacctcctccgcctccacctccacagtgcacacctcccacaccatccttctcgccaggaatccccttgctgccgcccacctcctcgacgacgcccaccaccaatcctcacgccctcgtcgtcgccaccggctcgagacctacgacatcgtcgtcgaggccacgcgccgcctacaaccgtgtcatgttccagctccgctgatccaaggccatcctcaacttccccaacgaggtcacagccgactcaaattcctacatgaaattttctttgaatgcttgtctataacttttctaactttgtactagtgaaattcatttgtttataaccctcagtagctattaaaaaactaaacaattagctatctcaaacggagcctcaatattcaaatataaggaatattaggttctaccaatatctgttctgaacatactaacatatacttcctccgttccacaatataagatattttggcatcttcatacctcgtctaaattcaccaacatctatataaattaggacgcgtatatgaaatacatatatggatccatgcatctatttaaaacccaaaacgtcttatagtgtgaaataaaagatatcatataaattcaccaacattcatatgaatttggacatgtatataaagacacatacatggatacatgcataactatttaaaactcaaaacgtcttatggtgtgaaatagaggaagtataaatttaaaatataggtgtatatatttggcatatcctttttatttgtgctataatatattattagtctgtttgttaaaactctaattcctaaatttaacttcacttgctttagagtggagttgtgaagcggctcgaaccccactcagtttacctctctagtccattttatgatagctcttcagtatgttccgctccctttttaggtgaagctatagttctgccaacaagctctctatctagtactactggttctattatagttattggttaagtactctctccgtcctagaaaaaataaatctaggattggatgtgacacatcctaatacaacgaatctaaacagatatatgttcagattcatagtagtaggatgtgtcatatctaatactagatcggttttttcttggacggagggagtaatgccttccatgtgcatcctagccattcagttctctaggcaaataattagccctccgaaatcttgctatttagaagtatttaataaagtctatgtacagaactacttgttgaacccctgggctaattcgcaagacgaatctaaagaggtatattaattcataattagcggatgattactgtagtatcactgtagtaaatcatggattaattaggcttattagattcgtctcctaaattagcttacgggttatggaatgggttttgttagttatctacgtttaatacttctaaatagtaagattctggagggctaataattagccctccggatccaaagaggccctagttgattatgctcccttcaagagccagaccctcgctttcccctatagatggccatgaggcccgctcggcacggcccggcctaggcacgactaggcacggcccaccagccatcgggccggcacggcccgatcggccgcacctccggcctaggcacaacccaccagtagtcgggccgtgccgtgccagcccgaaggcacgggtggcccatcgtgcctttttttaaataagtctattctccctccctcctctttgggctgtgacatactccctccctcctctttgggctgacatatatatagctaaaataagtctattttatgtccctattctttggaccgtggcatataatatgtctatttttactccctttcattgtgtgttgggcctggctaccggcccaacgtgccggaggaggggcccaggcacggcccggcggtcgggccggaccggcacgggccctaccccgtcgggccgtgccgtgcttaggccaggccaaaatgtcgtgtcgtgggccggaccgtcgagcctcggaccttttcgccatctatactttccgctttcaagctacagctctatcgtcgcttgttcggccccttttcctcctttcctccgatgattcgtcgtcggcggagagagggagaggggtccggtccttccccctagtattaggttagtttagtcgggtttttcctgtttagtcggggttctcccgttgtgtagttggttttttgagtccggagcaagatgaacacagctggagctagctctggagtttgttctcagggtcttctagtcatcactcgggatccctccagatctgcgagttcacaggtagcgtcgaccaactttcatttcttcgacgaatttcttcctcggctggttctcctctgctacttctccagcgaaggatttttttttctccaaggcgtttgatatttccaagtctagccgagatggtctcaatctcctataaatcgggtatgcctctcagttttctttgcaaactgctacgttctctctctaatcctcgccagtggaatagttatagggttcatccttggaatttttgtctgcaagccaactttcgccagtggaagtggaatagttatagggttcatcctgccagtggaatagttatagggttcatccttggaatttttgtctgcaagccaactttcgccagtggaatagttatagggttcatcctgccagtggaatagttatagggttcatccttgaaatttttgtctgcaagccaactttctttcactgatccggatccggatccggcgaatttcttatatgttgttgctgatattattatgtgaattccaacatccaaacctcctttgcaaggccccgtttgggacagcatgttggttcaatctcctgcagcgcatcctccaccgtcagagtcaagtttctggatttcgtcgttggggttgaaggcaaaaaagggggaaaggactccattgctttttgctatttttaaagtccttttctgcactttattaagctcaagtgtaatttgcccagttctaaggggcttttctgcaaacctggttgtattccagtgtcctccactgtatgcaaacttgtactcgtgtactgtgttacttctcttacttaaataaagttacatgagttcaaaaaaagaaaagaaaagagccagaccaataatcggagaatgaaaaaatattaccaggctattctacttttacttgtcaggagcatgaattatctcgatagaacattatgcaacttttactaggagccagttagaaggaaagaatacgtatgctccacttttctatacatcagctatctatatgatgtcttcaaaagaagtgatccattccatcctatagcacacaatgcactgtcgtacaacacaacgcacaacgaattgaagaggtaattcatcttcccaaataacatacttccttcatttcacaatataagtcattctagcatttcccacattcatgttgatgttaatgaatctactaacatcaacatgaatgtggaaaattctagaatgacttacattgtgaaacagaggtagtaccaactaatcaaccagcatgtgttgctataagaactcaaaatgtagaataaaacatgagttttaataaacagtcatatcaatattaagacagaaataagcgcttttttcgggagcaagacaaaaaacgagcacttgtgcagatgtgctcagcctccagtagtatacatgtcaggaaataaagcagtgattgtgtgcgctttgctcaagaaggaacagatgagcatcaaatgccttattttaccatcacatattgagatgtttatgaagacgtcaggccaaagccataattaagataactcactccacattatttgtttttactggagctgaaagtgaactctaacatttaggaaaaatgggagtagcccattaccaaaaacaaagttcatatttgaagggcatccgcaatcgaaccagcaaggctcaacacctcaaatggaggttgttggttgatggctttcactgtttgagggcaggagtcagtgatccagaaatacgcaaacttgtcagctgacccagctgtgagtgggaaaaaaaagggtgagaactgaagttgagtggctgaaaggtagaaagagaagagaatcacgaattaccggaattagtgtgagtgaagcgctcatacgactgcttgggaaaaacagcatgagtcacgtaagcactaacttttgcagcaccatgagcagccaaaactttctgcaaaataattagacaaagaagcattaatgagaaatgcaacataaagcagcatatcccatcaacagtttatgaattagtacgtcctcaaaagtgttaaaacaattacatggagtaaaatgaacatcaagcctactaaaaaatgaaaatgcaaaaataagcatgtgactgactttgctaagatcaggttttacaagggcatgtaattaatctctgtttttcaggacctctgcctgttggcaattaatatgtgaaacgtatattataggaggcattactctttgtcagacaactaaaaacaaagatagcaaaaaaccatatccctcttggcctctcccactaaagtggaagtaagaaaatccaacattagtaaaaattaagtcactgaagcactactttgtagtatcatggcaaagccacagacagtatgttgatacctgacattctctaagagttcccccagattgcactaaatcatcaacaataaccacatgccggccttcaggattcccctccttaattcgaactatcctcttgtcaccttcccgaacctttgcgcagacaaccttataatcaaacagcccaaagtaaaaactcggagtctttcaaccagaaaaaaaaaagagcaattccacaatggcatgcataaccgaatttcgacatgttcattcattcacacaaaacaagaagctaaccattgggaagttgagcaatagcttgtggaaacgcttccacgccccatcatccgggaaggcaatggtgatctgcgcaacacacaaatcacacaagtcagcagtagcaacacgaattgggtacttgaaagaaattagtaggacaccggtggccttgctacgcacattgtcagcatcggggagctgccggaggcgctgcagcaggagcggaatcccggtctcgaagcaggggaggacgtcgtccccgaagtagaacctctcctggagcgcgtggatgtcgtagatgacgacgctggtcgggccgccccgggacttgggaatcatggagaggatg

SEQ ID NO: 52728 - DNA, 2324 bp, Oryza sativa
cgcgttgttgatgaacaggttggggaacccgtcgtcgaagctcctgcgcggcggcggcggcggcggaagcgaatcagcgaatcaggtgactccacgaaaccggcgaggaggaggaggaggaggaggaggaggacggggagcgtacctccagttgatggactggagatggatggtgtcggagctagcggcgaccttgagcgcgagctcctcgcactcggagcagtagaagaggtttatctgcttcttcgccttcggctgcctcgccacgacgacctccatcctcgtcccgggctccccggcgggcggctgcggcggcggcggcgcgcgcgagcggaatctccgaaaagaacggcgcggggggacgcgagcagtgtggtcggctttatcgacaggggagaagcagcaaaggtctaggagcaaattattcgctcaacacttttctttttttttttcgcgagcgtaaaccctagcttagaccccagccgcgcggcgcgagccacgaatcggcccgtggtatgatcgatcgatcggccgacgcgagcaggctggatttgggctcgaggcgagactagcacctactagtagcggcgcaaattggggaagaagataatgcgagatttttatagagcgctacttgcaaaaactgacgaaaaaaaaacaaaaagggagaaagcatggaacgcgccgccgccgctgcaacgcgacggattactatcaccaatccgataccatatggtgtcatagagaggcatgaagtacacagccaacggctggctctcagggattaaacgtcggttctaaaatatactctccgtttcgaaatgtttgagaccgttaattttttagcacatatttaccattcgtcttattcaaaacatttaagtaattattaattcttttcctatcatttgattcattataaaatatatttttatgcaggcatataattttacatattttacaaaagtttttgaataagacgaacggtcaaacatgtgctaaaaaatcaacggtgtcaaacatttcgaaacggagggaatactagtatactaagtacaaatttgaattgactgatatctaatactatctaaacggatattcgtacggtcagattcgctaaacaaactcttaccacactatctaatactattactactactaatctataaatagagagtcgctaaataataaactcttactatacaatctaataacctgtttggtacaactccaactcctaaatttagcttcaggagttaggtctgcagtgaagttgtggagctgtctaaacctagcttcacaactctagttcattttatgagagaactccacccaactccactcccagttttggtggaactgaaactgtttggctgagctccagctccaggaggggtggagctggagctgtacctgtaccaaacaggccctaatactactattagtagtatgtagtgttagactgtagtattatataatatctaattcattatttggttaatatattttagtacgaatgaagcaccgaagagcattgttggtgaaggtttttcccatgaaaacaaagtgtacagaagcaagggaatcgtaagaagcatatgagaacctgagcagaagacaagaaaatttctcgagttctaatgggagacatgggactagtttattccccacttgtctctagtggggtgctaatttacaccagcccgtcttgtgtgtatgattgattatccttagccaaaatcaacggtacaaaaatcgtaagttacagaaatgtggtcaatccaaaaaggtatacgaaatcaacacctgaaaagaatgccaaaacttttgcaatgatccaaccgctgttcaccaacagaatctgctccaggcctattcaagaattaagataaaactggcgtgtttttttcaggagcatacctcgcttctccggaacaaagctaagagctgccagagtatctgagtatatacaagtctagctaacgcacggatcagttgacgaatagcccttttccaaattgaatttcggctcgctgggatatacaaagacagttgcggctgaggctgaaggagtcagtgcagcagaatacctcactgaagttattgttatccttggcagctgctgggaacagaaccaagcggcacaagcttatggctaacaatatgctcggttttcggcagaatggatgcagcatgattgtgagccccagagaagacgaagttctgggaatcaacaagagagtacttgatttcctgaagtaaggatgttgaattgtagatcttcacatgaaaagtgaaagggattccaaggatagggctgcagg

SEQ ID NO: 52729 - DNA, 10905 bp, Oryza sativa
tcgtgtgtagccgcaaaggtacctctgtgcaatttctagcacttaaaataagcatatttgactcgttgaaagcaagagaactttttttatcatcatcacttgaggatctgatcctagataataacaggggttctcgcctaaatggtctcaaaaactgttgactgactatcatggggatcttaccttcaatttgcaagcttctgtgcacattaagtctgtgcagtgctgcttcttcagtcgagtccagggaatagccaagtgagacatagaacatcactgacattgcttgatgccattttatttccaatttgcatgaccaggaatcacctgcatataatgtgggaacagatacaaccccaaacgagtgctggatttttcttatgctatcaacttcttcctttgacccattttccgtggtcacatctgagacaccaagaagttcaacatgatgactttcagattcttctgcttccctaggactcatcaaaaggcctccacctttggcatcgacaaggttgattttcagttcaccagaatgaactgcgtgtccttttgacaatatggtcactgggactgtaaataattctccaaccaatgcaggaccaggacaatctaagacaaggtcaacttgagcatctggctcttcaacttggatcagtttctgcccagaaaaagcaagtacattgtccttcataggtaatgcctctacttggtcctcaaatttccacaatgaaaattctcccattgaaacaggactttccgcttggcagcaaactacaagacgtttacttattgttgccttcaccgccaaacattccagctttccactctgtcctgcagaaagtactcacattgttatttcatgataggactaacagaaggggaaaagttaacatcagcaaatgccgaataaagcttaaattttgattttcaatctatcagccacagccaaaatttggattttagaacttaattttatagttgattttgatgttttttcatcgtagttcattttccagcattggcatttaagtcgctaagaacgcatataaaagagttttacccgcaacttatgttttggttgctaataagtgtcatgacttaaaatcggttgtacgcaaaacgatgagactggtaatgtcctgttgtttctgtatgttcagattaagatactaatatgacaatatttacaggttacttttcaagaaataaaacatttacaagttacaatacgtgcagagagcgggtggatgaacatctaatgaaataaactatatataatatatataactgatacctggtttaacttcatgagtcaaccgcatccatttatcagtgaacagtgtcagaggagtctgaacagctccatcatgaacatgtgaatttgatgcagaacaatcttcctgtgcactaactataacaaagttacagtcggattggttaaactgaacctccaacttatcaatcataactggacaaggaagatgagactgtagagagacactgacaagcattggtgaatcaggttttacagattgatcgtgaaaagcaacagatgcgagaaacactatccttagtggacttatttgatcaatatcgaggtgagtagattcttccatcaaatgaagatcaaattcatcatcagtgttctccgatgcatgctttccttccaagatattaataacttcctgctgtataagctctctactggaaatggtaggagatcctgctggtccatttttccttttattttctgaatttccctgtccactgccagagaataaaggtaatgcagccatctcaagtgaataactgataaagtccttcagagacttaagtttccttgcacattctctcaagtaacctaggttttcccaaagtaaagtggcccaaccttcttgacggtataggccagcaacaccatcaaaaagttgttttgcattactaaaatcccctgctgcataatactcaatggccattccaccactacaggcagaagccattcttgtggcacctaggctccgaaatgattcataagcttttctgaacaatgcaattatctcataggaatcttgaaacctttcagcttctgacaaagcatagctggtatactcagtatcagaaaggctgcaagcacagtgtcagatataagtagtcatataaaaattacgttaacatctaaaagtaactaagggtcaaagaacttacggaagcaccgcaactgtatctccttgctcaaacaagcgtacatactgaccaacatatacggaaggcattactgactcaggtaatccattgactcctttggtaaggcttacacttgatgaagagaactctaaggcatacctcttctctctcaagtaatttgccgccaactgccagaagggaaggcatcataaaaagatcactagtgtggtcaagtaaaaggaatgaaatatcctctgttgtagtgctgtgtagggagaggttgaacctgatagtagtaagctggttgaaattcccactcggtcagtgcgttgtcagcagtgccaaaacgaggagatagtgtatccggaacagttgtagatgttgtttctatgagctcaccaaagacaaggaactgcctgctaaaccattcccagtgaagaaaagcaacttctggtgatccaacaacacgctcatagcttctgatatgcttacggaaccatgtgattgctcccacaaccttccccccatgaagtaatattgttgatatcttaaagtgaaattgctcagcaactgcttttacctcaacaaggcgttgtgttggaggcagtcttgttgaagttcctatcatctaaataagagcaattgtcaatgcagggtgtaaagccaatagaaactgcttaagcaatagtgtcggaaaaataaaacagtaaggaatcttgaaggctttcaatatgtaatgtaagatgcaaacacacatggagaggatagggcaggatagagtggtagcttggataaattatctttaatgctagacaggtatgagatcctcatgaagtgttttctatatttaatattttaaaagtagcacgtgcacaagagtatattcagcattacaaatatatacgacatttggatggatagcaaccatagctgtctttctttatttactcatgagttcagtgtcacaataatctggcttctaaaagagtatgtcaggtgtggattcacttaattatcagtcttttaaggtctatggcaaacatggaacagggatccaattcacacctcacgcagaacacgaatgccctcctcatagaactttaatgcttcaggccaatcccgcctaaactccgcataaacagcgacctggtgttagaatcagaaatatcagaggaatgcagcccaaaaaaaataaaaattagagtagtgagaagtcattagcactactgactttaccaagcatgtgaagaaaaatttttgtcccaataccacgggcattaagaatgactaacagtgctaaattgaaccagagagagattcctcttcctaccttgaaacagtagcgaatgctcactcaacagatgagaaattccttttctcgatgcgagctttgacccttcgtccttcatccttatagtatgtcgtacataactccgcaaaaacagttgtcaacctttcaatacagaacataatgcaggttagtaggtataactccaaggaacacatgaaaaagaaaagagcaaaagatagtttcaaaaaaaaaagaaatataacagtagaagattaaggggaagtttcagagcatacttgttgagagatttggtccattccatttcatctctctcaaccaaaacaaccaggtgctttgaatcaatttctgcacgtttcctcagagcaaccgtaacatcctcgctcagttcatctgcaaaatgttattggctatctggttaggtttgacgacacaaatatcaagcgagtataagggtctgttatcataaggcccatgcccaagcccaaccctcgattcccatgacgcagagtgtaggcattgacatgcgtaaaataacagatctaatgctgttgcagatatggccagttgcagattgtttagctaagcttcgtaagctaaagtgctaattgcttgttcagcgagaaaatgtattactattagtatactcgagaggatgcttaccaccagcttgactctgtacaaggatcaccactaatttagtgttttttccttgaatcacagacctgcaaaaaaaaaatgaccattacttggtatttgcgaattcagtttgtgctacactagctgcttatacactgctgatacttcagaaaagtccttaatccaaaagaggtcgatagtttccaatttgcattgcaggggtgatatttatgagttctgattatgcgcacatctatttgggatcaacgatgcaagagatgtagaggaggtacttgaggttctcgagatcggagcaggcctggagccactgggcggggtccccggagacctgatcggcccggaacatcgcggcgacggcggcgggcactcgggtgcggtgcttgaggagccagtccttcttcaggatcccggcgggggcctgcggcggcgcgagcgggtcgcgggccttggcggtgcgagcgaggatggaggccttggagaagtccgggagggcgagcaagttcatgggcggctgcctggagctcagcgccgccgagatcgcggggtgcagctccgggcaccccacgatggacaccagcgacagcggcggcgtccgcagctcctccgggtagtcctccatggccgccccacccgcggcgccgcggcgaggcgaggcgaacggtcgggaggcgctaggtccggtcgccgccggggtggtggccggggaggacggggagctcggatctgtggtgactgtttggttcgtttggaagaactgggtgggggcgaggacgacgacgcgcaaggagtggaaacacgtatcgctatgtgagatgtaataatgaatatagtcagggtgttttctatgaagtctgaaggaccttgttataaaatttcagaattctgacagtcatcaggttaaatgaacaaatcaataaactacgtagtagcttgtactccctccatactcataaagaaagtcgtttaatacaatatttaagtcaaacattaggaatataaatcataaataactctcaagttgttgagtttgaaaatataaaaattatatgaatagatttgtcttaaaaaaaatactttcataaaaatatacatatatcacttttcaataaatatttttatagaaaaaagaagtcaaagttatgttttggagatcgtgtcgctgtccaaaacgactttctttacaagtacggagggagtagttcgtttatattgaaaatgaagatgaacttagagcacggaaaacaaaaaaatcataggcgtatgattaattaagtttagttattacaaaattagaaaatggttttatctaacatttcaaagcaatttatatatagatagttttcacacaaaatacaccagtaggcagtttgaaaaaactaaaatatagggatgcaagcgggtcaacccgcgagttcacttataggtcaaatactccctccgtactcgtaaaggaagttgttttggacagtgacacggtctccaaacacataactttgacttcttgtttctataaaattatttattgaaaagtgatatgtgtatagttttgtgaaagtatttttcaagacaaatctattcatataatttttacattttcaaactcaacaacttgagagttatttatgatttatattcccaaggtttgacttaaatattgtcttaaacgacttcctttacatgtacggatgggagtagatgataactcatggatttttgcaacgtggtccggcttgccgcatctagatatgcaagtgggtcgatctataaactcatttataggtcaaattaatagataacccgcaagtcaaatccatgggttacccactaattttgcctataaacgggttcgcggacaagcctgcttgcacccctagtgaaatattttttaatggcaaaagaacatgatctgtttggatcccatgaagacgaatattaagtatggacatgtaaaactagaaagccaataacacatggttaatttagttttaattattttaaacttagaaatggatttatcttatatcttaaaacaatttcacatagaaagttttagcacaaaatacatcgttttagcagtttgaaaaacgtgctaacgaaaatcgaggtaaaatatgtatcttataagacaacggaagtcattcgaatttttttagtgaatatcaacaactaattcctaactacactaattcgaaagtagaaatcacagattcagaggtcgggtggaccgacacgggaacagaggaggcccgtggtggtggggcgacgccatgctccctagcctcgccactcttctcgccaagttcacgcttcccctcattgtgtcgccaaaggtgatgacacctagcctctctctctcctttcccatatcttcccattatgttctctcctatcttcacgacgccgaggcctgaggccctcacgacagcaaaaatgacaacctaagcatcaacctgagcttccccgtcttcgtcaccgatagagctcggtgatgccgccgccaccgtctagctcctctctgccgactaccgcccttctccctacacaggcacgtgccatggaggcctgaatagagatgaggaagagagagaggggaggaagaagatgttgtttcaatatttaggaccatcatgatttttttttattttctatttttgcttttggttccaggtcagcttaacacagcctacaaagctgccttgggactacattcgtttgttttgaaagataaagaacgtgtgttatacttatatctggtactgcggtccaaagacacgattcgaactcaacgtgaattatgagggacctaaagtgaacttattctatcacgcggttggagttcaatagtctatcaggcccatccgggcagagagaacaaagcggcccatccaggcagagagaacaaagcggcccaccactggcgggagtaggcgtaggaacaatctgtccctcgctcgcaagccgtggagatccatcctttttttcccattgcgtgccagttgccacctctcaaccccccgcccctggctcaccctccgggcctccctcccccctcctctcctctcccctctctcgcggtcgcctcggtgcagcccgcgaaaatagcagccgcccgttccctccctctccctctcccctgccctgccgaagccgcggcgatgaacggcgccacggccggctccggctccggctccgaccacgacgacgcgcgcgccgccgaggaggccagaggggaggaggcggcaggccgtgccgtggaggttgaggaggaggaggaggaggaggaggcggtgcccgtggcggaggagagggccgcgtggggcggcggcggcactcccccgacccccgagccgaagagcgacgcggacgcggagggcgcgggctcgctggatcgggtggagctcaatgcaggggcgggcggcggccgtgagcgcgaggacgacgagggggaggacgaggccgtgggggcgaggggggtggagatgaacggggaggacgccatgagccacgacggccacgacggcgatgaggatggcgatgacgaggaggacggcgacgacggcgaggaggaggaggaggaggatgatgatgaggaggatgacgatgacgactccacccccgatgcgtcgccgagggcggaggcgaaggcggagggcgagagctccaccgtgatggcgggctgcgccaaccagcccgctgagcccgaccccttcctcgacggtgacgactctggaacggaggaggagcaggcggcgttcatggtggagctggagcgcttccacagggagcacggcctcgagttcaagcctcccaagttctatggcaaaggtctcaactgcctcaagtgcgtgtctttctacacctctcgtttctgttagctcctcaacccgagtacacccatctcttctcgtctaagcttgctctgttccttttccaatccaggttatggaggcaggttgcccacctgggaggccatgagcaggtatggtcctcgactccttgtcactagcttgctcgctgctgctactgtagagtaaaatattttcggtgacatatgtccgggtggatcacgatcaaataagttcaacagtgattagtgagctgcaaggacctgagttatatttattctagttaaatattttgcttgttcaggtaacaatttgtaaactatggcgtcaagttggagagactttcaggccgccaaagtaagcctctaattttcacagaacatgttattcgcagaaaaaaaaagacttccatatgtgagtaatttgttgctgccgtaatcctttgcaggacgtgcactactgtatcgtggtcgttccgaattttctatgagaaggtgatgcatttgctgcatgattttcttttgcctctgtacttgtcacaagagaacttcccccttttcagttctttctgtcacaagtaaatggtcaccaacaatcattttttttcctgcaatcagtatcatatcgcatcaactttattgtaagttttagttgcaaaactgttagacttattagtatagttcttagtttcaaacataagaattgatctaaaatgatgggtctgcctttattagtgtaaaaattttaggggttcccgtgtcagttaatgttgcttccttttttggcagggaatatttaatgttcttacttcttacttttagtttaacgagcaattatcttacttgatgcgtcccttcatcattttattgaaactgttgcgctttcttcagatgctattactcttaattctttagatcattaattttcttagttatttatatgctaactgatgcatgttttggatggaatatagtacagaagcattattgtaagcttagattccatcccatatttatgcattgttttctgcttgatttgttaatttttgtttctcattaacttaggcacttctcgagtatgaaaaatacaaagtccgaactggccagcttcaagtaccattgtctgctttaccacagcctggtggtactggccgtgaggtaattgttctaatagtgcagtttttaataagagctctaatttattaattcagtttatattttagttcaatactgtacaatttaacgggattcaccctatttgtgtaaatctttaataattagatgaacacatgctgtccttttaggacctgtctaattcgcgcctgcgccaaaagtcatgatcagttacggacaggatgcagccacgcaggacttttttttaaaaaaaaaatcatcactggaagaatagtaagacgagagcacccagaaggcctcaatccagttcttgtgtccccaactcgtgcagcttgcatctcatttcttgaactccccagtcacagtcacgcatgggcatggcacatttgtttatagcttttcgtgcatagtctcccctaatcctttccctggaatttgtagcccttcttgttctgcatcccgaaaagggaaactttcaacttctcattgcaaaaaaaaaaaaagatgctactaaaaacctttgattggacaactttcatctggaactgaaaactttcacctggaactttcatctggttactgaaaactttcttttggagactaagctttctactagagattgaaaagcttcctattggagactaaagagcttttgatcggaaaactttcacatggagactttcatctcgagctaaagctttggagcacacaactttcatatagaaaaccaaaagaataaaacggaaaagagaagggaaagcataatcaatgtgcttgtcaggggcctcctgagtgaatgccaagcctaaacaaaattgcataccccttcgtgtcgatcaggcccgtatgctagcattcctcacaatgtgcgtgaggggatttacttttttttttatatccatttgtttatggaatggtgttacgcctttgttagcatgcacctcattagtcatgtataaatgaaagctgtgatatttacaccaacctagctgaattaaggacacagtctggttatatccggaaagaccaagggattttagtcactgaattccttctgaaaattgagtgttggttatggatccaattttattgacatagacgcactaataactgatttaagatgcctgccatttgttaaggtttccatcaagatgtgtggtgttgcgttgttgccaaaagtgttttcttgtcgatgcgtgtaaactactagttttagctagcttgacaagtttgtttactgccttgcagattggtatgaatcaatcatcttctgccagagttagaagggattctgcagcgcgtgctatgcagggttggcatgctcaccgtctccttaccaatggcatatatggagatcaaatgttgaaggttaaaaagatcttgctctttgtttacatgtaccttttcaagtcaccaactatttaatcagaaaagattcaaacttgtacaggaaaaagattcagtcccttcttcaagtcgtggtaagaacctaaagtatttggtatgtttgataagttttctttcagcagtgcatctgttgttttttctcatttatttgttttgacacatttaggagtactcaagaggaagaaagcatctagtccagagtgtgctatcaaggtgtctcgtacaaaaataaacaaatcacagttaagacttcctttcctttctgttggttatatagcattggctgataatgacttggatttagctacggaatatgtcattacaaaattttataggaaaatcctaaaaattacagttacatttt

SEQ ID NO: 52730 - DNA, 1926 bp, Oryza sativa
atcgccgtggttcgccccgccgttcacagccgccgtcggccgtccgttccggccggcgcccttcttcaaccttccgccggcccgtgtggcagccacgtaggcgccacgtcggcgccaactcggcaagaccgggtcaagccgaccccgatccgccgctcccctctgccccgctcgcgcgcgcggtccaccgcgagccgtgaggctgctcgtgggcccgccgcatccgcacccaccgcgagccgcgcgcgtgtaccgcgccccgctccaaaccctagcgccacgtcgcgtgctcctcgctcacggtgagccgagccgccgacaagcgggtcctactcgagaccacgccagatggacccggcccaccggctccctctctcctcccctcccgcgcgtgccttgggccgccttctcgggccggccggcccattaagctcggccgagccgcccctttctctcgggccgcgccctagccgcccgagggaagtctgtttcccctccctctttcttttctttttcgaaagggtttaattaaatcctttttcctttagaccaaaaatccaataatcttagaaattcaatatcttctcaaccgtatgtccgtttgactccgttcaacttccaaaattcctcaaatctcgagatctatttaatggcacgtttagaggtcaataatagggctttattttcgccgtttgttgagttgtcccgtttcgcgtgtagtttcggagcccgaagacccgtagtgcgaggatttcgaggatcaagctcaagatctcgagcaaggcaagtcacctttgatcatcttgcacctataatttaaatctaagtacttcttttccgcaaatattgcatgaataagtttaacacaagtatttcggccgcggcttgcgagatagcctgccagccccaatcctaattgctgcaattaccctccttgaattattgaacacttgaaccacctttgtcaactgttgtgcttcgatgcatgggcctacaggcacgtgcatcggaacacctcccctcaaatttaaaacatccaacgatgggtaaaacttggggttttacaaaagacttggaaaacccgacacctgggtcggtgcttgcgaactaaaatgaatttccaaaatcgcagaccaggggacgtaccgggagtacggtttcccgctcttgcacttaaggaccgtttccttagaatttcatccgaacataaagcaagtgcgaccacatgggtggaatgggacacccctggctgagtaactagctaatcgggggaaccatgatgccaagagacatgtggattcaacagggtggtgccggggagaacccccgggcttcctggcacagtatggtctgggactaacctgatgtcggtctgggacccctctcgttagcatatggtgaacctgtgtcggctttcgaaatgccttgtcatgaaagcctcaaggtctctagacgtggccgttctgcacgggctgggtgatccgggttagtaatgtcttgtgggtaaagtgtaccccctctgcagaggttattaaactgttcgaacagccgtgcccatggtcatgggcgaatgtgaggtgattcctagcatagtttgactactgcttgtgaaattactgttgtggaatgggttcgatgtttggaaaatctacggctgatgggatcagccaggcccgggtggccgtttgaaagccgttggccgggtgccaaccttgaatcaattcaaagattgatacattgcacatactccgaccggacgagacgcactgtctcatccgtgtcgtttgagaagcactcacttagttgtttcaaaaaggagtttaaataaaaccaattgcaaaaacaacagcctttcctttgaagcctgcattaaacacttaattcccatggcttgctgagtactcctgtactcacccttgctctata

SEQ ID NO: 52731 - DNA, 2068 bp, Oryza sativa
cgatccacctctcttggatggcacagaggaaggtatcgaggaagattgtggcgtggagggttgtggagggcaatgtggaggaaggcggcaaggacaggtgttgtggcatcatatggaaactgagagaagagaggcgtgagatgacagaaagcaaggactagcctcacgcttggtttttgtcgatgcctttttaatatggttttatgattttcataggcatttctggtaccagggttgcctatgaaaataacttaatttcacacacaatcctcttacgtgaacgcttgcgaaaaacaattttcgcagcgggtttagaccacaggacctcctcaccattattacaagtggattttcaacggcctacatgtaaaaataaaatttggctctctgcaaaaaatcatttttttttagtagtgtgagcatgtagaaatcagtcacgcaacgatcagaatatcattggattgatcagtgaagttcatccctaatatgagttcatagagagacaacttgagatacatccattatatcagggatcagcaagtaggataaaactttcacatgacactcctcaatgtgttagctatatatactccctccgtcccaaaatagaagggattttgggtggatgtgatatattctagtacaatgaaccagattcattgtactaggatatgtcacatacattcacccaaaatctcttatattttaggacggagggagtcattctttatctttaaataataatttaataatataaataataaaataatatggaatttaaattaaattatatatttaaatttaacttaaagatactatgtatgatcaaatccattaattctacataagattaagttcaaaaagtttaggaaaagttcaaaaaaaaggacttttggaataaaattttgttcagaaaataataatttagaaaatgtgtagaaaaatatcgtaaagaggtgaaggttgtcaaacttgcaaatgaaaggctttcattcatgcctaatctacaaaattaaaacatctcgggttttatttcaaagtctctagtagaagcaagatacacatgaagtaaactgtgggtcctatgacggcggagtttgatagccaagcgttcacgtggctttttcccgcccgtcgctcccatgcaaaaccaagtatgcatttagatcatgcagatgtcccaccacacatcacatgattacggctccctataattagtgccaaatgtagttaatgaacttttacatgcaaacacaatcaaaattttcatgataaacttttgtatagcaaaaatttagaaactttttatatatagtttctatgtataaatttatgtgtataaaaactttcatgtatacactttagtacataaatcgattaatacactttaatttatgtatagactttcggtgtataaacttatatgaacaaaagagagtatgaggacgcggttgcctaaaacaggctatcggggtgcattcatgagggcacaccgcccgcactcgttagccctttcaatcaacttatgatgcctcctctagcacaatcaggctataacctagcatggttgcatcaacaacaataatccattatatttcatagcatattaattagactcattattacgataccatcaaagactgaaaaaaaatctgggttaacgttgctcgtaactgaatctattttgtgaatataattgaactaagggatagattgaagttggtgatcttcatttaatagcgatatagtagagaactctcctatctttgacggatagttaatacctaaaagatatccgcggaaggaaacaaacatgcaagcaaaagtaattaattgatcttttaagacaaatttacttgttgatagaggctcacaatttttaaactgtactttgccctttctaatcaactcaaaatcgagacaattgtccggcacattttaatatcaagataaaccttttcaaacctccttttatttaaccctttttagagaacacttcagattatcatacataacaattgcaagatatatatggacatttgtagtataattgatggaataagaatta

SEQ ID NO: 52732 - DNA, 9008 bp, Oryza sativa
  unsure (1)..(9008): unsure at all n locations
tcttcgcgcggttagagattaaaaaaacacctgaaacatatatgctaatcccaatctaaattgctctgcatcggtacgtacagataatatatcatcgagcaccaagctagcctccatggatgcatgtatcacactccatccatccaattcttttgttggttagtttaaagttgaactagccaatatcaaacgttataggaaatggggtagctatagtatatctatcacagaatatattaatatatgtgcatacagttacacgttataaatttatgtgtgtatatatcaacgcgatagtacatattttttaatgatggaaaaatttatattctcagtccctattatcacatagctaataggttttctactgaatagaaaagaaaaattaagtgcaatggggaaaaaccccccaggtacccaaacaaaaaaaaaaggactagctaaaaggttaaaaggcggaccacattattctaacaaagtaagccctataaatactaggcttatccatacagttgaataagtactatccttattgtctacaaaatacaagaatataacatcaatgtgcataatatcctatgaaagaatcactaaattggaacacctcattattgaaacccgcccatcactgtcagattctctagaacgaacactaataatactatgaacagcgggatatataggaaatgagtatcactgggcagtcttgaatgtcgaaactacagtgatactcaaataacaactatctttagaaaaaaataacttttccatataaagggcaacattttagaaaaaaaaattcatatgaaggcagatgaagataaaaattcatataaacgttgtagcgctctactccctccgtcccaaaataaactatgaggttgatttatttaggacggagggactatgatatctataactttgtaggagactattttttcatttgagatcatttatctagctaaatatgtgtaaaaagttctcatgtctatttggacaaaatgattttttgaatttgtaaaaacttcagatttagacaaactttgtatcaaagttgtagagctcgacaagatatacaactttgtagtaaaaaaactatttaattcgaagtaatctaaaagagatttactccggtcgaacaaaaagtatctcgagatatcggtacctcacggtattaaattgttccgatcattagatctagctaggcaggatggacattgttaaatccaacgattggaaacgatttgatactgtaaggtaccgatacctcgaggtattttttgttggaccggagcaaatctcaatctaaaatgtcaagtacgaatattacttttttggactaaaagagttcaaagaataacctatgctattcaggcacgaagtgccctataggtgagatgctatataccacacaccttcatattttgtgcgaaaaatcactgatttccaacgcacgctaacagggttttctgctatagtgtatcatatatcaaatagaagcgtcagttgtaacttgcatagagttaactaacttttgttttcaaaaaaaattatttctataatgccaaatatattagacactcccgtcatccggttactaaatatatttttggcattttaaggtgagagtattgaaaggaaaaaacacatcatgcaccgggcgaagagagcaacatgacattcaaagaggtgccggtgtctctttcctattgcaaaagcaaacattattgcttatcacctcctatatattacattttgcgatcctatatatccattgtcagcttccattatctaaaaaaaataaatccattcttagctaggatgcgtgcggcagtatatatgcagggcaaatgtattgcttaatcgatcgtatacattatggaagataagaacaaagaacacatctgcactcgttagagggatcaaaaacaaaatccagcaactagctcgtttatttaattttctgtgtacaaaactttttcgatcggttcagttttcttatgcatatattatatatatgttatagcttggtcgaagagattctttcaacatccatttcttcaccccaattctttgttaaagactgttggaacagtcctgctaactcctaacagaccggcaactaacaagggcttgctgacaaaaaatcaattagttaccctttgataaggagtatatatttcaagtattggagccaattctgcatctgattcatatacagcgagtactgttccatagaacactctgtgtgtgtgtgtgtgtgtgtgtacggttaattagaacactgcatgttaaagttgtttcatcgcctgagacaatcaaatcctcaggtaatatatgggaccatgttggggtatgctttgaaagtatttttttttaaaaaagaaaaaagatgtagtgccaagcttggaaggatgaaaccgaaggaaatcaaagtctcaagcagtaatgttcaagtgcaagtatattatatgcacaggaattcaaagctgaactacatatatacattaattttctagttttctactaataattttcttaatgaaaccacagcctttagtacccttgatcatgcagctatcgttcatagaggtaaaacaacataccatttcacatcttattgtcgatggcccttaattttgagctgatcaccataatctgcagtacaagtaggttagcacaatagttgacagtctcatttgatgcagtgtacgagacaaagtttctctctccctctctctctctctctctctctctctctctctctctctntaaagtaaaactggatgcacagtaagttattcttgcaactttactgcatatggtactagctaattcgtgttgtgcatcatataggtagaggatatatatgcaatagagtagtttatgagctcgctaatttagctagaaggactacgcatagtgttgtttggagggtccaagtccatgaacttatccttcgggattgtaagttatctactccctccatttctaaatatttgacactgttgatttttaagcacatgtttgaccgttcgttttattcaaaaacttttgtgaaatatataaaactatatgcatacataaaagtatatttaacaattaatcaaatgataggaaaaaattaataattacttaaattttttgaataagacgaacggttaaatatattttaaaaagtcaacggcgtcaaatatttagaaaaggagggtttatttcactaatatattgcaccatttcctcgcagaaaaaaaaatcatgttgtgcttagatatgtgcctgtgcctcaacgcccatgaactgtagctatcaagggttcatcaggctaggactgaaatttttgaaattttggaattcaattacaaatgaataattattcgaacaagttcgaaattccaactagaaattatttttatgtattgtatttgctcattttagatcgacaaggttatgtcaccattgtagtcatgtttatatattgacacgtagatctaatggtaggaagaaatcaagaaaaaaaaaagggaggaaatattttggtcagtgggtaaacttttctgaatgatatatggatatctgaaccaatttttttattgaatcaacttctagaccaaattatttcaagggatacatgcaacaagaagaattaaagctcggttctgatacaatacaacaccaaanaaactaacgaaatcgaaactgagctagcccccattgaaacgggaaaagtatactagctaattaaacttaaaccaaatcaaaatattcagaacacatgcatgtccctttttattcaagctttacctctagaaactgaatggcgctttgttttgctactggctcgctagttgctcccggcgaacgagccgccgtcgacgtcttcctccgcctgatcccccaccgactcctccccgtcgtcatcagccgccgcgagcacaaccgccggcgcaggcacaggcgcattcgcggaagcagcgacgtcgccagacgatatccccgccgccgccgccgccgccgccggcggagcgcccggcaaatccagcatccccgccccctgctggacaccgagaccgagaccgaggaaatcgatctccgcggggtgggtcccacgcaggcggtgcgcagcccagaacgcgtggttgggggacagcgccgccaccatcatgccacggcggcgccgccgccgccggtcgcggcggatcctcctccgcgcctccctgctgtcgcggaacgccgccgcgcggagcacggcgaggcgcgcccgcggcgccagcccgccgcgcaccatgcccctgacggccgcgcggtagtgcctcctcaggtgggagcggaagcggccccgctgcggcccttccgggcagtaggggcagcagaacctgcgctccggcgccggcggcggcggcgcgagcgcccagaacggcgggtggtcgttggacgaccagacgctgtcaacggtgctccccatcgcgcgagcgagtgtgacggcggcgaggtggtgagcttgagctggtgagggtgcatgaagacattcccgttttatatctaggtcaccgcgcttaaacgggaaagagggtgaatgtatcagcgagacggcgcataaatgctcctgatctcttccatttcaaggtgcacggtcgaacattgatagctgctcagcctgcagtcgaacattgcgtgcatctgacacgcacggccggcgtgggtgacggcggcttcgcagcggcgggcggcgcgcgacacatgcagcttcgacttcggggtcgcagcgcgtctaacgacaagtcaatgcatggcaacgggagtaccggagtagagactgccatgcgacaaacaaaactaacagtacgtacgtatgccatgcgactatgcgagacatggtctgatcgattgatatgagatttaccgttgcatggctcatccactagcttccgatagttggccagaagatatacaaacgctacgatttgggcttagattggttactctggtaggagaggaccgagcgtagcattgagcgtgtatggctcgctcgctggtctacgataacgcgagcaacaggcggtcaattcgatcccaggatcgtgtcatccggccgccggccccctcacttcctcaaaaggagtaaggagtttacatggagtatttttgtctaattaacggtattttttcagattttcgaattagttactttttaagtttctttaaaaaatcaaataaatcaatttttaagtttgtaatggctaatattcaattaatcatgtactaatgtgtatcctcattttgtataccatggaaaagctgagccgatcctcttccaacgaagcctaagacttgttcggttaatcccgaagagagagattgaggggaggataacaccacagcataacagatgtgaaatttgaggacttttacggtagaatatactagtagtatatatgggggtgaaaatgggtcgggttgggtcggatcccacccttcccatatgctaacacatattttacaatcggaatcaggtcagacacggatagtgccaaatacatatacaaactcggatattgtcgggcaaaaatacgaaacgaatacgtaccaaaatggatacgtacactatcggttacaaatacttattcggatatcaagtctaagcaacaatcatatatatcacatagacaataaccattcagcaattccatatatccataatacgattatatatgaccttaggaaataaatagggtgcaacacctcgcaattgaaaattatttcatatatgacatacatttaagaatattaggtcgttaaacacgatatatctcacagttgagtcacaatgccaatatatcaccccatacaagctatcggtaggcatcattcataggaccacagaggcatagactaatagatatcatttaaattatcaccaatagactaataggtactacgttcccgaacctgatctcatatccgccaaaaaagacctgtattcgacccgatatctatgaaaagtcccagatacccgaatttgtcctgaagtaatatcgtcgggccgagcgggcggaaaatacctgccccattttcacccctaagtatatattgatagtataaataaataagattgcgttgggactctctcacaaaatagaaaatgatctttagttatttcatgttagatcttaactccgattgtaatccaaatattgtttgtgggtcagattggattattgacctgctacgtttgaatagatggcacaactaaatcctcctgatcggatttatggattcatgaaacacataaaaacattaatccgtactggatagctagagtgggagaaagtatctaacataaagaaagaccattttaacccccccccccccccaaaaaaaaaaaattaattttcactgcagtcaatttaagtcgtgggtaggcaaatcaatgtacgcccttgattgtttataccagtagtatatggagtactaccaatatattgtaccgtaaaagttctctaaaatttatcctgtccatatccccttcaatcctcttaaggggagaataaccttaaaagacctaaagaatttgatttggtttgttaatatttgagaaatttttgaattgcattagacgaaactgagtaatacggtttcgattagtgtgtcaatttgtaaacttcttctccacgagactgtaaatgtaagcaacactatcattgggtaattctagcaccagtgatcgatcgagacaaccatgctacgttcggtcctctcctaccagagtaaccaatctaatcccaatcccagcgttgtatatcttcggctcgcctagtcacatggcacacgcgctgttagatttgtttgcccgatccccttcttcctctagctagctagtctactcccattgccatgaacatgtcgttagacacactgcgaccacgcagtcgaagctgtgtcgcacgccggccgccgctgcgaagccgtcatccacgccggccgtgcgtgacaaaagcacgtaatgttcgacatgctgcaacagctagcaatgcttattaccaggtgcactatgaatggaagatcaggaatacttgcattaatgcgtcgtcatcgaaacatttaccttcttccgcgctggcgccggctgatgacggggtggattcggaggcggaggcagacatcaacgatcgcttgtccgccgagagcaactagatcaccttgttgtcccaatatagtacactccccgcaacgaaaaaaaaaaaagtggttagtacacaatcaccatacatattagttaacgggtctccacataaatgatacatatagtgtgtgtatatataaaaggagacaagtggacaaataaattgacatgcagcaaacaaaagataaacataatgaaagtggaagtcaaaagattaaagatctagcattatgccacatccagcatataagtcataggcaacaaaagtagttgctacacaattatatctaatgtgtcttcacattaatgggacgggacggggtagggtgattctagttttgtggttgtttggttggagcgatacacggatgtgtcccattagatcggagaccagctcgtccccctaaatcaagcagcaattcatccctcttacatctctctcacgtgcattcttcctccttacggcacacagcacaaggcttgtgggaggaactagcatcgtggcaaaacctgatgagcagtggccggtgtttgcaccagtttgtgggaggagacatgcgacgttgtgcagcaaagctcgtggcagcctctcgttaatataactagctcttacataaatatgtgagggacattttctattgtcttgttttctaacttttttgcgtgttgcattgaagctaacttccatgttaacattcaatcgaccttgtttattttgtgtttaaaaaccaaaactagcttgcatactaccatacaagggctgagttactcactgtgaagggtgggttggctagcccagctacaacccattcactgcacgccactagaaccctgtcctagtactaggctacccacattagtcatcactcaccagcccataagcaactccaggccagtgattagatatggggcaatcgaccgttgtttctcttccaatcttgtgactacatgccccttcgtcatgacccataactgatcatctttattacttatcgctcaacgctcgtaccctttgccgcgctggtgactatgccagcaccagtctgcatgtgttggcattgtgccatttgtggttccacggtgcacggtcgtgcttccaccactatgcgctataacctctagccagcaactggctagagctaggtgactccataactatattctattatttatcttggatattctcttgtgccttcatttattggttgtactttattttttatacgattacattatgtgttatgttcggttattttttttattgagcatgtgcaatccatcgaaatgtgaccgccgctgctactatgtataacattgctcctttatccattctcaaatataaaaactttgcttgtcttaaccaaattatattcatattttgcttgatttgatcgagactaattatattttcagctcctgctgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctctttctattccatgactcttactcttcatcttccattcct

SEQ ID NO: 52733 - DNA, 6034 bp, Oryza sativa
ttcattgttcagtgccatatacaataatatgcaatcaagaaaaatctaaaatttatgcaaagcaaacctgaagacaatatttttttatcaagagggcagaatcattttggaggagtgataaccatggtgcagaaattttactaggaagcaattggagaatgcactcatactaatctgtgcattgtcccattctcaaaagagaaaaaaaaatcacttgagcagttatttgtactacattgagttgagctacatcaaaactcacttatttcattcctaactcctgttgataaagaaacaaccacgctaaagtataactgagctatgaccttactttacaaatcacatcatttagaatattcaaaaggaataaatatataagtagaaatcactgatcaatctcagggaaaaaaaatcatgagattaacttattcggtagtaccactgagaaatataaattatttagtcgtagcactgaaaaacaggcaaagtctaggtgtcccttccagcaaagtgcatgggttcgtttctgtatattgagaaaaattactactactcgatgagttcctttaataataagctactaacatgcatcaacagtttagcttgccctggcaaggtataataaacatagcaatgacacttcagctttgcccgactcatcacatctggacataacaacattgcaggctcactggagaatactaatgcacacaacaattaacacctaacaaacttaattaatcggacacaggagacaggagtagcaccgtaccttcacgaacaaatcaagcatcatatctgagagggatttgcaggactaatcatcagatctggaaggtatttgcagccataagaggaggggcgagcaggggacgcgttgttggccggtgctgctcacccgtcgtcgctgcgacgaggcactgcggaggcagtcggcgcttgggcaaggaaggggcagcaggcgccagaggagaagggaaacagggtacggtcgccctcacccgagacctgacgcagggacgagccggcgaggagggggcggcgaggagggaaggggtagcgcctggagtgggaggcgccgccggctcatcttgaggccggatttggcaccgccgaagctggggactgccggatctgtagcaccagcggcggcggcggctgcggcggcggatgttggctatgcggcggtggtggcggcggaggatctcggtgacgcacttgtggaggggagacggcaaacttcgtgggctatcgccgaaaaaaaaaagaccagtggcggctggggtagggaagtggggaaaagagaaggggatttagggtttagttgtggcttaattatagagagcagctacaaaacggaatcttgttgtaacgggatagtttaagtggctcctccccgctttcacgtgcactccatcttgatacctggtaccttgggtatcagttggtacctggtacttggaacttttggtaccgactgatacctttggtacctgatacctgatatcggctgcctttggtaccgactgatatctttggtacctaatacctggtaccggctgccggctggtacatgttatctagtaccgtgatacctagtacctgatacctggtagcctggaggagaaggaggagagagagagggagaaaggagaaggcagccgcgtggtggagcaggacgaggaggcggtggcgaatccggtggtcggcgaggcggagtgtggaggaggaggcagctgtgaatccgatggtcgtcgaggtggggcagcctatgagaagaccaacgagggcggggagccagagcagcgcggtaagggaggggagcttgagggcgacccttgccgaggccgcgccgtcgtcgtcctcctcggcggctagggtcctgagccgacaggagaagctcccacccaacaacgccttccccggcgccagcggcggcctccacgtcccgctcctactctccctcttgttcaccgcacccatcgccgagctcctcgtcgtcgcctcgacccctgcagtggtggagcgacggcaacagggacaacggcgggcaccggctccgacgagcgttctccacgcccaacgcgccaccccacatagctagccaccatcgtcgtcttcgtgctggtagtcacagagagataagggagaaggaaggggaagagacaaagaagaggataaggatgctagatatttagtggtagtagttgtcacgttgcaacggaagcccggggtgtaggttttctgttaattataacctatatttttttgctgacacatatttggttagtactactataaataccgacagatactttgacctcaaaatatatggaattactgacacattttatgtctcgtcaggcagtattgccgacaaatagtgtgtcataacctttagcgacagatagattctcggtgattttggtgacagatgtctgttggtaatttagtgtcatggtgtagtgtccgtcctcgcggcggaacggtggcggcggcaggccgcgggcagagcaaaggggcgggcagagcggcggccacctcgccaaggacatcgagcgcacctctgacgcgagaggagcggcggcgcgcaccagcctacgggagggagggagaggagcggcggtgcgcttgggtcggcggccggcgggagggagagagaggagcgacggcgcgcggggactggcggggggagcggcgcgcggctgccggagggagagggtcggcggcgcacatgagtcgacgggtgggagggagaggagcagcggcgtgcgccgcgccggtggagagggcagccaacaggagggtggaagaggagcagcggttcaccggcctctgcgcccttgtcactccgcccaccgcctgctgccgctccattttaccccgctgacgctcaactccgcttcctcccgccgcccaccattgctccgtccaccgccggccgctgcgccacttcgctccatcgccgctccgctcatcgtcccctcggctccgccgctcgcccttctttcctggcagtgtagggggagagagatgggggatagagagaagagggaggctgacatgtgggaccacatgggccccacctttttttaatttaatttttatgtagctgacatataggtcccacgatttttattatttttcgggataaaattgccacgtaaacgccacgtcattgccacatgggacgaagacctagtcaaaggagccacataggcaccacgtcggccaaaaccaccctccataatgccaagggacctcgtttgccaggtttcggaagttgggagaccggtcgtacccggttttgtggtaaagggacgaaaatcggactgaccgacaaatagagagacctaaagtgaacttatttctataaacaatgacgagtttcgaattccagcccatcgtcacgattacgccgcagcctgcaagcccatcgttacctagccagaactacagcccacttgcagtattggtccatgcccctttgcatgcaaggtggtccttctgggctcacggtccgtgtacttcaggtttcggcccaccataaccgtgcacgtttccggcttccccttcttgacgctggcaaaggaaagtatgggacctttgaattggaggaaaaatatagaaattttggaggattttaattctatagaaaaatttccattgaaaccctttgaaattcctatgaaatggacaatcctatatagattttggagaaaatttagcaagagcttcaacctcttggtaactttcctttgagtctatctctctcatctaattcctgcgtttttccttcggttcaatcaaacggtcattcctatattttttctgtgttttgcaatcttttgttttgcacttacattctgtcgacgtttgatgtcgcgattccggtatttgcatggtatggggatcgttggtactagggtatacgcaagactgaggtaaaagatatggagacagggatttttatacaggttcgggcccctgaattgtcaggtaataaccctacatcatgttggccgaagccgatattgctcttattcaccataatcacaccagtacaatatttggggtagcctatctaactgttgtcgacatggcggtctgaagttatgactcgtaatcgacaacagggtagtcttcctcctcgagttcgtgcccggtgagatcagagatagcgctttcatatctcctgacagtatccgaagacaccgtaggggactagccgtgcctatctttgaagtcgatatccggcgtcttgtcttggcgtatgttggcttctatattaatcttctgtcttgatctattgttccgtctatgttgactgtggtgggtgtgttgatcgtcccctctccttctagggggcattgtatttatacttataggtgtccccttgtccaagtagaactagggaaaccaatatggatacaatccgagtagtccttgtcgttttcatgtagaactctggttgtcttcccttatccagaactcctcctatatccgtaggtcgtttccgtataagatatggtatgtggtgggtcctaacgagatttagtcgactactattaggtatacgtggtattcataaccctgacacattcctattaaaatcttacgtttttttctatttctacattttctcaatcctacgatttaaatgaccctacaggttttgccaactttgcagctttgctatcgaatcgagataccgatggcgcatggatgcaatcgtgacacgcaatacgtgctaattcatggcgctttctcctgcaagctcgcatcgtaccttgcgtcgttggcacgtacagggaacgcgtgcattgtcgaataagacattatctatgtagatagacgtctatttagatttatagaattagaaaactatattcatttgtgttagttgggaaccttcttctctttaaaaaatggagcagcttattaacacatgattaattaaatattagctaaaactaacataaaaaatagattaatatgtctttcttaaaacaacattcggtatagcctgaaaaggagcgatctattgcacagtgtcagcgagagcgaaggatatgctcatactccctccgattctatattaattgacattttgaacaaagttaaagtcaaacttttataactttgaccatcaataactttaaaaatatttagtttaaaggaactagaacaacatatatagatttgtcttttaaagtactgtaataaaagtaaatatatatttatttaatatatatattataatagaaaaataagatcaaagatgtatcttatagaccgtgtcaatgtctaaaacgtcaattaaaatggaaccggagggagtatgccgctgttgattattgtacgaagtggccatcgattggcgtccggacgatgagcagttaatgctcacgtttattatatggtcatatatcgtgatcgccaattcgtcatgagtcgatcacgacgttgacagcgctaattccaaattaaattgagctggagttaagtctgattgatcggaacagtgctccaaatctctctcgccagcgcgtctccaaagcatcatcagatattctgattacgcatctctacggtaaagtttgttgcttgaagaaaggactacacgggatcattctgctccgtcagaatcgattttcatgtccaatatttgaccgttcgtcttatttgaaaaaattataaaaaaaattaaaaagacaagtcacgtataaagtattaattatgttttatcatctaacatcaataaaaatactaattacaaaaaaaattatataagacggacagtcaaacgttgaacacgaaaacttagggtttgactttttttagggagtacacgtgatcttatcactcgctcggtacatcagaaagaggcacccaacaaacacacacccctcgagacagaacaaaaacatctcaggcttgggacagagacaagaaatgctgctgcctgcatgattccagcctactccgtactccgtagtgtcctactagcgttcccatcacatgacactggccg

SEQ ID NO: 52734 - DNA, 2608 bp, Oryza sativa
ttgtctcaacgggacccacacttgtgctagaggagagaggggagaggggcgaggcagctgacggggagagaggagcggcggcgccgcccgacgccaactcggggaccgccgctgcttcggggaaggagctcgacggcactgggccacccgctcccccgctcccgcgccaccgacgcgttcgggagaggagaggaggggtggacgacgtggagaggagggcgccaccgtggagctcgtcgcagcccccgcttgcgcgacagcctccgcttgctgccggctgcgccactggagcttgccagccacacgccccccgatccgcgacgacctccgctcgctgccggccatgccagccctcgattcgcggtggccggaagaggaggacgggagggcggctccggccacgccgcgccctcgatctacttgtcggagagggagggggagatgaggttgaggtcggcgagaggggagaggcggtgatggccgcgaggtcgccaaccaccgctcaacctggtgccggccgccgccgctctctgcagcgtttgctctgccagtggcccggtggggaaaggagtagaggagagagagagagagggggagtggaggggagatgaaaagtgaaaagttggtaccggtggtattcatactacaaatactgcactgtggagcatgtagcttatatcctttttggtctatgtggcatgtgaagaacgccaaaatttagtggcgcactgtgaatggcctgaacatgctactcctacatatgctagccaccgttggccggaaagagattgatggatatgccggccgctgctgttgctgatgcagccatgcaggcgtgctctccctacgttttcagcaaactctgtgaccagaaaagatgggaatattgtcctatttcgagagatcaattatttcttgctagtaccaccaatggtcagtacatatctaatttggtaggagctgcaatttgcgagacagttgagggcttgaggcccgaaagcaacactgggtgcgagtgactggccctctgtcctcacaggtcaagcattggtttccaacatcgcagaggacacactctgttttagccacacaaacgagatggctttggatttgcgtccggtgctcgccacaacttccacggcccaaagataggaccacaccaaatacaccatggcaatatagctaaccctgtagtactacatgcaaatgcagaactacaaccatgtatatatgtccatatcagatccaaacgttctcttcagcaaaacagaacacgtagctagcatgctgattctgcaatgctgtacaccacacgctttttgtgtggatgggctcttccgtttccaagccggacaatcttgggaaagaaagcaagcaagaaaacatcccagcaacaaatgtaagcggagacggaaattcatcagttcccaaattcagagaccaacccaactactacgcaaaaaagttgtcattccattcgacgtttagttattccgccatgaacaccacaagcgttttacaacagcaagcaacggacggagccaactcaatgacagacaaaccgcacaagacacgtcgtccacacggacgccgaccatgacaacacctaaaccgaacaatggcggagggaaaaaaacgatggaaataacacgacagggaccaaggctgcgacaccggagctcagcagctgacacatacatagactacaaatccacaggcatgacacacgcctgatccgcctactttgcacttgatggcaactctagcaatggcactgcaatagccttcctctgtgcccaagtgccctttcctatttaaagagactaaccatagatagatgcatggatagatagacgattgttcattgggttgatggaatggatggatacttgctacgacgatttccgaagacactatcttctttcccttggaatcttcttcttcaaatttggttgctggttggcttttggtgtgggaatccgatttcacagcagcagcagttaaaacttgttgttgtaccagaagacgcccttgttgtcctcaggctcgacgtaaatgcactccttggcctcgcgccatgtcgccttggcgacgggcgtcgggtcgaactggtagtactcgccgaggatggggcggatcgccttagtggcctccatggcgtggtagtgcggcatggtggaaaaaaggtggtgcgcgacgtgcgtgtccgtgatgttgtggaacaccttgttgaggatgccgtagtcgcggtccacggtggccagcgcgccgcggagccagtcccactcgctcgagtcgtagtgcggcagcgccgggtgggtgtgctgcaggtaggtgatgagcaccagccacgcgttcacgatcagcagcggcacgccgtagacgcgcaccacccaccagaacccgaacgccgacgacagcttgaacagggcgagccccgcggacacgacgccgacgtcggagatgaagatctggacgcgctcccggtcgttgtagatcgggccgtaggggtcgaagtggcacgcgaagcgcgggtacgggcggccggacacgttgaacgccaggtacagcggccaccccagggtgagctgcacgaaaatgtgcacca

SEQ ID NO: 52735 - DNA, 8942 bp, Oryza sativa
agcgacccggtgttggagtgggtggcgccggtggctgtacttccacgaaaagtaggggacgagcagcgacgagtgcagcacgaggccgacgatgtcgtcgagcaccgagtagtcggagaaggcatggtggccgcactcgtgcgcgatgacccacacgccggtgagcacgcagccctgcgcgatccagtagagcggccatgccgcgaactccatcccgctcggcagcacggggatcatgaccagcgcgaagtagagcagcgcggcgacgatcacgaggtcatggaccacgtaggagaaggacttgatcaccgagcgctggaagcagtgaggcgggatggccttcttgatctgccccagcgtgaacggcggcttgtccgtcggcgaccgctgcacggccgcgccattgccggcgcggccgagcagcttctgctgctcctcccgctccttctccgtcatcctgccgccggcacccatcttgctgcttacaacaacaatcacaatcgcaggtgatgagaaagtgagaatcgattgcaatattgtagtgggatcagaaggtgcaatttgagcaatattataatgcaataatacggaaaccccacacgaacaaaaatatctcgcaactaagccaataagcaatagattacgtatgcacgagttgaggagcatcaacccaggaaaagaaagggcggcacacccatgatgcgatccatcacttttcttgattaaagtatatgtgataggttattccgagcagcgagccgagcagcatgtgcttgcccatgttcagattcgctttctagggcgtgcatcgtaagttcacatgtactgctacggatctgccttgcgcaagttaccaagatgacaagactgatcactgtaccatagcacagtgaattagtactagtaaggccattctcaacccattagacatagtttccataaactccacagcatcaagaaactagtactaggggcctgtttggtttccagtgacttattttaagtccctgtcacatcggatgtttagacactaatttagagtattaaacatacactaattacaaaacccattatataaccttggactaattcgcgagacgaatcttttgagtctaattatgccatgattttgacaatgtgatgctacagtaaacttttgataattatggattaattaggcttaaaaaattcgtctcgcggattagctctcatttataaaattagtttttttactagtctatgtttaatactccaaattagcgtccaaacatccgatgtgatatgggctaaaaagttttagcctcatctaaacaccccctagacactactcttccaatacaaacatcactattccatacttcaatttaatgcttcttatctcacatgatgtcttggatattgtgtagaaacaatatctcatgcaaaacatagtttccttctctttactcatttattcacttgtcacatcattttttatcctatatgataacttatttaatgatatagacatcatcctaatcattgagttgggaatagcctaattacgcttagcatggtgcagtaaacgaaaaggaaatggtgattgattcaacaagcgagaaaggtttggtcttgggatgtaatgtggttttgaaaaatactagtactacagtagttatatgttcctcgataaaaatgtgcatatgtcggaacgcacactttgtccagatagtctgaactctgaaggatgatgcctaggaccatccccagaaacgtgtgcagaaggaatttatcacttgtttgggggaaaaaaatggtaccatatctgattatgataaggtcattaaatccagccatacaaactgggcggtcaaatataagctatccatattcatcagacatcgtcatatcctaatgagtggtcaattttgacgaacaattaaacacacaggaagtttcctctactcttaaaaagacaccaatctttgcaaaaaagaaaaccacttgctcctgcaggttggtggaacagtaccatcaagactaattagtataattacctagctagggtcaaattaaccaagtgcactgcacgcgtctagtctaacgcaaatgccatcccacaaggcagattcatgtgcgactgtctcacttgacttggaaggcacacgagcctaccatttttcctacgggctccaggattgtggtgctggtgatctggccttcttgtattccgattagacggctgcactcgtttgattaggatgattgctagctcgctgcacctgtttgtggctggaaatcaccagcacatgcagctaatagcagacaagccagccatgcatgcactagtggtgtgtgaactatcatactgcaagtggtggatgcaaatccaagaagaggtaaggggggccagatccgctaatctacgatttgttcatttctgcgtgtccagcttatctctggctggaaatgtacagagatagaggggggataaattggtgaaacatgccgtcaggtggggctggagttcagcgccaccctgccgacctttgcaggctgtgtgacccctgcacttttgtatcctagcgaagacatgcagctgctgcctgacgatgggcatatgggttccagaccatacagtatttttatgcagagaacagtgataatttgcctggaaagtaagaggcaatcgtcaccgtccaaatgcaacgaacgggatctgacggtggagcgacctggggatcacgatgccttttgctaggtcaagcaacccaccaagcccgcgaccgggcgggggcggcggcggcggaggctgctgcccggcgcgtgagtgcgatgtcttttttattttttcctttcgctttcttttctacaaaatcagtggcatttccaaccacaccaccgggagcacgagaagcatatgccgtgccctgccgccggctaggttccataggcgaaaaaaaaagagagagagatttttttttaatgccagaaacgacgaccgcacaagaatcaaactttttcttttcttgaaatgttgtccgtgtgtaaggtcgtcggtttgtcagcgtcgtgactcgtgcccatagcgctgagtttcagaaaaaaaaaagaagaagagtaatcggccatttcgtcctgaggcgttgaaagacgaatcccaacatggaggggccagaggccatgatggaagcatgcagccaaaggaggcagctttggtgggtaaaggtagcagctttaatcacaagattaacgggaatagctaaaaggtttggcaaaagttcctacaatgagttgtaatggcatagcgatggagataaggtacacaactacagaagcatgcggaaatggagcatatcaaactatcatcctatcggtaaatcctacagatctgcccaggagacacaacaaaatcctatagctctgctttaatccacctcaaaaaggtcccatcaatccccggcggcgagacgagatcaacgacgacgagctcgcctgtcctatcccccaatccaccaccattactcccaagaacacaaactccacagagtgaaaacaaccaaaaatcaccgcagcgatttcacacaccgtaccgaaatcgaaaagaatcacgaaacaacagcggtggcggagggtaatgtgggaggcacctgagttagcgttggtagatttcgcaggcgcggaggagcggagcggcggaggcagatcggggtggggggcgggcgacacccttcccttgttccctccctctttgtggaggaaacgagtggtctgtgcaggggaggaggagaggaggaggccgcctccgaatccaccgggtcgatgcgctatttaaaagcggtccgtgcgacgctggcgcgtggggcccgacgcgcggacaggtggggcccaccacaccacgtcggagattgggaatctgacgcccgcacacgtgtcgcgacgtgtatcgcgcgcccggggggcggccttgacccggatcggggggctggggccgcgtgggccgtccgctgcgtccatccgacggccgggagcgcgtcgccgtgctggagggatcggccgggtggggttttcttgtgaggagggaggggtttggtggtggtgtcgcggcggcgcgatgcgaggagaaagcatatggcgcggcgcacggcggcggggggaatcggtcgcatccgggtaggcttcaacgagggagagaccgagagaggctggaaattggcaaaggtggatcgggccggatggcccggatccgagccagattcatgggaaatcgccgagagagagacgaccgccgaggcgagccgggagaaacggacgaagaaggatgagatatgaagggatcttgggcttttctacaaagtggtaggtcggcttccattgacatgtggcccaagtgatgtatgtatgtatgtataatttgtcctttaactttaaggttttcaatgcaaaagtttaaggcacacagcagctagaatttatacaggggctgaaacaaaaataagttagttattttgtattcagcgaagacaccaacctgtagcttagagagtggttttgtcacctttcttttcagatcaatctgatttgagattttgctagtggtttggtactttggtttacaaaaattatgcgatttctttgacaaccaaatacagcatttgacttcgaagttttaacggcatttttgcttccggtctttatttgaaatgggtggcgctacttggctacttaattcgtccaatactccaattaatctaatcccccaggccttgtctcactaatcgctactgtactggttttttttttcttctaacgcatttctcatgtgcaaagtctggttttgcaagcatacttttctttcagcagatgtctaacttcattgctgtagtacgtaacacgtacagggtcgtgtcctctgtccagtgcacgattttattcaaactactcgtcgacccgaagtaaatagtacatggcatactattgttggatcgtactattagatatggatcgtttgcttgtacacaacccttaagccattatttagaagattataactcgtaaataacgtaaggcgagctttgctttgtgattactgattagccttgtgcatggctcctacgcacgctacctgttccaaagccttcgtttgatgacaatcatggccacgtgatggcgtattctgaactggttttgcagcaaaaaatatctctcagcgagtcgccctcgaatgtcctcctaacttggcctttgggttatccgccagcttgtgtcttttcagcatcaaagtgcagttgcgcagtgtgcaacgccggaaaatattctttcataaattcaggaacccttcgtcggcaaccccttggccgccgcataacagcggattagctaggatattcttcagcaagatacacgcatacaggaaagatgttcatttattattagctagtcacttttctctccaacgatacagtaatatattaacgggttgattattattcgtgaatcgtgatttcgactaggctactaattcctcgacctaaacttcatggtatgcagcagaccaaacgctctcagtattatatcatgtcttttccattttgtttagttaattttggtcatcagagtcagagaccgatcatattcgcgcccacttgtgtccccaagttggtgtattggtgttcgtactgtatactccgataaaatatactgtataacataacatgtcccgtaatgtatatgctgacatatactatgtactccagctaacacgcaattaatcagctgcttcgtccatcgatctaaattaatgttactgtcctctgcagcttttgcgtgaattctcttgtcgcctgcaacgatcgtgcccaattctaactgcatcctgcatgtgctgcaaagatatatagagcactgtgctgctcgtagcagtgtacgtccaacatcacccacagtcttggtcacccaaaactggtggcgagatgaccgtgttcacggtccgtgacagtatcaacgttgtcatccatgtggtcagacactgatctggtgagatatctccgatctgcccaatagttaggtcgattaattaggtccctgtaggtgcaactggttggaaaatatatgtgctagatctagcagcttagcacggcgcaagacggccattgtgttgtcttcttgtagcgccggggactactcttagacggtacttaggtagtacagtactacgtacttagtgattcgtagtcatgtactaatggcattttgctttcggggttggtaattttggtagttttgttaaaccaaacacatgcgtggatctacctggtttggtgaccatacgcactaggcagagcacagagcagtgccacggtagcacggtcagcgagtactccctaggaggctgggattgtgcttactggcagaaagcgatggactggacttcatggcagttcagaaacagattgcttttttcccccttttaataaaatgcatgagttctcaaaaaaaaaatgacttcatggcagttgcagctgtgttttttcttttcttttattttttggaaaggtttggttgcctggctatatttataagaaggcagaaacagttacacacaatcgatttacatgaagcagataagcttcaaagagttgcagctggtatttttgagtcctgtggcgcagcacatatcaatttggcacaatttgcaacatggcaatttgggatggtttgtcagataaattccttggggaggcttcagtgcgaagtgggtgtaacgggtaataataatccactgatacgctgttatatatagagtgcgtcgctgctaattcaatgcttcgatcaggtctattctggcaacagcgtccgtgctgaacaatgcacagatttgcaggaaaccatatgtgcggactaacaggattaatatcggtagaattactcgcgtgacagaaagctgatgatgcacggccatccccactagctgtgccctaagttctacggggacagagatcagaaaagaagaaatggctatagctccatcatttcaattcaagaaggtagtgtggtacctcactttgttctaaaaaagatggcacagtgcgttgcagctttcaacggtacaagctgttaattgagtgtcatcatctgtacaccaaggtctactgttgcaatattccaaaataaggacgatatttagacagctgaaaacaatattttgttttctttcagtaatgatgctgctatactccacgcggtccggtctgcagccttgcgcttgtgcttctagacgaagtacagagtctaaaataacttgaactcgtttttttttcctccaatacgcaagacaacaactactactacttctcatcccgttagcacatcgaaggggatacagctctacctgatgttacaattgtagctttgcagtaaatgtgctcctcgcttctacccgaactcgtgatttgtgagttggcgcgatgcgcgtaagagcaattataatataggttataagctagctaaatgctgaggtggaggagagagagaggagaagctggctgtaaacttatagccggcttggatacaagaaccaaaaaactatataagagagataagtgggtcctatattaattataaagagctaactattacttcctctatcccagtaaaattgacgttttaaggttagcaaccaagattagttgttgtgcaaaattaccaaattgtccccatgatttgattcagcttgtcatttccagcatttatatatgcactcagaatattctagaggatgtttccagcagtaataaagtaaccacaactcactgccacgtgtaacagggagtacataaatcggcgccttggccacacgtttgataaaggggcaaagccattattaacatattcaaaaatttgaatcaaccattaaatttgctttggcgtctaaagtgcctcttctctgtgtagcgacatattttttgagataagcctggggcgttgaacgtcaattttactaggacggagaaagtatatggataagctgagaaaatgcctcttatagccaaccttgctcggacgcactgtggactgtgctaacatggcgagcccaagtgcaaactgctcgagcgagcgaagcagcctcggtaccaacgccaacgaattgctagtagatgttctctgtagtctactactactagtctgtacgtgtcatcgacgcccacgacgcgtgtggtcggcactcggcagtcctgccacgtcccggccgcgtgcggcgcacactcaccagcattggcagtatctgcggcttgccgccgcacgaccgcgcggggtaggtgggctggtccgtgtgcagcgccctcaccaactcgctgtttgggccaaactcaaagctacaaattccacacacatgtattcaagctattggatcgtcacaagattcagaagtcaaagtgtttagcacaaatccaaggaataagttcacttggtgacccttaaaagtgattgaaatctaatccgtaaccctaaaccataaaaccagatattttgacccctaaactacggaaaccggtgcaatttgactccctcggcggttttgtaggacggtttcgctgacgtgacggtattgaccgggttttctttacacatagcattgatgtggcgcttaggtggcatttcaattaaaaagttatacgtgggacccatttgttattcacacacacaattgtggggcccactgacatgtggccccacacgccatcttctccctttcttctttctcccctcccttatctctttctttctccctctcccctacagccgtccgcggggagctagcggcggcggtgacgacgaccatgggctagagatgaagcggcggccgctcgccgttcctctcgcaccaccaccacccgcaccacccagtgcccggcatcgagacgtcggcggctaccgagcggcggcagcgacagcccgcgggc

SEQ ID NO: 52736 - DNA, 5819 bp, Oryza sativa
tcccactgccgggccgagctcgttgtaccccgccgcgtgtgcctcccgccgccgccgctgtggtctccttcgtcttcgtcacggtggagctcagcccgggtgccgccgccgctcgcaggtcgccccaccatctccgcctgctgcggaggagagagagagggggagagggaacggcgaggagagagagggaactgaggaggggagagagaagggacacgtgggtcccacaatctattttctgtgtcattgacaaatgggtcccacacatattttttaattctaaatgccacgtcagcgccatgtgtaaaggagagccggtcaataccgccacgtcagtgaaactgacctccaaaaccaccgagggagtcaaattgtacaggtttccatagtttgggggttaaaatatccggttttgtggtttagggtcacggattagattttaatcacttttgagggtcaccaagtgaacttattcccaaaatccaataatacatggttcgaacatgggctggctatatatagctcctggagtttagtcgtgacagagaagttgcatgggccatacatgattctgtcacgcgtcgttattactacggcaagcctagttgccatcccagtatctaaacaggagccgtcacgagttacaggcccgaagcctaaacgtgcacggtgatcttgttcgccttctcctcgttgctgtcgagcttgatgcccttgtaccacacggcgcacgcgacgtacacggcgaggtcgaccagcgagagcgcggcgaggaggaagtagaacctgtcgaggtggccggagttgaggttcccggggatccacccgggccgcctgtcgccggcggtgaggctggtgaccacgctcaccagcatgatgctcacgtagttccccagcgagatggacgccatgcacagcgagctcccgaagctcttcacgccgtcgggggcctgcccgttgaagaactccagctgccccacgtacatgaacacctccgacgccccgatcagcgcgtactgcggcacctgccacagcacgctcagggagctcggctggtccggcgcgcccacccgcttcagccgctccacctccaccacgccggcgaccaccatggccgccatgccgaccacgagccccacgcccatccgctgcagctcggtcagcccctgcgggttgccggacaggcgcgacatgaccggcacgagcacgcgccggtagatggcgatgaacgccagcacgctgaggatgtcgaacaccgacatgctcgccgcgggcacgtggaacgacccgatgttggtgttcatggtggttccctgctccacgaacagcgacgccatctgggtgaacaccaccgagtatacgatcgtgcacagccagatgggcagcatcttcaggatgcacttcacttcctccacctgggtcaccgtgcacagcctccacggatcctgcatgttctccggcgtgcagtagtcctcctcggtgaccgtcgccgccttgtcaaggaacctgaacaccaaaacacgccaccaaatgcacatcgattatataggaaactattctaatccctcgaatggatattccctcatttgcttaaaaattatctaaacggttatgaaaaattctgaaaaaatttgataacattcatacaacacatatatacatctccacaaaatcttaagtccaaactcaactcacacgtcgagatataaaaaagacaaattcagcatatgaatagtagcgtactgtttatatctaaatttgtttttttttctcgatgtgtagatcgaatttgaacttgaattttggtggactagtaggtatcattatactctacattgtcaaaaaaaattttagaatttttcacaactatttacatcgaatttagaagaaaaaggtatacgaggggatatcccctcgagggattagaatccactcccgattatatatctcgaatcaacactgtttgatgcctgagtcaaacggcaaatcgatcaaagtgcattggcacatcgttcaaacaagatattcacctgatctggtcgctgtggaggatctttcggatgccagcaatctgggactcgtcgccgtcaacctcgtgcaggagctcgctgcgtggcacctcggcgcgccacttgcggaacgcggcgacgaacacctgcgcgatgcgggtcaacgggttgccggtcggcttgaagtggcggtagttgggggtgccgagcaagaagagcacgagcgccatggccgccgccgcggccgagacccagaaccccatgacccacctcccctcgtcctcgtagtacaccagcaccgtgttggagaagagggagcccacgttgagcgccaggtagaagtagctgaagaaggccaccttggagcgggcctccctggggtccgtctcgtcgaactggtcggagccgaacgtggcgatggacggctggtaccctccgttgccgaacgcgatcatgtaggtcgacaggtagaagagcgcgacgccggcgctcgacggcgcgtcgcagtgctcccccgcggcgccgcagccggtgggcttcaccagcaagaaccacgacgcgagtgacagtatcaccaggccctgatcatcagcagaaagttcagaacaacacacacgacgcgtagttcagcaagatcattccaacaacagaagagctaattaaaaataataataatataattaacttgaccatcgtaccgtgacatagatcatctggaagattgcacacgtgatgtatcggccccagtaggagtcgctcatgaaggcgccgatgagggagaagatgtagaccgtgccggtccacttgctgatgctgttggctgcctctgcgttgtcctggtggagcacccgccgcaggaacaccacaaggttcaccccgacgccgaagaaggcgcatgtcacgagcccatagttgactgcatcaggaacacacctgaattaactgtccaatcgatcccaaatccaacttgtaacagcttatatattgaaaaacaagattaggtagattctgcacatggctttggaagtgtcctaatgcaacacaaggttgaacttttttttttttcgggaatacgaacacaaaggtttaacacagttcacaacaatcggtcttctgaagtaaggttttagtcaggttggttattgcccatgcagagtaaatctggatgaagagcaaaacgcgtagtgttaaacctgaagagtacagaattgatagctttccaacggtggatcaacctccaggtttggctgccactcaactggctagaagctctgcaagaaggattattcttgaaggttccagttggtggaaatctgaagtctgaactgcatacaactcagacagcgaagtaggaatttactagcaaataacaagctataaggttgtgatcacactatgtgctgacaatattagttcatagttctttgaagactgaaacataacctaatctaatcaacaaccaacgttgtcatgttgggaatccaagaaaagcagtttttcaataaacaagaaaccaatcttattaaaacagttaatttgtagatatatgaataacagaattaaagtaaaacatagctttacctagcaagaggatggaagatctccaattcccagtttttgctttaactgccggatttcctcgcctgtccattgatccatcttcagtgatgtcagaaatccttttcgaatcgacagcagttggagccattgccttgctctatgaattttccaaacaaacaacaaaacgccgatcacctaatggctgatttaaaattttatttcaagaaacaagtagccaaataagaactaaacaataggaaaaaaaaaacgccgatcacctaagctcttttttttttctagctttgccagttccagaaactacaatttcattttcaataattgtctaggtttgcatttccacctaccaattaggtggtttatgttggacaataaacatcatgggtccgatgaagagacaaggggttgcactcacgtgtgcgtaggtacaggtgcatacgtaatggtttgtgtacatatatacatctttggtgtagaaaaaaaaaaacttccattaatgtcagctggagtatcgtttcggttcgatactttaaagtccatcgatacatgaggatgacctttcgttcaaaaagaaacatggagatggcagttgtttagtttctttctttccttttgatgttcctggaccctttgcaattaaaggccagagttcatctttacttgcaatagtactcagatgaagcaagtatgccgcgtgactcttatccgagcgaaaacaatgtcatgctcgaaacgtttcttcttggtttaaaataatacccctccgtcccagatataagaagttttaagattagatacgattattaagaaagtaattagaaatgagtagtggagagttgtgattggatgagtagtggaggtatgtatgaaaagtaaatggtggggattgtgattggttgggaaaagaatattaatggagaagttattatattttatgacaaatcctgaagtctaaaaattattatattttagaatggagtacatatataaagggcggagctagctacgttcatcaccaaggttagccgatgaaattccaaaatcatttagtaaagaaaaaatttattgtacttgagaaaatatctcgagatatcaagttttctatattaaaatttttacgctataaatattgtacctttcggtgaatagtaaaattatcctttagtaagatattgtttgaattgatggctcatcacgctatataataaagctgacgctgatgatagtttcgactgatttcgcctcttactctatataacattttgttcattacgctggagcgtgcaccaagcgaagaactggactaactagaactcgtgttgtgcctgaagattgtcccgtggatataccttacctttctgtttgttgttatatatcgtcgcccttgtggatactttctcgtttttttttatcaagggaaaacttccgggccttttttgctttaacctgtgcgagacaatcttgtcagagatgcactaagcaagtaattaaaagctgaaacgactgaagaaaagatacctaacaccgacaaaggggccctcgtccttttccgggggcccatacgtcagtcgggtgtttacacagcccatacgagctgaaactccttttttttacgtgataaacaaggagcttgagtggtggcaccaagcttgtgcacagtgcacagtcatatatcagactattcataacttacagggtaccactaccatctccaaacgtgatggcacatgtagtgtatatcacacggccacaccaccggccggccctacgtacataacacgtacgcatctctttgtgcaagcgtaccttcgctgatgaaccctccggtgcggacgcgcagcggcggcagctcgcacttctccggcgacggggacgacgacaggcacgtcacaaaggaagcgacgacctccacgacgacgacgacgcagctgctgcccaggcgtccagtcatttaccggcgcgagatcaaagtggtgtgtgggctggtggcgaacaccgcaagccttacctagctaaatctcctcaaacaacaacgcggtagctcgatcgcgcgcaacgacgcgatcggagaaacgccgtgctgccgcgcgcgcgcgcgcgtcggctgctgtgatcacccgcgctccctgatggaacgatcgcttgtaccgcgcgcgcagacgcagccggccggcgcgagcgcgacggaaacgcgcgtactgggaggtgtgggaaatgaaggggggggggggg

SEQ ID NO: 52737 - DNA, 27436 bp, Oryza sativa
gctagctagctagatagcgggtcgtgtgtctgggcggtgtatggggcgcgtatttatgggcgtgcgtcggggtcgggccggcggtgttggatgccgttttcgtttcctcctgcggggccggggcgagtagtggccgacacatatggcactgtggttgtgtggcagcgtgcatgggccgcgccagctgtttccctttaggccttttccggccccaaaataacggggatcctgtgaagtgcttggcagtagaccagagagaggcctgtgaatttcaccgggagtacgtaagaccgtgcgtatgcttaatcgtcagaacaatgcacgcacgcacgtctctagtgcgtgtacaacagtacaagtaaagtcagatggatggacggttgatcaggtttaggtcgccgtcgcgaggacaatgctactgctgttcgtagcgaaaaaaatgcgtcgtatagtacataaggggtacatggcgtaatgagctggaagtaccacactttagttagttgtcctccatttttgccatttaggcttgttataagctactccctcctattttaaacaactatccaagaaactatttatctttaaatcttgacaatcgtcttttttttaaaaaaaacactgaaaacttatattattgaagtgacattctgaagttgtgacagtaaaaacgaaacagtaatactcctatttaaactagatactattatcttgaactcacccggtgagaccgatcaatttttttttcacgaatctgcagttcgtatggtcactagtactccaggactacgattccttcgggaacaaaaaaacggtagagacacgtgaaaataattattgtgatcgagatgcatcgttttaactggctaagcgtcctaaaaggatctcaaggacaagaaattaaagcgggtcgctgtgcttgctggcgcgacgtgattgaacaacattgcgacctaacgaaggacgtaagacatacattaattttggaggtatgattatgttttcagtcccatggatacaaaattaaaaccatatgtactctgaactctgaagttccgaaccgtagcctctcaaagattctccgcacacaaaatatgcaaacaactaaaatgaaatggatggttgcgcttttttatgcatgaggagtatgttacaaacgaggagaagtactaccagtacacgctctatgcaaatgtccttgttgatcatatattcaagcacgttgctcgagttcctcccgcgtgccacgtccttgtcagaaatttcgagagttttggcagtttaatttgtcgttggtttactagatatatgcgcaaccacatcagcatgacagtacgtaaaacatcagacgcatatataaatccgtgcggcattcaactggcagctgcatcgttccaaattactgtaacctgtgcaaaatgccaaaatctcccttccttcgcggatgttctccctcccctcctcctttgacttacgtaggcctcgaccggccggttacagtcttacggataacttatgctccagcgatgcagctgctatagactgtcgtcataacaaagaaatgttgtttaattacgtcctccttattatgccacttctaacagtattagctggcatgcagcacgtccctacgacgactctcctgcggccggtacgtgtcgtgagatcacactactcactacaccagctcactgcactgcacgtatcaccgtctagtgatcaactgattatcctactggttataaggacgctagattctcgcctatccgacgcacagctcacgaatccgacacgcgcgacgccctccacgccgcacgcccacccacatgccgttcactccgctacgccgctagctgcccctgtcgccgtcgcgggcggcggcgtcagcggcgtacgtacactagggacaaagccagctaccgcactgatgatcaccgcgcgcgccgtagagtccaaagcgaaatcggccacacacactctgcctgccgctgcatatgcatgcggcagtgctcttgccaaactacgtaacgcatgcatgcaccgatcgaggcggccgccgtccgatcgatctcgattgcctgacggcgcgatcgtgcaacgaatcttgcacaaaatccaggcattcgggcgaagccgcgaacgtcgcggctcccctccttttgcagacatgcgtgaccgccgctcacagtgctattgctttcgctgacatagcgagtgagacaccgagacggtcgtcggtcgagcagtgcagcgacgcatgcacgcatgcggcagtcaaagcgtacgtatgctttttctttctctctcgtacgtcgattgggagaggtcgtcgtctctggtgtacagtgtactactctctctacttctctagtctctgtagtccaaccaaagagaggcagcaaaagatcaacatggatacagccagaagtgataagttatcactggatccaggtcaccttatgcatgcgtgcctccagatcaagtgaattgtgcagcattgtcgctttcattaattagttgtgtcacgtcaacgttcttggcctgttagcagcactccagtctccagctagtgctcctgtgttttacgcttttgctgctgttggatgttgccgaccgaggtcgctgatagatgctggattgctgccgacttatcgcggtttgttggaatcttcctctttcagacacaaaagaaacaactttgttgctggacccgtcaaaaggtaggggagaaaaataaaaggcagagaggataagaaaatatcgccggtgaagtcgatgtggcgtttgacagagtacagttgcgtgaatgcgtcgatcgtcgatcactgtaacggaccaagaacacttcagtggatattagctgtatgactgtatccggttagctcaggacctagccatatctagggtccgcatatcaacgagaaaaatgaaaagcgaaacaacaaaaggactcaaacgcccgtgtagtagccgacatgtctaatgttttggaacaagttcactttgagtctcttaaaaatgacccgaatctaatccataaccctaaactgcaaaaccagatatgtcgaccctcgaattattgaaaccggtgtaatttgacttccttggtggttttggagagcggtttcgctgacgtggcggttaggtggcatttgaatttaaaacgtatatgtggactcggttgtcattcacacacataaaaattgtggggcccactagcatgtgggccccacatgccatcttctatctctttcttcttcctccctgctctctttctttctctttctcttctctccccataatttttagggtaaattgaaaccatgccattataattttgcaaagtttgagatataccatcggtatctcaatgacatgacatgtagaacccacatgagtcaatcacatgtgggtcaggatggcatatctcaaattttgtaaaattataatggcatggttccaattttccccaatttttatgtgtgtgaatgacaacatgtggagtatacatttttaattcaaatgccacctaagcgccacgtcaaccccatagactaggtcaacaccaccacgtcagcaaaaccgtcctccaaaaccaccaggagagtcaaattgcaccggtttcaatagtttggggtcgagatatccggttttgcgatttagggtcatggattagattcgggtcacttttaagggaggcaaagtgcacttattcctaatgccttctaacacgatttttacggcccgtttagacccatagcccacaactccagttggaattcacggcccattataaatttatgggcccagatcacggcccatgcagaaataactgcggcaactgctcactgctcagaccaaccagaagccaaccggagttaaggaagaagggaaggaaagccacccgagcaagcggatcacatcgaggtaggggaggaccggaggagctgagctcagctcggtgaggggtggactgggagtgcgtgggtgggtgtgatggagtggacgacggtggaggcggcgaacggggccaagctgagcgtgcggctgttcaagccggcggcgggggcggaggcggcggcggcggaggacgtcgcggtggtgctggtgcacccctacacgatcctgggcggcgtgcagggcctgctgcgcgggatcgccgagggcgtcgcgcggcgcgggtaccgcgccgtcaccttcgacatgcgcggcgccgggaggtccaccggccgcgcctcgctcaccggctccaccgaggtcggggacgtcgaggccgtctgccgctgggtcgctgacaatctcaacccgcgcggcgtcctcctcgtcggctcctccgctggtaggttgctgatttttctttttccccaaatgacgtcggtgcccttgtttcattctcaccgaagcttcacagaagagggttatggtaatcgaccaagtgatttgctcattagaaactgtattgatctaactgaatatgcaattggcgattagccacttaaatggacctgcaagaaaatagaaacagcttgtgcgttgcagcagaactgaagtatcaggtttttggtcttatggatttggcatcaaatatactagcatgttattatttcagtgtctttgaagtacaaatacagagttacctgggtattagtcacattgatttgttttaggtgactctgtgcagatgcaaagtaatccacaagaagtttcaatggcgaaatttcccttctgtcagggtagcctagtgtcctcagaagcaacgtctcttgcttgtttacagctagaaccattgtttttcagcaaatcctgactttaggcaatatatcataacctatttttatgagcatatttacatttagttggttgcttctaggtgtacctacttctggcctattcattagctgtggctactgagacctactcaaactgaacctcttcacgcgctgttccctggactccaaagtcatacatatagttatgatttaagatttatgaattcttatgatttagttatgtcaagttgtcaacagatagtgctgcaagtataactgattatgtgtaaaacaattgtgttaagataatgactcatattccacatacaagttttcttcaaccattcttgcagctgttagatcatgcttagtcatatatctatatccactttcctgatgcaggagcaccaatagcgggatctgcagttgataaggttgaccaggtcattggttatgttagcattgggtacccatttggtctaatggcctcggtcctatttggcagacaccacaatgctatcctcaagtctgagaaaccaaagttattcgtcatgggaactaaagatggcttcacaagtgtaaagcagctgcaaaacaagctcaagaatgcagcaggacgggttgatactcacttgatcgaaggagctggccacttccaaatggaaggccctgcttttgatgcacgaatggttgaccttattgttaatttcatcaaatccttgcccaaatagcattgacagtgactgtgtgcaaatttgtcatgattgtagtgagttagtgacaaacaaaagaagctattgaacagtgcattcatggtgtgtattttctcatcttgtaattgtacacttggtgttgtaattttagttcaatccgtgtttctttcgaagcctagtgtaagatgatgagtttcagatacaatacatttacaggatatgacatttcatggtttcagtcatcaagttgttaccctgcactgtgatcaatttcttccagatgttgcccattcagtatgtacatgcttctccttgtgagtgcaagtggtcaatatccttgccatttaccagtccaaaatatatactcattttatgataatggaacccaacagtttcctggttcaggtaggacttctgtctgtcgaagtcttatatgtttgttgaactgtaactttatcttggttatataaatgctgttgatctcatccattttttgttgtcaggcttttggtggcctttgtgacgatgaatgaagaaccgagttaacagtttcagaatcctgttgatccaaagtatattctttaaacattttgcccgggccacgttagattcggctgtgttgtttgaggggttttgtcagctattaagacctgactgatgagccaactaagatgggaaagcatatgcaaggttgctattctcctgctgttgttgagtctgcaatcctaccaagagctaagtgccagttaactttctgtcaaaaactggtgcagaaaaaagacttgcagcttgcaagttttttaagcttgtagccagttaactcgtcataggttagacttgaatcgagctaagagatggctaactcaacttgcatagttatgcttctacagaaaattggtgtctacagtacttttagttatctgtcagcaaatggtgtgctggtgtggtcatgcagtgccctcaagagtgtggtcctaacttgctttgctttacttgtaaaatctgcatcgcagcttcagtgcaatgtttccccagctgatgcgatactgatgagactcacatgctgatacagaggtactaatgaaacaggcaggcttttcttgcccatctcatgtatcctgatgactggattatacgctcacgagtcatgaacttatccgatgataaatatccgaaatgaagaggtcaaatgaccccccccccctatccaaaccatatctaaatttcaaaagaactagctggatggcccgcgcaattgcgcggctagcatccaaacaaaatcatatctttttcagtattattttacttaagatttattaaatagctatccctatacttttaattatatagtttttaaaagtcacatcagctgctaccccttacttttatcagatacttctttatttgcttgctcggtctaccactatttttattcattctccttaaaacctttaaaatttggatcttatttgagtttattatctcgttgggtttcgtttttataatttctagaagtcccgtcgaacgctgccattatactcctctacgggccgtccactgtcttttctctttattatcattgggattttacaaatcgaatataattatcgttcgggatcatttttttactttctataagtcccgccaaactgtcagtggctttgccattatactcctttatggctcgcccgctgcctcccttctttattgtcattgagattataaaatcgaacatgattatcattgttttttttttactttttagaagttccgaacctttaaaaattggaccttatagtttttagactttattgtctcattgggtttcattttttataatttttagaagtcccgtcaaacaatgccactatacttctctacggcccatccgccgcctattctttattgtcattaggattctaaaaatagaacataactatcgttggaattcattttttattttctagaagtctcaccaactgtcgacggctctgtaactgtactcctatacacgccgcactctacttctcgtttttgttatcattaagatttttaaaatcgaatatgattatcaatgggtttttttttactttctagaagtctcggcaacagccttatccgtttgcttcacgtcctacctgtcgtcccttcttttaataatcattaggattcaatttggtgttttactaacagtttttatatgccgtatcaaccgctaccactctactcttttataggcatgttaattaatttatctcgtcatgtgttttagatagtcttttttttccaatagtctttattttttatcatcaatttttgttatttataaattgtattcctaattgaattcttttttcttttttaatttcagaatttattttttttcaaaatttaattaatacagtatagtgttcttttaatatttttattttttattttttgaattccagttgtttcaaaattgtattcctacttgaaatctcttttatttttctaattttggatattattttattttttattatgaattttaattaatctcgtattgggttcatatattttcaatattgcttatttttaatttatattttcaatattgcttatttttaattccgaatttcagttgattttaaattgtattcctacttgaactcttcttttctttttctaatttcagattttatttttatttttattccgaatattaactaattcgtattgggttcttatatggactcctatctcaatattccttatttttcaattacgaatttcagttatttttaaattatatttctacttggactctccttttattttctaatttcggattttattttatttttattgtgaatttcgattaatctcgtattgggttcttatatggacacttcttttaatattgcttatttttaattccgaatttcagctatttttgaattgtagttctacctggactctccttttctttttctccgattaatgtgggaatttttagcccccacagacaggggcggagtcaggattaaaggccaccggggtcatcaacttaagcttttgacagaatggaaaagaagaagattaaagaagacatgcaaaatgagtttatcattagcacaaaattaattaagtattagttattttaaatttagaaaatgtattaatatgatttttttttaaaaaaataaagaatttttttgaaaaaatatacaccgttcagcagtctaaaaaacgtatgcatgaaaaacgagtgatctcctctctttggcttgtgaatgaacgtagcctaataacaactctacacttttatgatattcgagagcagaattcctgtatctaaatgaacaccgctataattttgatttaactaaaagactaggtagatcatttttttgttctctcgattaatgcaaaatcttttttaaagttgttcttgtgttttttatcgatcaccagcaacgaatgaatgataattgaaataggctaagagcatttcctttcatcatacaaagaggtataaatctgaaattagctagtactaactgcttaactgacgaagcaaaagcacaacgacgaaacaattaattacaatgaggcttaggaaacaaaagaaaattgactcgggctttgtgcatgctaataaaagaatcattaatcaactaggatcgtaacaccaccaagtaaattgttttagtttcacgtactacgtgccaggtgaagacgatggctggggtcatttaccatcttatgccggggtcacagctggtagaatttgagcatcaccgtgcattcgctggatgtcatcggtgtcagatcaccccggtcgttagactgtggatccacccctgcccacagcgaacgtggtttctcctttgaaaactgtcttaataatataatttaataatataattgatagactatatcttttataatgtactccgtttgttcaaatgagtactagcagcgttcataaattccgtttgttcaacaagctcttgtcaaaacaagcatgcctcgtttgcaagttagcggtgagaattgaaggacggttaattgggagaaggtatataatgatgacctgacagcaagaggaacatgtacgtcttctgtataaatgcttgagagaatcatctcaagatacacagtacagtaatacagagatacagtagtgctattgcactagcgatcagtacaacctcctggttggctaccttgataagaaactgtataaaaagatgaattcaaattcaaagtaaaagagataatacaataaaaaagtatagcatgtgtcaggatacggtataatttaatacagccacttgctgcagcagctgaagtgtgctaagatttgtctcttcatggtattgcagtaaatagaagagacctgatcattctttactctgaaatactatactgctaaactttttaacttagcactgtttgagaagtatgagggcatctgcatgacttgcactaggaagcacagtacggagtagagatgaacaaaaactgtgttgacctgttcaaatgaattataaacacgaagttttcttaggtaaaggccatgaacaaaatattgatctctatctgaaataaacacctgtacagtacaggagcattgctcgcctggaagctggagccaatcgagaactgtggcatcgctttgaaagcaaaatgaccttggacgtcagggtgtcaggtgttgccgtgttgagttactactggctgtcctaggtgtttaaacatccagaaacatggaacaaaaatcccatcatggtaaaagtaaaccgcttccctagggctagggatccttctgtctttgcttttttaatctggaaaatggcaagaagccaagaacacacactctctctcagtatttttcaacggttggtaagctgtaaataaaagcataaacaaacagcaaatgactcctcagtagtagtactagtacaggagtagcagtactcccttcgtcccataataagtgcagttttgcactattcaccgttcgtcttgtttgaaaaaaatttatgattagtatttttattgctattagatgataaaatatgaatagtactttatgtgtaacaaaattttttaaattttttcataaatttttcaaataagatggatattcacgactacacttattttgaaacgtaggtagtattaaaaaagcttcatgagaagaaccaaatctctctctctctctcacacacacaaaccccagccagtgcagctgctgctgctaccccagaagctattggagcccaaccatccagaactcccagaccccagagcactagttgttcatttgtagagccctgagtcctctcctgcttcctgaacaccacatcccaatctttgctgaaacctcccgatccgcgggtacttctggcatcgcaaaccgaatattaccgccgatccattggatacccagcgtttcttttcctgtagcacctgcgaaaaattccatcttttttggctaccaaacatgaagaaatgggatgcatgatgctgcttggagtggacgccagctatatggaaggtgagtttcttgcttgtcatccgtggaaagaatggttccgatattgaatcggtccttgttttatgtttcttgttctctatcgaaaaaaaaaatccttttgttaaacttatcttgatagatgcgtattgcttgctgttttgtatagttttcatctggatatttatgttgcttgatctggatttgcaacttctttattgatatggatctcaatagacctcaaactttattgcttctgcaccccaagaacccatttcatcatgaactagttagatgtaacagcatgttgttcttggtattacgactgcagatttctagcctatcttcttgattggattgtcgccatcgcgaggtatctcggtgaaatattgagtactttccttccaaatagcaactagagaaaaacatagagcaacttcagtagagcctgcagcttcagtgattgtctgaataaatcttgtcactgctaagttggatagatgggtagaggaagaggcagaggaaagaagctaacgattgtccggagccatgaagacaaaggaagcggcgctgagaagctatgcctgcaagaaagaggaggggaaggccacaaaagcgcttcgccgataagattgatcaagtagatgtggaaaattttgtagacaatgtaattgatggcgaagaagtagaaggtgatgatgttaagctgaaggcatcaaggctagacaagaacaccactgcatctgctgctggtaacaagagaggcaggcagctgaaagaaagctccaatcttgtcctggaagagagtaattccagtgttcgatcaagcagtgatgaatcaactaggactaatggattcaggcagattggaagccggcgcaaaaacaagcccaggcgagcagcggaggcagggctagaatgcaagtgagtccatctacacaatttttcagtattcagtagacttcattttttttttctcatcgtcttctcttcagtagttcctcaatgctgcgaaatgtaagcaaaattatgtactgattgctcagggttttgccaatgttgaggcaaaacaaatgaactgatagtactgtacaccaacaggtgttcagctgctcttccaagctgaatactattttggcctgcttgtagcagagctctcaacagctggtgatattagcagaaattcctgcaatcttgattctctttgcctcttagagcagctcagtttagttgctaaatagacggtgttcctagcctggcaacgctggataggtttgttcttaccttatcttctgagtagtgaaaatccagtctgtttgttttttaattagagctgtatttctaaacatttttatctccatttggatactgtcatatttcacattcatacttgagaaaaacagcacagtacagttgcttatgtatatatgtacaagtgtaaaaccgaatttggtctaccattatatatgtagagcggggttgggttgcatcaggagtacttcgaaaccaaatttttgcatcaaaaatagaatatttttggtataaactcatctgaattgtatcactgtttgatagcgccgtatttacaaacgtttttgtgtcggctgagtactaaacctgagaaataaaccgagggcgttaagtgtagaagtcaaaactaagctaatggtttcagtggctaagagtatttttaaagcaagcactgtctggtcttggaaacgtggttaatgggccaccaccacggtagcaccaaactaaccttaccagtcatgtgctgatcctgaggacagatccaacgtataataagcatctcgtcggtcatttcgctttgccatgcccagcagtggcatcaggctgcaatgagcgcgcaccataatcatctagagctagaagggtgtgtttagttcatgctaaaattaaaagtttggttaaaattagaatgatgtgatggaaaagttagaagtttatatgtgtagaaaagtttcgatgtgataaaaaagttagaagtttgaagaaaaagttgggaactaaaccacgccgaagacacggcgaggtttggcacggagacgtggcatcgatgcaggtttcactgtagaatcagcgcagaggaaagcagagcgcgattcatcagaggcgccgattcgtctggtcgccttgacccgccctcgtgtcgtctccggtcgggacgcgggagctgagcgggcggcaggcaagccaagcggctggggccttttcggcaaagccgcgccactttttaccgctcgtgactggaagagaggccgcacgccacggacgccaccgcgccgcgtagacggttgggaaaaccacggcgagatcaccatgccccgcccgcggtgggttggcacttcggcacggcggtctctcggaacgggagtgagtggcagggacgtgcgcggcgcggcgcgggacgtggccgcgagcggtggcagccggaacggggaatacggggtgtgtgtctgggtgatgctgtcgcgcggtcgcgggcgcgacatcatgatggatcgctggcgacttcggctgccgggggccgccaccgccacctcccgcgtctgcgtctccaccggtttcgggccccggcgcggcatcattgggcaactctgcatctcgggggagagcggggtgacggctacccaaggaaggagccaaatagatatgggactccacgtgctgcaaaaaccaccatgattgactgccatactactattccaaagttcatagtatttccatgccaaaacagtggaacactccgcatacatatttgacagttacctccgcgtgagagatcagagagttaagcataaagaaagaaaaagatagagttaagcacagatcttaaaatcaaatggataaaagtacgtaattttgaggcacacaacttatacggatagatatgttgtgaaaacctaaaactattgtaggaaaaagaaatgaacgtttaagatttgtgcatgtcatcgtgagtttatttttacttataatgatatggataaatttgagacgtctatttttatatcctataataatacctaggttttcaatatggtttctactgcatattttagcttatgctcatacaaactcagtttcattgaagtgtacgaatcagtcatggctgtgaggcccgtgacacgagtgaaaggcccgtgaggccgtgaagccacgcgcgagccgaagtgggcagcccacgtagggaggaggcccaaggctcaagcccgcgccaacgttgcggccgagcgggcgagcgggcgagccgcgagcgccgccgaggccgagccgagtgagaccacgccgccccgtcccccctcccaccccctctctcctctcctctccaaccacgccgcgattcccccatttttacctcactacctccgcccccgaaaatcccaacaattttttgatccttcgccgccggcaagcgccgcggagggttccccccaggtaagccacgcgctgtcgcctccgctcgatcgccccgcctcctgtccccgccgctcgccgcgggcgtcgctccggctcagatcgaccagatctcgatcccgtttctagggggtttggctcacgttactgttcgtgcagggagtggagaggagaggagcgggcgggttggtgttgggaagggagggatggggttggaggaggacacgccggtgacgaagacggtgaaggccgcggcgacggggctggccgcggggaccatctggggcacggtcgtcgcgacatggcacgacgtgccccgggtcgagcgccacgtcgcgctcccggggctcatccggacgctcaagatgtgcggcagctacggggccacgttcgccgccgtcgggggcctctacatcggcgtcgagcagctcgtgctgagccagcgcaagaagaacgactacgtcaacggggccgtcggcgccttcgtcgccggcgccaccatattcggctacaaaggttagctgatgctgctcgccctgttcaacacattcacgtttgcattcattcacacttgctagtgtctgtgttctgtgtgttttcaggcggattaaaccctaactggtagctagattatttacattatggacttttctacttagattgaaattggatgattcaataatatttacttcgtgttccatagatcatcaacactattaccttaagatataggaacccttttaccttggtcatgttaacttattgaaaaatatcgtcgcgctggttcctgtatcactaaggtctacacgtaagcgcaaaacttttaggattaaacacagtttatatgcacaatagttccatgagaatcatttccatctaggattgaacacgttcgttcaaaaatgttgactgcttgagttagctgctatactaggctgaccattttttggtgggtgtggtagagatataggttgctagtcacatgcttatgcacagaaaatatgtggacaaacatgtgactaacctaaggtgtattgatcaaggaaccaccattagatacctggagcattttggattggttcatcctaaatttggatgatggcatagtttgtgctcctatatcaattggcttctggtgactacacagtaagagttattgtgtggacagatacgggtcaaacatatgttagaaatatttgacactatttttgctccctttttttaaacataagatggattctaaacaggctatgctttcaggagcatgagctaatcctcaccataaaagtacttttgtttgcctgataatcttgcattgaggttgctatgaggttaataagatatttatcttatgcaataatttcttctagatgatgctagactagatctaacagccagttaggcttatggaactcattagcatcacgagataactgttatgaaacaagttagagacaactttgaataatggcatatgtttaccattcaacccaaaaaaaaagcattttcttgtggtaaagtagacaaagctgtggtgtcatgggcttcagaatgatattatgatgtcattggctagtatcagctgacaatgtgctttagaatgatattatgatgtcattggcttgatcattttctattcggatgctctattggttgtatttttattgcaaacaaagaacctaagtaggactaatccagattttacaaacacttgatgcccaatgaaaatttttataggggattcttaacaggtgccccatgatatttttctgctgtgcgtagtatgttcttgctttgtacctgaacagctgttccatgtgtatcagttttactaaaggggtagtactcagacatctcacgaactgttaactttgtttttacctctgcatatcaatcaatggttatctacgaagccagcatgtaatgatcgtatttgtaatagtcttgtctttatttcaccaatcaattagtaattttatagttcagtatattggctagaaagactcatgtctgttaatctggaaatgcccaattggcaggaaggagcatcccttctgcgctcatagctggttcttgcctggcttttacatctgctgcgctggacgttggcggcaacactaccagagtggacaatggcaaagagtactatccctacacagtcgagaataagcccgctcattgactgaagttctgtacgtgtagcccaagtcctgcaaaaccgtcagctcggtgaattttgaagctgatgcttactttcatgtctgttttgttgatgtactagctcctttgcaaatccttggcattgttgtgctcgagagagacctatacaacagtctcggaataaatatttttgcttgctttatcgtgatcatcgatcacaataaacgccttcacgatgcttgaaacatctggttttgcttgctttctcatgatcataaatcacaataattatttcctagcctcgaacatcatgtgatactgaaattttcatactgggatactggtcctcccgtttgaaatcagaaaatctagagtgcggtgcactttgggccaccttttagtttcacattggaccacccttaattcaatcttttcactttagattatctaactttagtttgttacactttgaccatgccgactcttttctctagacatgtctatcctaggtggaggatttcattagcgtgccacagtcaacatcctggaggtcgttgatgtgttaaagtggaggtttgggggtgatctaaagtgaaataaacataaacttagctagtccaaagtgaaaagattgagggccagtttggtttgtgaccaatgttggccttaccaaaatttggcatgacaggtaaggccaacatgtgtttggattgaagccaaattaactaatttggctattgaaatggcctatgttatataggcatgccaaaatttggcttcaatccaaacatacacaattattgttgaggttgccaaaaaattagcaagcctaatttaggcctcaaaccaaactggccctgaactagctcgtttgggaagcttctcatagctacagcttctcccagaatcaaaagcttctcaaatagtttagtttttcgtctagattctgataagctatagttgcataatttaaaaaatgaactagaagctagaaactagaaaaccagaagctagaaactagaaaacctagttttttagattctcggaagctagctacttcctccgtttcacaatgtgagtcattctagcatttttcatattcatattgatgttaatgaatctagatagatatatatgtctagattcattaacatcaatatgaatatgagaaatgctacaaatgacttacattatgaaacggagggaataccaactagttgctttttgtaatcctaagctatccaaacatgccctagaaatggtccaaagtgaaaaaaaaagagggcccaaagtgaaattcacccgaaaatcttaagaaagtgggacatatagacaggataaattatgcaacgaagtgatacgttcttcttccccgtgttgctcgcaggcatacctccactatagcgatctcttcatggacacgtctccgtcgccttcccacgcatcatcaccgtgccctatgctgcctgcccgacggtttgcctcaaagacttcccgtgtaaccatgctctatccaggtcggccccatcgagccacattgttatgttcgagtgttcgtggaagcgacagtagtttcttccttggctgtgatgaccatggtgaactcgagggaggaaaggcgcgtggtggcgcaccctgctcgataggtgacaaggcgctctgcatgcatattgggtgacttgagctttgtgccaggccactccatgagatcatttctctctgcatgtactacggcgttcgcctctagcgatgctaggtatcaggccataatacataggtagcacgtttgttttctagagtaccatgtctgatacttaaatatcaaatctggtaccactcaaataccacatgtaagaccaaatcagatatgttgacatcattataatatcaaccatctcgttccacccttttaaggtatgggaagtccctcaacagtcaacatctattctttgaagatggcaaaatttgttatggacacccaaaaatcatgaaagttcgagccattaatttggttttgatgattaatgacaaatccaattatgtgagactaatgtttttataagcatttctttgcccagtctcatgtggatatgaaagtggagtgtgtgagaggtgattcccggacttcatatgagttgagatagaatcattcattgatggtggacctaaatcacaaggatgaaatgtatgaagatcaagctatgtgtatcactctttctctccatatacatattgatatgttcatatataatatttccacgtgattgacatatgcatgtgagactaatgttttgtttgagtcttttctcttgtttagtctctttatattgagaacatgaagatgatgaaggtatacctttattttaatgcctatatttgacaaatgccttctattcttatataggattagctcctaatgtttccttctttttatgcatactcttgattgacacaaacattttgtatgcatacatcttgggggagcaaatcctatactttagttatgcatgtaattgatccaagttattaaatttcatttaattgagatctttacatgtgagcatatgtttgagatatgacacttgtggtgttgattgatactcatcatttatttatatccttttatacatgcgatcggttggtcaacatgtggatgttgacaaccggatcattgggactaataattttattgagttgaatgaaagaaataggtcccaaggattacaaaggtgttgatgctcaagtgatatcattacacctaacgataccaagaatgacaaagtgaagatattgaagatgtgggatacgaagtggctactatggcaagacggtgaagggtaagcgatgctcggtcgcgatggaccatgcagcggtgaagggcaagcaaggggctggcgccgaagaaccaaatccggtggtgaaggacgagtgacggctttgtcatgatggaccatttgaagtaaccacattaatcatttgaagaatatatggtgaaacggtatggcattggcgtccctaaagacaatgaaagaaagatggaaagaaggcattcctattggtataattctcttcctatttacatttgagtttaggaatgccgtactattaagagggatgcaacgtcgatgtgtttatgtatgtctcggtgctcaaagtgacccaagcttaagagaaacccaagctttaacctatcttttgagtggctttaggcgttgtttttggttgagttgggtcgtcctctgagtgagctttccatagagtccaagatcataaaaaacggactcctgagcgaaaagttatagtcgttttactctgtgcttttcggaagttccgaaaattatcggaagttccaaaaatggttgcaaaactgagtttagcttatgtaaattttcgtaagtttcgaaaattccagtcttttgcctccaacggctagtttttgaggggctcgggtatataaactcctccacccctcctatgagtggctgctgttcttgggcaacattagatacatccaaacccaaatagctatccccatttcccatcctttgtggtgcctttttgtgagggggatttgagaagggaagagagttggattgagagattgagaagttaagagctagtgagcttcactccatactttgagcactcgagttcatagcaagcaaatcttcgattgtgtttgttactcttggggactaaggtctcctagacggctaggcgtcgccggtgagcacccaaggttgtggtgtaccacggaaagtttgtgaaggcttcgctttcgcctccgcaagagaagaaaatcaagagtgaaaccaatgagtgcatttgtgcaacctcgtgaggaaagggttgaaatagacccggcccttgtggcccctcaacagagacgtaggatccgtggatccgaacttcaggaaacaaatcaacgtgtctcctctcttggtttgctcgttcttgccatctctcatattgtgcttgagcttgtttttgcctgatctacttgcatgcttaattaatatagttggtgaccttatatcttgcttagatatcttatttgtcaccttttgattcatatacattttgtttattcgtgctacaagtccatagctagtgttttattccgttatccgctgaacctttcggttgagatcggaactttcaatcccataccaaaagttccgatttgaaccgaaagttctcatctatctaatatgctatgaagttgtggtaattttttaggaacgcctattcaacccctcccccaccccctctaggcgacatcaaggtcctttcaaatcatgatcattgatgatgcgtttagttggagggatatgatgggttggattataaagaactcgtttttcatagtgtttggcttggaacaagtggaatgatccgttaaaggaattccctctagatctggttagctccatccctcaaaagtggatcaatctaatccacttcctcttgacatgtgggccacatcctctgaaactaaaaaaaaaagatcattaacacataaatgaaaccatcccatcctaaaaaaaactaggatggacctaacacatcccacttgatccccaaaccgaacacatgctaacaaaatatgatttttgttacatggcactcaaaataaattgtactctctattatttaatgctgatagtgttcagcagcaaatgtaactatcttgttccagccctttaggtatgggataccgtccctcatcatcccttttttgaagtgacaaaatttgctactccctccgtttcacaatgtaagtcattctggcatttcccgtattcatatgtttagatttattactatcaatataaatgtgaaaaatgctataataacttatattgtgaaacggaggaagtaaaaaaaaaaacttctggtatgagatactgtacgtcatcatctcttctttgaagtggccaaatcttgatacacgacaaaaaaaaaaaacatgatctttaataaaatataatttttgctacgtgacacttaaaaaagtaactccttacttgcatgtatatattattttagtgtatatggtattcagtagcaaatgtacacaaaaacgaaattagcgtagcacattttgcctgcgtactgcatctccttgaagaaggcaaaatcgttgtactacctcttaccttcaagaagatgaaactgttattctgacacagtccaatgctggataatggtcctacaatccaaaaagcatgaagaaataggcaataccaaatcatggacattctttttctgccaactaagctaggcagtaccgaaatacgattccagcaaaaacgacataattttatgaacgaacgaacttgactcagctttctggtgtgaaggcagaatgcttagtcattttatctcatcatcagtagtctatcaatgtcacaacaattgtttcacttcattctcgtttgttattattgaactcatcctaagaaccccttcaaaaaaaacaaacaaaattactctgccaccatgctggcgtgacaattctatgtgggtaaaaaactcaaagcaccctagaattccaaaattgttggaaataaacctaccactgatgttactttctatgacttctgctttgatttctgcttcttcaactccaaggaagtccctaatcctactggtgtggaaccaccggactttttagacgatggcccgttggtattccctgcagtgccgttttgtgggggtccattcgattgctgaccttcagatgcattttgagtgctggcagtagcggaagtagcagcggcagtggctggagtgctaccagaagcagtaggcgccttcgccgagcccagatagttgagaatttgagatagattagacatgtaatcaggcgcctgcccgcttcgcacattaaggcctctggcagcagctttcttccgaacttctgcagttgcccgagcagcccgctcatcaactcctcttactcgaggaacaccttcaccaactactgcagcattaagtgatcggttgacatttgctgatccttcaccaggttgtttcgcagctgccttcagtgctctcaccaaatcaggatttgcctgtcaaatcataaggtaaaaactggatgtcaaaagaaccaaatacaaaatactgagatgtctaatagccatatacatatacttcgttaacagtgacaaggagaaacccaaaaaaaagtggcaatgtaccatcaccttcaaacgaccaagcgtgccagggattaatccatgtacagaatagcaaacaaacaatatagggacaaatattggggcaaaaagcttccataactaaaacaagagaatgtcaattcaatcatactgccagtcaattcaatcaacatcatctgatgcaacactaatgttgccagattctcaaaaggaggttttcactctgtacttcctatgacaagctaaaaaggaactacgagtctacggctatctattctcctggaattgtagggttgtatcaaaggcaaaacggtaaagacttcaagattgcagcaactaaacttaccttcaacaactcaataggattagcaggtgggttagtaccctgctgacctttttgcttctgggcattcacctgtacagcaaaatgagagttacgtcttcgatggacaatgcaaaaccggatccagcatgaagataaaggtatgcaaagcagaatggaagattttcttacacaaaggttttgcattgcattacttggtacttcctccgtttcacaatgtaagtcattttagcatttcccacattcatatttcattaacatcagtataaatgtgggaaatgctagaatgacttacattgtgaaacggagggagtatattagatgtacaagagatacaggaccaaataaaaaatagccgtatacattttcttaagaaaatacaaaactacaatactatgccatacataaaacatgttgcatgcttgttaaaagtatcacaaatccaaatacagtttaaacttatacctgctgttctcgcgacttaaatgtatttaaccaactttctgcatccttagtccttgaatcatcactccccaattgtttcaccagtatatcataggtcttcttttcatgctgccatcagaatcaatacatgagatcaatgttttcaaagtattctttttaccaatcatctttctggtgaactgacctgaattgaaagtttgaatgcacccatacaactgaatgcaatggcaagggcatgatagcagatagctgtttgaatatgatctggtcctagaagcctctcgttctttgtgagtgcttcctgaagatacctaagagcagtactcatattcccagcatcctggtacatcattgcaacatttataagagtcgctgcaacatctggatgattaggacctgatgctaaacttagcaaaagcaacgtgcgagacatgtgacgcagagcaagttcagtttgattaagcccatgatagaacaaagccatgttaccgtagctgaaaaagaaaataacacacaaggttagttaatataaaagatattaactgcacaaattgaaagaaagaaaatgatgttgtaaattaatatcacatatgacaaagatacattcattctctagttggtttaaagatttctagtagatgttgggatctaggatgggcggtcagttttgtatcaataacgtgaaatttagcttcacaacaaggacaagatcaaaattctatagaaaaattgaaattgaacaacatgcctgtgggctgtatcaggatgatctagaccaaggcatcgctcatttatgataagttctctatgttgctgcacaattgctcctggtatatcgccagcatggtacaaaaccatagcaaggtaccttcagtcaaagggaaaacaaattaaaatccaaagattttattatggatgacttatgtacataaaaacaaaaagagaaatctagaaaatgccagatgcctaaacaaataagctaatgtgttaccggcaacagtttgcggcatccttatgcatgggaccagtaatctgttaaaggtcataaataaatgtcagaaatcaaatatccacgtttttgccgtaatatagctgtgatgcatacctgttgaagtagtgaaaaagcttcagaaaatagtgcataggcctcattcaatgttccctgaaatgcaggtataaaaatttgtaaaatccacgagtacagaaaattaaacaggatactccctccagacaaaaataagtgacaagcatcttttgaacatttcaaatcaactattaaaagtgatatggttagatttgtcttcaaaatagtttcaaaacaatttagctatgatatatattttttataggttctatacaagtaaagaagtgcattggtgtacatatcactgtccaaaatgacacttatttgtcaacagaggaagcattaatcagtataagatgagtccatcaaaacatgttatcacaaatttcacgggaaaattatatctggattttctccatacatacctcagccatccggattttccctgcttccataagattccttgcatctgtacatacaggaacagaatgcttgacaactggttggagattcaggatatctgaaggctggaatggagctgcagcatcgaggtcatatttgcgagaagcaattgttattcccacctattatgcagattatgtcacaattgaccaaaagagcacataagaattatttgttggaactacttgcagccaaactattaaacatttctctgaaagagaatagcaaactcaatgaatatagagctgaacaaagcaaaccttttggcaaagattgcggagtactgcaactcttttagcaccagtcttagcatcatcggtcacttcaaactaaataaaaggagtgttatattgatggcatctatagaaaactacggaaacaaaagaagcaatagccactaccagatatttatgtttcgcaaactccttaatgttagaccaaatcccatcagatgttagatgggaaaatgttggcacaatgttctttgaagaagcagaaaggcttgatttctgtccctcggcagatttttgattttgagtcttctcatgaccctaccaatttgaaaatccaaaagaatagccattagttgcagttagaatacaagtgatgacatgagtttcttacacgtggaatagcataccttttgggtttttgtatccgtactgtcaacactaccttttgtggaaggtgccaaaacattgccaataaaacaatttaagaaatgagcaatggctggtccaatatcatgatctgcgctttgcctaagtatttcctgggatgggaacaacaaacagtacggtcaacaaattggcatagtttttccaatgacttcttattaaacgtggtaaaacaggaaagttatgcattttgatgaataatcttatccatataacatttgtttgaatggacagcaggatgagtctgggtgacagtatgactcatcctttagaaattattaaagaaataaatgcaaagaatttccatcataaaaacaaacagctggtaagatagatctatcaccttgaccacatgctttgccgacctaacaattatctcagaagacaacaaccccgtagatgtggcaaatgcttgatcatgtcagctacctgagaaaggaattagataatgaacatactatacataaaatgcaatgaactcacatccagctggatcagttcagagactcactttgccaagatacctaacatttatcccattgctatgcagcacatcagtcaaagtctgcccatccatgggggagacatctagggagcagagatcctgaacaaactttggtatcaccgtgtctagaagatacgaaccaacctttttaaccaatgcttcatctgctgcaatctcctaagaaagcaaagagtaggctgtcaataaattagagcagggatatcaagcagggagtagttctaagactaacctctggactaccagcaagtttgtactctgtaaacacatttggattaaaaaggatttctgcagttgactcgttatgttcagctggtttagtagcagagctgtcatcagatgtgccaggtctaggaccagagtcttcatcaaacttatcaggtctaggaacagagttttcatcagatttggcaggtccttccgcagttgtagcctgaaataggtggactaagtttccagtttgcatatttgaaacaagaataaccacattttttttaaagaattttaggcatatgagtaccacaagggaaattgaacacccataaactgttaaataaaaatgggaaaatcattttgcttcatgatattggataagttagaactttagagtttagacaaacaaatcattaccatgcaactgaataagggaagatatgaaagtgagaaataaaaacgtggcaatgtgttttaggttataaaggaaaatagcatatccagtttgacttgactgtaacactaatttaggaatgaatgcttttgaacaaacacaaagtattccataataaatttctgcaccaaccgtagcatcagaagtacttaccaattgcccattagattctccaggagcatctgcaactttctgtgtagtggatttatttgtggattcagcctgcttacataaagatatgagatagttaggactgatcatataccagcgaaccatcttctttgcagaaaaagggagaccacgggatcaggctcacctcaatgaatgaggctacaagttcaggcctcaacacacagaagcggtgctgtagtccaatgtagttagaatctcgaggggtcactctcatcagatccaaaatataatgct

SEQ ID NO: 52738 - DNA, 5646 bp, Oryza sativa
catgttattcaataaaggatatcaacattagcactgtagtgtgtgttcactgagtacaagtttgggcagttgacaaaattataaaggttccaaaagaggcaccccctcccccccccccccccccaaacacacacacaaaacacctagaagaagcttatacaggatctccagcacccaaaagaaccactgagcatttagaaaaagaaaaagcacattgttgtttttagatatagattttgacctgtcatcacttccaacaattcccttgcattcaaccgtagcagctaattttacaggattaccagaaccatccaaaaccacatgctccttcacatggagtcgctttgcagcctcaaccacctaaaataatagatatcatcaagaaataaggatagtctttgaataccacaaggcacagagtacatccactgctgtataacatgatcagagtggttaatcactaccaccaagaatcaagtatggctacaaaaaaaaaatctttcttgacttgctattccaatttccataatgatcttcagtggaaattaagtgccactaagtaaggctaacatcaaaaattgcattaccgtttgatagaaaatcaaattgtgcacaagtcaggcaaaccattaaattttcatctaacaagccacatgataagcttgtgaaaaacttgacagggaaacaaaagtaaaagtatataagtatccgaagaattcaaatatcaagaatagttctttagtcaccatacttggtacaacatgcagttttagcatcaccactgataatcaaaatatatcaaacaggcacccatcatgatcattattaagcaacatcatcttaattaacataacaaccagtttatattaacttgcaaattctcgttagttgtgaactgtacgacgtctagcaacaagataacaccaccatcaactaaagaacataagttttgagagcccatatactgaagaaaattcattactcctgtacagagaatattttgcatgctaaaaggaacatattggccaacctttgaatggaatgactcattccaagatattttcttgccattatcaacggaaccatacagaagggaatcggacttgtctccttgaagaataccaggtatgatgctctacaagacaagtacagttgtacaaggcaaataaacaaaaactcagttaaacattttcaacaggacacattttatgagagagagagagagaaactaagacaaggatagagtgaaacaacaacatacaacaaaatgcaatgatcaaatttataacaacatcagcagcaaactgtatgaaatcatatatcatgctaaaagggtactaccaccatcccaaaatataagcattttttaggtgggcacgggtattaagagagtaggttgaaatgattgtatgaaggttgtgattggttgagaggaaaaaatatgtaacaaattaaatggatgatagttgtgattggttgagaagacaaaataggtaacaaattaaatggaggatggttgtgattgattgataggagagtataggtagagaaaaagcttcattttgggacaaggtactgtgctaaaaattgctacattttgggacagaggtagtataaatctaggtatctacttatcagaagaatatagaaagattattgcaattaacatgtgcaagagaaaaaaggtatccagtagaacataaaaaaaaatatagtaatcaggaaacatacctgtgctacaaccctgtgacctctgtaatcaataattgccatagcaagattatacagcccaggaatatcagattcttggtatgccttagttccttttaagtcattgttggcagaagcataggtagcctgttcactgtctgctatctgtgcctctgccgatgcatcagaagtattgtccaaaacaccattaggttcttcagtttttgaatttgttgtgccactaggatctgcatggttcttatttggcttagaccccggatctgaggagcctatcacacttctgccagatccattttgaccatttggcttctggtcctttgggagttgctcatagtcggagtcaacagcgaaactaaagaaaatattgttgtgtacatacctgaaatataataagagcataggtaagcatctctaaatgggaattaaaacatcattaaaaaacagttaagccagatgactcaaaccaaacctgatgagcaagtgcaaaagagaagttcctaacagtcacatgcaacacacacccttccgagagagaaatttcacataacactagtccaaaattccatacaaaaaccaaacaacactcacagacataagaattgtttcgctaacagttcagatagtattatatttgagcttactcacatatgaaaacattccggatcagttggatttattgggggtatacacctattaatgacaccaactgcccctttaactgcagcatcaacgaaatcacatgtcaccttataaagtgctctgccacgcaatatcctacaatagccagaaatatttattgtagatgatataaataggcaatccaagaatgcaaaggtaggtaacaacctttcttgaggattgctatgaggaaactcctggcaagactgtaattcttcattccagtctctttgcatgccaatcaattcggttccatatgacagcacaacagaatcttcagccctagctgcatcccttctatgttctgctaacacaaaaatgtggagtataaaagctatattacagcatctacacaaaaagacaaaatacatggagtaatctacaataaataatagcagtcccaaaaacaagaataattagcaaagaagatcgacgtaaagagctacggaaaataggaaggatgaaaggttcacagacaaggtcagaatcagctgaaaagaatctggcaatgattatggggtatatcaactgaagtcaacgctacaatagttgtagaagtagaaacaacataagaatagttgtgcacatcaaaccattctgcctgccggcagaaaacatgttcataactagcttaagatttgaccataccagaagcggaacacttcaaatagtcattaaaaccttagtacaaacagaaaagagaatgaaattgtgagcagggaatgtactgaataaatcacctggcacaggataagctcccaaccaagaagtcactgggagcaaggcctgaacattctcaaaaggatgggctgatgctttgcgatccaaaatttcacgaaaaccttcataagatttgcccgactattgttatagaaacttaagagtagtcatttgacataataaggaaatatttgagagcaattgaaaacctttcttgaacttggcactgattttttgtagcagaccgactagggtgctgtcctccagagcctgtttgctaggccttggatccagaatacttccattgctagagttcacataaaatgatttggagtttcctgtgatacagtacttggttccttctaaggtcataacatcaatataaatgagatctccatgcaatctgaagaaaggatcaacgactgtgaattccatggagaatcaaaatactaagcaatagccttatatttgaccaatctttctaaggtatccaaataaatgacacaagtgcggaatatgcggtcattagagttacctcctataacttggcggaggattaaatgaagaaaaaactatgctacccacgcatttgatctctgctggtacagatggcaacaaattaatgacagcaccagtactgtcctccatgaaattcaacccatcaagctcttgattagccgttttcccagaatctcctaagtaaagaaaagacagaacatcaaaacttgcgtgtaaattagtaaactaatcagtgacatgcaaaaaattcctaataatatagaatgtcatcaataaactacacagcatagggcaaaaccaagggttgtacctgcagtatctgcagatttttcctgtgcagattcttgctgaagagcaagggatgtggaaagtgatacatgaagactagagagggatagcaattccctgacacgacggagatgtgacctaatagatctctcatcatatatcgctagaacaaaacacaaatcgttgcgtcaaattttaaaaggaacaactgaagagaatgatccaaaaaagataattttgaattgcataccagcaacaatctccaatgaacagccaccagcagttatatcagcaatctcagcaatttcattatagtcctcaagctcatgagttgagccatctttagtgtgcaataacaaatcatagcatgtgtagaagcacgtttcaggagcgtccaagagaaattgtttgacatcaatgacggagtctccagggcttagctgtaagtaatatcatgatacgaattacacagaaccagtacagactgagagacacagcacactttgtatataaaatacctgcaactcaagcttttcaccagactgtgtcttaacagaaacagggtagagatgaacctcccctgttgagataaaacggttggttggttgttagaacttaagtcactagagaacgaaatataattaataacacatctaagcacataggaagtcctcatgatcgatcaaatgagaacgggtagcccaatgtggaaacaaagagacatgctgttaataagataagtagagtattccaacaagtgtctcagttcaagaaagtttctatccaggtagagttttgtagcttatcacagctttttgaaatagttagaacaggaaagtatcagttgttgcatcttacaaatgctaaagacacttttttgcccattgcagtagatactatgtatacctatcatcattaatgcaaaaacaaagtcaacagcagcagcattaaacgtgttcttcattccacataaattgaactcagctagccttaccctacaatttttttaaaaaagaaaatgcatcgttctaaactacttaattactaaaaatgcagataccagctgtatccttgtaaaacttagtactgcacacttggtaattctctagcccgatggcctgtcagtactaaaactcagatatttctctaacacgatggtattgcacaattcatttatctctctaagaccagagctttattaaaattatgttctatattctacaaggcacagtttctgatttgaagaaacaaatacagtatcagtatatgaacacgatcgagtgggggagaccattaccttcagctggcttcttcgcggcttgtgtttccccagctgcatcgccctgctccttctcagcgccagtgtcactgccctctacgacggcaggttcactaacttcctcgatctcgggcttggcatcctcgactccatcggtcaccggcacctccggctccgccgcgacggcggcctggcttccaccctgcgccttcgccttgttcctcgcgcccttcgacttccccgccatattccctgcccaggccaaaaaataccaaacccaccaaatccaaatcaaatccaaaccccaccacagagtcggccacacaaacgactccctaataacacgggtcgcgccgctaaaccccaaccaaacacgatctggagtcgaatcaaaaaccctaaaccctcgccaaatcgaccccgaggcgggc

SEQ ID NO: 52739 - DNA, 10185 bp, Oryza sativa
  unsure (1)..(10185): unsure at all n locations
attccattcaagacttcgtcacaaaagcaacttggggaaattaattttggcataagctatgcggaaacgcttaatatcggacgtctgacgtatcataaaaagtcagatgggcaaactactatctccctatccacttcatacatccattacatgatataatgatctttaaaatattttttctcctaaactacttatccaatcgatgatatgatcataccattatatttgttataattaaatctttacaacaagatatcacatcattacattccgatgaaagaaaaacatatatttcaatccgttaaaatttaatgtttcagacgcggtagcaatatgtttcaacacatgtttttgttatgtttcataaaaaaatttaaatgtttcgataactaaattttcttgtttcaccatatataacctaatgtttcataaatgaccgataaaaagtatgggatgtttacgtcactactctctcccgccattcgattggctttctccccacaccatgcatgtatgcatgtatttagtgatcttaaaaatactttttcttctaaactatttatccgatgagcgatttgatcatgccgttgaatttgttataattaaatctttataacaaaatatcacatgactatattctgacgaaagaaaaacatatgtttcaaacaataaaaacttaatgtttcatatgtgatagcaatattgtcagtgatatgggcccgggagtatcatgtttagagggaggaggttgtcccccaatgccacgtggccctcccccagggggagtcaggcccggggtggggtggcggccactccttcccaaagactagttggaggaggctgccccccaatgccacgtggctctccccgaggggagtcgggcccgaggtagggcggcggccactccctcccagagattggacggaggaggttgccccccaatgccacgtggccctcccccgagaggggtcgggcccgagatagggcggcggccactccctggccgagactagagggagaaggctgccccaggcgccacgtggccctcccccgaggggggatcgggcccgaggtcgagcggcgaccgccccctcccgtgactaggggtcgggctcccccgaccccctctctaggtcaccacgtacggtgggttaggtgtccgcctacaggtgtccacctacccgcatttatggcgacccgagcggtcgcgccacgccgcatttaatgcggtgtgcagtgcactcaaccggtctgtgaccggtcgaatgaccgatgggacccagtatgtcaggcgcaccatcgcgtatgtcaggcgacgtgcagcccgacatgtcccatcaaataatgatggtgagaggttcttatactcttatcccagccggagtcggtcctccctctttggtcaaagcaaggctcccgtttcccggtgtaataggagcccagaagtcttcacccattaaatggtgactgacaggggcacccctcgtgtcaggcggcaagatttgacaggccccatcatcaagacgacgtgcgcttggcttcccaagtcaagagaccagacatgcatttaatgcaaaaattataatacttctccaccggagctaggttaggttgttgggcccatgtggtaaccccttgaggtataaaaggaggtccagacctagtggtggaggggggaactttcgagcgaactcgcgcttgggtctcgcaacctcaagcactagtgttctacactcaataaaccaagcacaagagtagggtattacgcttcatagcggcccgaacctgtataaacccctttggtctcatcgtctttggggggctcgaccccctcaacatcacacggcttcactcaccgaatcctcgaatctctcccgctgcccctggccgaactcacaaaggggggcctcacggtcccctggtggaggagttcattctccaacaaatatgtttcaccatgtgttcgaattgtgtttcacaaaatatttgtatgtatcagaggctgattttttttgtttcaccatgtataacataatgttgcaccaacggtcaactgaaacatttgaccgtctgaatttttttataccaacggacgttcgatttgtagctctctcctaagctatgtgtagacttttttacaaatcgaaagtccaatgttacacataagaatgcactattatgttctaaccatgcttcttatacttcttgagtaatcgacatatgagattcacgttcatcaaatcctcaacctctagtgctagttgactgcgagcaaggatgattgattgcattggtataacaagaactattgattacgggccgtggcaatgaaggagcggccttgtggatccatgcatgtagtggttagctttcttgccttagtaaacaggcagtacgcttgatgacaacaatggcgattgtagatatagaacactaaaaatacaaggtatttgctagaggacaatttaaaaaacaagggttttctaatggatactttaacctcttgtttctttgccatgagacaccgcccttaatagtttgtcatttattgccattttggatagtcaaatgacacaaagtgcccttcgaaaagggctagctttacaatagcaatgtgaagtgggctatgtccggacaaagaagaaaacgagaaggagcatcacgggagcatcaagtgcagtgagaaagaatggacggtagtgagaaaaagtgccaactagcgaatggacgaaatgaagggaattttggttatttagcaaagtttctctcttcgaatcagtaagaaatgataaacataatactcgcgatatctaatgggaaataaccaataaactagattgtcatatgtttttttaagtgtactccaataaagaccatgtttcttttgtgtcccatatcattttttgtcttttatattttactagcaaactacccttgcattgcaatggaaagcagaaggttatgatagaaattatatgattagattgaggttcagtttttatgatggacttctatgttagctctacaggtccgatgggtgcttcagcacaatgtagtgcacaacaacatcaaataagcctaaaaaagatcagcatgtaaatggtaaaataactagaacaaatgaaagtggatgacctacattttttttatgaacggaggaaagtagcaaaccagtgtaagctctaatgaaaatggtatgaatcactcaaacaagccatttctgcctaggctcacaatttgtccttatacgattaagttcaaatcagcgtaaccttgacttgattgagttagtttgactaaaatgataaccactattgcaccgtaccacatgttattggtcttcttcttcacgtagaggatgaaaagggacagagagagagagagaggggatatggagagataaaaggtgggttgtagtaggatatagacgagaccatattgagaaaaacatgttcctgagagtagcaaacctagtggcattgtcaacttgtcgatatccaaataggacatatgctttggtcagaacgtggattccgggtctagaaccacaatgacgacatcaatacatgggaccgatggcacacctagctcctatgagtctatggcctcaccgccatcctctccttgtgcacatgcactacattgtcattaccatggttaaattacgacgttgtccactcttcttaaaggatcgccgagttacagagtccgacactaactccaccatcaacaaccttttgcaactccaagtccaattttaacctactaggactaattcgacgcctactctaacaccatgaaggctactcgatttttaactaagacatttcactcataaatagaatctccttaccttcagtccaatcgaacgttttactaagttggtccatgatcagtgatggaggactcggtagggcgagatgtggcgctcgccatacctcattgcccgctacccccagctccgggctctgggcagagacaaggcaccaccgagatagacaaagcgcagtgaagcatcatcaaacgaacgagtcatatccgcacatgcatcatttgctagcaggtgtttttgtgtaaacatggcttttaactattgaatctagaggcaaatttccccattctccacctccatcgattcccccgatctccatccccatcggcgccttggtggctgctgcaagtcttcggagcctagagggcggaggcaacgcgtcgctagcgagaaggcaggaagaaccatgttggtcgggagaagtgtggctgctaggctcctgggtgcaaccacacagagctgtggcatccacgtcgagcgatggcgcgacgacatggcatgggaggcggtgacagtggcaagctaggaggcgtgcaacatagggtggacgcagggtggagggtgcagcagcaagtcaccaagcaagcaagaagtggccatcatcagaaaatggatagatcgttgatatttatcttatcttatcaacctcgaatatattatactaatcaatctttactatttgtttcgtagattctacatatatgatatatctatctatcatcactaattcctacatgtgatgtattgctaaaagcatgtattttttttctttttattcttgttttgtgctactgctaacacaattgtccatgaaccacacctgtattttttttccgtcctccgccactgtccatgatcaaagacaatggttcaagatattgactgaaaacaagcacttctgatttcatggcttcatacatgcggacaatctccataatgaactttgtctcaccctctcatgggtttgatcataaactctttaataaagacacattcacataagatgtttatttctccaacagttttgcatgtgtgatgaggactgatgggtgtatagatcttgtgttctacatcaagagtccccattgctacaatgttctttatagtgttatagtgtgatgatttccttttgatgaggaagaggatttagaatcacaactgattctctcaatctgagaagagacttctaaagggtgtcaccgttatggatatgcacaataggatcaagtattttccggattccatctatatcctctgtgatgttatttagtgttaaagaacaaaatttcttaccttcacccaagtgaagaagcatatcttgcttggcatcaaactaaggttttgtgcttgattggttgtttcttgaagcaaagcatcttttcttcaaacttttagaagtgagatctcttgcaaaatttggtctaattagatagaggatattataaaagctctagaaagttattttgaaatggagcctcaaactatgtttccctacatgagaaaaggtaaagaaatcggtacaataagaaaataaacaagtaaaataatattggggatcaaaatagtgtccatgacactttaaaaaaaaagcgtctacggcacaaaatgatagacaagagaatctctactattctaaaaattgaagatatttttgccagtactttggtatgtcattcgtgtatgagtcgtttttaagttcattcgcttttgcaaatacatatccgtattcgagtcgggctttaagttcgttcgcttttggaaatgcaaaaggagtcgtataagaaatctttttaaaaaagactcgcatgctaacttgacatgattttctagaaaaatatatatctaagcaaattctcacaatgaatttcacggtgaacaataataagatgaaaatagccttcacccgttgcaatgcacgggtatttttttctaagttattttataggtaccatatatgaaaaagtggggacctaggtccccactactggctatctaggactctaaggattttctaaccatgccatgtgggatcgggccacgacagcgaaaggtgggaccgggaacttggtttcttgttttaaaccaggtgagtcccgagccatgtggctgcttgggcccctactatgccataaatacgatggggtgcgaaccttcaatgcttcacgtcgcgcaactgccctcgcttttaatgcgagggataccaatccatcttttgcgtatgagaggcgacatgctaactatagaactggccataattacccctagaaagttgagaacgtgggctgtcagataatgtggttgactatcatatcgcttggttgggcccaccacaacccgacacacacatctctctaaagccgataggtgggaccagtagacgtcatcagcgtccgtacccaagtcgatgcaaagggcatacgactcaagtcattagcgtccgtacctaagtcgacgcaaagggcatatgactgaggcagactcgcctcgtgagaagcaagatccaatagaggcaactaggggcctatagtggaccctacctgtcagcatatgataagactttttataagagcaactatatcatggtatccctcgcggtgcaagactctccctctcttttgacacgtgaggccgcgtttctccgcaaccaacacctaggtgtccctcaatgggcgcatcacctccctcaaccgcaacgctatacccacacctgcgcatcctgtccttccctctcacattgttgtagcatggggccaccaccatcctttcgtattcggccaaaacactatagagaaggtcttgagtttttctaagtgttcggatggtaaaataccatctaaagcggcaaaatgataaattatatttgagtagagtaatggcaaaataccattcaagtggcgaaatggtaaaatgctattcgagttggaaagcactattcaaacaagtttatgtcactaagctaaataatatcttttgagcgcatttctaactagtgacaggtaaaatatcaaggactaagcaagtggaaaagagtggttgaatattctaggtggaaaagactacccgagatgaaaaatactactcgagcaataaagatgccaagagaagattccatgggaccactctcaaccactccggctagctggcaccaaaagactataatgacatcccaaatgtaccaaaatatctctaaagttgctgacatggcaagggtataattgtaaactcacaagggcccaatggggacaagattgtaatctcacatgtacggttacggactatataaaccgaccaaaagcctgtagcaagacaggacaattttagataaagaaatattattcatcaaaagacatgcattttgtgttcggactcattttctaggataggcgggaaaatgagtttttcctttatccccaatcttattcatgaccttaggtcatgacacacatgacgcgcgaggttgcccctcccctctcctacgtggtcgtgccccaattcctgctttttttcccctgcactgcctcctaggtacactttttgtctgctcttcaattgctttcatatgtataaacaaggtgttattttatcttttttttttaaggataggtgttattttatcttattcgcgtaactattttttcctcagtttgaaggaggaacatactcgaactataatcgagggacgaacgacagactttcttttcatttgtttcttccgtctagccgcgttgaggaatgagccgagaaaacgaaaacagcccaactcaagcgtatatcagtctgtacacgcctacaccagagtccagtggtcctaaatcctaatcccggattcccttcccctcttcccctcgcttcttcgtcggtcgacctgcgcacgaaccgccggcgagggcgggtgattggcgcgatccgtgcgcttgccgtcttgccggcgttggggaggggggcaggtgaggccgactgctgctggtctgcggcgtgcggctcgtcctcgtcttccgctaaaatcccccgaaaaacaacgaaccgatttctcttttgcgactgctcgtgtcagcgacgtggctgaaccgcggggggctgggagaatatttttatccaggcgcgccccccggtttgcgtttccgtctctccctctcgcggattactgctcgctcgcttcacgcatcgtccctcctgtctcgctcgctagctgtgttcccacttctccccctcgcactacttaaaaccgccgatcccccattccaatcctgtcgcgatacgacttgattcggcctctctctctccgcgcgcgcagcagcagcagccgccgatggacctccccctggtggacctcgcgccgtacctcgaccgcgccgtcgccgggggcggcgcggcgggggaggaggcggtgcgcgcgctgtgcgcgacggtgagcgccagcctgcgggacacgggggcgctgctggtgaaggacccgcgctgccccgccgccgacaacgaccgcttcctcgacgtcgtcgagcactacttcgcccgatccgccgactccaagtgcctccaggagcgccccaacctccactatcaggtaatctggtgggatcaaaggcgagggtttgggttaaatttggtccttattaggcaggatcactaaaagtaccctacttgttagaccatcttctctgcattgtgaaatcgccatgagaattcaggcacaaaacatcgtgtctgtccctattgtaatgctggctttatttccgtttcaaatgttaaggttggtgtgacacctgaaggcgtggaggtacctcgcagtcttgtcgacaaggagatgcaagacaagatcaagagtatgcctgaggagtttcagcccgccactcctaagggtccagacccgaaatggcggtatatgtggagagtgggtcctcgcccagcgaatacccgttttaaggttgagactgtttgcttgatccttttaatttggtgtggatatctgaaatgatatgcatattgtgtgtggtcgttcgctatgttctatactgacttgtgagaaacctggtttaggagctgaattcggaacctgttatccctgatggattgcctgaatggaaagagaccatggattcctggggttctaaaatgatttctgcaattgaggtagatcatgctctacatttaatttctgttttttgttgctgtattatatacaagcggccgtgtcatttcataggttgttgctgagatggctgcagttggatttggattgccaaaggatgcatttacctctttgatgaaggaggtaatgctgtaacaatctgtaatatcctgctgtaatttgttaatctactcaggatgcaagtaaacagtaccaggtcccagcattatgtttacttagctaaaaatatttctgttggttcacagaaattgagttgtttttttttttgtaattatgtaatgaacgctgcattttaatgcattattcagatccattctgcattcatcctgttgacattggtcgattatttgtgtgtttttcatagggaccacacctcctagcaccaactggaagtgaccttgagcggcatggttctgagggcactgtttttgctgggttccattatgatctcaatttcctgaccatacatggtcgaagtagatttccaggcctgaacatctggctaaggaacggcaaaaagatggaagttaaggtccctgttggctgtcttctaattcaatcagggaaacaggttagctttgccagttttactgcaagtatcttaattagttcatattcgcgcatcaatagaaggtcatatgtatgcatattggtttctgttctgatctctaaattctggttttccatgaaattgatactgttgtcaatcatagaatcaaactttgtatttgtattttgagccttttctgaaacacaaacactagaaaactgggagtgtaagctagtgaaagatggggcttatttctgacaacttggatgtgatgaaccaacacacaagcaagtaaagcatctcgccaattgaattactttatgttctttaactgcagctggaatggcttactggtggggagtgtttagctggaatgcatgaggtagtggtaaccaagagaacactagaggcaatagcattagcaagagagcaaaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52740 - DNA, 808 bp, Oryza sativa
tcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacacctgcttcttttttcttcggctcaccgactcaccaccctcaccccttgcctccaaaacactggattgctgcccacccttgaaccgtatgaagtgatgaagatcagctaaagtagtttccttcaaggtttaccaaaccgtttaggatagagttaccaccaacccactgttatatagtttggggttacggccaccccacggtttgacagttaccatgaggtataccttggtttcaaaaactaaaaccacacatggtatcgcgtgataaccacacagttttgtagccctagtttcctcccaattggtgtattaatagccattgcattgagaaacactg

SEQ ID NO: 52741 - DNA, 22364 bp, Oryza sativa
  unsure (1)..(22364): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttgtgtcctcatcacctgagcagctacagtccctaccgacacagacgtaccaattccatgaacggtacatagagatgagcaccagcggtagggagattatcggagcgaggatcaagaacgccgacttcttacaaggagaagatgttctctggatcaattttaaggatatctacgaactataccagctagacgtcgtcgacgtctctcttctgagcgcatggattttgtacgtatcgttgagagttatatttcttacgttcctttaattagctccttgtatatatgtacaccataaataacaattcctttattgttgtaaaatggagattcaatgggcccgacggcggggggttttcgatactggattcatcgaccctcggaatgtaaacgtcgaaatggtcaccaagtatccacaggccactgaggaaaatctcgtccatctcctcaaggagcagcatttcaagacgttcatactactgccgtacaacacagcgttagtttttattgtctaccgaacaaatttcattcccgtacatatacatgtacagtgtttcatatatcatctaacacaaattgcatattccactgggtccttttactcttcgacttggaggcatgcagagttaatgtctatgactcaatgaataaagatgagtctacttttgaccaggtttttgaacttatagataggtaatgtcatatgttccagtgttattattatgaattttgctattgctagtacaaatcgtagctttaaactccatgtagggcttggtatcggttctgtcatttggtccgcggcacttggaaagaaaaacttagccagaggttcaaatttccagtgagtacatgatctaaatttatattgaatctctaattcaaatataagtgtatattaaatctctcgtcgtttgtcatgtatatagtgtgcaaagcaggaagagggaactaacttgtgtggctactacgtatgtgagtattgccactgctttgcaactcaaatcatcaccacaagagagctcgatgtacgtataaataaaccattcaaaatttcattgcatacgtatcgatttcttgtttactaattaatataacttcatacattcataggttattcacatgagggacaacctcacacacaaggactttatcacggcggttcaagaacaactcatgggattcatcaaagaacaagtccttaatcccgagggtgaattctactacgacaaatctacaattcataagacgttatcttctgagataacgactacgtcgaagtcgtagctaggacataatgaattgtaatacatgtctatatttatatatgtacacatttactttactgtaaatatatattttggtcatatatgcacataaaatgttaagtgctttaatatatacatatatgtctattttgtacacatatccatatgcatttgcatacatataaatatgtataaatacatatatatattattcatgtatatatgtaatatatatatatatatacatacatttatatatacatgtatatatatacatgtatatatatatatacatatgtgtacacacacacacacacacacacacacatatatatatatatataaaccatgcagcaacagggccatgcaaataaaaaaaaaggtagatcgatctttagtctcggttggtaccggtaactaaagatcgatctttagtcccggttattccacccaggactaatgatagcgatctttagtcccggattggtagttccggtttgagaaccgggactaagggggttaccatccggaactaataaaggtttctccacccgtgtaaactacaaatgttatttgcaaaagtggccactgaggttgaggcagctaaggcatcaatacaagcggcttaacattttagccgcatatgtaaaaaaacatttatgtaatagtgtaatgaaaaataatggataagtgtgtggatattatggataccacatacccactcgcttggatattcgattgaagataggaggtgggtcgagtctaggaattatgtaataattaggactggggatttattattgccttgtttcctacggcaagtctcataagtcttactcatatacggttatgtaatatataaggaaaccgatgccggattcggttaggtttctacccttctaaccttgcaccaacctatacaaggacacggggtgttttgaaggcataaccacagccaagatcgttagatcaatacaacactcgacgaattcaatcgccgaaacaggagtaggggtattacctctttgtcaagagggtctgaacttgtctaaaccttttgctttctacctatccactttcgatctcgtacaccacctttttcttattgccaatatgtagaactgacaaagtggcttaaaattatcatggtacatagattattgatattccctatgtgaaacaatacatataaatatatgcgtatcatagtttgctaacatttgatataccttgatttttcttggtacatagaaaatcgaaataagttaatcattatatgtgttccatggctgcaattttgtctgagttgtcagtatagcgtgtttataataagtatgttataaaatctaaatggattttaaagttggttatgcatgtgtacgaataacaaacataacttcttcttctctactactacttattataggagtattcacattttcaatagcctacgcatataaaatagacaaaattatctttatatatagaaggtatggaagccaaagcaatattcatctggttgttaaaaggacctgtaagtccattaaatggcaccatatattatattttagagcgcttatgtaaaggatcaactgatttaatttgtcttatcaattgtgcatatttcaaaagacataattatttggatattgttgcatctgactaaaggtaaaatatttttttcataattgttatgttagtcaaagttaagttagttctttttcacctacatattatatatccaatttttctatgcgtgcttacaaagtaattaatgtatgatgaagcaacatatattgttaaattgttttacaattttgtacggtaatttggattatatgcaaagtgtaatagtgtggtccctagataaattactcctttagccagtgagtttataaattcttatcctaataccgtcgatctaatttcgctatgaaattttgtggaatcactgatttaagattacataatacatgttcatttattttaatgttgagtaaattgcattggtggtacacaaacttgttaggtgggtgcaatttagtatataaacttataaaatgctcgtttcagtacacgaacttgtctggttcgtgcgaatgaggaccaaaataacttggcaatgtcaattttatgaagttgacgttgattaggatgcgacgtgtatacctgtagcaagtatgcataggacatgcaatatttataaatttagtctctactttatccttcatcattgaaatgatgaattttatatgtttctaacccttatatcagtgctcgatattttaaatctttttctactatcactaaatcctattctatattttattgaataggtgtaagtctagtggcaaccttctcatatatatatatatatatatatatatgtttacatagcatcctaatcagcccctaaatcaataggattagtcatatagtgtcctttttgacttctcccgcacgcaccacgcaagttcatgcaccaaaacgaacattttacaagtttgtgcactatattgcacccacctgacaagttcgtgtaccgacgatgcaatttactctttaatgtttctttgtggccgctagataaattattcttttatatgaaaatttattcatggttcatgtttgtcgaatggttccagatgtcaaaatatatgttcatttctataatatcttattgctatttggttgctatacaaaatatatagtggcgtaactacattcaccttcaaggtagattattcgattttaactaattcatgccatattaattaataatatcaattaataattaaataatttatatgtgcagtgtcataataatatttttcttggtttgacattgaaaagaaagggtatatatccaagtgatgtcccaatatttttttctgggtttgtcaccgaaaattaagggtatatatattataatttttatataaaaacatatgtactaatagattatttagctaactaattaatttttatactatgtatggttgttagaggtagaaaataggagagagaagagacggaagggtggaggtcagagagggagggagggagagtacgtacatatatgtgcacgttctatttttcttttcaaatatattacgtgatgaatatgcgaacggaaagtggagcgtgtacatattttctttcttggagataagatgtaatggtgaaaattagtataatttaatggtttataaaatattaggtccacctaccacgtggcgatataggagcgtttgtaggagcgctacgtggcggtttaaaagcgtttgtaggaagtttaatatataattaatttttataatgtatggttgttagaggtagaaattaggagagagaagagacggaagggaagagggtcagacagggagggagggagagtacgtacatatatgtgcacgttctatttttcttttcaaatatattacgtgataaatatgcgaacagaaagtggagcgtgtacatattttctttcttggagataagatgtaatggtgaaaattagtataatttaatgatttataaaatattaggtccacctgccacgtggcgatataagagcatttgtaggagcgctacgtggcggtttagaagcgtttatagaaaatttaatggactaatagatagctagatgctcttctcttatttcagcacattacactccactccaccacgtgctactatcttgatggggtttatatcatctcccatccaagtactaatgttctatggggtttatagggtctcccatcttagcactatctatcattacacaccatgcggagtgtaagaacttgataagatacaaagcgttgctcgccttgcaacaaggatatggttgacatgatttttatacagcacacatatgcatgtgagagtgattttagtccttatattatagccatatgtaaagggtcccgtttccagtcaatccccatctgtggacaccctaataagtgttggaaggtccgaaggtgatcagtttctccatcaactgcccctcccagtatctatcatcatccttatatatccgacttatagtttggtaaatctattttatgcaaggtgacagtttcatgaagcaaaataaggtttatgcaaaataattcaaatcatcaagatcaaaggttcgcttgcctgaattctcgtagttcaaatcaaaaatagctggcgctcccaactgaccagactccgcctctagttcccttgttgtattccgtcaaatgcgtcgagatttaattaaactatactaatagaaatacaataatttacaaatacaaatgtgcttacaaatttgtaacctttttattgtaccgaaactccagttgtgatgtgctagataatttatcaaactatacttggactacagaattgggtcactatgctcaggttggtgttctgtgtagcctactaatgtacatctagcaatcagtccacattttcctttcttctctattctctcacctgcagaaacctctccccgtctctcccctcttatcactcctgcaggtaaaagcatcagctagctaatccccttcttccttcctccatttgccattagcagtggatatcttttccctcaaatcctcactctactactctagtactgctgctgctaccaccatgttgctctcggcgacctcaatgcccaggctaccagcaagacctcccctcttaatccttctctctatgctctccaacccacagctccaagaagtggacccccccatggctagaatagggtcacgcatggagctctagacccagacgccatgaccagcgccccatggagctcgacttcaccgagcaatcatcccctaggtaagtgctcctattctttcctcctccattttatctgctgctagcctgctaccgctccttcttttctattaaaagctgaactaaggtgctagggaaaaactacacagtggtgatggattgttttaagtttaatttactagaggatgtggttgtggtggtagtatgggggaaattctcaccttctcttttctgttggtgcgtgatgttttattgattgatccccctcaagtttgcagctaatgagcttcactccccagttcttcctcaaaccggtagccctccttgctaatttacaaatgttttactctttgcaactaaaattgcacgttttgctaattaggagtacatgggattatgggactacctatttcctcgcgtgttccatgtttacttgtgatccctcctttgtcaagcttgggtgataatttgactagcttgtgtcacttatgttgatcttgctagaatctttatatgcttagccatttttaattaccactagctcacattatgggataatcacactatatgcattagcatcttgatgagctatgagctcgagacatatggtcatgttttattggtcgtaattatctaactaaaatatggcttaacaacgagctctgggtgtatggttttgctagtcgcacccatggcaattaaggaccggttcgggggaaaccctggaagaatagaattaccgcgcttacacaagccagcgtgggcaacagctgcactttgtagcgtagattttcctagctaacgtacccgggcaagggtggacgtaatggagtatggatgggccttgcgacggtgtaacaccctgaaaattcccgacaataaaaatcactaaaatttcgaactttttaaaacttttgcatcatgctggatgttatggttgctattgcttgccaaactataaattgtcacaatgaaacattaaattaaagatgtacaatttgcaagaatacgctatctatcgatcccataaatatttgtgcacatgatagcaaagccaaataaagtacaagtcacttattaatttctataagttacggattgaatagtgtcctgacatctaagtaaccacgaaatagtcgtcactacaatgactctatatatataggagtgtttcactgaaataattaaattaatatctataacttacaacaaatctctcatggcataaaattcactcatataaaataattgttcacataaaataaatttatccctatatataaagattgaaggatgggagtatctaattaaatacttagatcaatattataccaagtctcaaattacctctagaataaaatagattaaacttttccatgtaaaatacattgctagacaaataagttcaaccaatgagctattgtattaatagtagtcacattagaatattttaattaatttttataaagatcagagcctacaaggtatataggaaatcataaaagctatagtaaaatttaaaatattggacaatattaattttggaccaaattcacatttgaatacttaatattgttgatcaaatgcactggtgaaaatacaaattgaattagctatctttctcgatttttaaataaaccaaaaccctaaaaatctctttttattccagcatggcattattcattgcgcgtcaggtgttcgactcgaacctagtgagtcgaacacccagcgacccagcccccaccacgcgtccgtctttacttaaccgtgcgccactccaccgcgagaccgtgcgccatgccgcgctcgcacatggacctcagccgcggaagccgctccgcccatgccgccacgagcgccggcgtcatcgatgtcgccatcgcgcgtcgcctctcgacgccgagggataacggccgccacctcgcccttcgtcacccctagctccgaggcctgcaaacctaataccggccatttgattccccaaatccctgagtgtgagagagaagagaaaaccttatccacatctcatgatgttttggcgcccctccttatgtccgctgggtaaaacggagcctcctaccacagctagagctagaacgcacagactttaggctttaggtatgatgatggagccatagaaccttaatggaggaggagatcaaaccttatccgtgtcatccacctccttgcccttatccgatagccattagagctctatttcgcctgggaatgtgctggcgatcttatccacaccgtttccttacaacctaagctaagcccccaacaaaaatccccattcctctcagctttcttcccgaatacattgcgtcgaacaccttgtgtgcgtaatctcaccgctaccaaagaccatattgcgggactccccgtccagagctggaggttggagggagtggggggcgggggggcgggggtgtcgtgctgccgccgttgccattggggaagccgaggaccgctggacgccgggaaacacgcgtcgaacactttcgtgtgtcgccgaccgctagccacctctgctttgtctgcactgcaccacgcgtcgccgcccttcactgtctctccatccctgggtaaaccctcgagaccatagcattctctgtacctctaatagctagcgtcggctccagtttgtactattaatgcctatggccgtgccggcccgaccgccgttccgccgccggcaagcccctcgtgggtagactatcccgggagctcccctctccatctagcgagaaaaaagaaatccccataccccgtagatactcccacgcccaccaattcgatcggaaactctcccttttgccctagccgccgctcgcctccgcatcgccacgcgtcgtggtcaccggcgggagatcgctggagctcctccgcgcctctcctggctgccgtcgggtcaccctcggccggccttcccgtgcgcgccgtgttcccatgctgctcccgctcggtcgggaggaagaataagacgaaggtagaagacgactcctggccaagtcgctgacaggtcgggcccactcccatatttcccctagcaaaaataattcagtagaaaagataataagacccctgaccccacacgtctgtgactctgagctgtagataggtttcggattaaaataaatcggatatgaacagtactgtttcgcaattattcaaatttgaatatttaaactagcataacttattcattttagctccgattcaagtgaaacttgaacctaaattcatctaaattcataagctttccaatggtatataactcactgtttaataaaatatatttataattattacataattaatatcaaatgattagattatggtcaacttgaaaatatgctaataaataaaattggtattatacagtagagtagatgtaataatatttgtttctagcatgttttgtcacagtagcaaccatgtaaattaaatataagtaatgtctcaaatgaatggatgtataggaaaattctagtattatttaatattcgatggccatataattaaacccatgacttataggttatctaaatcaaatttggcctcatatcctgtaactaaaatatgaatactcatagatgaatcgttgacttgcttttgagaaataataacagagctagtgtgattagatcaccaatatgatatagcttatagtcgattgcctatattcagtaaatggttcaatgttaatatactgttgcacacacatacccttttagataatctacaagttgcatatattaaactaggtaataaatgaagaaccagtatattagctaaatactagtgctagttataaatcttgaccacacataattttagtttaaccacaactgaggattgttcattataaagttataaagttatacaataagataatctgtaactataatattattaacctcacaaatctaacatatatagcatggataattattacctttttttatttatagtgacaagtaaaacctgatcatgattaaaataatgactccattgataaaataataatacaaatgaaacactgtaattatttgtttgactataaccctcccataaccctgtagctagaataaaccacatattagtagtatgtacctcattcatattatactggttagctcctaaataagccgccatgacaataagaatgattaagagattatccattagcaaacgcgagtagtaccaacagccttaggtatgtcttcaacaattatattttgtttgtgcatatttgattgttgtttgaatattggtttctctcgcgtattatagtattggtgtatcaattagttgtgaggtaacatatgcagcttctaggaggtgaacgttgatcaagattatatcaagaataagaactatcctgagcaggcaagtcatcaccccatccctttagcatgttgatccgaattgcgaaattgttttgtttataaataaaattgcatgcaagatgaatatcctacttgttattatgccatgcctttgattattatttccctcattatttccttgtacccatgattacgtatgagtccttagtcaattatgacaaaagcttagtaatgctattttagaatcatgcattctcatatttattaaatgctatatgcttgggcaactaccttagggaaggtagttgagattcggcatgtggagatatgagcgccacattgccatgaacattggtgacatgatttgttaaatgaaaaaaatgaaactaaacaactgttttcgactggggcggctagaggacttgggtggtgtccggaaaaggctagtgccgtccctggttagttaaggaccgagccatgaagttaagcatgaaacaacccctgtacaaccgtacttctcgtgtgggtatagacctagcggagtaaatagccgagcggaggcggtacccaagccatagtggttttcttgttgtgtgtgaggcagggcctacggtggggcagccattggtaggaccgcaaggggcgggtgcctacaatggtgtcgccatcggtaggactgtcatgtgcaaacctaaacttaactataacttaatgaatgtgtgagtctttccccctcgcgagcgccagaactcctctcactgctagaaaccttggacgcctggagtgcatgaggactaaagttcatggagcgggtactgccaaagtgaggttgttgaaaggctttgccgtagcaagtctcattcgttgggacataggcttatgtgatgggcaagtcgcggagtacgagtacgggtaaagtgtacatccactgcagtgtgagtaaatcaatctattcgaatagccatgctcgcggatattgagcaccgggatatgtattacacttggctagactctaaattcttaaaatgatggatgggatatgcatgatgattttgtgctggtggatcaacttctcgagaggcgagaagtggtagaccccagaaaaccatgatgaccagtggcgagaagctatccttgggaacacaatagatggtggacagaaccatcgctgtttaatgaataatggaattaaaacttgatcagtttatgctaggtcttaggtttgtgaaacaatatttgaaaactcagctttacgcaaagaaaccatagccactccttgtattatcctgtacattattgcattttgtgtggtggcttgttgagtacttttgtactcattgttgctctatatatatcttttagcagagtgttgaagagaagcccttgttagtatgcttgcgtacctaacaagatgatcggagtgcggttccattctaggtctcgttccccagtcgattgcttgtggcatgtcaaccgggcccttgtattattttgtcttccgctgttgttctctgatagttgttggcctgccttgccctaatgtaagcatttaactctcttagcctgaattcattcatgatatgttgtgatttggctatgtatgtgtgtaccaactactgatccagggattggtactgataaatacagaagatttccgatttccaaaattggaggtcgacagacggcctatgctgcttctggattcacctaggcacgagaggggcctacccgacttggcttaaggagggggtgaaacctgaggtgtgtagtgcgattggttagggggagttaccatttccccctttgcagtatcatcgtggtacttcaaggcagaatttttttgagaattaatattatttttatggaaaatcgcaaaactagtggccacctgtggaaaatcgcaaaaatggggtcctgtcgaataggtgcagttcgataggcgccttatcgaacgggtggaccgcgatagaagaggggtagttcgactggcgccttgtcgaacaggggcagttcgacaggtagcagtcgaatagcgttggttcgataggatccctgtcgaacaactgttcttcgacttgtcctcaggctgaatttttatttgtgaattttgtgaatttttttctggaacttttctacaattaatattttttaataatattttgtgggaaattttagtatttattttttggttaaaatatttggatgaatgaatttatattttcattattgtagtatagtgcgctgcaaagttcgaagcgaatcttttgtactccgtcattggaaagggtatgaaaaaaaagacaaaaatagtactgatagttactaagttaataataaattgttcacaaatagtacggacacaacataaatgtctcaatttttaacagaaatagataactcaaggacgatcagtgcccttcgcacgcttgctaggtccccccttcttcctacgcctaacctgctcagtgggataagtcaaattatcaggggggtgcctctctcttgctgcctgctgtggtgtcacattgggagcctgaatggcccccatctcctgcgtcggctgtgtcacctgaggtgctgcgtgccagtaatccatccctagttccccttgaggaggctcagtggaaaagaagtcctcaacgaatgctgtgcgaggggagtaagtaggcattccatgatacgtcgatgccgaaccgtactcatcgtctgtttgcataagagggagaaacaaataatcgcgtagttagtaatgatacatgcatataatttgaaactaaagcgtgttattgtttaaacacagctctcatgggccacacaggcctcattctaattgggccgggatatcacatataccgtacatccacatatgttatttatggggtaaccttggcctattaagttgagtacttgtctaacattgcattaaggagaccgatgcagtataggtagtggccacgagtgaactgtaggctatctagaggagctacccatgtgtgtgttgaattttaggatgagtgaactagtcctaagtgtgtgttttctgtgaggggatgagtgtactgttccgcctcacagcgtgggtgtctaagtttgtccaatacaatgctgaatgcctcatgggaagagttgcttcgccacggtgtcaggttcgataggccaaccgtcctaacaacactaatgttctggacttagtagggattgaaaattcatcgtgctcatgcaaggtcagacggtagtcaatgtaaaagccttgttataacctctagaccacattcaccatgaagagtatggcagtgcctggcgagcacaaaacaaattagagtgttcatatcatgtggatatctgtacaaactctgcaaagcctaaaactgtcacatctagaaatttagcccaaattttcagactattttgtgtattaagtccctgtccaggaatcagctagggtacacaaaacaacaagtaaatatacagatccaaatataaataaactgtaaatacttacataagaggcacttagtcctcacacagaaaaaaaacagcaacaacggacaaaggcgatcctaatggggctttagctccactccataggcaaaactcaactggggtataagccttggtcctctaacttcgtcttcaactcagaaacactacacttttgaaaaagggtgaataatagcaaggttgagtacaaatattcagcaagccacaccaatgatgcagacatgcaagggggaacaaagaggggtttgtggctagttgcataaaggcgattgcaaacattttatagtttaaaatagtaaaacggttgattaattaaggcactattaaatctccactgaacaacgctacaccatgttgaacaggcccaaccattctacctgatctaaaccaattcattaagtcaagttaattaatagaatgtgattaatcacggtgaatctggttgatcgcccataaccgagggcacaactatttaaatagttttactctggccagatgtgcacaattgtaccgagaagacacaattcaacacatgttgccatgccttgaaggaatttttttgagaattaatattatttttatggaaaatcgcaaaattagcggccatctgttggaaatcgcaaaaataggctcctatcgaatgggggaggaacgacaaggggcttatcgaacatccagccttcgattgggccctatcgaactgtagccatttgacaggacggcctatcgaaccggggttgttcgactgggcccaccacccggtgccgcgcggcctgtcgaatacggggagttcgactggtcccgccgccgcccctgtcgaacaatgggcattcgacaggtccctttatatcggcagcccgaacctagctttctctaaaccgattgaggaggaccacatcgccatcgtcaccattgcagtcgccagtgctgtcgccgtgcgcgctggagggagtgaggggagggtgtgggcggccagagacaaggccagggcggcgccggcctggagggcagtgaaggcaacggcttgaagcgacgacattgaggtataaatttgtaatccctaagtatgaggattacgattttttaatcttatagaagaagacttgtgatttgttaattgtttatcattctccaatgtgactacatatcatatgatacgttaacagttgtcattgtgaaatgtgagtagagatattaaattagtcgtatgctgaaattagttaagttagtacatggtagtacatatatttaatgtttgatgtgtttaaataggtagaggttagtacaactgggtatgatgattattaaacgtaagggtaagatatgtgtcggtcagtaccgtataataagacaatttataatgttttatcaggatgtcaggtgatatgcccattcgtctgtattatggagatgctcctatacaaatatgtgatagcggagtggatttgactgtatatgccttctataatactagtctgaatgcaccggagcatatgggtttgaacgatgtgttagggtggttgtataatatgtttggggtagatccagtgctcgataaatttgtcataaatgccgtgtggccagtaaggggtcaacatggatggcagcggagagtagtggaggttgcgtcaactggagttggaggaagtttgttagtaaagtaagggagaaagggtatagcctggcaatagtggtgcagaagacaacatgtgttgatcgatcgggggagtcaagtcatgccgtggtggaagaaactccattggaaggtgcacaagctgaaaatgtttggcggactgagcaaggtcgggggaagaagtagtagagggtaatacacaagcagaggtcattgttcgtgacaataatcgtgaggccgacgactcggacgatgaagaaccagattcgcctatgcgtgttgatgcagcaaaggagaatgaggcggtagtggatcggatggaagtggaaaacgaagaatacattgcgcttgtagtggaaggagaagatacaacactgtgggacaacgaaaccaacatacccgatgattggacgaccatatcgatgagtcgtatgaaggttaacgatggtttagatgcccactggcgttatgatagtaagcaggtgcaagttgggcagatgtttcatgacaaaggtcacttacaagatgcggtgaagaggtgggcatttgaccagaagcgtgagttcagggtgaaggtttcaaataggacgacgtacgacgtgaagtgcacacaggctggatgtccttggagagtgcatggttacaagccacaacatgacactttatgggtagcttcgagggttgagcaacatacgtgtttgttggagaatactcatctggtacataggaacatgacagcggtatttgtggcacaaatggtatattcaaaggtggttagaaaaacatctttgtcccctttcacaataatgcatgacgtagagaaagagtacggatatgagatatcgtatgtcaaggcttggagggcaaaacagaaagcacttgagatgaggtttggaacttatgaggattcttatcacaatcttcccccactattggaggtgatgcaggcaagaaacccaggcacacacatggctattctccacgaggtgaatgaaaatagagagaatgttcttcgtcgggctttctggtcatttgggtgcatgatagaggcctttagaaattgcattcctttgctctgtgttgatggcactttcacgacaagcaagtatagaggaacaattctaaccgtgatcggagtcgacgcggatagccatgtcattcctgttgcttttgcatttgttgaaagcgagaacacatcaagctggctatggtttttgtggcacattaaaatgtgtgttgttcaaaacagaccaaatgtttgtgttctgcatgaccgacatgccggtttgttatcgacgatacagaagcttcaagaagatgtgacagagtccgtgccatggccagatttgcatagcagatggtccatgcgacatcttggggctaatttttacaggcaatttaggagtaagagattgatggacctgttcaagaagttatgcaagcagaatcaacaaagaaagtttgatgctatatgggaacaacttgatcatttgaccactacacacatggaagaggttaggaaaaagcccgtagttgccagacaggaggagccggagggacttgaacccattcctaattaagcaccaagtattactcggtgcaggaagcgcggaagggccacgaagtgcttcacggagtgggttgaatttgagccaagggagaaatggtcgttattgtacgatacaaatggatcgaggtatagtgtgataacaactaatcttgctgaagtgtataactgggttatgaaaaaaatacacgaccgctaccacttgttgctatccttgagggcatcactaggggtacacagaagtatctctgtaaaaggtattctatggctagtcttaacctcagcaaacccagtgttaagtatagcccagcaattacacagtacatggatgagaaaagcaagaagggaggaatgcatagagtgtggcctgctgggaatagagagttgctatttgagatacgacttcgtgacaagagtggtgtcggcattgggactactgacatcacattggaatgcacgttgtggccagagtatcatgcttgcaaatgcaattgcacaagccttatctgttacaccaaccatgttctcatgttctgtcgcttccacaaaaggaggtgttgatgcaaaccattttgtttctccgtactttatgaaggaagcgtgggaggcaacttggcgaggtgaattgcgtggttggcgagccgtgtgcgatttcactcgtcctcctccagggcaagccaattgggttctggattcatttattagttgatactaaaggttgtcgccagtcgcgtaggatcaagaaccttatggatgaagctaaagcgaaagatcgttctcgtcgtaagaaagcttgcattctttgtggggagaaccatgcccgtaaagattgtgccatgtacaatgtagggaaagacgccgcaggagctgatgttcgtcgcgttccaaagggaaagtcgaagaagaaaaataatccttagatcgctaatagccttggtgggcttgtacttttaagttggtgtcttcaaatttatgtttagcgcgtctgtatttttaatttgaacaatcctccacttttaacttccgaatcaatgtgttgtgggcttgttttttgtaatatccgaatctatttgtaatgggcttgtaatttaattttcgaactgtgcactgcacttttaatatccaaatctacgtgttgttggcttgtagttttaatttgcaatatactgcacttttattatctgaaggtattgtaattttaaattgaataaatgtgttgcaatttaattatctaaattatgtatctgaattatgtgtcatgcatttaatttactgttaccatatgaacattgtactaatatggttttcaatatgcaggtatggctgaacaatatgacgtgcagctgatcgacaaggagattgataggaaccatcggtcgcgacgacttagtagaggaactttctgcaatgtgctgaaaatgcgaggaccggatcaatattggcgtattgatcctcgttgggttccaaggtgcgtaataatatattgttttaaccttataagattttgacatttccctgtattaataacttgcactctctcttcttgtaggttgagagcagctggcttgttgacctttgcacgattgttcgagccttcacgcggcgcttctgagtgctctcgtggatagatggaggcttgagacccacactttccacctcacagttggagagatggtgcccactttgcaggatgtgtcttatctgttgggtctgccgatagctgggccagcagttggcccaacaatggtacaagctggatgggcagacgaccttctggccaattttggtggtgtgctgcctgttgcactggaggatctcatggatgggcacgggccgacaaaaagttggttgaatcagtttcgacatgatgtctttcctgatgatcaggaggactggatcgtgcgacggcacttagtcgcttacctgttgtggttgtttggatgggtgatgttcacaggaactcacactgactcggtggacaagcacttcatccactacgcggagcagattgcagagttacctatcgcagagtttccacagtacagttgggggtcggcggtacttgcggccacatatgctggactatgtgatgcttgcttgaggacagcaagcaaattcactccctggatgcccgttgctactcatgtgggcgcacgagcgcttgacattgggaggcctcagctggactcgtacgcaaacaagaattgcgagagatgtacaagtcccgggttggtgacctcgacaatcgacccactatgggaaccttcgggacacacctgggaggaaatcattgtataaatcggttggctgcctcattatatacggttcaccacaagttgaataatttcctgatataactaatcataagtactatcttcttgttacagccgaagtgggttagcgggacgacgcgtcgtgtgtacacacagttcgtactaactttgatcagcttacgcctgaccgtgtgcggtagactccgtacactcaacacgatgtcaatgatcgtgcaccgcacggtctcgcggacctttgcacgcgggatcaagcactatggaggacgacttgtcacctcgtgctggacgtgcacgtcgagccacacaatgtccaaagggttcttaaacagttgggcatgtatcaggacttttctcccagagttggtcatgctttggctgatagtcttcagaggttggtacacataacagttgtttaatccaatttttaacaaaaatatgtgtacgtacgattttgaataaatgtgtccatttcttgctgtgcaggtattcccgaaaggggctcgggctttcctacgagcttgttattgtgaccatggttcagccgactgtacaagagtgggagcacgcagttgataatttggcgcttcagaaacctccagacgatgggagttactatggggcctaccttcgttgataccgcagtgtcacacgatggaggtgttttccgccacaaggagatagcaccgtcccccaccaggcagcgattactgacacgtttgcccctcagcctcgatcagcttacaactcaatggtatgtgtttacttgtggaacatgcggaatatgagcaactagttcagtatttctaataaatgtggaactagttcaatatttttaataaatgtgctagttaagtattttttataaatgtgcaacttggtcaatattcgtaataaatgtgcaacttattcaatactttgaataaatgtgcaactatatcataattttaattgtcttgcttatttgtggaacatgcaaaatttgttgagcacgtgcaagtcgagtcggacaccttgctgcaaagactagagacgagacctccaaccgtcaagacctccagccgtcaggcctgacgacgtggcgagcatccttcgcaacttccgtgcccgtgctgccgcactacttcgtcgtgtctcctgtcggagcgcggcagatgtggtgcagccgtcggcccgtagggcatcaccaccactaccccgacattccagcgtggatcacagtggtccctcctcgtcatgccgcgggtacgaagcagcacaaccatctcacagtcgtccttcctttcaacacaccccagcaccggagtacaccagggggtcagctagatcaggggtacccccgatgagcacggcacaaccacgtccccacggcacaaccacgtccctaggtattccaaattccgcctcatgttcaccccacccaggaagcatctaggtcgggacacttcccttacatgccaacaagggacaacgtgttcaacacaccagcatggcgacttcacgtcactccgcgtgcgccagatctaggccacacacagcacgtttagtccttgctagtttagcaagagttgaaccaacttataagggcttgtccctccaaccatatcactcccgggttaacccttttacaccaagcgagcacaaaagtataagtgaagtggtatgtgtaagtgggtccgctcgttggatgggctagctacgcggttttggagggaggaatagtacagtatacataagtgggtgacatgtagttcggtcctaaattgactcagacaaacactcccccctatcggtatgcaactaccaccatatgcatatcacttgccacccaagtctaaaatttacatttttattctaaaaatatgcaaagaatctatcacgtcttgataaattcatcccaattaaaaatcattctccaaaaggaataatagaattaattaaaactcaaaaagaaattgacaaacatcaaaactcgtacatgaaaaatctgaatgtgtcccggagtatttttgttaaattatccatggtctaaaaggagccctcaaattttatttgaattttcagagcgtcagaaatatttattaagcaacaaaaacaattttcagagttcatattaaaaaagaaaaacctaaaaataatccatctccttcatttaggccaagtctggcacagagtcttcccctctgtccctcgacccccggccgaagtcctcttcctctccctcttcttccttcctccctttttgccctccttccgggccagcccactccctcctcttctcctcccagcctacctagatcagtttttacattcctgtactgtgggaaaaatatgatttggaaatagaaaaagtacgaattaccccctgaactatcgcggtcgtccgaattaccacccctaaccacaaaaccggacattcttcgcccccaactatacaaactggacgaattacccccctcaacctaatccgcagtggttttggtctacgtggcgtacacgtggcatcccagccagcgtttttttaataaaaaatggtgggacccgtctgtcatactctcccacctctctctttcctactttcctctcaatctctctctctcttcccctcttcccctcaatctctctttgtctacaggtgtgcacgagggcgggcggcggacggcggcgtcgcggcgacggccgagcgaaggcgactacggtggcggctacgggcgcgacgcatgggggcgggcggtggacgtgcccgtggtgcctgtgggctcgtagagctggagctccctgctcccctgcaccaggtcggacagcagggg

SEQ ID NO: 52742 - DNA, 9027 bp, Oryza sativa
gtgagctcccgttgccgccaccgcctagcctcgcctcctctgttgcaccctgccaccgctcgccgcctcatcccctgccgctcgcctcctccgccgctgccgcctcgcctcgcttgagcagcgcgagctcccgccgccgctcgcctcttcagccgccgccgcctccgcacccaccaccgctcatcgcctcatcccccgccgccgccgctcgccgcccgcctggtgctgtgcgcgtgagatagagagagagaggagagagagaggaagagtgaaagagaagagagagaggggggaatagtggaataggagtatgataggtgggtcccacattttttaaataaataaattgctgactggactgccatgcgtacgccacgtagatcaaaaccaccgtggattggatcaaggggggtaattcatccggtttgcatagttaggggtgaagaatgtccggttttgtagttagggggtaattcggactaccgcaatagtttaggggggtaattcgtactttttcctttagaaattatactgggcccttagctttctcctcagcaatggtcgtatctaccactgatctgatcatacccgtcaatgtattgactagcacaccagattaattaatcaaatgcatgatgcacagctaagtcaatgtgaccttccagagttggcttgtattcttctttatctccatcaccttcagacttcttatctatcttttcttcaacaagctttgggaactcgactttattcttctgaatcagcttcccttgccgagtcatactataagaactgagatacatccgctgcatatgttgaacaagcttctctctgctttcttttcatcagacaagtgctcaatagtgacggggatgatgttgtcgtcggtgatttcaatgagagatggcggcatgatgaatggtgaagtggtcccaccgggcgcgctaaaagagtgttgatgagaaacacaacggtctgggagatttctttcactcctatgctggttcaaggcttgcctcaagtatcaagaaagacaataaacgtaattagatgaacgatacccgatcggccaatagagccgataacgtatcatcaagacccagccgataagttaaatcaaatcggttgcggttttgagatggatacgtaaagcaaaaagtctgaatatgtcctatcggctgtaatactatgtcttttgtttttatcaatcacttttagatagcattatagaaatagccaatgatccaatatttagagcgagaatatataataatccaatacaaacttatataaacaggttaatctagataaatgtatcaaataataatctatcaccagatataatagattagttgagatcaatcagacttgatatatttatacagagtgatctatctatataagtggcaaatatagataaaacagattatgaaatatgcattattatgtatattaggtaagatcagctgaaactccgatgctatccttagttatgattaattccaggctagtttatagggttcgagacaagactagggttgttgcaactcaaagtatgttaagaaacctaaagtctaaacaatcaagaaattaaccacttgttaggatggtaaatacgttagctaatctaatacagtaaagcaatttagcttataccagcataaaccctaaagtgagaatcagccgatatgactaaatcgaaatactaaactagattaactaagatatatgataaatgatgaccacggtaaaaaggctaaaatcgacataatagccctgatagtgcaagccatcaagacaagttacctcttgtcgagatatcgcagccaatacccgactcgaagccagaactcatcgaaaaagtaaaaaaaaaagtggcgatgcgccgaaagttgtattgattggattctcgtcccttattacaatgatctagagtttatattcataccccaagtacaaaacttgtccattatgggcttgactcaaactttcccatggataaaaacaacaaataagtccatacgatggactcttaccatatctcaaattcaaactgtcattaatatcctaattaatagatacatttgccttaaatgagttccatctttatatcgcaatattggttatctcgtggcccaaaccgaacccaagtctaactgtatcggctgctttccatatcggctcaatcaaactccgactctattttcagctgatacgctgtcagttgatgcgcaatctgttagaactatatacgatatgctccctccattctaaaattagttgatctctaggatttaaactttctcaagaatagttcgataaattcctacaatcctatctacccttatcagcaaattaaattcaatattacttaccactcaccaccaataatattttttccattaataaaattgtcactggatacaaggaatacttctattttgtgatatagagggagtagaaagtacacaccaatagttgataccccttgcttggttggtgttctatgcacgcatgatgcatatacataggttgtgaaatgtattggagaacaacccaagtgcaacctcatattcctttacattcatataaccgcagcatacatatagatacaaaaactagagaaccagtcagaaaacaaaactagagcataaatacttctcacaaatacacaacgtaagaaattaacccgaaaaagggaaaggaaatataccacccttcagttttctcttccctcttaagcttacagttatcatctccactgccacgtcagcaggacgtaataatatataaacgagataaaacagtcatatgtgttatagatcaagcaattttttccttttatttgataaggattacctaatgttggcttttctttttcagtaagccaccgaatttcttcatcaaagccttcttttgctggttctgcttgactaccaatttggtgttactgttggtcttctctgtggacaacctactgccattgccatcagcagcaatgtctctgtctgtgtccaacagatcaacttccggttcaccgtcgtccctctccttagataagttgtagctgttctcccacatcttagaaactagcaaaactggcccatctttctccgtgtttccctcgtcatttcctatcagagaatacaagtccttgattttctctgaaccagatgattctttgacatgcagatgcaggccatcattctctttgtacgcttttgtgtctttgcctcctctgtaattattatccttgtccatcagagcttccagttctcttaccttctcctctagttgagcatttctgttctccatgtctcttgccgtctctagtgctttacccaaccgagttctcattgacatgatctcttcttctgattttgtgatagagctaacaaagctaagctctttggatcgccactcctcagatgtggtcttggcttctgcttccagctgttccaccttattcttcaagcagatcctctcgtagtttgcttcatcaagcattacctcatagttatccctggtgttgttgaggctgatgttgagctcttgtaattttgccctggtgtgctcgatctctttttctttgtgcaggtaattctcctgtgactctcttgcctcagcagacatctcttgcaatgcagaggccatatcctccattgcttttctaactttctcgcattcatatttgctagattctagttccttagctagcttatccttctcttcacatatggcctcaatttgggagcttgtaaagcttccatccttgatagtacccctcttctcttgttccatcgcgccaagccttgacctaagctcctggatctctgtccttaaggctaatgctcctctctgcgcggcatcgacgcgctgacctgatgcattgatatcttcattctgcctcaccacttcatgttccaaggactctatcttgtcgtgaagaagagcaatttgagactcttttacctgcaacaaagcattcgccgcatccaattccttcatcaccgaactcatggattcagccttgaggatgctggactggttggctagctccagtttgatctcaaaaagttgagccttcttcttccattcaccaaccaatccatctgcttctctcctggccttgatggcattggcaacatcagctctgagaccttcaacggcaccttccaattcagccaccttctcttcggcaaccttggctttcttgagcttgatccttagtaccgacgtctcggcctccagcttcctggttttctcagcggattcttttaccttgctctctagctcagaattaaacgaatccttgagtcggttgatttccgcgttgaggagctccacctgggcggcgttcgcctcgccggctctgatggcgtcatcggcgtggctgagcgccaggttcttggcgtcaatagcgtcagccagttctagcctcgcctcctccagctgcgctaccatggaccgcagcgccgcggcgtcggcctcctgctggcgccgcgttgcctccagcctccgctggagctcatccttcctctgcgtggactcgatggtagtctgctccagctcgatggctcggaacatctcggtctcggaggcttcctccgccttcttgagctcggcgagggcgtaccggagcttggcattggcctcatcggccgtcctcctggcgtcgtcggcgaccttacgatgctccgtctccttctttgccagctgttcctttgccctcctgagatcctcctggatcgccgcgagctgttccatggactgcttcttcacggcagtcctgtgcttctgcagccagcaattcaattcaattccagtgggcgcaggacaggagtcgctcaaaaaaaatttacaaccaaacaaacatctctcaagaatctaagcaagcagtaaagatgatcaatggaccgtacctcggcagaaggcagtgtactgatccgggaggagatcttgggcgagcggtggtcggctgacgacggcgacggcgtcttctccaccaacgccggggacctctcggcacgcgccgccgcatgacgtgggatgccacaggccaccggcctagcggtggcggccacatgtggcgtgctcttgctgcttttggcagcgtcggccgtgctagaactgcagcatgtgtccaacaaatcttattttgctcagaccaagaactaagtcaaatggaaccaaaaaggcagccaaacaattgcgggtaaagaagatgagagattgatgccggattggcacacttacttgagcctggacgagcccgccattgcttctgcctgctgctccccgagcttccgaattggagcgcgcggtgggttgaagaaaagaaaagaatggaggggaggggcagtgcagtgggtgtcggtgttgatcgcccactaggggcaaggggaataatagaatctcatcgccaacaccagcaaaaccagcaatcgctgtttggcttcaagaacagatcttcctttttttcttttttactgtgaaagatcacaatcaccatcacattctgtggtgtactggtgtggcatgggtaggctggctggctttacttgggtttgcagctgttgccgcctcgtcctcaaagggcaagttttataataaatgtggtggtcacctccaattttattcacatcatccatccaaaaaatcaaaattaacttatgtaaatgcattgcatttaatacactagtctcaatacacttgccaccaatcagtccttttattttctcttgttccttaaaatttgtgtagaggttgccctttgcatgaggggtggctcctcccctctctcttcttttctctcctccacatcattatttaagcatacatggcactttggagtttgtgcttaaaaccttatagtacttgccctaaccacccttgcaaatcctgcctctccgagaaaagcgacagcgcgtgtgtttgtgtgtgtgacggaccgcacaaaaaagccacgcctcctgtccgccttgtctcgcgcttgcttctcttccactccccccctctctcaccgctgtctggttttcagtgtgacatatgtgtgggaaaaggcaggaggttttataattttttttattttctttttattttctaattttattaataaatctttccaaaaattatttttaaaaaccgaactggcgtagcagcgttggttggccatgctagctacggtggcgtggaagatctattaataaaattaaaaaaataaaaagctctgaaattttttttaggttttataagaaatacaaggaaaaaaacataatatttgctactttgtgcaaaactgcaaattaaaccatgttgatgagcaaacgaaataagccacaaccgtgtacatgcaccgtgaaggacagcaagctggatggagtattggcatcaaatatgtggcattagcaaactatggcgtacacatgacatatagtactgtgctctttgggcagccatgatatatgccaacgtatagttcactttttgcctcacaggagctagctttgttggtcgagctggcacgtattcatgattaactaggtactaattggtacattacatcagagagggcacgaaaaagaactggacacagaggagcacacctcgagacaatttaatttaatttatttttgcttctgaatacggccatccgggcgtcaagcatgtggggcagttgttgtgcagtgaagcatcaacacacaacaggacattcatgctggccaattcgtcaaaacgatcagggcaatgtaaaaagtgtacccttgtcatcctaaaaggtattccacgcacagttacatacaccgacaatgtgccttatggaatacgccgacgaggaaaatcaactcgatagtacagtgctaggagcctaggagctctacaccactatcaaatgcacgtatatgcaagcgtacaagtaaattaatatttgtttaaacaagctagtaatggtacttacatagggtttaattagtggcggaaacgtgttacttacatgggtatgttaaggcatattaagagatattccattcaaacatataaccacataattttttaaggaatattttaggttaaataaagggagcaaaatagatgcctttcgtttagccactcgtgaacatataccatcaaacacaggtacttattcattatcatactcgcacaaatggtggccaaatgataacgccaagataacgagttcatcctatcctgacttttatcaataggacggtagctagaagatgatatatgagtgtctgtgcaaagtcctattgatgcaacagagataaaaagctagaatgcactacaaaaattggggtgtagaatatccccaaaatgtcacgaccggaattaacccaacgggcgtttcttttgtgcgtgtattattccttgtcccaggaggcaaggtacaccaagagttgatacaattcagagtttaacaagcggaagcgtaaatagataatttattacatgggcgacgaaggcccagcacacataaagacaaacgagaaacagcggaagactagggcgacgaccacaggcgcttgacagcaggcacgagctagacaccaaagccttcatcaaccaggggctcctcttctgggttgggaaaaattgagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtaaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccatggtatacggacggaagacatgatatagtttccaacccatcctagccatagacaagagtaccgacccaatcccacctacggccggaacccccgggacaggcaggcaggactgagcccctagcagcaggacaccggccctgtgccacgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaaatagcgaagcatctacctaacatcatactagtggtaccatgagtagagtgtccactagttggggttttgtttaatctagggtgaacaaggaaataataacaataacaataataaggtcataacaaaggtaaataggcatggctaaacaaaacagtgataacgcgggaatttaaataaagcgataatgcaataatttaaatcaacataattttataaactgggattcaatatgttcaaagatgatgtgacttgccttgctcactttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaa

SEQ ID NO: 52743 - DNA, 6578 bp, Oryza sativa
acttggtttatttccttaataattattatttgtgctctgaaaattccactaaaatttatttacgcattttaggcttttaggaaatatacaaaaatcctccaagccttattggacttttactttgcacattttaattgtgggaggctttcacaaggattttaattattctaggcataatttcgaggatgtattttagagtcattttgggacgcgacaaacctaccccccttaaacggaatctcgaccccgagattcggaagaactgacgaagagatcgggatgggctgccttcagctcgtcttcacgctcccaagtagcttcttcctcggcgtggttgctccattggaccttgcaaaaacggattacccggttcctggtccttcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttgcccaaggaggcgggcagctccaactggtaagcgacttctccgcgccgagcaatgatacggaaaggacccacaaaccgaggtgcgagcttcccctttgtctgaaacctgtgtacacctcgcaagggcgtgacccgaagatacacaaagtcatccactgcgaattctaggtcacggcgtcggttgtctgcataactcttctgccgagaccgggccacctttagattatcccgaatggttctgactttagcttcagcttctctcaggatatcggtcccgaacacttggctttccccaacttggtcccacaatagcggtgtccggcatttgcgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcggatacaattttcttaggaacgccatggagactcacgatcctagcgaagtagagctcggctagtttgttccctccataggtggccttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttctgttccatagggttccgtgttcatcctctgtgaaaccagcggctttaccctgtttcatattcttgaggagtccatgcatgtccggatcgttcttctgagcctcgcggatttgatcgagcaaggtgggcttggcttccaacgcagccaagaatccgcgacccactatgcttagattcagggcttccatctgttgattaagttcgggtggaatgccacggacgttaagagtgttgcaatggctttttcgacttagagcgtcggcgaccacgttggccttaccaggatgatagtgaattcccacatcataattcttgatgagttctaaccatctcctctgccgaagattcagatccgactgggtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagttttgaacgccttctcgcattgcgggctccacacaaatttctcctctttcttcaacaactgtgtcatgggtcgagcgattttggagaagttctcgatgaacctccggtagtatcctgccaaacctaagaaactgcgaatttgagtgactgtcttgggttgcttctaatcggtgacggcggtcactgtttcgggatccacagcaactcctttagcggatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccagaacgaagatcaatcttggagaataccgtggcacctttaagctgatcgaacagatcatcgatccggggaagagggtacttgtttttgatggtgacttcattgagagctctgtagtgaacgcacatcctcttcgtcttgtctttcttctccacaaaaatcacaggagcaccccaggaggaagtactcggacgtatataccccttttctttcaactcttccaactgtttcttaacttcggccagttcatttgctgccatacggtagggtcgcttgtacagaggagtggttcctagagcaagatctatccggaactcaatctctcgcttgggcggcataccgggtagttcttccggaaacacgtctccgaactctctgacaatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaaggaatcccctgaatttctatagggacggcaggactataatactttgctgtcataacccctccaggggtggtgatgagtagagggttcctaagcctttctacccccaactgatttctccccacgaatggcacagatataaacaagtgggaagctccagagtcgaacaaaatggtagcagggatggaatggatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcggaccttgaacgtccctgcggccttgtccagactgcgcggctggcgtaggaggacggggcgcacgggtcccttgctggctctgctgttgctgcggctgtgggacgcgcaccacgaattgaggtcgaggcgcggagcgaggttgctgctgctgcgaggaagatccccctggatagggattggtgtagcggatcctttggttagcaccctgttggttgcggaaattcgccaagcgacgcttgtgcgactccagttccttgtgcttggcttccaagcggatgctcttttccaccagacgttggaaatccggatagtcaccggagactagacggacagacagctccgggtccattcctgccaagaacttctcttgcttctcctcatcttcccgcacatcctccggggcgtaccgggccaagttgttaaactcatgcaaatactccatcacggagcggttgccttgcttcaactctcggaactcccttttcttaagggccatgactccggcgggcacatgggtcctccggaaggcggcggtgaagcgggcccaagtaataggctgcccctctggctgcgtagcctggaaatgatcccaccatagagatgcgggtccctgcagttggtgggcggcgaagacgactttctcctcatcgctgcactgcacagtgtctagctttttccccacggcatgcaaccaatccaacgcatccacggggttgttggagctagagaaggtaggtggacggatgcgtaggaactcggcgagtttagagtgttgtgggggtggtggtggagcattatgttgtggcggattttggatgtggtggaggaaagcagccatcatgttggcctgctgggcgaggatttgggtgagaatggcgttggtgtctggtggtggtggtggaggcggtggaggaggtggaggtgggctgccatggttgttgtggttgctgccttcaggttggttgccatcactggtggcagcatttctcctggtcgtcaccatctgaaaaccccacacagaaccagcaaacagagagagctgacaattaaagctaaccatccacgactaccataactcttgaatttattactgctattaaattggttcattaaagttcaagttgcttaagcaaataaaataaagacaggctccgacacagttatgccacacaccggcataaccatgctccacaagaccccaataagaagacaaacgagaaagaacacacgtgcaagcctactaactgctcgtctaccactgcgacgggccaggacggaaggtgagcaacagcgcatcctccgtgctaccgacgccggaggcttccccctcctgaggaaccacgggcgcgggctcggcacgaggggtctccacgaagcaagtccacgccagggactgacgaacaagctcgggcctggaggtgctcttgcgggcggtgatcttctggctgcggcagacgcggcgacgcttggggcgacagacctctccctgggtgatcttgagctgatgcagctgtgcctccactgcgtctaggtccttcttcagctgcagattctcctgacgcagctccaggatcttcaggtcgttctcgaccatcccacggcgcaccatctgatggaagtcgatacgagccgcgtcgtacgcctccaccatgcgcgccaggtgcatgatggtagcgtcatcctctgagctagcatcccagaaggtggcgtagtcgcgggctcctccgcgacgagggtggtagcggtagggcgagtgctgcagctcgtccgggtagcgctagtgaagagtgccgatggcgaggagagcgacgctctggcaagcggcggagaaagaatctccacccgcggtgactgccaacgaagtccgctcgggtgagccagtgaggatcactgcagtaacctcccaagcagcgtggggctctgcatcgtcaccctcctgctccgggagcggcctgccctggtagtccactccatgcggataccccaggacaacgcacataccccgcagctccaagacgaaaccagtcatgtccagaccacgacgactaacgctgccggccatctacaaacaaaaacaaaaagaaaagcaacatttaaaagtcagattttggcgataaatgaagcagcaggacagagagagactagagagttttcacaattagcaaaggatttttatttttgatgatattgctaaggcttgggatctacggctcgtcctagggtcaagggggctctgataccaacttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagactagggcgacgaccacaggcgcttgacggcaggcacgagctagacaccaaagccttcatcaaccaggggctcctcttctgggttgggaaaaattgagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccatgaacccacacgaacctgccttaacccaaggcctacgatgattcagaccgaaccggcaacccgaccctgggtcccagctcgtcccagccacccaggccaaccattccacaatttagttgttaagcagg

SEQ ID NO: 52744 - DNA, 1027 bp, Oryza sativa
gaacccccgggacaggcaggcaggactgagcccctagcagcaggacaccggccctgtgccacgacatctcgactaccgggccgcagctcgtgtagccttcatttgccctggagatgtccatcgacccccgacttcgtccatctccatccgtgtacttttgtttataaccagactgagccacaaagtaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaagtagcgaagcatctcactccctatcacccaaacaaactcagcctaagaagttttaggttatctctaagttaaacttttcatttttaactaactttatacaaaaatatagtagcatcgataataccaagttaatattattaaattcatcgtaaatatatttccttagtatatttcttttgtgttgtaaatgctactaacttttctacaaataaacatgattaaatttaaaaagtttgtattaggataaaccctaaatgacttatctctactaactgaatttgattgctcaatattcgattattcttttacctttgaaagaagaggcattgtcctcgtccccactattgtagtccccacataaaaaaactacccgaaaaaaccagcccatccaaaaaaaacaacccaccaaaacacaagatataaaagacagaaccctataaaacatgtgcatgacactagtaatataaacacggtggagtagtagttaccatggagggccctacataaataaaaaaacagatcaaacatgattcacgcaccacgaatgattaactaatccacatcaaaataactatttcctccggattg

SEQ ID NO: 52745 - DNA, 2052 bp, Oryza sativa
gggcgcgcccgaaagtggccacccccgcacaaccgacgggaagccgcgcacccgcgccccgatggtcccgccggcgaccaccggcgcggcggaacggcgccccaaaaaagggaaggaagggggaaacgaatcggcggtccacagctcaccccggggtggccgcgaacaacggaaccgccaccggaaccgaagaaagccgccgcccgcttccggttaacggggacggcggcggttcggccgttggccggccaaaccgaagggttgaccaagttggccaagtttcggccaaaccgaaggaagcggcccccaaaccggaaaaggttcggggcgacgacggcggccagccggaagttggcggttaccgccgaaaaaaaaaaccaccaccgcgagttgtattcggcgaaaaaaaaaaaaccgcgagtgcgaaaccgttgaaggaagccacgggaggtgtttatataggtttggaattaaaaaaggccgcccggataaggggaaaacgggcgcggaagatccggccgccattgatgcgccggcgaggtttagggggaaagattccgaacgaatccgagggagagagggagggaaaaatggggggaaagagggagggaatcacggggaatatttccccctcttgattgcacgcgggcggacgggagcggcgggatttgcggcggcgcggccgctaggcgcgggcgaggcggcgggagcggcgggaggaaggggatgacgggtgggccccacccgtcagcgagggtggcgggcgggcccgcccgtcagcggcgcgcacgcgggaagaggccgatgggccgcggggagaggagagggagggggagggagatgggccgagccggcccaagagggagagggagggaaaggggactttttagagtttttctttttataaaatcattttaactttgtttatttcttaataattattatttgtgctctgaaaattccactaaaatttatttacgcattttaggcttttaggaaatatacaaaaatctcccaagccttatttgacttttaactttgcaccttttaattgttggaggctttcacatggattttaattattcttggcataatttagaggatgtattttagagtcgttttgggacgtgattatagggagatctgtctatataagtggcaaatatacataaaactttagtaaaggagtatgcatattaggtaagatcgactgaaaccccgatactacccttattaacaatcaagaaacaggctagagatcatggttctaaacacgaccttagtaggtcgaatatactgatgcggcactaagtatgaaaagaaacatgatatctaaacaatcaagccattgactaaattttcagggtggtagatgtctaagctaatctaatctagcaacacgatttagccgataccggcaggacccctaaagcgagaagcaaccgatagagctaaatgatatgctaagactaaattaatagagacatatgataacgatggtcacgataaaaaggactaaaatatctaaaaatgacatattagcccacgatagcacaagccatcgagacgggttgcttcttgtgaagcaaactcgtcgaaaagtaaaagagaaaagggtggtgatgcgccaaagttgtattggattatctcccgtattacaatgctatggggttcatatttataccccgaatacaaacttagtccattatggacacgactcgaacctttctaaagataaaatacaaacaagaccatatacggtggtctcttaccaaactctaacaaactgacataactatcctaattaatagatacaattgccttacatgagctctatctctgattggcaatgccggttatcctgatctaggcccatgccgagcccaagttatatcgtaccggccaagccaagcctttgtccaatttttagctgatgcttagtccgtcttggagataaacttgataccacaccaaatccgcttcggtttccttcttcctttttgaatctgatgcaaaattccattgttaacactaagataactgataaccagc

SEQ ID NO: 52746 - DNA, 1952 bp, Oryza sativa
taccgccagcatttgcataaactcatataataaaacatccaatatagtgggtaggtgttaattctaacatattccacgagtgttggtgtttaattgatgccaggtcctaaaccaccgaagttgggagaaaaatcagctaaagtgaagaaggaacatatccatacaagggaggggctttacactttactaaaataccagagaatcagcccaaaactcacagtaatggataaagcagaacaggaggagtccacaggccaaaattgagggccagatgggccagcccagaaccctgatctccaccgttgatcctggggtttggcagggacgctcctgatttgatcctaatggcggttggagggcacttcggacaattctcgttccacaaccgtcattaactgcctatttaaggagtttcactcattcgcttcttcacacacttccaagcttgagctgaattataagaggctctgttgtactattttgtatactagaattaggaagagagtagagtagaagaaatcggaggaatttcggagatgtcggtaatcctctcatgtttattttattctgttaattactctattttcaatagaaatatctttctgagtaatttagatttacttgtgagtacttgtgagaattacctcttataagaattattgatcacaaacatatattgatctcgccacaattccgtcatcaccagccacgccaagcaccaacccgtgatgtgtttgtgcttctaacggtggctgctataacaatactgccatttttcatttaagcaggttgtccatagaagtcaaatttgagaacttcatctcttcagtcctttggctcacatagcaaaactctgagttatcgtatacatgatttgttagtaagtcagagtagcatatacgtaattgtagtgcaagaaacataacctaaattacccatgcataacttgagaccacctttttttttattcaaacaagtatggcggtcagattccatttccttcattgtggttctttggcttgccttagtcctgacctgcaatcgataacattgtgcaatacatctaaatgagaaaaaaaagattcatgcatggggttgaaatgaatgaaaatcaatgttgctgtccaccctgaagatgctattgccatttttccaaaacattgcattgacgaaataatgaccgaacaaatgaaaattcagatggaagcagtgctctgcacgtattgcacatgcaaattcaataatgcacacatgaaaatttagataagagcaggaaatggagatgcttaaagcatcacaaaaacaaaactctagcagcaggcctacctatgcatgatccttatccatatttcatatccacaaaaaaaaactactactattttgtagtcataatactgctaaaaatagcatgttcaacgagaccatatatatgtacgtagtgagcagttcagaaacacaatccaatccatctcctttttcaacaagaaacatatcgtcagaagttcagaaaaaaaatcaatcgatgtgctcctttgaacaacaaaattttggaaatgttgctatccaatcgagttatttgagttttcatctatccaaaacttcagattcaggacatgcagtaaaaatttcagaaactacaagcatatgtgccaatcatgtggctgactgatctagtgatgttctgtaaaagctgctggctaatcaactaaggccattcacagagcgccctgcaattttggtgttcctcccatgccaactagacaaagaactttataggctacatactccacaatgcatgtagcatcttttttatttttttatctccctctctctcctcttctcctttcccctgttctccctctcctctcctccttcccatcggcagagcgtggcggcgagggcggcgccggcaccggggcgacgagggggtgcacggcgacgaccccccaccc

SEQ ID NO: 52747 - DNA, 26448 bp, Oryza sativa
  unsure (1)..(26448): unsure at all n locations
tggccgaatccttgtttcgacacccgtcggcagagcgcggcggcgagggcagcgccggcgctgggacgacgaggcggcacacggcgacgaccccccagcccccgccccctcctctcctcccaccggcggcatgcagcggcgacgaccccgccgcctcctctcctaccagcactcagatctggcgccccccgtaccgagcagcggcaacaacgtcgaccccgtcccgacggaggcgccgggtggagggacggcccgagcagcgacgacaacatcgggtggccctagtagcgacggtgccggttgcagatcgagctcgccggcgacctgccccgcggcgccgccgctcctctccccgttggctgcctcgcccctcgcccctctttcctgtagcaatgagtgtggggcccgcctgagagcaggaactcatagccaaagttggctactcggacttgagaaagccacgcggttggatgatgtggcaaggaatattcgcttttaggggttgagactgaatgccatgtagacccattgtgaatggcctaatagctctgctacactaaaaattatcagaaactgcaagcttatcgttggtgctcaccattggccggccacgcggtgtcgctggcgcttcaccttgctcccattgttgccagcaacctctcgtcgctcgagaatcgagatccataaaaatcaaggttttggactgcttgccactctcccggatggcgtgttcttaaatgccactctcccggatgacttcgctatttttttcattggagagagaagatttcttgctcgtgtgccatttttgagcccgcaaagcaccacgtcacctgatccgagggcaaaatgaccatcttgcccttcttcttcctctagctcggggtctctctcctccaaccttcctccctgtgtggggccgtgttacgggataggacacgtggcgcgattttatcatatgtaaaattgcttccaggtttagccacgtggcccaatcaacgctaagggatcggacccagaaatcggtataagagataaagattcctcatatccagtcggtttgcaaggctgtgttgggggtttcaaggcgtgacacgtgctccttttcctttttcttctgccgtttgaatgcagcatttaccacttcattaggttgctgctgcttttttccttcttgtgttctgatgtttgtatagctgccggtggattcactgattagaacttgctgttgacggtgtatatcttagaggagatacaatagtagactataagtcggttataaacatatttcaaaaggataaaagaggagagagaagagcaacgttctacaaatttatagccagctataacacagactttaagatatattgtgtgtacgacaagtaggatcacatattaatagtataatagtattgaggtctaacccctcctagtttcattagtacaagtatatcgaggctcgttatatccagcatgaaaggtaaagggaaaaagaagataaaaacagcttactcagtgtcagtgatgccatcccatcacttatgccaagtctgcaactaaaaattgcaagctagctaaaggaactaattctgtcaaactatagaataaaccagtatcccagcattttgccaaatgactgacatagcaactacaaaagacatttcacttctaggtattttcttcatttgcttgcaaggtgctccactcgcattgccagattgccttcactgtaatctcctcatttgtggcttggtttagcggcagccttaacgtgcattcatctccatcgccggtgtcgagttgtaggtccagatccggccagttctagcttccgccacttccagctcgccctcaccaacggctccagctaggaaggaggcagagggtaacgcgcctcgtgcacgccctagccggctcagcaactgtcgccgtcactgacggcctctatggcaaggagggagggggttttggactatttgccactctcccggatggcgtgttctcaaatgccactctctcggataacttcgctgttctgccatcggatagagaggatttcttgctcgtgtgtcatttttgagcccgcaagaggccatgtcacccgatctaagaacaaaatggccatcttgcccttctttttcatttctccccacgtctctttcatccccttcctttcccaaggcggtgaggttattgggctccggtgagctcctcgcctcgcactcctccctccttcgctccgctccttacctcccaggcccctgctgctgccaacaccggcccctactctttcttttgtggcattgccggtgcctcgctccatcgtcaccgtcgtcgccttcctactcctctcggctcttctccactctcctccgacgttggtggttgcgtcaggtccaacctcgaggcttcccctatcttgtcgtttgccacctagcaccaagaggtcagtccggcggtgtcaccagctcacacgccgggaaaattttcagaatataccaccaaatatgcaccgctttcaagatttaccaccaaattcgtgctactttcagaatacgtcacatcggagtacgaattttcttcattccgtgccattccgtcccccaacgttattcacaccgtcgtcatccagctcccggcgctgccgacgtcagttcgtcacctcgcgcgctcgcgtgcggcacgccgtcgtccgtcctccgccgcccgccctcgcgtgcgccacgcagtcatccgtccgcccggcgccgccctcatcgtcatctaccatcagcttggccgtcgtcgtcgcccaccatcagccgccccgtcgtcgtcctcaccaacagctcgtcgacgttgtcgtatgtggcggcctctgcctgctcgccagctccgccacaaagccgtttaagcagattctctttccttactcaatattcaggaaacattcgttcttatgaatcaaagacaacaatcttttctctctttttttggtatttcgagaggagaaaccatgcaaacatagcagcaagacgactttgaaaaataggggggggtaaaatgtgagagctaaacacaaaagggccccccccaatcttagagtgtaaacactttcaaatatcgatatatttttttccgaaacgaagcttcacccttaaatgcaaatctcaggcataagcaagcagaagatccctggtggctggctggcttggtcttttcagcttccttttcttctacttgttcccacacagccactcctttttttccccggtgattaaaaccgaggtgttctcacggtcgcggcatgaggcctcgacggcgatggcctctacggccttggtggtcgcatcgtcgtgtcgacgtccagggcatcgacgacaccaatccaggcaacgaggagcccgcgtcatatcgtcgccatcttgacgcagctccgggctcagccctggagcatcgccgcgccccacatgcggagctccgccccaaacacgcgcggtggccgcgcttgcttgccctgaagctgcggaggacgacgacgatggcggcggcgaacggacaacggcgcggctgacgcgggtacaggcggtggcggactgacgacggcggcgccgggcggacggacgactgcgtggcgcacatgagagcgggcggcggcggacggacgacggcgtgacgcccgcgagcgcgggaggtggcgaactgacgtcggcggcgccgggagatggacgatgacggtgtgattgacgttgggggtacggaatggcaccgaacgaagaaaattcgcactccgatagcgtattctgaaagtagcacaaattaaatggtaaatcctaaaagcattgcgtattcgatggcatattctgaaaattctcgcccgcctatccgccatcccgaaacgccgccgcctcccctcctcatcgctccgcctcctattgctgccggccgccgctgcatccttctcctgatctccttcccatgccaggcaccacggcaaccttctcctccccatcaccgcctcctatccatccccttcagacgtcaccgctgcaccatccaagccacgccaccagtccctcatcggacgagctcaagggcgccagatccgggcagaacgagcgccgacgctgcctcctgcccatccctattctgggctcccctcggacgacatgcacgggctgagcggcgacactgtcgacgacacgacgacgacgacatcctcctcagcgagatgctccagtcgaccacccccgacggtctctggttaatccacagctgctgcaggttttctccctttattcctgctcatctttaggcctccttctccctgacctcgctgtggaggaacgagctagacggcggcagcctttcatccaccgtcatcctcaattttgtttattctctggcaaagaggcaataaagctcaccggagatacacacaagttatcaattccggtactcgtttctttaggtgaatactgactcatctacactttcttaattgaactggaaaaatgcatctagatttttttttctgaattcaattaatttattagcaaggtttccatatctgacatgatgcttcatgctttccatgcatacaatcagcagattaatgacccgtaaccttcatgtatattataatctgatgagtatgtgtcaatggttgaggacgtcaatcagatatcgattaaatgacctccaaatcatttcattatctgtatactttgttagcagcgatgcgttcacctatggtcaggtagctgctgcactaatctgcaaaaggaaaaaaaaaaagaaagagagaaaaagaaaacatagtaaggcattttgagcttaaatttagttagcattagttaaaaaaagttagcagttatataagttatttacatgattgttcgttaagatccaaaaccttttgcttacctgatgctaattttatggacatttgtctagttgtttataaaatcttctttatcttttttatggcacggagtaatctagcaaaactaaccccaagaaatcgtttctactatgctcacatcagtgggacaattttgacctataagaacagcagaaagaaattgccctttctattttgcttttaaaactagagtttctttgctttccattttcacctctgcatgaacgaagatcacaaccagaacttctgcttgggctaccctatagtcacaaagaactttgtcttgataacaagctgcatttcttttagatcacatatacttgtattatgctctctcaaaattatttgtttcatgttatattctgataaccgagtcactgccttatcctttagatattaaaatctgaattaaagtctaccatagctcaaattcaaggagctacattgttatgttccgtttcttcagaacacatgttttttctgttcatgaccttatttacattttcttaagttgacatagagtgctgggactgagaaatgcaggtgcagaactgggactttaaccactgtacaattcagtgagagagcaatgctcatgccaaacaaggctgtggtaaatgagatatcacaagacggtggattcggtgataagttatattattatcctcactgaaaatattgtcttactttctattcattacaaatagttaaatctccttatttcatcattgatgctaatctgaaagtattgatcatacaatatctttgtaaggaaaacatatttgacaggcaaaatttgctataggacatccaaaaaaacgtgtaattagctaagagacaccgcaagaacgcgtttttgctatagggcaccgtaaaaaactggtaattagctactggacaccctcgggattattttattatatccggaagaattggagagagaaacagctgtgtaagtacagatctaccctttgatttttttttctttttcttttttcttccttatccttttctccctctctcgttctctctctctctctctctctctctctgctctcaaccgtcgccttcaacctcgcccgcggccgccgccgctcctcctatgctcgcccactgtcgctgctccgcccaccgcgctcgcttgctgtcgctgctcctcccaggctcgcctgccgttgccgctcctccttcgctcgcccactgtcgccggtgctactgctccatggcttcatgtccttcatgcccagcacggtgatgtagacatgaacgcgctcagccactcatcagtagccgacggcgaccattggcgcgaacgcggtgccgaacgagcagtcagcggcggcctgcgatgttagctaaataatgcaatcttgtgcatctagtttctgtagttgcattgcatatggttggctgtgttagaatctgtcagcagccgttttacttccagttagcatgtagctgttttctagctagtttttcggttggactgaattggatcgtgggatggcacggtcagtagtggatccagatcaatcgggtgttttttctgttatgcatgtaacaaactctgtaattgaggagaataattaggaaaccagaaaagcagcagggtacttcgctgtgccaaaactctgctcgttctactctgttcttcagttaactattcatatattcgacaaaaggttcagagattgtgagagtgagagtttgatcctgtaaaaatgagaccgtgtgcttcacatccaccatcgtttcttctcctctcttgctctttgcttggtgatgagaatgtaagatgtgtttaagcccgtgattagtgaagactaactaaagaaaatgtttagcggcccacgttggattaacttgagccaagggtaaactagtctttaatgattgtttctctctcctattcctccaaaaataataaaataatcccaccagtgtccagcggctaattaccagttttttacgatgccctacagcaaatacacgttcttacgatgtcccctagctaattacacgtttttcagatgtcctgttgcaaattttacctatttgatatgaacctcatattctttttataaggagaaacaaagttgatctctcattgtcagtaacaaaagcaacttagtttgatggtatgtaaaactagattatcgggtaagttgaatgtaaaattttgtgattatgtagcccttttttttgttttggatatacatatttagttatgatcaattcttatttacctgacttcataattaacagtgcattgggtccatccaattgagctagcctatatatactaatgcgcggcaaagccgtggttagtttctagttccttacggaaaccaagatatatctatatatgaaatatatatgaagtgtgttcaatgtcctgcattctacatatagcacataaacatgtatttatgattactacatagtaggataaaaggtataaacatatgatcggacaaaagatataaaaagataatcaaacaaaaggtattagcaaccctaggcgctccacaacatctagttgttcaacgggcacaaggaatgctattccatgagctgaacatagcacagccatcaggcttacgaaccccacagtttaataatggaaacaacaaaactgtagctttctgattgattcattaatgtggccaacttctactccaacaaagttatagcatacgtttagcttgagtttacaaacttaatattgatggtgcatttcaagcggatcgcaaaacagatggatggggttttgttttgcgcaacgatgagggtcatgcttttgtttgcgggtgctgggcgcatcgaattcgtcaatgatgctatttctgctgaagcaagggcatgcttggtagctctgttaaccatctcggtccaaggtgtatctgctgtggaaattgagactgactcggccatactggctttggcgattaagtcctcatcgcatgacctagccactggtgctacaatcttcacggaaataaaaacgcttctccagtttcagtttgctagctttgaggtctcttttgcgcctcgttcttgtaataaagttgctcacgaacttgctcatttgggtgagttggaacccgggtcaatcgtttgtttgggttgaccccatcccagaatttgtaaggttcctggtgattcgtgatctcactgaatttcagtaataagaaatcgtcgttgcagatttaaaaaaaaaaaaaaaaagcttcccggtacaccagaacattattttcgttttgatgacaggtacagtttacaatgaaggattagctgctaacaaggacggattgtacatttacacttaattattgtacagttgcacctacaacctaaagattgaaattgtgaattcccactgttactagttatacaaagaacaaaaactttcccatgcacacccctagcatttcaagtacacgaggtgtatagttaattcaatcaaataaagaacacgagtaaacaatggtgctcctatctgtatggatatctcatattctatgtgacttgattttgcattgatttgccatttatttcccacctgctattcattatctcatgaccctctgaaagaagctttgactttagcttcttaccagctggtcctggttcaactataatcccagactcaagctctctctcaatccaatcatcttcagtcaaaccatctaaagatacaggctggtcatttttttgtccaataacaattccagattccagttctctctcaatccagccttcatcacttaaatcatacgatgcaacaacatggtcaacttttttaaaaactataccagactcaagttctctctcaatccaggcttcttcacttaggtcaactgaaggaatgcaccgcccttgtctttctcttcgtctcttcctcttcatcaacaaatcctttatccgtgccacatctacctttttacgctccacacacaaatgatcaacctttatctggacaggcaatacaaatgatgccttctccgtggtacctgcagtggaattagccagtctctgatcagagcacaaactgtccacattgagactgtcactggtatggttacaaattgtagtgggcggttcgacagattgagtgcttttgctgtccacatctgtaagcgatgatccaccctctgagcataactttgttttatcaccacttcgctgacttattgagaacgggttcaagattttgccattgaatgtgttacttgagctgcaacaaatgccaatattctgttccacgcatttagcagtgctgctatcaatctttgcaattgcatctaatggtatctgctgattacatgagatcagtccaccatgtttgatttttaaggcctgatccaagctttctttattgtgtgttttaccgggattattcatatcagcagtaagattcgataaattcctttcaggatatgacttgctacgatcctcaatatgcactatgtcttgacttgaatccacctgcaggtggtcattggggtctccaatttcaggactcgagctgcttactgacaagctagattgagtcaacacagaatctgggctatttgatatgagcagcattccttcaaaaagaacttccttttgcttagccggactgggatgagcaaacagctttgctttcatgtgaaccatctccctcatttgctgaaggacagctatagcagtgtaactcttagtctcttactgtaaataccaagaatacacaaggtactattatgtttcagcttagtagtctacataccttccaaaggttttggggcaacatcaaattggtgccaccaaacatgccctccatgcacaggaagcttgacgttctgaaacttagcagccaggtagagcgaaccagcagctatgtattggggcttatactgtaggcacagtgttgttttaagcctacgagcaacagaatgaatacatccagattgatcagttgaatgaatgaagcatcaaaacaataatgtcacaaagtgatatgtcacatctcataccaatcatttacaaagttccaagctacttgtttcacttccttctgagagatcccaagtttttccatagcatcaagtagtggtctgtaaggatgttggatgttgaaatcaaaccgaacagttgtaaggactaatctctccccggtcaaaattagtgctttctgcttctcaaatacatcctgttgatagatactacttgtcaaccattaactggatggtacatatatactgaaaactcaattaatgatccaactataccttctggtggattcttcgagctgtagctgggtccctcctgtacattgttccataggccactctaattacttggtccagaggacaaggtgtatcttcaacttttgaagccagaaatatgcacactgttgcaatcgtctgcaataaaaaacaagtaaagctattggctctggaatgacaataagcaaataaaataaacaccaattacttgtaatagtatttagttatagacagcttgcatcacatgcacagctttttttttcttttcttgagcaatgaagaaacatgtcagcaagtaacatctgcaagtgcagataacgagcacaactccagattaattgcagagacaagaatgtgtttctcaattaaataaccgcatgacaggaatacagtgaatgtggtgaggcgaatcaaatctataaaacttactggaggatttatacttattagatggtcagttatagtattttagcttctaataacaggattgtaagctgtattcctgttggctaatggcaatagtgtaacttcaacaggaatgctgaacagacttgtcctcaaaaaggatgttctattgtattgtacaatacatctcaatactattgtatcttccaaacatcccaagcaaatcaaccataaatcagactatatcaaaactttacagcacagtaaaaaagtaaggaattacaatataggattactgattggcacaagtagatccctttggaattgaatttctaaatcacctaatggcactgtaacatcgccatgcacttaataagcaatacaagattaaatgttagtgttattatgcagcttcatatttattgtacaaccgataatagatcggaaagttaagcacaagttgcaaagagtatatgaactgatcaagtataaaaaatatgcaagggttatatatgttccttgagaacctttgccagtaaatattttttaaagagaagattgtatccaattgcttttctaaaacattctttcagaaaaatgctttttctaaaagacaccaacccaccacaacaaaagagataaattaaaaaaaaaagctccttacctgccatccgtttttggcaagggactggtacagatagaagcgatggcagaacattattgctgttgctatagtcatctgtggtctgaaagaaaaatgttaaaataggtaacaagcttagcaaacttccagaataaaagaaattattgtgtgctaactaagggcacaaactagccgtaaaaccaacatataagtttgaaaagtgagctatactgacattaaaaggtacactcaacaaggaaattggcacatacagtttcagtctaatgccaacatcccgaatgaatgaacagtacaactgccgaatttctgactccattatctcagtaataccatctttcctagatggggaaaatttctccagttcttccctggtgaagtaccaagagtacatgtgctcacatgataatttactcgtctgggattccccatccatcagtatgtttgaaaaaacctgcttaaggaccctccaaaatcttcagtgtagtttcagacagaacttccgaattgcttgtgctgaacagcctgcagaaccatgaaatttatgtatataataaaaatatctacaatatgaatccacatactgagcaacgaacattatgaatgtaaatttaagccaatatgtacagattatagctaaattgtgcatgttttacatgatctattcctttgatagcttgctacagttgcattcaccatgctactgtgaacatttttacctccctttccctcaattggcagagaacgaaattaacagaaatgttaaaaaagtttctcatagccacaaaggaaaataaattatattgatgaagatgatattttttaatcaaattaacatacatggtataacaagatactaatgtattccatcccagaaaatctctcccctatatttttgagtataacatgagccatcatattaagccatgtcatcatcattaaaatgctaatcatctgatgattttactttaaaagaaatccataagatgacctatttcaattttatccataactaatcaagagtcacggatactgatttatattcatcaaaatgctgtgtgcagttatattcattacatttccttccatttaaaactcttttgttcagaacctgtacagacatgtgaattccacgagattgaatcttttgaacatgtactcctaatggaagacgatatccggcattgaagcgtctatactccagaggaaatcaatgtgtgctgatgagtttgaattccaaagtctaaattccaaaaccttaccaaaaatgtagatgagtttgatccgcctcaatgcactaataaaaggaaaatagcactgagcagagcttagaaattctaaagcctacttgcatggtccaatttgtaaccataatcacttatcagttgcatttcaagatttctatgcaaacatcttgcaattactgatttgtctgttcatttcagttcattgttgtttgtgccctcttatgtgccaattaaattgttgtttgtgttctctgaagtgcaaacatcagacattctgatctgttgccatgcaatgtggagcattgtatggatgggatctatcgacactatacatgagacaatgtggatataggagtacgatgtgagatttccgagatatccagtgtaaatacatggtgaaatgtttaactaggtcggaaacatgtaaaccacagaatataagttctcaaaaagagttttatttgaaaaaaagaactcaatgatagctatatgaaattagatgggcatacaaaattcaagataaaactcaactttgtttgtgagatattaagtttacaaatagcaaagaaaaaaacacaaataaagaatactctttttttcctcactgtttatcaatttcatatgtcctgaaattttatatggttgtctaatataaccttcctgtatgtgagatattttagaaatttatgcgatagttttcccatgtttaatatccactgcatgtttttcccatatatcaatgtgcaactacacattacccattgaaagttttcgcatgtattgcctttccggttagaagcagacaatacacaatttcaaggatgtggtacacggcccttgggttctgcttaataacaattgcacctgagacaagttaacggtattccattatacaaagagaataatgctcttatgccacaaagttggatgcgaaaactctcattttgaacaaaagtttgaagcctttactaaaatgccacaaaattgagtaccaattcattcttttaccacaatacagtgtgaaattccaaattaatgcccaccttcttctccttctccatttttgtcctatccccacccttcttctctgtgtccagcaaggacagacctagctctgtccggccaaagtttgagccagacctggcagccagcccactcctgcacgtccgacgccccactcctgcatgtccaacgcgcacgccatctccgtgcacctgagctcggcatgagctatgacaccctagctccagtagccagcttcaaccttagcattacctccgcctctggccgccagcagcacaacaatatgcgtcctgccctcagcaactggctctgtgcagcccacctactccgcgcacggctttcctcctgaaagccagttccacgcgccctgctcccggccgcagtggcggacctaggtcctaggcctgggtgtaaaagcccatagagagacatacatttttaagatataattttctgttgggccaaacacagtgggcaccagcccgtgcggccaagctccattcacaaactcatagaagagagaaagagggtgcagaagaagggaaaattgcacatttggtgggttaaaatggtaaagtgtggcagataaacgagtatacaactgaactttgtggcatttttacaaagccaacaaatcatgtggcaaataagagtatggcatgcagctttgcggcataagagaaattttctgttgtacatacatcttcacagtatagaaattctggttacaacaaaaacaacatgctgaaaactatgtcttttgttggcagaagattgtaatatctcatccaaatccaagcttaactgaatgtagaaaagatttctcaactagcagtaactatttatgtataggcacaatcttcttgaccaagtaaataatagattctacaaactgcgctcactaaaagttggcagactttgggtgtaatttcaaccaactcccagttaataaactgaccaaatttctcgacaaaagcaaagcagtttgtccacccctttaggataacatctttgaagacaaaatcaagaatacacacaagctagtcccagcccgacaaaaaatctagcccacaagatatcgttgtaaaaggtggagaagcaatgaattcacatcgacttctgcatatgccatacggccaatacgtcaaacagcgagaagatccccaaattgaataggaaatcacgacgaagctcgtcggctcacccatgaattcacctcccaattcgccaaagacagaatctttgacctaaccgggggcatgatggggttcagttgaacccccaaatctattgtttgtggaactaaggcggagagaaaagcttccagatctaggagagaagataagggattaaaaagaggatgacgcgagcagggtgctcaccggcctgcgaggatgcggcagaagcagcaggctgctactcgccctcgcgagatggagatcggcgcaggcggcgggtgggcagtcgaggccgaggggacggggatgcgggggagatcaatttccctaggccgggcgcgacgactcggaggccacctacgccgtactgcactcggatactattgacttgcgtccagtgccccaaaatccacccttgaaatgcatccaacgtctcaaactgcctcccctactatccggtgtcactggtctgtaccgtgtaaacagctcacttccaaggtcggacctcgccgctaattctgctatcatattttggtctcaaatatataattctaaattactcctagctattcactgggtgaataaggccatctacaatgtgtcttcaacccgccccagcgacggccgttcgcttttccgttcgagccatgccctggtgatggcgcgcgacccctgcttgggagacgcgcctcctccttttcggctagggaacgggctagaggcacgcgctgcggcgacagacgcctcaggcgactgtctctccaccaccatattccccttccacccctctccccctctctctcctctcctccgttctcatcgcgagacggcctaccccgctgagccgagctcctcctcgggcaccgccgaggtgcgccgtctcctcagcctctgctagcgggagagagagaggcggtgggcggagtcggccaccgtgcggcagccgtctgccgggctcgtcttagccatcggcagagggagcggcgggatctcgagctacggccggaaatagcagcgacgagagagagagagcgcgcggcgagcggcggcaacggcggatccccggcggaggcaacgggttcgcggcggagtaggcggctctcctcgtcgccctcgtcgacaaagctccggcggcgagggtggtcctactcgtcgcccttgcggccgccaccggagagagagagagctggggtgggtggcgacgatggcgtgacggagaaggccagggaggatgccacccgcctctcgccgcttgccgtcggccaccgcagcggtgcgctgggcctgagttggaggcggcggcgagagggagaggcgagtgcggtggcgaaaaaaaggagggggcaagagagagagagattaggggtaggatagtaaaaataaatatggggctttgtaggctgtgatacctattgtgggttggagtgtctctattaagttgtttcagattttgaggagcccatccaggggtatcctccattccgagctgagttcctctacagcactctagaagtggctcacattgtggattccctaaggacaatagcagtacaatctactcaaaatcatgcctcgctatgccacataggatgaggttcctatatggacactagctccacaatggagggtccccctaacaactttttttcatctgcgcccttaaattcttctatgtcagcccttcctatattttgtattaacaaaccatccaattttttatatttcagaccctgcaacaaaaaaaaaagatctacacacataatcatgcctgcccactgacccacttgtcagccatcccttactttttcctccccctcaccccgttctctcgctcccaattgcatttaatcctcatcccctcccaagtcccaacgaagacgccgacgcctctccatcttcgccgcctcaccaacatcgcccccagcttcatcgcctactctcctctccatctccgtcggcgccacccatctccgtctaccctctcccgttccccatccatcccctcccctccagcggcaaatcaagttccaatgatgcaaccaagctcggtggcggtggagcttcggcggcgggaccgaactccggcatcagcgaattgaactccgacggcgcaaaacaaggttggctttctcctacgtggatcaaggccgacagtgtgggcggggcagtctcgtctccggcaagcaccaagtggagcaacgtcggggccatcgcgacgtggagcatcgacggcatcctcgggctcatctctggcaagcggcgagtagagcagcggcaggcccactcgtggtcgttgccacgtccggaaattcactagtaatttccgaacttatttgtgcataaaaccctcgtccaggaatcagccgaggtacacaaactgacaatttaatatacaaatccatcataataataacgttacatacttacaaaagaaaagaaaacagcagcggaaataacggtctagcgatgacttcagctccattcccacaggcagctcaactggggtataagccaaacgtcttctccttctggatcccttttcttcaattgaggttgattgattattgcaagaataagcatatgacatactcaacaagccacacagcaaatatgcaagtgcacaaggataccaaaggatggcataatataggctcatttgtaaaagcagcatttagcaaagatttaagagtagtaaaacaatagagtaattaatcatcaattttaatcaacactgaacagcaccccaatgctgtacaggcccaaccaaacctgaacaaccaaccccggctgtacaaatctaactccaaaccaggagctaagcaaattattaccaattatagcatcaataattattgtgagatgtgtgagactaatcacgaaaaacattgctcaactcgcccataaccgcgggcacggctattcgaatagttttactctggccagaggtgtaccactgtacctacaagacacagcctcaacatcatgtctaccatgcgtcgcgatactggaaagtacccgaatagaggctatgacaataccctctgcacaacacaactcaccacagtgcaccatacctggatcataatcaccccctctataaatacaaccagaggcatggactccccagcgacccccacggacttctcgccgcttctcagtctggtgccccgcaatgaatcatgctatacaaaaggtaaagccgttgcctatgctggcttgtggttggcacggttaatgttttacaacagtagctcgcgaatcggtccttaattgccatgagcacgaccttcacaaccatgtgctcacaacccaccattgacaaattttaattggcaataattaattaaccaatcacgattgaccatcgtgagctaccattaaatataaccataagtgatagtgtaacattagttatcccaatcatgtgctaatgtttctaagcatggctaagcaattatatatatatagcatttagctgaacccaaaccaatatataaggttctagctaatcaaattataacccataggaaaataaagccatcttcggccattaattaattgtgaaaggctcaccacccgatgacattcgaaaataatgcataagttgaaatcaaacaatagctttaaacgggttcaacatgctcaaagggttgtttgggatctttgtgacttgccttgagcttccgcaaacacttccgaaccttcctcaacgaaaacgctctcctccggaacgtcggaaactaaaacgaaagaacaaaatcaacaaaatagtacaaaaacaagcataaccagtacatgtggatatttttaacatgtagatcttgattttagaaaaatttagcaacttgaaccactcgaatccgaggtacgatgatttagttattaatttccgaagtttaatcgattttcatctaatagagaaaactaagaaaagggattaatgacgtcatcgctgacatcatcaatgtcgactcgacatcagcgacgacctcgccggcgctagaagactcggccggacttttggagggtacctacgcgtagaggagaacaacgcgatctcaccggtactaaccaatgcgacgaacgacgaccggcgacgagcttgtgcggcggcggcggctctccggtgaccggtggtgacggcgaaggggcggccgagcttcccctcttccacgcgcacccgacggcgacgtgaggaggcggcggcggcggctaaaacgacggcgcgaggcggctgttcgccggcggcgacggcggcggtttgggtggcgcggcggcggcactacggggcacgagagagctcgggacatggggcaaacgaaagaggacgactaggggatgctatttataggcttggattgaagagatcggactccaaccgagaggaatcgaagccggaaaatccgagggttagttggagagataaactcgaaaacgaattcgattccgcgttgatttcttcgtgataaagtccgattcttgggggaaaggatagaggaggataagaggaatatttcccctcaactaattttgcaaacggagcacgggatgcggcggatttggtggaggaagcggcgtccgctagagcacaggacggcagctcgggcttctgtccaagcttgaagacgacactgtagcagggaggagaattagacttttcgtcttgggctggctgaaaccaaagcaaagaaagaaagaggaggagctcggatgggccgacttgggctgcacagcacgcgcgcgagggagagagatgttgggctgaaatcagcccaacggcttaggagaggatttaaaaactttttccaattaaaataatcactgaaatgatctttgaattgttaaaaatacttccaatgctcaaatagtttcaagaaaaatcctgaaaatacttggacactcaaagtacttaacaaaattataatcagaccatttaatgattaatttaatatgtggataattactgaaatgttctttgtatggttaaaattaggaattgagctccgaaaaatccgagaaaattccagagagtataattaaccatggagaatttaataaaaaataaatccgtccatgctttatatttaggaaattttatttcccacatttaacttctcttgtaaattaatgaacatttaatataaattctaataataatttattaaataatttataaatcctaaaacgaaaatcaggatgtgacagtcatcctcctcctcgcttcgagaggcggccccagtggtggatctctacgctgccgaccggtggtggatctcgagcggcatccccggtggcggatctcgtgtgacggcccggtggcgactccagctccatgagctctcatgatgaggacatcaacaccatcgatacatccacgtctccacgactacaacctcatggtcctattacctgttgacggtcattatagacgaatttcgaccatcaatactgttggaaataatggagaactagaaatgcttgcatgcatattcatttagaaataacctatttccactagtacttgacaaagtacttgtatacaggagatcacttcataaattaagaagaaatgatggaaaatcaccaatcagaggtcgacatgcggtagacatatggatagatgggcccacaaacctattgaaacacttgcaaatgggaccaaccaccataccactgggcccaggatccatcaggagacgttcagaaggaaggactggcccagggaggcctgccaggcgtcggccgacccaggcttggctccgctggcctaggcccaagccaacgacggttactactgaccttccaatgacggttgtacctgttttggcacctccaaccgtcattctcaagctataaaaggacctcatctccttcattccaacacacaccaacaaggaatcaagtgaagaagctttttagtttacatattttgctctagtgctagtagagtcagaattagaatagtcttccttagttcttcaagtcttctggagaattcgggtatggttctactatctcttccctctcttgtaagattttatccattaatgaaatatttttctttatatagttttggtcctttactatacttgtataattattcgagtaccaaatttggtttatacttgactcgtattaaatatgtggctagcttaccaaagatatgcaatggtattggcttagtgttcattcatatggttgctctatgtcatctgcagaggtgtagagtaatatttagtaatgtaagtgtggtgcttagattattagatattattaagtggtgttatatgccacagatctgtagaggtaggccgctgatggtgatagctcagcacgggtattcctccacgtcgtatatagggctaagaaggttcttggtgcaggtactcctccatatctttaaccggttggatagccatgacggattgtagtaaggaattcggcaatatggggtggtttctcaatatattaggaggacatagttagggggtattagccataaagttgtacaatagcaaatgtatactaaaatgactatatactagaagtgcataaatgatatttttctttttttttatccacttagcctagacttatcaattatcaagagtattctaaactgatccttctgtgtgtcaacctatccttatcctaaaatgattaactcctgcaaaagactttgattttatataagtgtaatatgaatttatagcatagtactctcttaccatatcttttcttggaattaaataaatacgatacttggaaatatttccagttgaaatgctacagtggtatatccgtgaggatttattctataacccataagaataccgtctaatatctctggcaacattgcttgggattaatttcctagtaatgtcgttaagaaatatcaacattacctgcgcttgtgcacgtcaatatcaacattacctgcgcttgtgcacgtcaactcaactatcaggtgagttcattcttgagttcatgttcatcttatttatacccccagagacatgtgcactcttgttttacttaggaatgatagagaggatcaaaagggagaggattcgcgcgggctggattcaaactacaggacaactccaacttgtgacgaccgccacgacttcctacgaactccgatttgggcgtgcaagtacttcatggaaagcttatcaagtctactttgaaatggatctggcctcatgtccatatcaattctggagtggccgcaatcatcgctttatcaccgagcctttttctatcaaaggtattgcgtcaacttatttgggcccaataggctatgtatcaagttgggtccattaaggacgcgtcctatgattagagcacaaccccaacacccatgtggttgttctccccctcttcttatacctttatagccactgccaagaacaattggtttttgatgatcagagttagcaacttgctacctgcttgcagcgcgcgtgttggcgaaaccgcccgtctgcttctattcggaaccctgccatattgtgatttcctagtgaaactttcatattcatctagcagttctacttgttcttcgattgcttgcagggcatacgagtgccctctaggtcgggttgtcgtgcaccacaagttcgtgacgaccattggtgacggtatatcggttgctaaggcgcaacgtccttggacggttatagttgggccataaacgtcgtcttcatccaatcgagttatctccgcctcttattgaaagattgggatacaaatccctcgcgggttcacaacaggtggtatcagagcgtggttgatcagtgagagattatttaccctccgttgtttattttttttcctatagtctagaaaaagccaaaaaaaattagattagttagggcttgttgagttttcgattgcatcggttgtgtcaacttgttggtcttagcacttagtctattagagtttcttgttcttaccacgcacatcgccatcttcatcaccgccgccatcaccacttttgtcgtcatcagcaccatcacagccatccaccaaattcctttctgtttgtgtttgatatgttccttttattgagtttaattgtcgttgagcctgctgccaccagaaaggaaacagaaccctgattcgagtgatctaccttaaaggaaatagaaccctgattcgagtgatctcccttaaaatagtcgtatctttttcatatggactcgaaatttggcataatatatccacggacatctacctaaaaaaattacatcgccaaattccacactcgacaaaattaaaatcgcgaaattccacttgcaaaattatgtttttgaggcgagaagctttgcaaaacctttagatagaactttgaaaaaaatttacatgcttcatattttgtccgtttgagctaagaatttatgtggttggttccaatgtgctcctaactgtgaaaaaatatcaaaaaaataaaaataaaagttccatctctctcctcagcaccttccgccatttcctgttgtcaccactgtcatcgttcctgtttaggtttgtgtcttgtgatgttctttgtggttaggctcacgtctctacttcggctagcctaggaccagtcaggcccggcccgggggggtcgagctgggcctccacacagggcccacgaagtgaaggggcccaaccccatatatgctgtacataatagcccataggaactaagaagcccactagctcaggagaggaagaagcaaatgtacaggaaaaaaattgcgtcgatttggcttccttccgtgattccgtccgatcgcttcgccttcgctcgcaatcgcctgactcttcgcatgttcggctgttcgccaccctcccaggttccagccatgtttcagctacgtcgacgactgcgcgcggctatgcgtcaacggccggtgtcgtgctcagtgccgtcagcggcaccacgacagccggtagccagatgcaaatctcttatctctctgactctctgttcagttctaggagaccaggaggtaccccattgctctcccctttgatgtatgctaagtttatatgtttaaattttgggatgcaaaatgttactccccaattgctcctcttctgatttctgaaattttgatttaggatttagggatcctcgcggagtcgcggtgcagctgtgcaactagggcagtgaatagttattttctttagttctcaactaggtaatttgccagcactcatttttattataatgttgaattgaatctagtatgacataattttcataaattacttacttttttctaaatttacagtgaaatcatgtaatgtctcaagaaagattaaatggtttggcaactttatgcatcgagaagaaactattagatgaaattgatattgatgccatcgtcgatgacttcgcatcggtacatgttagaagaaaattttaaggtaagatatataacttgttttataagaatgtttttttatgcattaaatttattagaaacatagttatattattatagttgtattaaagggcccatttttctagcttcgctccaggccactgaattgacaggaccgggcctgtgaccagcactgtacaaaccttgaacgattatattattcaacttgatttggctaacttggttgctagttttctcttgagcattactttcagcccattgacaactcaaccacaaacctgactacaacttgataggtcttgttgctacggcaccgatacacctcgttccacggttgcagacttgtgggttgacgtcccctcctatgagtaaggtaagaattggtaagggcttgtaagataggctgagagtgagcatcttgcaaaagctacatcccaatagttgtagggcttatatttcctcatttgttgtttttgttgcctttgttttattagccatggcatgttcagaggataatgatgaggagggtgcgtttcattccccacgcaccaaaggcatcataaaatattttacaaggcaagttaagtagcacaaagaaggacttgatgctgatttgcaggtgacaaatgagaagaatggacaattggagtccacacagatcgccaccaacatcaagcttacagggttggagacatcgatcgcttgcattaacactagccttgctgctcttgtgaggcattttgatgatctcaatgctagaggtaatggtcgacgtaatgaagacggcattgaggatgaatatacgctgacactaaacaagatgatcgagatgctcttgatcgttgacaactacgcaataatcatagaggtatgggtggtcaccgccaacgcaaggtacgcaataatgatgatgtttttttttctaaaattaaatttaagatacctcctattgatggaaaatatgatcccgatgcgtacctttcttgggagattgttgttgaccaaaaatttgcatggcatgattttcctgagaattctaaagttactagttagttcactgatttttcttcggtttggtgaatagaacatggcaagaaaaatcctaataacatgccacaaacttgggatgcttttaaacgggtcatgcgggcatgatctgctccttactttgcgtgtgatttgttgaataggttgcaacaattgagacagggtgtgaaaagtataggggaatattatcaggaattacaaatgggcatgcttcgttgtaatttagaggaaactgaggacgctgctatggctagatttttgggtggtttaaatggtgagatttatgacatcgtagactacaaagattacactaatatgactcgattgtttcatcttgcttgtaaagctgaaagggaagtgcaggtaaatctacattatgataggcaggcaccacttctccggccggccgtactccttcctcatcttccacacccacacccagtcgagcagcacctcctccatccagtaacaagccacgtggccctcctgcaagttcaacgacaaaggctgtttagctagccgcgagtgcttcttcaattgcatccacgggtaaaacaagagatgttcagtgtcaccattgcaagggctttgggcacatgcagcgtgactaccctagcaagcatgttttggtagtcaaaaatgatggtgaatatttgtctactagtgatttcgatgaggatacacttgctttgcttgcagctgaccatgcaaataatgaggagccgccagaagagcatattagggctaatgatgcagagcactatgagaacctcattgtgcagcgtgtcctcagtgcacaaatggagaaggcggagcaaaatcactgacacacattgtccaaacaatgtacgtcatcaaagagcgttcttgctgcatgatcattgatggaggtaactgccacaattgctagcagcgagatggtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52748 - DNA, 18340 bp, Oryza sativa
ggggtccctctctgcgccgaggtctccaccagggttcctctccgcaccgaggttgccgccgttagatccagtggcacgacgggcggcgacgctagatgcagtgatgggcggtggagatggatgtggcgcaaagggaggagaggatgagagagagagagagagagaggataaggatggagcagatgcgcgaggacttggtggggttaagtagtggctcgtttcaggttttttgaggtgtcggttctctaagaaccgatacctacaatatattattatagttgttgaaaggtgttggttttgtattttttttcttcccatggaggtgagaacggtcaataggtgttggtattatgagctggtatgtatgagggtttaataggtgttggtattatgagctggtatgtatgagggttttttttaagtagtgttggcaacttggcataaaaggtgaacgagaatttattttccctgctttcacatggaaacaactgaacacacaaacaatgtagggggtgtttagatcttgggggtgtttacatccaggggtgtaaagttttggcgtgtcacatcgggtattatatagggtgttgcatggggtgttcgggcactaataaaaaaactaattacataatccgtcagtaaatcgcgagtcgaatttattaagcctaattaatccgtcattagcaaatgtttactgtagcaccacattgtcaaatcatggagcaattagacttaaagattcatctcacaaattagtcacaatctgtcaattaattattggttgatcctctatttaatacttcatgctgatgttcaaacgttccatgtgataggatgtaaaattttaggggggctctaacccgggccgtaatcttctgcccagtggatacagttcagtcagtgtgatcattatgcttgtatggactacaaggcacgctgagaactgggctgctggtatcgcaatggttacagtatggttcagccaccaggcataaccgattctttgttgatgtgggagtctcgccaaatgtcctacaaatgaaagtgcgtgtgcttgaagagagatcaaatttgaaaagtgacaagacagcgttggatttctcgggtagagaaaggttctttcctctgtttttttacaaaaatatcaggtttttcccttttctggaaaattaacttgggggcgagagaagccagaactctcgacctcaggatatctccttaacgttcggcagcagcacattgtgtgaaagttatttcgttttccgcgagcacgttttccaaattactaaatggtgtgtttttttaaaaaaaaatttctatatgaaagttgtttcaaaaaatcatattgatacagttttaatttttaaaataatttatatttaattaattatgcgctaatggctcacctcgttttacgtatcttctcaatcttctcttctctcctctcaaactcaatgttccaaatagtaagagagattgagcctcattgatcacggggtttacaatatatatgggggagagaggcatgttggcaggagtgcgtgagggcctgaagacgtggggcaccaccgtgccccggagttggttgccgatccatccatatatatggatgagatcatatatcttgtttcataatagattcaatctattttcatccctacacatatttttttattgaaagtctatctagcagcttgaactttgaaatgagatatccagccctccgaactactatataatatcgtttatattgcaccctagtgtagtttttacaaaatgatttttatctaatttacatatatgttggattagtttaactaggtgacatatgcattggaatttggacatatgtgttaaaatcatcagcgaaatcttctgtttccccaactttttgctcttaattgcttacaaaagaatgcccatataattctagtatgacaatactatggagtataaattggtccatgtgatttgacgatatgtaaacatgctacattagttatttaaaactgctgatttaaggttccaaatacccaaaactactatccaaaagccactatactatatgattgacgatatgcaaacatactacattagttagcagtgttctttccgcgcccgctttttaaactgctaaatggtatgttttttgtaaaaattttctatacgaatgttacgttaaaaaaatcatattaatctattttttaaaaaagttattaaacaattaattaatcaaagaaaatgcgttgttccgttttacgtgcgcaggaggtgagttccaaacttcacctccctaacacagcctatttttttacgatgctagataaacttttatcaagtatatgtggtacatagactttttcctttttaggctgagctaaacaagtacttactcgccagtgtagaaaaattatttggcatggtctgaatttcgtgaatatcggcgatttttcatcatgtccaaacagttgggcgaacaaattttttgcggaaccctaagaactactggctactgtcaacttgccaattgagctatggagatggggaagaagtgaaattagcttccgttaagaaaagacaaaaaaactaaaaagcaaatctgtttgttccatgtcaacgttcacaaacattcataagcaggcaccatgctaactcttgcctgtacaaaaacaatgctagctgccgcttcaacgcaggaagaaacgcaaatccacgacgctcagaaccttgaacccgttcaggctgcaacccatcacaagcctcggcttcttcggcgccggtgggcagtgcagagcaccttcaagtcctcctcctcctccacagagagctgttggcgtcgaagctgctgcttcttcttcctcctctgaacggggccgcttcgtcttcgcgggatgtagggttacagcttgcgcctcctggatggttctcttggctagaattttgattttcctctgcaaacccatgttttcctgatgaacccctgagcattgaacagaactagagattggtcagctagctctcagacttgagggtgatgtgaacaatcaaaacaaaacaataggagaaagagttgtgcatactagcagcagcagcagcctaggctcgtcggagatgtccacgggagggaatggatatgacagaacgacagtgcgatgtgcatgcttataagcagttcagtaaaggaagcaggaaagatccttgcaaggggctggaaaaggaagaaacaggaacgctagatacagtaaatgccagtgcacaaggaggcagagggctgagatcaagcaatttaggaatctgaggaagttgcaaacgagatgaaaaggaggaacccatcagttcatttgcgctaaaacttgtcttctttcaataacagtaaggaaagattaccaggatgcaaaggaaagaggaaagtgcttaatttgcgagaggacggagggaagttagtactgaggggcacgtgagcatgagcaaaagtgagcaagaaagagaataaaaggaaaaaacaaagagaaaaagaatagctttgtctttgctgcaaaaagaagattgaaggccgctaggtatatgcaaaaagccaaccagttataattatccatatttttggtgtgttttggaggaatcagctcgatactttaaagttaaatgcaaactttttgagctattaaatgatacttttcaattcaactcatcttttcttttcttcttttttttttttgacaaaaggcatacacgacccagctttactgaagccataccgggttctgatacaactacacgctggagactcaacacagcatagctcgcttagaacaaaacagaaccgtctatatctaagaaatgccatcgatgaatacaacttccgggaaatgccatcgtacgaatcaacctctcccaaaaatgccatcaccatcactactcccttagctatactccgttggacatggtgaaaagaccatttgccccatgtgaatgctacataatgtatctgcaaaactattgtatgatactttggtaaagagtggattttctcttgtaatatttgcaccaggtaatattcttactaaaactaaaaatgagacattatgatattttcaattttcacacacatgtaatagtagcacaattatataggaactcattttcgagttctagaccaaaatttgtctaaatttattgaatgtcaggaactaaagggaatggccaaatacctaggcatgaactcacatgaacaccactatgctcagaacagcacaagcagaactctaaaaaagtgaaccttgaaaaaaacaggacttcacatcaagataaaatcattacaaacatcaataatcatatattcataattgaatcattacaaatcaacacatttcagtgggtaaatggacctataccaatttttgtcaatgacaatagaaacttggatttcctcacttctggataatatatcgcagatgaccaccttcagggaccacagtgctgtcgcctgcgtcccccgtatcactacctgggagtgaggcgccaccgcctccagcctcacttccaccgccggttggagtggccctacctcctcctcgggcccatgcaccattgtctggggccaccctagcacctccttgcgcccccatgccgccgcctaggagcgcagcatcgcagcctcgcccccccccccacgccaccgcccaacgtagccctggctgggagacccacgccgccgtcgccgtgaggattcaccccaccgctgccatcattggtcgggagcgccgcggtgccgccgggatccaatcagcttcctcctagatcggggctagggttaggtgttgtttccattttgtcgaatttgtctttactaggtaaaaagaaataaaggatagagtaagtatagtatgtactgagggcactttgggcttttctaaaaaaaaataaataggtgtaacggagtggaattaacagaaaccaaacggtagtggcatttttgggagaagttaattcgtacgatggcattttctagaagttgcgttcgtcaatggcatttcttcgattaggacacttgtcaattgcatttcatggattttctcgagaaagaacagcgaactattctttttatcgcagtccaagcacaagagatgaaattgccaccattgtcatcttccgtggagaatatgggtacccggtacccatacggtctgcatatccgactatagataggaggtgggctggattcatgtattatataactagaaaagatgcccgtgcattacaacgggttgagccaatttaatttgtacatgtgtcggcggccattgtttcgtttattcatgtgcttatcggaatcacttacaacaaaataaaagactatttgtgtgcaaatctctcatacacaagttcttagcgactcaaaagcaaatactgtaaaataaagtacgataaaaaaaccaaaaagtcaaatttaaaattacgttctaaaatttaaaacttggcttataggaataagcataagccaaacaatgaggccttcaaacacgagctcgatttgttgcccagctttatctcaagtcgggcaggaattgatgacggatggaatcagcaacttcgatcatactctatttcggttggcgtgttcttttcaaaagtaaaactgattctggattattgtaacggtatctctggtagtacgtacgagcatgtgtggagagtgacttgaaatcatgctaacatgtcccaggaaccgtgtcgtgtaatatgaatagaattggataatctgggcaacggcgtatgtgatatccacatggactctacgacacggactttctttcgcagttcgctcgcgagtcatgacttcgcaatgaatgttacacgtaacggaatcagatacaggcgacgtaccatagttttcacaaaaaagaaaaaaaattttaaatcacgggtgagggcgacgcagtcccaatcggacatacggcaaaggcaaatcatgcgcgcgagggcgttgccgtgcaaaggcgcctgtggaaatattctcaggcacgggcccgattgccgtgtgtggcaaggggcgcgtgaaatgctacgggcctaattaatttgcacgcatcttagataagagggacactctggcgtaagaaaaaaggaaaggatttgacataaatataaaattctagcaaaaaaatcttcaatttttataatagtagagatagagataaagtatggctcggtcacaatgttgccttgtgttctattgtaggacctagagtcccgattgagtactaccatgtaatagattagcaaactgtatcgtgtccggctaggtttttctctttaatttgtatccctgcccctaacctatataaggtgagtagggagaccttaaagggtatagcaacataagccacagtcagatcatcggaccaatacaatccccaaacaaaagtaatgtattacctcttattcagagagcctgaacttgtctaaactctcgtctttcgcatctatccacttttaggtctcgtgccctacccccttatcattgtcaatttccaaaatcgatagtttggcacgttaggtagcggtcgcgtcgagtttgttgtcgagaagtgcgatagaatcaacttctagagaagtgttgagatcaatctcaacgagtttgatggctcaaatctctaacctgggtttgtcattccaatctaacttctattagattgatatctaaaggtagattgatctcctgttactttcttgttttcaaatgctagctgagatcgagatgagtggtcgtcatcccagtgcgtcagcccgacgtgctccttgatgcactcaatgcacacgccggtgcgggtcacgctcatcatgggaacaaggcaggtctacgggttgtgtccacaacctattaacgttaatcgcacgcggagccgccggcaaccacgatttaactcgtgtgcatgtgtaattcaaccggcatgcatgacttaatcacacacaatacattgatatatgaagcatctatatctttcagcttactgacggattgattttcatgattgctttgttttgcatgtatgacgattcaatcacctgataagatcgatcaacccacctccatccgagctatacatgtgttgataaccaaatttgacacgggtcatgttatagctagtttgagccaaatttagaacggaattgctaactatcgtttgactgatttatgagccttccatcattcgcatttttgccgtaggatatggtttttgagatccgtgctagcatctagctgctaattaactaggtccacgttgctaattaactaggtccacgttactgttccctgttgttaaactagccgtacgtgtttttcaatgctaatttatttatgatcccacgcgtactaattacatcgtacttacactataattatatattaattacatatgtaattttagtgtatttacgatgtaagtctgaaaattacatatataattttagtgtatttacgatgtaagtttgaaatctacttgagcccatttgagccccatgagcttcagattgtccacgtggctcgtttgtttgttttttgtattttgtttgtgcatattaatgtcatccgttagatgttgatttaaagggtaagaaatgtgcatcataggaggctaaaaaatctgtcacatgatctataggcagtaaccaaatttgacacgggtcatgttatagctagtttgagccaaatttggaaactaccaagtcattcccgcgaaggccagtctaaccgccgtagtgtggctggtcagaccggacaatgagctgtgatcagaccgccgggtggtcagaccttcagcatagagtcagagtccaatttaggtatttctcgtatttccttgttttagatcggtgttggtatttcttaacgtcacaaatgcagcacttcacctgggattattcttaggtatcgatttccacaggcaacgggtattacttccttatcaggttcacccaaggacaccaagctaagatgcgcaaaggatagagaggatttcctagtgagaaacattgtctaaggaaagtttaattttaatcctaacgcgataattcagacactggcaacccgctgttcctagatgtcgctctactacataccctgacagggaggacttaagtgctcttgagggctgtcaccacctctacacccacctcaaacgtactgtgggatacacaacaattactggatataaattacctaaacaccacgtctgagcaattaatatctactttagtgtttctaactcactaaagcaatcactatattttagtcgattatagtgaacaataattcttataagaggtaattctcacaagtactcacaagtaaatctaaattactcagaaagatatttctattgaaaacagagtaattaacagaataaaataaacatgagaggattaccgacatctccgaaattcctccgacttcttctactctactctcttcctaattctagtatacaaaatagtacaacagagcctcttataattcagctcaagcttggaagtgtgtgaagaagtgaatgagtgaagctccttaaataggcagttaatgacggttgtggaacgggaattgtccaaagtgccctccaaccgccattaggatcaaatcaggagcatcccttccaaaccccaggatcaacggtggagatcagggttctgggctggcccatctggccctcaattttggcctgtggactcctcctgttctgccttatccattactgcgagttttgggctgattctctggtattttagtgaagtctaaagcccctcccttgtatggatatgttccttcttcactttagtctgattttcctcccaacttcggtggtttaggacctgcatcaattaaacacgaacactcgtggaatatgttagaattaacacctaccactatattggatgttttattatctgagttttatgcaaatgctggcggtataaaaatgtgtatttaatagccgccaacaatagggatttctcgagtcctagttgatttctaagcctaattggacgtgggaaagaccatgggaagtaagtccacccctaatataaatataagggggacaagttcgattgaaacaataaccactcaatcgtcaaaatcaatttagttatccaaaccctctatattctacatctccctccttgcttccaatcccaagtaaattctccccaaatcccctaattgctcgccgcctctcgtctctacggtgttaaaggacatcctagctggcctgccgagtctagcacaaactagagcgcattcaccctaacggggtccctcctgggtgtgtgttcggcagcctctacccacaccctacagcggcgcgtctccgggtgattccgtgggttgcacataacatgctcaagttgtggcggcgcgattctacatcaacaacatgcacatgcgtgatctacctgtacaggtacacatcaaccagtgactgttctagccagaatccacaaagcatagatgttaacaacaaaatttggtaagatacgtggacataaggatggatccgaagcggatttgaaggagttagtttggtttccaaaatgaaacaatgcatctgctggagtctgtatcagtcgatatagagttggatttgattagtcgatacatatgatttcgagttcatgatgagttcggattgaggattcagaattattgccatacaaggatagagtctaaagaagcaattgcatctattaattaggataagagtaagctttcctttttgtgttttagaaatctatattagcatccacaatgggctggtgtgtttattttgtgaagtttgaatcgtgtccgatatgaacaagttttgtactacgagtataaatatatgcccagggtcttgtatgaagaacaacaacagttcaatatactctcagcgcatcgccaaactttttgttttcaattttctcaatgagttcttgtttcgagttggggcatcttcttcgatcttccgatgagaggtatgacttgtcacagtagtttgcatcggtggattagtataacgttttaaatgttctaatctatctattgtagctgctggttatcagttatcttagtgttaacaatggaattttgcatcagattcaaaaaggaagagatgaagttctcaaatttgacttctatggacaacctgcttaaatgaaaaatggcagtattgttatagcagccaccattagaagcacaaacacatcacgggttggtgcttggcgtggccggtgatgacggaattgtggcgagatcaatatatgtttgtgatcagtaggattaattagtttagggaacggaatttcgtggcaagatcaatatgtttagaacaatcaatgtaatagtaatttagttactaagagataatatgttgagaacatgtaatagtaacttggttactaagagaaattttgtggcaagatgaatatgttatgttgagaaccatcggtgtaatattaatttatttactaagtgaaattttgtggcaagataaatatttaatgttgagaaccatcgatgtaatagtaatttgtttactaagagaaataatatcaaataggcccaaccatcacactactgggctgatggatcaacaggcaacacaccgaccaaaaactgggccggttgggcctaactagggttggctgttggctcccccttgcacgtggatgcctaggatcccttccaatgacggttgcggggtatttacgaccattccaaccaccacaaccgtcattggtagctattgacagtcgttatcgatcagttttgaccgttaatattaccaaaatagaggataactaatgatgcttgcaatgcataaatgtattagaataataaacttccactagtattaggcatgctaacctcttgcagggaatgacactaaagtggaggagaatcgacatcaactcaaacgataaatcaatcagacgatgtcgagaaccagacgtatgtatgaatgggccaagaactcagaattgacacgacaaactgggccaaaattcacaagtctgaggagaagaacaacggagaaggccgctagccgaaattgggctagattgggccggccccaagttcggctgaacctggtggttcggccgaacctcccgcagctccgtttgatccagggttctcctggacggctgagatggctccccagtggcggttggagggtattaccgaccattccaacagtcacaaccgtcattgggaggctataaaaggagctctcatcctcacttcactcacacacctcaagcaatagctctctcatttctctcaagtttagtttagtagtatctagctggtggaataggaatagagtagaaatcaggagtctggaagccttcggaagactttgggtatggctctaacagctttcctttcctcttttgtaagctttgtacttttattagaatactcttctatatacatttatggtattgaaatactttccgagtatatgagtacctactttacattatgttcatgttatactaaatatacgtctagcttatctgggagatgctttggtgcgggtataatgtttgcatatacaattactctatgtcatgatgatgatattaaagtagtatctgatagtttagacgtggtgtctagattacaaggtatcattatttggggctatatattgcggatgagaggtgggccactgatggtgacagctcagtacgggtattcctccgcgccggtatataatcctaagttaatttcctggggagggtattcctccgtatttagccccggttgtatggtcatgacgggctatcgtaaggaactcagcagtcaggggtggcttctcgaagtaccaggagagcatcggatagagggtattagctagtatatcagttaactagaatgtatgtatactatgtatattagaagtataggaatatattttctttgtcttttctttccacctagcttagataatttattatgaggatgagtagtaatgcttgtgtatcactctactcttgtattatcttaacccctacttagaatatgattatcacaaagtaatatataaactattagttaagctctctctacattatcttcccacgggataaaataaatacgatacccttggaatactctcgggtaaaatgctaaaatggtatatccatgcgcttgcggatgaactctgtaaccataatatactagaagtatttctgcgccattgctgggaattatatttctagtaatgtcattaagaaataccaacaagcatttctggcgtcgttgccggggaagattcataatagagattacttgaactaatactttatatttacatctatataatcatttcctttgcaggctaaccttggttgttttcactttttgttgtgaaaacagggtagtgcatgacaggtttcaacctgccggaaaacttcaaagaaaatccagaagctttcttccgagcgtcaggccgcgagtcgttgcttcgcagaaaactctaccaacggagaaaccagccctaccagtgccaccgaccttcaagactatggccagcaagactcttcgcgagttcgctgctccctctgctgacaatgtggccattgggccgcaggtcaacataggggacgtggattttgacttgaagtccagcctcatgacgatggcacaggctagcccgttctatggcaagcctaatgaggatgccaatgctcatctgcaacagttcctggagatctgtagcacgtacaccattaagggtgtcagtcccgacgtcgtcaggttgcggctatttccgttctcccttctcgggagagcaaagtagtgattttatgccaaccatgctgctgtcaacacctgggacaaatgctctacggcattcctctcgaaattcttcccgacgggcaaaaccaatgcccttcatggaaggatttccagtttccagcagacaagggacgagtctattcccgaagcatgggaatgactgcaggagtacgtggccgcctgtcctcatcatgggatggacgactggctgatcctgcagaatttttacaatggactcaccccaatgtcccgcgatcacctggacgctacggctggaggagccttcttttctaaaacggttcaaggagtcgttgaactgatagagaagatggtctccaatatgggttggagcgaggaacgactccagacccgtcagcgaggcatacacaccgtcaaggagacagagctacttgctgccaagctggacctcctcatgaaacgcttggacgaccatgagaaaaggccacaaggcaccgtcaaggccttggactcacacgtcacgtgtgaggtctgcggcggcacgggtcattctgggaatgactgcccggaaacccgtgaggaggcgatgtacatgggcaacaacaacgggtaccgtccacaaggaggtcaggggtggaaccaaccacgcccatattatcaaggaggtaacaataacggtaacttctctaaccagccctccctgaaggatctcatttttgcgcaagcttaaaccactgatggattaagcaaaaaacttgctgccaatgataaggtcctagagaacattaatgtcaagttagatggctttgcttctgcctttcaaaatcagctgagctttaacaaaatgacataaacccagttagctcagttagcatctttagtccctgcaaatgaaactgggaggattccgaggcaacccgactcctccattgaaaatgtcaaggcgatcacgacgaggggaggtaagtccactcgtgatccgccatatcctaaccctgcaggaactaatgggatgtcaaaagaagcgccatctaatgactcggctgacaaggagattcagccagaaaagaccgtgctgcaggaatactgtgacacacggttgctgccgtttccccaacggatgaggaaaccgtcagtggacgagcagttcgctcgttttgttgaagtgatccagaagatccacatcaacgtgtcgttgttggacgctatacaagtgccgacatatgcccgttatctcaaagatatactcaacaacaagagactgctcccaacaatggaggtggtcaagctaacggaacaatgcagcaacgtcatactccataagctcccggaaaagaagaaagatctggggtgtcctacgatcacctgctcgatcggggcacaacaattcgaccaggccttatgtgaccttggagccagcatcagcgtcatgccaaaagacgtcttcgacaagctcaacttcacggtgttggcactaacactgatgtacctccaattggctgactcatcagtccgttacccggtagggatagcagaggatgtgccagtcaagatacgggacttcttcatcccggttgattttgtggtgctagacatggacacggggaaggagacgccactcatcctggggcgtccattccttagcaccgcaggatccaacatcgatgtgggaacgagtagtatccgtttccatatcaatggcaaggaggaaagatttgagtttcaaccaaggacggaacaatgctccatggtcagaataaagtacgggtcgaacccgcagaatattcaagtggttaaagtggagccacccaaaacggacagcctggtgaaatctatgcagaacttcctggagaaggaaacaacgatgcccaggaaccgttattggaaaacgccggtaaaatcacccgtaccggccaagaagttagagcaaccgggctcagaagaagccgtcttccgcaccaaaaccaaagaaggtgtggaaggaaaaccaaagacgcccgctccatcacctccggagacgggtggaaaatccgcgcactgaaccgaaaggagggacggtcttgcacgtcggacctaaaatgatgcgaccttcatcaaaaggtaaattggtatgtatccgcatatttgctttcaacaatttgaattcttgcatcatcacatatttgaatttcaaaatgcatttaggctttttgaattttgaggaaattcttcaaatgaatttttcagagcaaaccaaaataaaattttcaacgaaaatttactgtgccacgaccacactgatcgttggaatccaacggccaaaagtggggctggttgggcccaccaggggttcggccgaacaccctggttcggccgaaccggccaggcaacggctccctgccacttttggcagggtaacggctagtaggtcccacatgtcatttctgaccgttgtgggcaccctataaaagccagtcggctgggagagggaattccatcccatttcaacacattttcattcccgctccaaagtttgctctcaagttcattcaagctttgatagtttccctcaaattcaaaaatttagttgcatatatatacaagttgctttggtgaaactaactggcaggtgaaattcttgtcacttctaacccccgccgagttagtccacttttgctccattgtgcagtatgaggaggcgactgtctcgtctattcaaagggtccggctcttcatcaagtcatcatgatgagtctagtactcgttcatcagctgatgtcttgatggaagacgccaaagttccgcgatgactcctgaacgacaccgacctcgaccttgtcagtgatcgggagagacaagcctactacatgctgagcgaccgggagtatgctcacacgcgagaatactcttcggagttgctaaaaaagataggtatggatgttgaattttgttctatctggaaagtttttggttggaagagatttgctgtggcagatgagcctggttctcatttgcttactttgcaatttctgtgcacttgaaagaaatagaatatggtatttcttttcacttttttcgtaaggagttcacactcacatggaaaggcttgagtacacttcttggatttcacaattcctataaaatcgatctccggaaaggaatttctgggttcgagaaaaataggttttgggaagacatttctggtgcttcaatttgcaagaaacctagaacgaatgatatccataatcctacacttaggctcatgtacaaatggattgctatgactttgtttcctagaggtgatctgatacccattaggggatgaattaattatcatgtttgccatggttagaaaaatcaaaattgctcctgtgaaatgtatgataaggcaatggttagaaagtataaagttctctgctcctgtttagtgcacttctctgattactcggatagcaaaagggctaggggtcgttagcgaccaaattgcttttatctcagccgctcgtccgcgtattgatgaggcttatctagtgcaagggcatattgtgaaacatggagcagatggatctttgatatactttttccccggttgtacaaatgaaatcccgttgccaaatgcggggtatcatttgtacaactgccatgaagtaaccattcccctgcagaccatagaagaatctcgtgcaggtggaacatacagggagacgcgcaacatgacaaggaatgagcaagaaagttcatcatcctcaacacccgtgcagatgtatgatgcaggttgggcaccaactgggatgcacccgggtggacccaagctccacgccatagcatcggaatctcaacctggacaagcgccagtgaggaccggtggcatgcgcctcatgacatccaatggggggacaatcaacctcccagatcaagtggtgtgcctccatctccaagtgaatggcgctcgagttcctctcgttgggacttgggtgaaatcactaagagaatggacacccttgatatgcagacgggggagatccagtacaacctcacggaacacatagctcaaacgcaagaatggcaacaatctgctaatgctcagttcgccaacaacaacaacatgatgcagcaaaagcacgatgaccttcaagcgtacttccgttttcgggggttcaatccttatcaaggaccctgagcgaaagccaagcttggggggagacatcgctcccccctattgaggtaacttgtatcacattgcatatttccctttccaattgcattttataaaacttgaaaacaacataaaaatttgcaaaatataaaataccaaaaagataggataggtttgagtcaagctaggtaagacaagctagttctctttgttgaaatgataaatagttgctctattttatatctctgatatatgggttcttggtaaatactctctcaaaggttaaatataagtagccaacaattatccgggaacctcaggtaaatgggctgcacttgctgatctaagtctaggttgttgtgagatatgagatagtaaataagagttactatgatcctgatactagtttgacttgaattccggatgttttgtttttcaaactaataaatttgaaagttcctcatttgatataaattcctaccagagccaaaaatatgctatcatgattaaaccatatacattttggttgcttgtcattccattgaactctatcaaactcttgtgacttgtgtagatacttctcatgctctatgatcaaggtcatacacccacatatatgcatatgccaaactcctacactgggagctaagcaatattccattccatttccatattaccatcaaaataaattctccatgctttcatgtgctttcttctcctaaagaaaataatatactttttgaaaaaaaaagagagaaggagggaaaggcatggttatgaaagaaaaaaaaataaagttatgctccatcaagcatgagcatgattgaaaaaaaataatatagccatgccctctcctaatcaataaaagaaggatttttgggagaagaaagtaagcgcaaaggagaagcattttctttatttttttattcatgtgccattccaccatataccacacacacattatgcacgatcttgatcttgagtatgtttagttatctgctctagtctaagtttttgacttagtaataaatgtgaatgcaagtatgccatgtttgatccctaccgagctctacatataaaaccttagagtaggaatcaacaagacaacatttggtgaggaattcatgttgatacactaagagagactgagtgaatcatttgaggaacttggttttctttttgcaaaatcatttgaaaacttccggaataagagttgaatataaagatcgggtgattggtactctaaattgctgttcaatctttcaaccgcccaaggcaaggaaaagcagtgtctcgtgggaatcaggggtaagggtaagccaccgtgccaaaaattatttaatctgagagagagtacatataccttgcacctgtatctttga

SEQ ID NO: 52749 - DNA, 3040 bp, Oryza sativa
acacactccaagaagaaaatcaagagctctctctcaagttagttcagtattcttgtgctagtggagtaggaatagaatagttcatttagtcctcgagtcttcaagagattttgggtatggctctagtagcttttcctccttttgtaagacttatagagttaatgaaatattcttctttatatagttccggtcttttacttaatttatattatctgagtatcggctttactttatacttgtctcgatataattgtgtagctagcttacctgagatatgcattggtgtgggtttaatgttcatgcgagtgattgctctatgtcgttcttggggatgtagagttgtatttaataatgtaagcgtggtgcttagattattagatatcattaattggggttatatactgcaggtcagtagaggtgggctgctgatggtgatagcttagtacgggtattcctccatgttagtatatagtccaaagacactttcctggtatgggtactcctccgtattcatttccggttggatggtcataacggattgttgtaaggaactcggcatcaggggtagtctctagaaacaccgcgagggcatagttagggggtattggctacatgattgtaaactaaagatgaatgtatactagaagtataggaatgattattttcttattctttctccatttagcctagattatatatattagtgagagtatcttagttcttcattcttcgtgtcaaccttatcctacccttgaattaattaacccctgcatagactttgatgtatacaagtaatatataaattagtagcaaagtactctcttatcatatcttcccttgggattaaataaatacgataccttggaatacttccaagtgaaatgctacaatggtatatctgtgcgcttgcggatcatatctgtaaccatgtgttaacatcaaaatttgataagccccgaagtcatcatcggcttagattcactatcagctttagcatcttggaatcggccgatgggagttatcaagtcaccaatagtcggattcttagtagattcggtttaaaggaatctattaaaggaagtttatctagaaatgaccgagttcaaagaggatgctccatgacagtttatctattaattaggaagagtttgttagtttccttttatcttgaggaaagtgtgtttagtgtccgataaggaatttatattttctttattttagtaaagtttctttcttgtccaacaaggactagtatctacccatgggtataaatttgtacacccggggtcattgtaaactatttcgcaatcaatacaacttcagcgcatcgccaccttttacctttctactttttcgacgagttcttgctttgagttagggcatcggctcgatcttctgacaagaggtatgacttgtttcagtggtttgcgttggcggattagggcatcgctttagatattctaatctatcttctacgaccgctagttatcatatatcttagttaatctagtttagcatcttaatttgatcatatcggttgagattcgttttagggtttatgctggtatcgactaaattatcatgctagattagattaactaaggtatccaccaccctaaaaaatagtgaaaagcttggttgtctagatattatgtttattttcataccttgcactgcatcagccctagtcgtgtttagaaccataatttctatcctgctttttgattgctaataagggtttcatcggggtttcagatgatgagttatctggatgttgcatcggcttataaggattacatacaagttggatttagccgattgcagcaaaggttttactgtttatctaatcgtttggatttattgacatcagacctccagccgatgtatgctttaacctttggatcaacacttgatcattattagccgattggtttctattagattatattgttgcttaaatatattattatcagccgattatctatatatcattatttactcgagtgttagaatctacattaattgtacatagagctgattgctcaaaaccctatcgacatcggctggtatcggtatcgactagaattgctccatcggcttgttagtcgatcggctatttgatctattgtttacatatcttgtcagttgtaggatcaaaatgactggcacgcccacatctcatcaatatttttgacctgcactggagctaagcagatctcccaagccgctgtgttcgtcggcttagttcgcgccaacacagttccggcactatcggccgatcacggatttttcgtcaataatatcttagcagatgatatagagtttaggttaataaagatacaatattggctattgctctgatacaaccttatataagaatatcattctaagtaaatataccaaacaagcatcaatcccaaatatgataatctggccaaaattgaatacaagcttgatatatttaaatagagtgatatacttatataaagggcagatataacatgaaaaactagattgaagatattaaacaaagaaaggcaatcatatcagttaagatcagctgaaaccctgattcttcccctatttgcaatcaaggttagttgctatgattctaaacacgacttagtaggtcaaactcaattgatgcagcactaagtatggaaggaagcataaaatctaaacaatcaagctttttattgatttttagggtggtggatatcttagctaatctaaactgactaaacgatttagccgatactagcaaaaccatacaaaaggcttggccgatgcaagtaaatcgagtcatcgggttagattaactaagtgttgatgtaaaaacaatgcggcctgggagatctgcttaactccagtgcaggtccaaggctagcctcgagtgtgttaagggcatgctagctgagttaatcctgcaatcagcaagaaagacaaaaagcagaattagttaaccgatagccgatcggccgatgggccggtagcatatcgttggtggtctcagccgatatagttataccaaattagctat

SEQ ID NO: 52750 - DNA, 2918 bp, Oryza sativa
gcccagccgataccaatctggtttgacataactattgtcacgaccaaaaataacccaacgggcgttccttacgtgcgtgcattattccttgtcccaggaggcaaggtacaccaaaagttgatatagttcagagtttaacaagcggaagcgtaaatagttaatttattacatgggcggcgaagacccagcacacacaaagacaaacgggaaacagcggaagactagggtgacgaccacaggcgcttgacggcaggcgcgagctagacaccaaagccttcatcttccaggggctcctcttctaggtttgggaaaaattgagcaagactgagtacaaccaccgtactcaacaagacacacccacaagtgcaggataaatgcaagggagtacaagggggttataatataaagggttagggtttgcagcaaacagcattaaaagacacttagttgctcaaagctattttgtaaatacgatcctagagctatacaagattattaaacaaggccgtgaacccacacgaacctgccttaacccaaggcctacgatgattcagaccgaactggcaacccgaccctgcgtcccagctcgtcccaagcaacccagggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatatggacggaagacgtgacatagtttccaacccatcctagccatagataagagtaccgacccaaccccacctacggccggaacctccgggacaggtaggcaggactgagcccctagcagcaggacaccggccctgtgccatgacatctcgactaccgggccgcagctcgtgtagccttcatttgccctagagatgtccatcgaccccccgacttcgtccatctccatccgtgtacttttttttataaccagactgagccacaaactaagccttacccactagacatgtggaagtacggtagtgctttgcaacataggcccgaagaccggtccttatatggccgaggtgctactatcaaaaccatgcaccccgagcccagcctaaaaccattttgaggattttgaatagaggaggaggtgtgaatccaattccacaatagtccaacaattccatagtgtccaggtgataagagtattcccaaagtctagagttgtaaaccacctaatgttacctaattaaccagcgaagcatctaactaaaattatactagtggtaccatgagtagagtgtccactagttggggttttgtttattctagggtgaacaaggaaataataacaataacaataataaggtcataacaaaggtacataagcatggctagataaaacaatgataacgcgggaatttaaataaagcgataatgcaataagttaaatcaaaataattttataaactaggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagctggaacaaagcacaaaaatgggttcttgacttcttaaggaaaaattagagacttgaacggtccaattccgagttcaaatggccaacttatggtcatttaaagtttatatgctctttaaatgaatatttgcgaatttcttcatttaaattttaattttaaaagggtttattgtgtcagccgaggggagggggcgcgcggaccgggtccacgggagtagggcccacgcggcagcctcacggtccacggtggaccgggtgcacccgggctcacaccggctgtcacgcccagaatttcccgaatagaattccaagcagaatgtgcattgaaatccccgtccaggaccggccggggtacacaaacgacaatgtcgacattcagatccacgtcttacaaacatcataaaagtcttacataaatgcagcggaaagaaagagagacaacaggagctaagccttgactagaactacagcgggaacaccactccacaggcatcctcgacggcacggactaagcttactcctcggagaaaccttcatctgacacatactcgtactctagggttgggaaaaatagagcaagactgagtactacccactgtactcagcaagtcataccggaatagaggcatgatgcagggaatcatcaaagaagagctaaagtggttcatttgcataaagcgagcatttataaacagaagttgaaagattaaacagttgtaataattaattagtattaactatccactgtccaacgctatcccacgttgcaacaggcccaaccatccacctaaactatccaaattcaaaagattacactagggtgagactaatcacggtgaatctggtcgaccgcccataaccgcggtcacggctattcgaatagttttactctgatcagaggtgtacaactgtacccacaagacacagccccacgacacgtttccgtgcgccgacatccaccacgacataccggaaagaggccgtgacaggaccattcgcataaccccctctaaccaagcacaccacacctcaggtttcacccccactcctcgcaaggcagcgagcagtcccctctcgtgcctaggtgaatccggaagccgcataggccgtcgcaggacccatccaaactccatcacgcccacccttgcctggatgcgtcggctagagaaaagctacgctacaagcccagccgttgcccacgctggcttgtggtaagtacgataagtt

SEQ ID NO: 52751 - DNA, 4589 bp, Oryza sativa
  unsure (1)..(4589): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatttcttcaaaaaagaggggaggtcatgccaaaatttatagtgaatttacttcggtgattatatacaaatcggaggtgcctaaaaggttagcaacttcatcctccaatgttttttttgtcatattacatttggagctatgttttgcacacttttttatctctaaaattttgttgtaagttgatgagagagaaaatttgtgtgggaaaagaaagaatatatagaaattttgtttatttgctaaataaggttttataaaatatttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgtcattattgtacgaattattatttgtgtacgattttttttttcatttcatgtagatggatcggcaatggatgtacgctgaccggcggtccaaagagtttattgacggcgtgcattattttttgagagtggccgaagctaacaagtagaagggttttatttgttgtccatgcaataagtgtaagaatcagaaggagtattctgcatccaggactattcatttccacttgtttgagtcggggttcatgccaagctataattgttggacatcccacggagagcaaggggttgaaatggaagaagatgaagtggaagacgacaatattccagactttgctcagtacgctggatttgaaggaaatcaaacgggcgaggaggacagagaagctgattataacgatgttgcggatgatcttggtcaaatgttgcaggatgccaaggaggactgcgaaagtgaaaagggggcccataaattagacaagatattagaggaccacagaacgtcgttgtacccaggttgcgagcaggggcacaaaaagttggataccactctggagttcttgcaatggaaggcaaaaaatggtgttagtgacaaggcatttggcgatttattgaaactcgtcaagaacattcttccggagggaaacaaattgcccgagacaatgtacgaggctaaaaagatagtctgccctctaggactggaagttcagaagattcacgcatgtccgaatgattgtatcctttatcgcggtgaggagtacgagaacctagaagcatgccctgtttgtaaagcactacgatacaagattagacgagatgatccaggtgaggttgacgggcagctaacgaagaagagaattccagctaaggtgatgtggtatttccctataataccatggctaaggcgtttgtttaggaacaaggggagtgctagaatgatgcattggcacgctgaagaacgtcaacaggacgggatgctgagacaccccgcagatggttcgcagtggcgaaacatcgacagaaaatttaaagactttggaaaggacgcacgaaacatactgtttggtttaagtacagatggcatgaatccttttggagagatgagcagcggccatagcacttggcccgttacgatgtgtatctacaacctccccccttggctatgcatgaagaggaagtacataatgatgccgattattattcaaggccccaagcaacctggtaacaacatcgatgtgttcctaagaccactggtcgaagattttaaactgttgtggaagaaggaaggtgtccccgtgtgggacgaggacaaacaggaggagtttaacctacgagcgctgctgttcgtaaccatcaacgattggcctgcacttagcaacctatccgggcagtccaacaaggggtacaaggcttgcactcactgtatggatgaaacagaaagtatgtatcttaagcactgtaggaaggttgtgtacatgggtcatcgtcgattccttgcaacaaaccacccggtacggaagaaaggcaagcactttaaacatacggcggaccaccgtacgaagcctaaacatcgcagcgggaaaacagtgtttgatatggttaaagatcttaaagtagtgtttggaaaggggcttggcagccagcctatagagagcgaagatggtcacgcggcgatgtggaaaaaaaaactccatattttgggagttaccctattgggaattcttggacgtccgccacgcaatcgacgtgatgcacctcactaagaacctttgcgtaaaccttcttggcttcctaggtgtatatgaaaagtcaaaagatacactggaagcacgtaatgatctgaagcatatggaacaatgcggcgaccttcacccggaaccacaggagaaaggcagccattacttgagttcagccagctacactcttagcaaggcagagaaggaaagtatgtttcaatgcttggagagcatcaaggtaccgtctggatactccacgaatataaagcgaataataagcacgaaggagaagaagttcacaaacctaaagtctcatgactgtcacgtgttgatgacacagctgctaccagttataataaggggtatcctcccagacaatgtccgggcaacaataacaaagctatgttatttcatgaacgcaatttcgcagaaggtcatcgatccagataggttagaaacccttcagaatgatgtggtgcaacgtcttgtcagctttgagttgatatttccaccttcatttttcaatataatgacgcatctactttgtcacctagtgaaagagatcgatattctcgggcttgtgttcctacacaacatgtttcctttcgagaggtacatggacgttctgaagaagtatgttcgtaaccgtgctcgtccagaggcaagcatcgccaaggggtatggaacagaggaggtcattgaattatgcgtagaatttattgaagacattcacccaatcggggtacctgaatcacgccatgaagggagactacggggaaaggggactctcggaaggaaagcaataatgacggtagacaataatttattccgtaaagcccatttcacgattttacaacaatcttcattggtggctccttacatcgaggagcacttggctctagttcgcgccagaaatatcggtaagtccgatgcatggattacacggcatcacattgatactttccccgcatggctgtgacaacatctcatgggtaacgagacgattaaccagcaactggccttcctggcgaggggtccatctggctcgatcgcgacattccagggatatgagatcaatgggtacacattctacacaagagcccaagacatgaagagcacgaaccagaacagtgctgttcgtatcgatgcatgtgacacgatggtacaactggcacgtattacggtgccatcgaggagatatgggaacttgactatggacctctcaaggtccttctgttctggtgccaatgggttaggttgattggtggaggcgtaacgattgatgacagtaggatgacaacggttgaccttaacaaggttggatactcggacgaaccttttgtccttgccaatgatgtaacgcaagttttttacgtgaaggacatgtctagcaaaggaaagaaggacaaagggcctgacaatcgaagcgccacgtggttctcccaagcaaaagaaaaatcgtcggagtagaggacaagactgacgaggattacgatcagtttgatgggcaaccccctttcacggtgacggttgacactagcatcctcctatcaaacgaagacaccccttactcacgtagcgatcacaaggaaggaacaatagtgaggagaaagtacgtgcggacaaccgtcactgccgtaattgttgtaaactattttggatgtattgaatatgctagttatatttgattaattacaatttttaacaatttaatatcatgcatatactaattatatacgattattagaatttttaaaagttttaaatcatgcatgtgggatttacatatgttagttacaatttttaacaatttaatatcatgcatatgctaattatatacgattattagaatttttaaaagttttaaatcatgcatgtgagatttacatatgttagtgacaatttttaacaatttaatatcatgcatatgctaattatatatgattattagaatttttaaagttttaaatcatgcatgtgggatttacatatgttaattagaatttttaatgcattatttactattttagaaacacatatgcaacgaaattcaatattcagtgctattaactttagtcccggttcttaaccctaaccgggtttaaaaaagaatttagaaatagcgggaaaatatctttactccc

SEQ ID NO: 52752 - DNA, 24306 bp, Oryza sativa
ccgacgaacgccgacgacgccgacgccgacgtacgccgccgggccgctacgttacaccgccgccacggcacgccgccgccgcgcccccacgccgcgagacgccgccgccgccgcgagacgacgctgccgctgccacaccgctgctgcgccctcacgccaccgggcccccatgccgcggccgtacgtggcccgccgccgccccgcccctacgccgccaggcccccacgccgccggaccgcgcccccaccgccacgagacgccgccgccgctgccacgccgccgccgcgcccccacgccgctgcgcccccacgccgccgggccggcccacggcgccggaccgcgcccccaccgccgcgaacgaacgcttaacgaacgtgaccaaacgtgaacgaacgcgaacgaacgtgaacgaacgcgaacgaaacgttaaagaaacgtgaatgaacgcgaacgaaacgtgaacgaacgtgaacgaacgtgaacaaacgtgactgaaacgtgaacgaacgtgagtgttagtgaacgaacgcgaatgaaggtgaatgaacgcgaacgaacgcttaacgaacgcgaacgaacgtgaacgaacgcgaacgaaacgttaaagaaacgtgaacgaacgcgaacgaacgtgaacgaacgcgaacgaacgtgaacgaacgcgaacgaacgtgaacgaacgcgaacgaacgtgagtgttagtgaacgaacgcgaacgaacgtgaatgaaatgcgaacgaacgtgattgaaacgttaacgaacgtgaatgcacttgaactaaaagtgtgagaacgaacgcgagcgaaacgtgtacgaacgagataattaaactattgttgaacttagcatatatatatgattatatatacttgaaaacgtgaaatacattatatgttcctttgcatttagactaatacatttttttgcatgttgcagagaagacgtcgtcgtcgtcgtccctcaagccgaagtggtagctagccctcgaaggaattcgcgcaggcaagtgatgtaaagatgtgatagttagagatataatataagattgttagatttctaatataagattattagattattagagttagcatatgtgagtgttagaaattattagattattagacttagcatatttgagtgttagagatagttagagatttaatataagattattagaggtttaatatacgaaacttaattagacttagcatatgtgagtgttagagatttaatataagattattagagatgtaatatttgaaacatatttgattgttagagatttaatataagattattagagatgtaatattcgaaacttaattagacttagcatatatgattatctaccgtacaaatacacgacacttagacttagcatatttgagtgttagagatagttagagatttaatataaaattattagaggtttaatatacgaaacttaattagacttagcatatgtgagtgttagagatttaatataagattattagagatgtaatattcgaaacatatttgattgttagagatttaatataagattattagagatgtaatattcgaaacctaattagacttagcacatataagattatctaccgtacaaatacatgacacttagacttagcatatatgattatttgagttttaatacaagattagtagtgttaatatcacgcttagcaaatatttctgctatgaacagatggctgatcgcgatgaggaacagatactatacgatacaatcgcattgggaagcagccagtactggaacaaagaagaggggaacgaggatccaaaccagtacttgaacgaggaggggaacgcggagagggatgcagaggggaacgaggaggggaacgtggagagggatgcggaggggaacgaggaggaggctagtggaagtcatccctccgctggatagaagagggcacgcggacaatgaggtgccgcgaagaagatagagggtcggcacatcattactgaggtggacgcagacggccgacctagtgccccggcacaagcagccaagaattttgtacgccacagcggttgggttgtgagggataacgtgcctgtcagcaaggtgtactggcgcagaacaagggcacgcgggggtgatgacagctttgtcccggagtcagagaaagagatgctgtggaccacaatgctcgagacgttcacgctccctgcgggtacagagaacatagtgaaacagtggactcttaagaaaatggcagaacagttccagaccttcaagggagatctgtaccggaaatacatcctgaaggggcagacaccgaacttcgacatattcccgaagctaagggatcactgggacgagttcattgcttacaagacaggtcaacaagggcaggcgatgatggaaagaaataaagaaaatgccgccaagaagaagtaccatcaccacttggggtcaggtggctatagcgtcgcgatgccgaagtgggaggagatggaggcaagcttgcttgagaggggtatcgaaccggccaccgctaaatggcctgatcgatcgaagttctggtactatgctcacggtggaatgctcaacccagttgatggctccttggtcttcagcgatcagatacgcgaggctgcgaatcgactaacggacgcagtggaagcctcttctcagggcacgttccgacccgacagagagaaggacgagctgtcactcgccctacagactcccgagcatccaggacaaacacgagggaaaggcgtgattccctggaagatgggattcaaggaggacatccacacgtacaggagtcggatgaggagcaagagagataccgaggcgaagattgcagatcttgagtacagggtatcgagctacgagctcagcatacaagaggaggtggcccggaaggtggatgaacgcatggcagcacatcggtcacacgatccccagccgtacatacctcctccaatggtcagcccatcaggcaatcgtagcagctgcgcctcaacggggcaggtagtatcacatagcatggacgccatgcaaacccaggacgaaaccacctaccccgttgatgagatcacgcaacggacaccatgtgagctgcatattcccttcaagaacttatcaatcaaggtatgctcgatgtaatatatgatttttgactcgtacgttccgcaagttgctgcttaggttgattactaatagataacctctcatcacgtgaaggtggcgtagggaatggccatcccaacggacatttcagggacttaccactgcaggccgattccagcaggatactcgagggtcgaagttgagctggtggaagccgtgtacgaggacatcgagttggactacccaggaggagacggtgagacgcatctacgagacacaagccacgccattatattatggcgcaagcggtacatcatcgtccctgggcgacaagcggcgtctcgtgcaccatctcctccggctccgccgtctcctcctgcaccatctcctccggctcctccgccacctcctcctgcactatctcctccggctcctccgccacctcctcctgcaccatctcctccggctcctctgccacctcctcctgcaccatctcctccagctcctccgcctcctccgcctcctcctccaccgtgtccgcctgcacctcccaagacaaggtctcgccaagctccacctcctgctagcacaagggcaacgaagaaggccaaagttgacaccaccaaaaacaaggagccgccgtacggttgtagtcaagaggagcttgacgcttatgtggcaggagaagtgaagaggcaactcaagcctcagagtcctaaaaagaagatacctattaacccgagcgtgaagaatttcttcaagggaatgtccaccgcaaacaaggaggccttaaagctatcggactatgaccgaacacttaggaaagcctattacaagaagtccaaaccagttcctcagcttggagaacaaccacaccaagtggtcgagccgttggtgaccggcgaagactttggcataacggatttcatttcggacatcggtctaaccatggctcagttggttggaggcgcaccaatcccgaaggcggaagtggcatacaagtttgaactcggtaaaccgcttgtcaggcctgagcagctgcagtccctaccaacacaaatgtacaaattccatgaacggtacatggaaatgagcgccaatggtagagagatgttcggagcgaggatcagaaaccccgacttcttgcaaggagaagatgttctatggatccatttcaaggatgtttttgatctgtaccatcgggacgccctcgacgtctctcttctgagcgcatggattttgtaagtatctttgagttcgatttgtttcgttcaataattagctcctggcatatatgtaagcaataataatttccattcattgttgtagaatggagattcaaagggcccgacggcggggggtttacgatactgggttcatcgaccctcggaaaatcaacaccgaaatgctcgacaagtacgagaaagacacagaggacaatctcgtccatctcctaacgcagcagcatttcaagacgttcatactattgccgtacaacacagagtgagtttttattgtcgttcgaacaaatttcattcccatacatataacatgtacattctgatatttatctcatctcatgcatattccagattccactgggtcctgttctttttcgacttggacgcatgcagagtcactgtgtacgactcaatgaataaagaggagaaggtttttgacaaggtcttccaactgatagacaggtaatataatgccatctattccaaagtcgcgggactctgttgctattatgttgatctcgggtaatatttaattaatcatagcttgcaactgcacatgtagggcttgggatcggttccgtcaattggtccgcgggacttggaaagaaaaacttggacggaggtttcattttccagtgagtacatgcatgatccaaaattatattgaattgaatctctagttacagttaatataaagagtatattaaatctctcatcgtttctcatgtagtgtgcaaagcaggacaagggaactaacttatgcggctactacgtatgcgagtatgcccactgcctatcaaatcaaatatacaccaaacgagagctcgatgtacgtatacataaaccattcaaaatttcattgcgtatcgatttgttaagttgtttattaatttcatatattgatatgtcattatttttcgaatgatagcgtattcacatgagggaaaaactcccacacaaggattttatcacggctgttcaagaacaactgatggggttcatcaacgaagaagtccttaatcccgatggtgaattctactacgacggatcgacaattcgtaacgtcggtccttcctcttctgacgtaacgcaggcatcgaagtcgtagctatagctagcgagcaaatgaattgtactatacatgcatgtatatatatatatatatatatatatatatatatatatatttatatttatatatgtacgtacatttagtgttaatatatattttggtaacatatacgtacataaaatgttaagtgctttaaattataaatatgtgtgatatatatatatatatatatatatataaaatcaaccatgcagcaaacagggccatgcaaataaaaaaaaatggtacatagatctttagtcccggttggtaacaccaaccgggactaaagatggatcagccggccacgtggctgaccgatctttagtcccggttcgtgttaccaacccggttatttcacccgggattaaagatcgctatctttagtcccggattcgtagtcccggttggacaaccgggactaaagggggttacgaaccgggactacaaacgatttctccaccagtgttatcattaattaacatgataattaagcacgtaaaattatgaagtaaattgaacaacaataacaaaacaaagttctaatctaaactttggactaaatagatcgttgcaaatgagaagatgagaagatctcaagaccttatcctaaaccctagcgacaatgcggtaaggagtggccgcatgagagttggcaacggcggcaatggcataggtcctagccggtcgcacaaccggcataggccgttgagccagccttgctaattgtgcatcagaacgatttgcatgcagctactatagaacatgtgcgtggccgacctacatactacgatggaagtcgaaaggttcatctacaagccgacggtatgtcgggagcgatccatttgaagtttggcacattattctttcaattaggtaaactactagaaaaaaacacgcgacgttgccgcgtgcaacactcgatgggccacactatttggccgtattgagacagaatgatcagtttaacaacaatgcaagttgtagcaaaatactatattgcacaatcatgattactacagcagagtattaaattttaaaaattaatctatggcatataatgtgatatagactgtataatctgaacaaaacacaatagttatcctatatacttatatagttcatctccactaagtgtagttaatgctatttctctcttctcattaacccacatcaccctaattatttctagcctttggatgatagatctatggtctaaattgtttcttctttcttctctcttaaaaacatgcaatctcaattacttttaggctcaaaattgtatcaaattgtttttagttttgtacatattatgcaacttaattttccgcagcaacgccgcggggtatgagtatgtgacatattatagacatttgatctggaacttaaataatggaagattttaataaagctccctatcaattttgtattagagtaactggaaagtagatgagtgtaggttcttggtgagtgctaaatacatcaaaaataaattggctggtagatgagaggataacaaaagtatccagcttgggctataaatagcaaaagtcagtgttttcttcttcattattttcccaaaaaaaacaataattagaatccttgtcaaagtatgttactgaggaaccagcaattctttctcatgcaatacttaacacaatgcagtagctaggttgggcaagtatgaggtttctatgtagtgtcaggtatatatgtgaatactacatgtaaacagggtatctggtaggtaaccgtgaaattgaagcagccatataaggtaatacacttgcttgaaatggtgccaagcttatgcacagtacagtagtaggttaattatatgattgaaaaacaaatgattttaaatatgagcaattgtttacctgatcattactgttcggatcttcataagctcttttgcctgacaaactgcttgtctctaaattacatggctcagcttccatgctctgaatatcttggggtggttctcactaaattaagtgtgtcaatttttcactatagtggcagaacagagaaatttaaccaccagataatcacaggaataaatattcgaggaattaaattaagttaaccaactgaaagtctgaaacttcttatgcatgggtagtctcctagtcaatacaagccccaaagctggagctaagcaaagacttaacaaataaaattcaaatgttataattaatcattggcgaaattgtcaaacaaaaacagaaaacctcatgatattggaacttggtagagtaggagtagtaccagcatcactaaacaaaatatattctacaagggttctatcttcttaatgaagatggtcctcattatgcgtttacaataacaaagggacagtaaaacttctttccgaatgcttccattcccaataacttatactataacaaatagtctaatatatatcagtgaagtaacagatctagctggtttttttttaagaatgaaaaatctgcaatatttatatcactaatacatgtgattgccattcactgaactcgcgaacgtcgtcctcgcggtgcaggacgtgctcgccgtagagataccggccgaaggccaccgcctcctcctcgtggtgttgtctctgtgcaggacatgcttgccgcagaggtaccggccggaggtcgctacctctttctcccggtggatcagacaagatggagaatgaatgtgaaacaatgacaagagaaaagaggaacgattatagaagatgaagagtgaatcaagattatagaagaccaagagtcgtgacccttccggaaatatcaggtggctttgcactttttgattttactccaacgtaagattgttttttatattttagtccttctcaagtgtgggagcgcacgcacgaaccacgctgtgccacgtggcatcgctaattgctcgataatttgcacggatttcgatagtaagagattggttggtagcgatggggtatcggctggtatcaatgaatatcaactgggtatcgcctgttaccgatggatatcaacatggttccaacgaggcattgtctaatactaataaaaaatatcccttgatcctctgcccatgtaaaaaagtacttttcagaaaactacaactttggtaacaaaattatcagtgcaacaatagcatggaaaattatcacaaaactgtaatttttacgttatatcttgctacagttgtcacctatatatactgtagcagtatataacgtaaaaattacaattttgtggtaattttacacgctattgttgcagcaatctgaaacatgtcgctaatattacagcaaactgatagttttgttagtaaagttgtagttttctaaaatttactcttattaaaatatagtaatttctccatctaattctcatcttaacagctcaactaattacaatcatatttttttaatgaaattttttatccacgtcttttctcatacaaccccccatacacacacacaaacacacacacacacacacatatatatatatatatatatatattctatttaatttcacctaactccttaattactgtgcaaaactatttttaaaatccctctcacaaagacggagggggagtggggtagttgctactcacctgtcttgctgatccctctcaaaaacctcagttcgatcttctctgtcggtgcttgaatgacgcgtaaagatgggatttctaagtactccatccgtccttaagaaaaacttagtataacgaatttatacgaagggtagttcagaggaagtatgctgacttgattactgcgtgcattggcacttcaacgagacataattgatgagctgactatacgtggagctgcatgcatgaacatgtagcaggggagtcctctctccgtcccataaaaaatattaatctagtactagatgtaacatattttagtactataaatttgaatatatctatttaaattcgttgtgttagaatatatcacattcagtgtttaatttattttttatgagacgggaagagtatgttgctaagagcaggtacaatagtaggctataagccagctgcaaacataatttaagaagataaataaggagagagaagagcagcggactacagatttatagccagctgtagcacagactccaagatgcagtgtatgtatgacaggtggaaccaagtattaatagtgtagtatataactattgtatagataagctatcatattagttatagataaattagagctagtagttggctatactattaaacttgctctaacgctagctactcagctccacgagggaaacgtgcactagctagctgccatgatgtactaggtacgttgtactagtgtaccacagattcagtcataggtaaggagtagtaggagcactattgagcagaggcaattaaagaggtactagaggaacgtactagaacgaacgtgtggctgactagttgaactgatcctgatcgaggcacccactcggccactcggcccctcctcacgtggacatgcactactttgctatttttaagcactccctgcgggatatttaacactgttattaactttaaaaatatttaaccatacatcttatttttgaaaataatatgaatatataaaaaaatataaattataacaaaataaaattacgtaattttctgaataagacgaatggttgaatttcactctgtttgttacttcgggtgcgtccgaatcggcttccctaagataatttttagcgagacgtaaaatgagataagctattagcacgtagttaattgattattaattactataaacttgaaatttgagtttatttttttaaatctatataaaatgtattaaaaataccgtttagtaatttaggaaacgttctcatggtttaatgaaggagtagtttttttaacttacgaaggagtagtttagctgagttgtagaatcaaatgaaggtgagtccatttcatatttagaatattgtagatgtaacctaagttaatttcttaaagtttgactaaatctattaaaaaacagcaatattttacacacaaaataaatatactatacaaatagattcaatgatggatttaataaaactaatttggtattgctaatgctatttttttacaaacttatcaattttaaagaaattgtcagttttaattatctacagttaaatagagaacacgttcataataagtactaattaacaagcacaacggcacaagcatgaagaaattgcaaaccgctcggtattttttgagcatttaacaagatttaaacttgaacactgatacagatgtacgtactccactcccacgtttatcaccagctggctcgtatatagtattgggtttgttcatatgtggcggtgggatcgagattatctaacttgagttattaacatatcggttatcaacccagtgaatttatatgttagtgacttaaagttaacgagaagcaagtaatataaccgatatctcctatgacggtaagtacatggtatttcctccgtattttaatgtatgatatcgttgatttttttaccaacgttttactattcatcttattaaaaaaaattaataaaatgagtgatcgttaaaatatcaatagctgtcatacattaaaatacggggaagtacgtacaattagaaaaatgattaaccaattgggagcacgactacgcgctgtcgatctctatatataggagccactgcccacggagagtggccggaacatatacagacgtccctcgtctcttcacctccggcggccgccttacacccggccaccagcttgttcgtcgccggcgagctagcttcctcctctccgggctccggcgtctccgccggccggctggcctgttcgtcgtagtatatatatcgtcgtcgtctccgtcgacgacaaaactgtgtagtgccactgatcgcgacccggccggcattattgaggctgaggcaacgatcgacctgacacaagaagaaagaagatggtgaacacgacggcgggcgtgaagtgcggcggcggcggggcggcgctgccgctgtcgacgctgaaccacgtctccctggtgtgccggtcgctgtccacctcgctcaccttctaccgcgacttcctcggcttcgtctccgtccgccgcccgggctccttcgacttcgacggcgcatggtatatactccatccgtttcaggttataatacgtttaactaaattactttaaatttaactaaatttatagataaatataataatatttacatcactagattagttttattaaattaatagttagatatatttttataataaatttatcttggataaaaaatattatttgacttttagcaaggtcaaaacatcttgtaacctgaaacggagggagtatatatatacgcccggagggagtatatatatacgcccatccatgccaatgtgtacactaaattttgttcttggcgatggccggcatttcgacgatttgattgctgcatgaattgaaagtctgaaactgcaatgtttcatttgatgattcaggctgttcaactacggcatcggcatccacctgctgcaggcagaggacccggagagcatgccacccaataaggagatcaaccccaaggataaccacatctcattcacggtaacaaccgttgattatatatacaacttacatacagaatcaacctcaagagaatgagatgcaaagtgatagtaaagtaaaaagagagatgagaaaaaatgacaagagtgggatacctgatcgatgcatgcatgagggcaactacgacgttgacattataatataggagcgacttgtatgccatattaattgtcagatactcagatatatatattcaagatccactatatactgataaatagagataatgtgtaggagtagttgccctgccctagaatacatattcttggttctgatagaagtggattaagcatctattgaatgaagcaacatagcacatgcatgctccctcagatctggggattgatgatgatcatcctcacaagattaattgagaaccaagagaaactaatttcaaatagtgtcggctaaccactagcacattattattccaaactcagtaggtgcagttggctagttgttaattaatttctgcatcaagattatatatatttcagctcccagtcagtttagcagattatatatattccagctcccagtcagtttagcacaactaacaattgatgttcatataataccacaacattgcaattaccgctaccatgactcgtggatacattctttaatttggagatatgaattgaaatcggtcgaaatgatatataacgtgtaatcgtctatactcctttaaaagataccagtggtaaaacagtgaatatgttactaccacagtgccaccccaccactccttaagcagtttttataaatcatctcttggtattttctgatattatggaatagtccatttgattcaaatgagtgaataccatatattttaataaaaaaacaagtaaaaaaatatattttgtgtaaaacatatcataatatattttcttttacacctagcaaaacacgagcatttttactagtacgcataaaaatatgaatgtgtggcatggcagtgcgagagcatggaggcggtgcagcggcggctgaaggagatgggcgtccggtacgtgcagcggcgggtggaggaaggcggcgtgtacgtggaccagatcttcttccacgaccccgacggcttcatgatcgagatctgcacctgcgacaagctccccgtcgtccccctcgacgccgccgccgcccactccatcttcgccggccgctcgccgccgccgcccgtcgcctgcaagatcaggcccgtcaagcagccgtcggcgacgaagctgggcagcgtcgccgccggcggctgtgttggggaggtcatcgtcgtcgacgcgatcaacggcgccgccgccgccggcggcggcggcgcgatgagctgaggagacttgtggcattgctgatccaacgaggaatcattgatttgatgaattgttgttcaactttaattttggtcgtgatgatgattaaggtgtatgtaattcgatccggtgattaatttgtctctcgctgcccaataatatttgcgtaaattaattaattacctgtggtcgtcactagctaattcatcaacgtacgttgagtgaccagagattagcaggacaaactgaaactagcgcgcgtacgtaatatttgattccctccgttcaaaaatatatgacgtattttttaccagtctaaaaacacaaaactttgaccgtaaatttcttttgtactatttcgtctatggttacaaatcatgaatccaccaatatttttttaggtaaaaatctaaatattattaaattaatagcttgtcaaagcttaaaattgggcggtcgaaatacatgcatcttatataaggacggagagagtatacgagtacgcagcagctctgctagcaattactgtctttgaattcattcacgagatgtaatgtttcctttgctgctttgcacacgtagtaggccgcactgagtgagcaagataagataagataagaaaattcctcatttttgcgtgcgcttcgcgaggtgcaaagctatgtgttttctaagaaaaaattgtagaaaagttacataaaaaatatattaatctattttttaaatttaaagtaattaatatttaattaatcatgtgctagtggctcatcttactttgcatgcatatacatatcttcttcaatttcctatcctcaagtacagctgtagtatgtgttatatgcgtggtatttatacattgttcttgtaataatcagtgctgtcagcacattgtattacgttgttgaattcacagacaagtagcacctggagatcagttgcgttcaaaatgtgtaaatccagtaatatattgtgcaatgaagttagcagaaatgacatgcatgcacgcatcactaacatgccacagaactgataaaatttactattgggatggaggcatgtgacaagctaatataataggaacagtaccacgcatgatccacactgctcatgctccaccattcttaatttcaggttgacgatatattggtatgcatgtgatcggatgacagcttgtacgtagtattagtcatgttgcttcaggcagataacaaatgtattttaattcgattggtcaaagccgaatttaaaatttcccagcccaaccagcctgaccgaggtttttaattttgggcttcccaaaaaagaagtgaagattggagccgacgcgctgtacactttacacgagggaaaagtgcaatttgcatttcttaattattaatggtggagctataaatttacgtccctcaaccgtaaacgggatatatatagcctcctccaattcttttttttttcttttttttacgaacggccggtcagaattgactggcgttatattgatagaaggagaaaaagtacagatagccaaagggctaagaaagagaaaaactgtacatgacaacatgcaaacaagcttgcacgtagccttcctagctcctcatggcaacattctcccaatgtgtttagcgctggtcatacttcaccaacctaattcctcttggatgcgactaatcatctggtgtgctgtcgcctcctttgctctgaagattcttgcatttcgttccttccagatttcccgagcaatgagcaagaagagagttctgagtcctttctattttgttgcttccgggtcgcttgttccttgtgtccaccaatttaagaggtttctacttatgttccatttcgggatgatgtgcccttggtgtagccatgtgagaatcccaaaccagatttgctttgagaccggcattcaaacagaagatggtcgattgtttcgagatttcgaaagcatagctggcagaaataattatttggccatcccttatctgtaaccggtcagatgtccacacccggttttgaagaaccaaccaactgaagattttgcactttgccggagcccatgcctcccaagacaactttgttgatggcgagagtaccattccattgaattggaattggtacgtggattttgcactgtattccccattagttgtccattgccaaacaatcgagtcttgtaccccctctgttagttgtggggtgtcacgggctaaaatttcccaaacatggaaagaattcatcaagaaggggaatggtgaggctgtggcggatgtcgttaatccatcttccttgttgcagggcgtcctggacggtgcggggttcctctttgaatgcctataaagattcggtgcttgactttttaggctttggccaccgatccaatttgattcccaaaagctcgccttttgtccgtcaccaatttggactctcgttgatgccgcgaaaagatccttatccaattcatcacagggtgtttcagtccctatccaaggcttctctggcgtcctccattcgaaccataaccatctcagtcgaagagctctggcaaacttttctaagttcggaacccccaaaccaccgtaccggacatgtgagcaaactttaagccaattgaccttgcattttccgccatgcatattctcgttacctgcccacaggaaccgccttcttgctttgtcaatttcttgaagagattgtttcgacggtttcagcaccttgagggtgtaagttgggatggcacttagaactgagttcaccataattcggcgcccccccccaatgtacaacaatgatggtttccatcccgagagccgacctttgatcttatcctggagaggctggaaatgcaccttacgtaggcggccaggagtgagtggtagccctaggtaagtcagtgggaagctggctcttgcccccgaaaaactacgcaagatgtcgtccagatctacttcctggcatcgaattggtgccaccagactttttccaagattgacgtgcagccctgttgccttgccaaagtccctaagcatggtaattagaacatccacctcgctttgtacagggttgagaaaaacagctgcatcatctgcataaagcgaagtcctcaatctagcatggcgacttccgatgttggttagttgcctaccttcggtcgccagatgtagaagcctttgtagggggtcgatagccaagataaagagatagggggatagggggtccccttgcctcaagccacgtctgtgtgcaatgcattccccctggtctctatttaggactaccttggaagtggcggtggaaaagagcaaacagatccagtttctccactgggggccaaaacccatgttttgcatcaattcaagtaaatattcccaggagaccgaatcaaaagctctagcaatgtctagcttgaaaaaaagtgttggctttttgctggcatttaggttcctgagcacgttccgaacatacaggaagttgtcttgaatgcatcttttttttatgaaggcgctctgtgcaaccgagatcaggctatccatctgcctggcatgccttattgctagaactttggatgtcagcttggcgacggagtgaatgaggctgattggcctaaaatcggtcaccaaggtaggggcgttcctctttggaagcaaggtaattgctgctctgttgagtgctccaaagtttcctcctgacaggttatacaaacactagaaaacatccatgatatcctatttaattagatgccagcatttcttgtagaaggtaccattaaagccatctggacctggggccttttctgccggcatctgctttaaagcggcccaaacttccttctctgtaaaaggttcatctagttcatcggggttaacctgtggtagatccatcgcgttccaatttagggtgcaatttcgcgcctggttgttgcctaggattgagttgaaatggttgaaaagcgcctcacttttttcctcatgttctgtcaggatagcacttgttgtatggagttggtgaatgtggtttttccttctcctcgagtttgcgtgaatgtggaaaaactttgtgttggcatccccttctttcagccatgtcaatcgcgatctctgccttttctttgactttgccactgctgccagccccaaaattcttagcttgaggtctttcctgagctggtgttcatcgacagtaaggatcctatcctcctgggccaaatccaatcggagaatcacctcctgagccacgtgaaattgcattttgatctctccaaacagacttctactccacttcctgagagctttagtggtggcagtcaatttgtggctgagttttgtaaatggatgtccaccaaaagtgtgagatgaccaagcttgttgcactacctccatgaatcccggcacccggacccagaaattttcaaagcggaagactacccttttgggtgggcttacagtggaagcaagaagcaaagggcaatggtctgaacagaatgaggagagggcctgcagtgtgtggttggagaacaggatgtcaccatcaatattacaaaaaactttgtcaattctttccagagtaggcgcttcccgctcattgctccatgtgaatttcctattttggagcttgagcctcctccaattcttaattacgagtataaatggactctctcgatggtttatgattttacgatagagggcatgtgaattaaacctattgttgaagggatcatcctgaacattgctccacggtaatgtggcaccgacgcatgagttatacttgatactgcagtgtcaaagggtgtatgatttcagcctcgaggtcacatgttcaatcactagcaaactcttaattttcccttaaaaatatatttggagggatgtctctcactccaaatctcggtttttttatgtggcaccgacgcaccgtgcgggctattgattttgggctagaatgagtttgtgggatagtgtgggccatattgtttgggccgaaaagggaatgaagctcacgtgtggcccattctattttttttccgtgcggcccaccaaagaacgggccgttcctgcaaccggggattcggatatttaaaggaaaaagtacaccgaaggtccctcaacttgtcatcgagttacaaaatcgtcccccaatcgcaaaaccggatacaacgcatccccttagatcccttggtggttttgaccccggttttagctgacatgatggctgactcagtgtgggacccatgtgggccccacatgtcaggatgccacgtcggccagcctctcccttcctttcctctcccctcctttcgtctcgtctggttaggaattaggatgcaacgtcatcggcaggccggtcggcggtggggagggggttgcccgggtgagaggtccgtcggccggcgggcgatgcggcagcgacaacgtggctgctgagacacgagagaaggggaaggcgacgggccagcgtcgtggtggagaggcggcagcaggcgtgcgagcgtcgtggcagagagggcggaggcggcggtggcggtggagaggcgatggcggcggatgcgagcgtcgtggcggagaggaggcggcggcggcggctgccacgcgggaggggaggccaaaggcgacggcgtgggcgagcgtggaggcacgcgacggcgaggccgccgctccgcccgtcgcctcttctctctcaggtttctcctcgtctgggtgggcaggtcggccggcgggttgggaaggaagggaaggggttggggtgatggcttgctggagctgcttcggctacagctggtcgatgaagcaggaggcgaggtctggctgccggagccgttccagctgtcggcgcccttgcccagctagccgcatggtctggggacttgttcgctttcatcgttcttcgaattctctccccgtttcttcgtgtactgtttaattggttcttaatctgctcataaattaatcgtcgtcatctatggcctggattgccggatagtatctttgtgcttgtaaatttttagctgctatgcgagagctcgtgccaaatttgatatgcgagagttttgttgtttgttctgccggcgaccgagcaggactggtccgggcaccggagcgacaggcaccgcgcgccgtcgcccaccgccgcgcagaaacgaccggcgatgcagcagccgcaccggcctgccggaggaccgagcaaatggtgggcgaagcgggcgacggcgtaggccggagcggccggccggcggtgggcaggcacgctgcgggagaggaaggggctgcggcggcaggggcgcaggaggtcgggccgcaccggcaggcggctgtcgacgtcgaccatttagagggcagagagaggacaagagcggggagaggagagagcggaggcggatggcgccgatggggagcgggatggggatagcaaggctgccatcgccgtcgtcgtccatggcgtgggggaggctgcctccgctccgcctgtcgcctgcctgccaccgccgaacctcctcctctcccgcctcgccccgtcggcttcctccccaacccgtcggccggcctgcccacccagagtcctagacgaggtgaaagctgagagagaagaggggaaagagagagatgacgtggcatcctgacatatgggtcacatgctgagtcagctgctatgttggaaaaatcggggtcaaaaccgctgagggatctagtttgtcctggttttgtaagttaggggatgcgttatatccggttttatggttggaggatgattttgtaactcgttgacaagttgagggaccttgggtgtactttttccatatttaaacaacgaaccttatttgggtctctggcaaccgttagatgaggctgtgcggtccagatcgaattggtcagtgcacacgaaagatctaggagagcggccggagaacaatggccgtcggaatgtattgttttcccctggcaaaatggctgatttcttcctcgaaaattgctttgttgcctagcaacagtcttgacaagcatttctcttttaatctcgtatagctgatgatcgtctgtttctccattgtgattaagccaagtcgatttggtttacttgttgtctgactatgaccagttcaaaacagatcattgctcattagatgttttactgaagttctgcacattatcacctctgccgaattccatctgtctcgaaagagaaaagggaaatatctgttgtccacgtctgacaaacattttttttaatcttcaaaaatgaagtggcagattgaattgaaatgaaatgctacttcagcttgacgctgacagaaaattctcaaatcctttggcttgcatgcgttatctcaggtagcgcgcgggaatagcgatgcggctactaacaaaggggttcggggttaaaactccgaactcatttggccgttcgattgagtggatcagcttgtcagcgacctgcatcatactatcataaattggtactatctttatattttaatgtatgacgccgttgactttgtattcaatgtttgacattcgtcttattcaaaaaatttatacaattatcatttattttattgtgactcgattcattatcaaatgttctttaagcatgatataaatacttttatatttgcacgaaaaatttaaataaaacgaatgatcaaacgttggtcgaaaagtcaacagcctcatacttgcttagcgagcagctagtgcaatcatataatcattacactcacaaatcacgaacggcttaacgaagtcagtgtttattctaagtactccttcctctttttttctttcttttttctttgttaatctctctatgtgatcgtcagatcagatgcaatgtactgcagttcgtttcagtatttttcttattttcttttgtgtttggtttttgcctattaaccagctgaacgaaattctgaaacccagctagctatctgctatccctgtatgttcaagctgacctgtatcttgaacaagtttatctgaagtgggagtacgttacactgcctttattttcgaagctgcatgcataactgaatctaatatcctttttcaggcgaaactactgcatgattaggccgatcgattgcataactgaatctacatcctttattttcaggctgctgatggcttgcatgcaatcgatttttcgatcatgatcactaattgcgtgctttgattttactggaaaatctgtatatatatcatcactggaaagatgagcaaccagcatcaaggttgctgctgccgtcatcactggaaagatgaccccctctggtgggtcgctaccagccgttcgattagcctctgcggcccagattcgtactgtgtgcatcaaagacggccctgtttgatgtgggctgcctcgcgcggcctttgcaaagcccagcccatttagcctatggagtccgttctggcctggctcacgaactgtcatcagcccacatagataggcccagatggccagattccacggaaatggcaggcagttccatggcctggctgtaaagctcgcagaacaatgaacgaaatgccacattgaacttgattttcttttgagattagttttgaatactctgtatctatactactactattagctaaatgctcacgcgttgcaaaaaaataaaaaaaatatttcattacattttccaatgttaattaaaaattcatactttctttgaaattcatgggaatagatgatgttggttcatatggctcaccttttgatgtagagtaatactcctagatggtggattcactgatttgaatttcaagtagaggcgtggttaggggtgaaaacggtactgaaacggacgtaaaccacctttatcatttttgtttttatattttttttgggtatcggaatcggaaaccccggatacgaaaatggaatcaaatattatcgaaaccgaaaacagagcgaaaatgaaccggcgcgaatacagtaatgaaaatttatcggaatacgaaaacccctcaaattgataaatccaattatcaagtctcaacggttaacaattcatcataaaacacaaccatataagaccaattattaagtctcaacagtacatcacaaaacacaatctatgaaataaattatttatgtttaagagagtaatactgttgataaatcccaatgcaggaaaaaatattcttatgtaacttcagatttgcataacaaatattttttttaaaaaaataatagacaaacaccatggtattcactattcagtgcttacaaaaggaatccagggtatttcagtcacaaaatttccggaaattccgagaaaatttccggaaagtttctgatcgattccgagttccaacgaaaactgcccttatcattttcgattccgtttctgataaaatatttccgaattcgtttccgtttccgaaaaattccgaccgacaaattccgtttttgaaaatatgtccggaatctggaaagtttttgtaccgttttcacccctagccgtggtcacactgacagcatgaacccacataagtagatactatcattaaggtcttttaaaacagtatagataaagaccactaagtagtggtgtagttccgccaaaaccattatttttatacatctattttctataaattagtttatgacattacatgatagtgttaacattgaaatttagtaagcccaaagttaccatcggcttagagtcagtatcggcttcaaagttctagaatcggccgatgggagtgaagtcgccacgatgtcgtgttcttggtggagtcggatcaatcaaaggaagcttatctagaggagttcgagttcaagaaggatgcgacatgacagttatctattaattaggcatagtttgttagtttcattttatctttagtaaagtgtgtttagtgtccgataaggactttatcttttcatttttagtttctttcttgttcgacaaggactagtatctccctatgggtataaatattgtcacgcccagaaatttctgaatagaattccaagcagaatgtgcattaaaatccccgtccaggaccggtcggggtacacaaacgacaatgttgacattcagatccacgtcttacaaacatcataaaagtcttacctaaatgcagcggaaaaacgaaagacaacaggagctaagccttgactagaactgcagcgggaacaccactccacaggcatcctcgacggcacggacgaagcctactcctcagagaaacctccatctgacacatactcatactctggggttgggaaaaatagagcaagactaagtactacccactgtactcagcaagtcataccagaataggggtatgatgcagggaattatcaaagaagagctagagtggttcatttgcataaagcgagcatttataagcaaaagttgaaagatttaaatagttgtaataattaattaatattaatcatccactgtccaacgctataccacgttgcgacaggcccaaccatccacatatactatccaaattctaaggatttcactagggtgagactaatcacggtgaatctggttgaccgcccataaccgcgggcacggctattcgaatagttttactctgatcagaggtgtacaactgtacccacagacacagccccacgacacgtttccgtgcgccgacatgccaccacgacataccggaaagaggccgtgacaggacccttcgcataaccccctctaaccaagcacactacaccttaggtttcacccccactcctcgcaaggcagcgggcagtcccctctcgtgcctaggtgaatctggaagcggcagaggccgtcgtagggcccgccccgctccatcacgcccacccttgcctggatgcgttgactagaggaaagctacattacaagcccagccgttgcccacgctggcttgtggtaaatacgataagttcttc

SEQ ID NO: 52753 - DNA, 21880 bp, Oryza sativa
  unsure (1)..(21880): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgttttatttatatagaaaacactcgtgcaaaaagtaagtggatggactcccaagatggtcatgtccaagtttggccatttgtctgatttaattttttttagattaatatttaagtaaattgcacccacaatgtatcaacttggcaggtgggtgtaaattggtgtaaaaacttgtgaaatgagcgttctagtgcaacaacttggtaggtaagtgtaatttagtacaagaactttataagtgatcgcataagaacttgcaagatacgtacaattttgatataataagttaagaagttatgcgacaacttaattatttggagcacttttttttatacatattcaatttttaagtacttattttggcaatatactagtgtggatttgtatataagcatatttatatttttatcctaataactaataactgaaagtcaattaagctggatgtagaaattattatatttcggttgagatttgggaaggtgaagaaaacaaaaattcttaaaggtaattggatgtgtagtataatttttaaagataatatccttaggatttctatgtaatggcatattgacatcgtgaaaaaaaaaactcacctcatatgattagctaagttgatgcactttttcaactttttaataagttttttaaataagataaacggtcaaaggtacttatggctacacttattttggaacgaatataatataataattttgcaccacgaaacgataaactgacatatggacaaaaagttgttccactttgcagagggttgatattaaatcgagtagtgcagttgtgcaatcctaggatccaacaaaattccgtaacaccagaccccgcatagacccatgactccgcacgtatattttgtgaccgttggatctttcgatctaacgtcccatccctgacctccccactcggctctgcctatcacgcttctccctccctgattcctctcggaaaccgcatctcctccccgagtctccaggcaggcaggctcccagcaaccgcatgcgtcggcacttcatcgccaccgctctgccatcgccgcccaccctagcacccagccaacgtcgtcgccgcctaacgcgcccaatgtcgtcgcagccatcgtgcacgctataagagcaaggttaatagtatagccaactactagctctaattcatctatagctaatctaatagccaatttatacaatagttgtttactatactaatagtatatggtcccactgtcatacatacattgcatcttggagtccgtgctgcagctagctacagatctgtatcccgctgctcttctctctcatcttttatctcattaaaatatatttgtagctggctaatattctgctattgtacctgctctaattgtcgcctcccccgcttctgcttgcctcgccgccaacctcgcccgtcgcacctcttttctcctcaccttcacatacaatcgtgtgaagatttgtcttttagttaacattttgagggttctatcggtttgatttatcaaatttgaattttcaaacttaattttgatgttaaatttaaaatatttttaacatagttttttttatattggcttaagttgccagaaatatatatacaaaagttttactgtaaattaatttttgtttcctaataaactgttttaacatattcgaaaatatggacaaccgatgaggctgagtgtgtgtgtgtgtgtatatatatatatatatatatatatatatatatatatacgcgcgcaatatccatcgccatatgcaagatacgctggcacaaatatggcaaaaacacaacaccctcaaaacaaaggcaaatatgcaaggcatatatgtctttttcccactaaattaacaccgagccgtagcttgaggaagaggaagaagacggggaagacggggttgccgaagacgaggttgaactcggcggtgagagagaagggcgtgcggcgcaggcatgggagccgaggggcccgacattgacgcggacggagatggagaatgggaggctggggcagtgggctagaggaggagatggtggagacaacgaaccgaagagcgctcacgcgagtcaccgctggtagagagatcggactggaaaggcagcctgagcatcccgattggtacgttgccccgcatcaatggtcgtcatcgtggaatttgatcgatgccatgaaggtcgatgggtgcgtgccggggagagggccgtcacggccgtcaacctccactccagtgccgcctgggcctctccgcatgctgtcgcggcctggtcaactagctgagagagagataagggaagtggagagtttgactagtgggttccacaccgtttttcaccccgagttgtcacattggtatgtcacatggataaaaatggtaaatagttaaagaagtcatcaccttagaggggtaaaaatatttgcaaaaaaataagtgcaaatataagaatgacatctagataattgtttattctagaagtggcaaatagttaaattttcgtttacaaccaatgctatgtatatcatcggtcaagaaataatacttttccctatgtcggtactagctatactctcctaccgatcatctatatgacactgtgatattgatcccaacgtcatactcatacatatccctgtacatgtctcgagttcgtacttaactacggattagtacgttctattgccattgaaaatttcccttatcgatccagagaaaagaaacttcccaccgaccaattaactggagtacgtgctcctccctccattaaaaaaaacctacaagaagatgtaatctttttttataataaatttaaacagtctgtctagtacaatgaatctggatagagagtgagtcagattcattgtgctagaagaaattacatctttacttcgattaagggcatccacaatgtactccaaaaatggtccataagcaatataatatttgattcagccacctagcaacattgtgaaactagcccataggaaagaaataacaaaagctactcataaacatatggcctgcctatagagaataaaatatattatttgtctctatctcttctcttctactaatactatttgctatccatatacattgtgaaatttataatagttaaagtttatatatgtgggttctagttttatggactacttttgtcatatatattgttgttgtcctcagtgttgtttttaagaacggagggagtgcattcgacgatgcttactcgtgacaaagtacaaataattagtgctaactcctcacaagcaacggcagctgcctattctgctttgtacccctgaacagcgaacacatggccaacttatatactgtactatgttctaatcacaatcttgatcttgccgaccacctgatccgtacgactaactaaacgctacctgagctagtgaaagtgactgcgtaatacttcctctgtttttttaaacattacttcctctgtttttaaaatggtggttttcgattaatattgtatttgaccttcgtcatattaaaataatgatattttcgatgagtatgtactaattattatttattttcgtgtggtttgttttatcattaaaaacgctttttatgcatgagtagtatttctgcaaatttatagtattgatgttttaacacgatgaatggtcaaacatatcaagtcggagtataaaacaaaggaagtaattatcaaccctcctctgcatattaggcgaccagacaattggacatttatgctgcatgatccgatcgagattagtataataaaccagctgataatataatcagaaacgtgcgtgtacgtgtcagctggttaattcgcccagactttttaatcagcgagaacattctggaggttaaacctgagccatgtttcagatgattcgcattttatccttttgtttcatccgtcagctgcctgcctggtctgagaattgcatttggactttggagctacacctccgcttttgatttttttcaagttaaacttttcttttagttttgatcaaatttataagaaaatatagtaacatttttaatataaaataaactatcaaaatatatttaatgttatatttaataaaattaatttggtactataaatattaatattgttgtacatttctataaacttaaaatgttgactttagaatagttaaagcaacttataaacagaaggaggagctagtgtagattaatttaatgtaatggatttagtgtgtgtacatatcgtttaaaatcttcaggattaattatttatttgataagaataatcaatcgattcaattgactgatattgaaacttgttcttttttattttcttgctacaaacattgtgtatatgagaaatttaaagttaaaaattagttttaaagattgtgttaaatttcatcatgtcttatttagtggaacggaaagagaatgacggaggggtgtagggggcattatttgtattgctttgcatggccgcatgctaaatggtaaatgtaaaaaataaaagtgatcttgacccagtgactcatcaaatttaatttacaggcattccttttttctagttatgatcctaaattgtaatttttttctactctatcaatagaacttcgtttaaaaaaatacagacatccctttgaaacattcctggcagcatcaaactttattgagactaatcaacatttttacgagatgtacttgatagtgcagtggtaagtagcgtgtgattttaaccataaaatctcatgttcgataaaaaaatatttggagggacgtctctccctccaaaactcatttttcttaatcaatatttttgcatcgataattcaacatggcctctcatattctcatacagtcagtctcgttgtcatcttcatatagccagtgccttcactgccttgatgagcgaatctggactctataggcgccgtcatcgcttagatcacgattatcatatctttttttgtgtgtattttacagcagaattaattcgaaaatgcttctcttcgaacgtccgatcagatgaaaaacatcgaacgcctacggtcagctcagtccttgcttgctaatttcttctttctctttattgacgtcaacaaaatgttgtagatcagcagcctggtactgtcgtactgtaacatacatgcatatacatagttgtttcttttcattcttttctcatctctttaaatattttttcttctaaattacttatctgatctataaaccgatcacaccgttgtattcgttgcaattaaatctttacaacaagatatcacatgattatattatgtcaaaagaaaaacgtatgtttcaaaccgttaaaacaaaatgtttcatacgtgatagtgatatgtttcaatatgtgttttaagtgtgtttcacaaaattcctgaaactacctactactactctctctccacctcatgcatgcatacatacatgtattttagcaagcttcaaaataatttttctcttaaattacctattcaatctaagaaccgatcacaccattatattcgttgtaattaaatctttacaacaagatatcgcttgattatattttcataaaagaaaaacatgtgtttcaatcagttaatacttgttgtttcatgtgtaacagcaacatgtttcaacatgtatcttcactatgtttcataaaatatttaaatgttccagttgctgacttttttgtttcaccatatatataacatgatgttttacttgttggtcaactgcaacatttgaccatccgtttttttaatttaaaaatgtttcacctaatgtactcataatgtttcactatgtatgaatcaactattgcagtgagttgaaacatcatttcgctattcgctaaaacattattttcatataaggcgaaacggcgtccaataaaacattttcgatctacctagtggaacaagtccgatatacttggtgcaactgcgtgcaacatttaaaaataattcaataataagctaaaattttttttcatcggattatattcatgtgtggtcttgttttaaagatttaattgcaacgaatttaatggtgcaatcggatcatgatttggataaatattttgagagaaaaaatagtttaaaattcgtttgatacatgcatgatggatggatggtgcatctgtgcatggatcggacggttgcggaggcgtctgatttttcgtctcgcgccgtacgtccgacacgtagcgctctccgaattaattgtacgagacagtaaagtattagcacgtcctgtttaagatttataccaagcaaagtaccaacaaatatcttgtgaaggctacgatttttcttgtacacaataactgtattttttttgaacattataactgtacttagtagtacgattttgttacgcataggtaaaagggagtacaatgtaagtactgctatacacaaaatgcagatattttagctactagggtctgctttttaaggctcaatgactgaatgattcttttttttttacaattatttgatagcacaaacgaatgtattaaatactataaagttaagaaatatattttaattgttttttttcatgaattcatatatacaatgttttttgtaaaaaaaaatatagtaaacatttgctaatgatggattaattaggtttaatagattcgtctcatagtttacatgcggaatctgtaatttgttttgtaaatagtttacgttcaatacttcaaatgtttcaaatgtttgtccgtatacataaaaaaaattaacaaggaaataaacacggcctaaggagcggcaaacaaattgttagccacacccacgcagccacgcttgttgcttcctgaccaagaggctaccattccgtttttctgttcagatcataacaattcgagacgtcgctgcagctgcaatctgcaggatccaaactgaaaacccccaaagaaggcagcatgcagttgctacgttgcgccttattattaacagcccaatcgttaggtatattagagtaaaaagtgaaacgatatattttcaaaaaaaaatctataaataaaacttttatacatgtattcttaacgatctaagaaaaataaacaacgatgaaaaaaaaacttaaaatctactctatatttaaggttaaaaatttaaactttggctaataggtataaataagatctaagactccaagaactcaccggccacacaaaaaactttgaagtacactcaagagcatgaaaagtccttgtctcttttaagtttttatcagggaacatatgagaagtccttgtctcataaaatttaaattttagagattcgtttttttctctttcttggcttgagaggtcctacattctccttatttggtagagacaaaagaagaggttgtggtgatgaggttgccgtcaggttcacgttacgttcctagcagctgcgagcatttcttgggtgtttttttccattgaatgcaacaacacatccgtgagtagtttcagtgacgcctggccaggtgtagggaaaatactttccagttttgaaagaaaggggtatttctcacccttaatttacgctaactcatggttatttatgtgtattaggaattacacatgatttaaacacgatggaggagtcttacacgtacgactacacaaagaatacagtaatactccaatacataaaaatatatgatgtcaccatttcaccatagagctatacaacttacggaaacggaataaaactaaaatattttggccattagaagtagaacctcatctaaataaccataaataaattatatatttttttattacacacaacacgtatgtgcacacataccactcactcactcacctgccagtttgctccaaaacacacgttttgaagagataaaaaccgccgcatagcccaagccctactatacatatgataaaatttcttgctaatgttgcttctatgaaactagtgcatgcaacaaacatgagctccaatataatgttttaatggcccaatcgttaatcatgcaaggcaggatcataacaagattttatcaattttatcatacatatagttattttcagcatagccctgactctgaatacccgtaaatttttattaaaaacggactcacacatacataatatttatagatacagggaatctactgacccactattgtccccctttaataagtttcattttaaccgatcatctgttagagtacgacatcttttacattaatgtaaacgtctcaaaactaaattacacctttcgctataaaactaaatcacaacttactgtttctcatcaatacagcgtggcaaatgtgtcagcatctcaacaaaaagctcctgcaatttactcctccacaacttcttttcattttggcatcgtaggctcgttagtagcagctgttcgttgcgcttagcttgttggttggacgagaaacccacatcggccgtgcctgctgctgctgctggtggtggtgatggccgtgccttcggccgcgcggcgtacgtggcggtgccctgcagcagtggatgcctgggtggcagggggaagctgacgatgacgcaacgatcggtacacgtcaccatcaccccggccttaaaattaatttttaggtttggttatcacatcgaatatatacaagcacatatttaaagtattaaacgtaatataatataaaataaaatatatgttccgctaggaaactgctagacgaatttattaagtctaattaatccatcattagcaagtgtttactgtagcaccacattatcatatcatagcgtaattaggattaaaagattcgtctcgtaatttacacgcaaactgtgtaattgatttatttttcacatttaatacttcatacacaagatgataagtgaaaagtttttttttaactaaacaaggccatacagccataccgtactatctctatcatataatataataattaaatcttttatttttttttcttcatcaatatttcttttccaaccaatcataatccttcattatttaatttttttcataactttatttctcaatcaatcataaacttgtcccatttaattttatttattttaaccatatctaatttgaaacgaattttatcttagaatgtaggtactccctccatcccacagaaaattaacttctgtgaatgaatctagataagtattagtcagattcattcgtagaagttatttttttagaacggagggtatatgtaggagtagagtatctttggcgctgacccttcaacctcagggagtcgtcgtcacggctgccatgcggcagagcccctagtatcaccggtgagccccactggtgtcagctcctggggcccacttgtcagagagtgacgccgatgagagagtagacaaaaagaaaaaaaatcctttggaatttatttgggtgtagctatatttataacacaatatttttcataaaaaatagtcggcatgtatttacattgtaagttcctaaatatatatatatatatatatatgtaattttagtgtatttacagtgtaaatctcaaaattacatatgtaagtaataaaattacatatgtaaattcaaaaattacatactaattacatatgtaagtgaggtgtaactactatataaatggctgaaaaaatcgactgtagtatatggcgtcatatttctaacaactccgatttatttttcaaaaaaaatactcctaggtaaacgggttctcgtctcctttgttttccagccttccagaggcagccgcggcggcttttttttttttcttttctccccttcttctcggcagcgtccattcgattcgccctcgattataaatagccgcacatcacgggggccttgaggtttgaggagccaaccccgccccgcgccgccccgccgcggccgcgtcgtctcctccgccacctccacgtctagggttcccctccgccgtcagcattgcccgccggaggtacgggtcctctcgccgctgcctcgattgctcggccgatgttgagtgagcgatgggtttttggaggttttgcagtcacggtgtgcgtgcgttccctttcggactgtgaagtcttgtgttgcatgctggtgtttgcggctgatttctcttcctacttgtggggagatttgcttgggttttttcatagttttttttttgatcgatttcggtggtaaaagtttgtgggttttttgttcgaggtgatggagaaacgcggcgcttgttcgtttcgcaagtgcggtggttgcgtgcgcatgtagatgtcgggatgtggaatgcttgcatatggatctaacaagttatctgtaaatatttcgtgatttgggtctctactgcttgatttttttttctttttgctgttttctgattttttttaccactaagtaataatattggagtaacatgtatgtgttgtttgctgttatgactgaaccccacgcatgacggcatgagaggagaggaagtgttggacacttgccgcggttacctgacgacaattttttagtgcttttatttttgaaagaacccagcaagctggttttattttagtgcttttatgcatgatgtttagctcagcaagtgaccaagtaatttgtatagtataaacttcctagaaattgtatgcagaaatgcaaatttgtctcctcgtcatgcagaagttcgaattacaaattacaaatgctaattatggtacaccaaatatgttgcaatgcagtaagcgcaaattaattacgtatactgcaaactttgcatacgtattagcaccaagcgtgcattttgtgatgattgcaagtttggtccgtggtttctctccatttgactcatctgggtagcttgacaccttaacctgagtttgtaaattttgtaacatgggggcttctaggatgtgtgtatgccaatatgtgtgtcttcaaaatactacgtatgtaatatatatgtaccatttctgaattgtaagtactgttgcagcttctggttagtattgagtggaattcagctgatggaactactaaagattccctttaagggtgtcgtcgctgatatcgaaggccgagcagcttggtacaagcatgattggcttgagggattccactctggcttcaggttaattttgtttcgaacaattaattttgcagtagatcactgtgtgtgttttcactcctcttgttgctgtcagtttcattccttaattattcatgttgcctctggatgtatcgtcaggatattggcacctactatgtatatattttttgcctctgccctcccagtcatagccttcggaacgcaactgagcagagaaacaagtaaatacctaccctcttgccactatgagccatactacagttgtgctctttttggaattgctgtccttaggctttaattacatctctaacaaagggaaagtggttcatttcagatggtatactcaccacagtagaaacactggcatctactgcaatatgtggcatcatccattccattcttggagggcagcctctgttgatagttggagttgcagagccaactataatcatgtacacgtatctctacaactttgccaagaaccagcaagctctgggggaacgactgtatttagcatgggctggatggtaacaactgaaactgaatactatcacgttagcttttcagaaaaaaaagttaatgctctcctgatttgcttactgttgacagggtctgcatctggactgcgatcatgttgtttcttctggcaatgttcaatgcttctaatgttattagcaggtttacaagggttgcaggagaacttttcgggatgttgatcactgttctgttcctgcaacaagctattaaagtatgctatttctagcgagctcagtgctttgtatcttggaagaaaatatttagaacggtgcctacttattgcagggaattatagaagaattcaaggtacctggaggtgtcgaccatagttcacctatatatcgattccagtggttgtatgtcaacggcctacttggtgtaatcttttcaattgggctgttatacactgcattaaggtcaagaagggcaaggtcatgggtgtatggtcaaggttggtcacgttttcatcttacttttatctcattgtgtccaatttagggggcaagttgagctctgggtcatcaaattagcaatagctgttccattagtcatccatccaaccgttagatttatgccaaacatttcttttgctgttttgaagtttggactgggcctactttagatcaggcgttggttgggctgggctgcaagcttgtgttgtgtcagcctgtcagctttggggcaaaccatatggactccttttttttccttattgagtggatggcttggcttgagatggtgtttagtagcccatatcgacagattcttattctgcacagtgtttttccctctttgaaatttttaacatttagaaacaaaaacaagaaattactactatcttctctattaaatacgcaaagcttttgccatctttcaagtaaaaagagaagaaattactactatgtatgctacatcagcatgcaaatgactccatgatgacattttataaccattgagaagcacatgtacatgaactgatcattgtgcgtttgagttgacacttgcagggtggctcagaggcttcatttctgattatggtgtcccacttatggtgattgtttggacagcattatcgtacgcattaccaaaggatgttccttcaggagttcctaggaggctgttcagtccacttccctgggagtcaagttcactgcatcactggaccatagcaaaggtaataaatcaaacttgcttgggatactggagatgtgaatatttatggtcttcaggtttagaattttggtatagcttattttgcatggcatcattgataatatctttgggttttttttttatttccaggacctgttttctgttcccccagcatacatatttgctgccattctgccagctttgatgattgcaggactttacttctttgatcatagcgtggcttcacaattggcgcaacaaaaggagtttaacttgaagaagccctctgcttaccattatgacattttggtcctcggattcatggtgtgtgccatggttctatgataaatttatctgcttatacccgtctaaaaaaattatctgcttatggcggcccttcttaagtttttttttctcggctaactaggaacctaacatcttttggtcctcagtgaacatttcatttctctatcacttctagcctaaaactagccaaaatcttttagtatagtcttatgaatatgaaatatttccgttcaaaaaaaatgaataagaaatattctcatatattttaaagtagagttggtatttgttacaacaattgaatgggtatgattgaaaatccaacatccataatatcttatattcttttttgcgtgattataacctggcactactgcaatctacaaggtgatggttgataggagtattggacactgattctgctttgtggtgtaatagaccaaagctgtgacatgctcctcttctcatatagtagtataaaaatgatgcaggtcctgctttgtggtttgattggcatccctccatctaatggagtacttcctcagtccccgatgcatacaagaagccttgctgtccttaaggggcaggttggtgaacttcagaccgaagtgttttgtttgctacaatatccatatttgctcatcagctcacccatcttcttcctctgtttgcttagctgctacgcaaaaagatggttcaaactgccaacgaaggcctgatgaatcgtgctagcagtttggaaatctatggcaagatgcaaggggttttcattgagatggactgtgaaaaaaatgtgagtatgtactcttcattactgatgtatgttaccatataatttcctcttccatttatttgttgcattttacttctattgtcaatgccagttcctgtcaaaattactacatcagttgtcaagaaaattagtcctaagctcatgtaattgcctgaacaccttacttttcaccttacgaggagtccccatacttttggttttctttcagtaactattcaaaatgtagatgccactgttagtcttgtatggaaaatgttcaagtaaatcaacttataggtcaaaaattgtcctgcagactgattctgttgacaaggagttaaagagcttgaaggatgctatgctgcaagaaggtgataaagaagggacattggctgaagaatttgaccctataaaacatattgaagcacatttgcctgttcgagtgaatgagcagagactaagtaacttgctgcaatccttattagttggtgcttgtgttggagctatgccagtcatcaagatgataccgacatcggtcctctggggttactttgcttatatggccattgacagtctacctggcaaccagttttgggaaagaataagacttatattcatcccatcaagccgacgctacaagtaatatctctatctgcatctgtttaccccatttgaacaatgaaattgcatgcttgactacttgcggtgcagcctatgtgcctccttttggattaatcgtaagataatccattttttgtcaaaacagtgattaacagctcacactatgcttcaacatttgcagggttttggagggtccccatgcgtctttcatggagtcagtgccttcaaaaacaattactgtcttcacgatcttccagttggtttacctcttgatatgcttcggcataacatggataccaatagcagggatcctgttcccgttgccattcttccttatgattcttatcaggcagcatgtcctcccaaagttttttgagccaaatgaccttcgggaattggatgcagctgagtatgaagagcttgaaggtgtccaccacgatcacacgctggtataaatttatctcccattcttggattatttacttgtcagtgatgattgtgtttcactctttaattctccgatgccccacgtctgttgttaatctgaatcttttgttccacacaggaggatggtgcatctgattcagaaagctgtggcagccgtgacgatgccgagatattagatgagctgacaactaaccgtggagagctaaagcacagaactttcaaccaccgtgaagaaaggcacccgcaggtaaactattggcatgaacaatattgcgccgaatgtgcacgggattagagatgagatgatacaatgcgtggccttacaatttgctctctaactcttctatcagcgtcactactagccaggcttgttgaaatatcgagctctttcttttttacggaagatcaaataccacgcacgatttgttgtactttctgcctgaaaaatggcagagttcacgtgcaaattcaaaattctcttgcgttaagcgcatttcatggcatccctttatcttttttatatatttgagtttgacaaatgttgatctccatcatgcaggcgcatacaaaagccgttcagcccaggtgtggagatacagaaaactggtccgagtgctaaagaatttcggcttactgtcggatgggtatacgataggcatatatagcacttcctcatacattcctactttcctatacatcgcactgtagcaggagatcggcggccgtatgatatgatatgcttgtcagttgtcacattgtgcatggagtaaacagaagcaactggattttacgatgttctctagcctgtgaaatgttgctccttgattgttctgttcgattgtaaaattgcatggcaaatcagatgtggggagtagcacttcatgtttcgtttgctatggcataaacttttagcctttttattattgacaaaattggttatatagcatcgaaccaattttgcctataacttactgtagcacgcagacgcaggagctcacatcctagggaaggatgggaacatgcacagtgcgcacggaaaacggagtaatctattagcgtgtgattaattaagtattttagctatttttttccaaaaatagatcaatatgatttttttaaaaaacaactttcgtatagaaacttttttttaaaaaaacatattgtttagcagtttaaaaagcgtgcgcgtggaaaacgagaggggagtgttgggaacttgctcttgcaaacacagtgtttgatggatccaatcttcaaactggtaagacaattcctcgatctccagttatattcctagtttatcaacttcctgcttgaaattaagattcagaaatggttcagtgatatttttagaaaaagtgtcgagaagacgaaataaaaacatgcaaacaaacatcgattttgtataaactataggatgagttatagagggattcaggaccaagtaattaaagggagcaagaaacgttggtgctgctaaatagctaaatcctagccacaattatattcatctaaaatcatgctcttgactgatcaagctaccacaacgtcaatgctgtctaaacataaatgggcagaacaattcacttcaaactaggaaaattctgtacaacatgcaaccaaaagaacagtatggcatgcatttggcaaactagacatgaaattattaccttttcatggtttgtccagacaggtaatatggcatttcactggagataaaggagagtctctcagacatccttctggcagtcatgtaggtggtgttctgatgagacaagcttccatttttagaataactagtacaacctagtagaatcttcttcttcatgtggaccttgatcatccatgttgtggcttcagggacaatgtagttgccctcgttcaacaagaagcaaacggtgtaagggttttccatgtcaacaatagggaattctggttggacatttggaaggcggttttcacaatcgaggtcccaaagttgggcagcatccagtgtcgcatcttctctccatgttccgtcctcgcaccacgaccacagggttatgctaaaactgccaccacattggttgatgatattgacgaacttgatgccatggtgggtggcacacacattacgggaagcttcagggcatcctcgcccacgctcactgtcataagggttccccataaccggatcgaccggaagcggtacataccatagagcaggctcctgtgggtctcctcctcctggatgtgccaatttggcaacaatcatccctctcaagtagtccacccagatcaagtagcgacggcggtaggataacactgcatcagttgaccaccagccggcaccattgatatggtcaatccgcacatccctgaagactctccagccgtcggagccggagaaaaacatgtagatgttagctgcagaaggttggtatgaccttctctccatctcggccacaacgaacgaatccttgctgcaggacaggacacccatggccaccctactcatgatgcgtggccgaggattgtctctgcccgaagcccccttccagtagcaaacgggcagccgcgtcaaggagggttccccgttgggcttggccttgtagacgaagtagtcgatgtcgatggggcgagggcacttggcggtggagatgatctcgagcagcacgacgttgccgtgcgccgcgatgacgtaagggtaggatgtggtcccctccgacgggcggggcccttgcggccagtcgagggtgaggagggaggtctccggcggcggcgcgagctcgaacgagacggagatctccttgccgccggaggtgcgggaggccaccgacgtggtgcggtcgccgcggaaggaatccctccgggcaccgacccgattcaggatcacccaggttgggttggagtcgccggcgccgtccaacgacagggctgaggaggaccgcttcggccgcccgtggccgccgggaatctccgtctccttggtcggcgttggtttgcgccggtgtacggcccgcgaaccgtcggacgatcccttgcgccgcctgtggctgggaatccgtgcccccgtccccgtctccgtctccgtctccgtggggatccgcatggcggcgccggcggcggcgagggtttggtgtttggtgcgcgaaagggtaaatcaaaggcgagagaggccgcaccacccgatcagttttcggcccggggaaagtgggctcgttcttcgttgcaaccctatacagatacggggtgatactgtccgattgattgtcttttttttgtttaccagccgaattcctgaccgttcatctaagtttaagattggtgctttatccggggtcgccattttgcatagattgaaccctgttttgtctctccgctccagctactctactctacggagtaaacgaaactgtatatttacaaacaaaaagtaatttctaaataaaacttttatatatgtgttcttatcaatctaaaagtaaaggctaaaaaataaagtttgataaaaaaaacccttaaaattagctctaaatttaaggttaaaattttaaaatttgactaataagtataagcgaaaagataatatcctagtgcattccttctgaatccaccaagacacccacgggaggttgacactgtcgatgagacgggaggttgacaccgtcgatgagatggccatatatatagtcgtcactgacaatgtgagtctcttttctacactttggaggcaactagttaagggtttgattcgtttctaaactcgaatggcttggcattttgtttgccccaaaacatgggtagtgttatttgggtattatggagttcttgatagctatttagattgaaggatctgatttctttctctctctgatatgctgcatttgggatcaaatgtatgcaagcaaagagatggggtaaaaggggacaagtttcagtgcgtgacaggggaggggctacagaactccaatccaccgtaggtttgtagacaagattagtcatagcgagggatgcacataaataagatctgtactggtatactccatcccttctaaacaaaaagagactaacctaagagagtccgacatagacaacccgcttctctctcttatgttactgtcaggggagtccgtctttcccgaaactaaggccctatttagttgggaaaagtttttgggtttggttatcacattggatatatggacacacatctgaagtattaaacgtagtataatgacaaaataaattacagattccgtcagaaaaactgcgggatgaatttattaagcctaattaatccgtcatcagcaaatgtttattgtagcaccacttatcaaatcatggcgcaattaggcttaaaagattcgtctcgcaatttacatgtaatatgtgtaattgattttttttttgcctacatttaatgttttatacatatgtccaaacattcaatgtaacagcgcgattttttttccagaaactaaacagggcctagacccctgcaatgggccacccatgtcatactcatagaccatctatctgcgagacagcgagaggtagtgtagcaaaacggctccgtgcaccttgtccacgagtcccacgagtgcaccgggtccagtgcaccaaaaccaaaccaaaaccccccacccccacccactccgctcctcgtcctcctcctcctgcaagcttcctccctcctcgcggccatggcggcgccgttcgtctactgccgccccaccgacgacggcaccagttcgtccagcctccccccacctctccgcatctcctcctagctcgatcggcttgctagctcctcggccatgtggtctaatggcgatttctcggtttgttcgcaggtgagagcgctctcctgagggcggccttcgacgggaacctcggacgcctcaaaggtaggtttgcttcctctcctcctcctcctcctcctcctctccttcttctccgccgcgtcgatcccccccgatcgatgcgtgtatgcattgcccccctttgcatgcgcctgtgttgcgtgcttttcctcccttaggtttgggtgatgcatgtgtgtccttgtgtggagcgcttggcgatggctgtactgttaattgatttggccatggaattttggaatgcaaattctgtatctagcactcgttgcctttgggaatttcccacaatttattttcggtaatgtttatatgttgcatggatttttgaccctgcgtgaaggaattaacagccaggtctatggattactggagatgcatgccatcttatctagaaattgcaagatctgaggcttttatcgtagcaagtccttgcgttggataaatgcgacaacgttgtgatcatctttctattacagttacctctccaagtgctaatgtgtgatgagtagcaggtagtactctacaaaaatgtttttcaagtcgcaagtatgaagtataggttcacatgactcagtgaggttcttgcacgttgcacgtattcgtcgctttttcgagttctacctagttaatctgttcattcgcagattatcttcctcactgtgatgacttcttttgttcttatttgcgagaaggtattttaaagagccttgggatcgagaaaggaaagacccagtatgcagtcttagctcttaacaagcatgggattgggatgctgcacgccgtggcatgccagggccatctgaatgtttgcaagttcttggtggaggaattggggggtgacgtgaatattgctggaaaagaaggttattatctaactctaccatcctttcatgaaattggcggctgccatgtctatgttttggcagtataatgtgccaagtgtactgatgtgctgtttattacagatataacaccgtttatggccgctgctgagtctggtgatgttcctacggtgcagtattttcttgatcatggtggtgatgtaacaaaagcagatgttagaggatgcacagttctccaccatgctgctggcacaggtctcccttgatatgaacactatccaattccttgttatattaccaattatattgttgtacaagattctacgatactgcattactattaatagattacatttaattcaaccatgtcgtcacagttatcttttattgtgttgctaatctagatacttttagtttatatatcaccactcaaagttgtataggtttgctctgtttatactcggtcacatctcacatgtaatctattgtgatttgtccattatactggtactaactgtttattcaaataactcaatttatatagtatttgtttccccatgatttatggcccatctcattcactgcaggatgctgtaaggtaacagagttcttgctttcaaaagggatacctgttgacatagactgtggccttggaacaccactctttcatgctgctaacaatggcaaggataagacactgaagattttgttggatcacaaggcagatgtatgtagttgccactatttcttatttcctcttcctttttctcactgctagtttggatagatagatatttgttttgctttccacttagatagttagcttattagctgatgtacactgatgcagtggcggagccaggataaaattatagtgggggctcctcagacttttgggccttctaacaatctcagataaagtctattttagccccctttaatagatatatggatttaaattttagggggggtcttaatgggggctctaatgatctattagggggtagggg

SEQ ID NO: 52754 - DNA, 2169 bp, Oryza sativa
cccccacgctgtctccgccactgcactgatgcgtgtttgcatgggactgttctgtttgcttggattgacccattctcagatattgcagtgcataatctatccttttggtttttactttgacattttatagaggatcttagatcatatggatttccaggtcttaaaaaggattatttcttttcttttttttggttatgaaatgaattattgtgatgagagttaggataccacgcgtagcacacgctactgaggcccctgatcgacgcggccacaccgcgtacatagcatcttccacctgcattgtgattattattataccgctgacctttgagtaatactcctaagtcctaaaattgccatttggcatgctctaaataaggttggctgatgtttttttgggaaagagcatgggagtttaggtgttcaattcatggcacttatataagctattatcctgctcttttatctactcatctctttaatgattgaaatgctttaggatcatcactagaaaaaaacacgcggcaaagccgcgtgcaatactggatgggccatgctatttgaccctaatgagacagaataatcagtttaacaacaatgcaagtattatctaaaaaaaaaagcgcaagttatagcatgatactacagtgcacaatcatgattgctgtagtagactacaaaatttaaaagatttttgtgacatatagtgtgatatagactgtataatctgaacaaaacacagtggctatttgtgacagacatttgaagagtattgacatattatcttcaacaacgggagacgacgacaggattctcgagaacccggccgacgtcctcgtaatcgtttgccggaaccaagcaacccatcgtcatcgtcatcatcctctagatgttgatctagagcttaaataatgaaagattttaataaagctccatgtcaactttgtattagagtaactggctagtagatcagtctaggttcttagtcagagctagatacaccaaaagtaatttggctagtagatgagaggataacaaaagtgtccatcttggactatagatagcaaaagtaggctgtcttgattggagaagttatcagtagaacgcttctttttgccctttgtctgaatgaagccatagtcagtgctttcttcttcatcattttcctaaaaaagaaaaacagaatccttatcaaagtatattactaaggaaccagcaattctttctcatgcaatacttagcacaatgcaggcagtaggtttggcaagtatgagacccctagtgtcagccatatatgtgaatagtacatgtaaatagagaatagttgttgaccacagggtatacacttgcttgaatatttcattccattatctaaaaaaatacacttgattgaaatggtgccaagcttgtgcacagtacagttagtaggttaattgtatgattgaagaatgaaaaacaaatgaatttaaatatgatcagttgtttacctgatctgtactgtttggatcttcataagctctttttcctgacaaagtgcttgtttctaaattatatggttcaacttccatgctttgaatatcttggggtggttctatctgggatgatgagcagtaaataagaaagaaaagaaaggaaatagtaagagattatgtagcaccgacaaaaatgaataaaagaaagagtactactcttttacctcatgttgtattttcttggatagtataggcaccagtggaggtaaattatgtagttgttgagatgaacttgaactgatgggaagattcttagttgccttaaagccttggctggaatgttgccttccaaatctttctttaattgtcagcacctcaaatgaaggttcatcagcgttgatagttatgttcggcaaaaccttcactatgaatgtgaatttatgtcctatccatgcttttatttctggaggtgtttgattgatatcatattgccttttcatagtttcagcagtcctaccaataagttctgtacctttcttttcaaatagcacaagttcaaggctagctgtgccatcatttgcaatgaatggtattttgtacctgttcaagtgcagagttatttgaaaattatagttatatatattcacacttaatagtatgattggaaaaagaaatactcacttgtactcatactgcc

SEQ ID NO: 52755 - DNA, 37786 bp, Oryza sativa
tgctccgttgcatatcttcatcactttgcaagtatagcttttgtataggatcagcatgtggtggaaggctgcatatataagatgttagaaataggaaattccataaagtaaaagaaaatatgcaggggattaaattgtacttaccatttctgaaacatcttgatttcagggatgtcattttcgttgatataccaacgacaagctgttgttccacttagaaattcatatgttcccttaaggattttcattgatgtaccaacaaatattgctattatatggttattttgaccaacttccagtattgtctctccatcaaactcaacagctctttttcctgataatgagaggtcgatggtttttccactttgaagaaacaataaagtcagtatcaagtagtttcagattagtgttagtgttcagatggggaaatatagctgatattggcataaattaccttaaatcttgtagtttgactattcttctcatcctataatctgatgaacttgtagaaatcattgctgcattagaaacagcaatgatttttccaataacatctgcaaagatagaataaagtatttgattataacattgcatatagaatattatggttacgtgtaatgaaataaaagttaatttagtacctagaaaacgatcagtcttgcttgtgaaatcatgaagtttatcaaatgacaccaagtcaaatgtatactttggaaaatccataggttgatctttggcttcaatgatacaagttcttttgtttagtttgatcatatatggattaccaactgctctataactgggcttagcattgttaactgttatcttgctgatgtagacgatatttccttcctgtaaatattggttcaataaaggtatagcatcaggtgggatctcagcatagatagcatctccctgcaatggccatgcaattttaataaaataatatatatttaatgataaatatatgttaggagaaaatataaataaaggatatagtattaccttttgatcaagtaaaaccagatctaaatgtttgatgttatcatcttcattagttcctctaaattcccatatcctagatattcggacgcatatcatgtagtcatatcgccctgggcgcagctctgcaattggagtgatattcatctgcaaattataagcaatggaaaatgttagtactgtgtttgtgtttatatagtatatagagaaaaatatagtatacattaagatctaaatgaatctaaaatttctctatatactatattttttgtttgtgttgcacatgtcccatcttcattttctattagaatttttaaacctttactattgcttactcgtgagattgcgacatataattggccatgtgtaaagactggtttttttagatataaaccaacattagataaagtttgtccttggcttttatttatagtcatagaatagcacacttttattgggaaatgtcgtcgacacaaggtaaatggccattgatttcctcgggttgttaagtttattctgggtatatatgctttttctcctatatgagttcctgttattattataccttctataatattgtctcctaaatttgttattatcaatcttgttccattacacaatcctaaattttggtttagatttcttagcaaattataggaactccaactttcagcttaagtacatgagttggaaaattattggcatttagagaatttaatattcgacaggatataatatgtccgcatcattagttgtatccatacattgagatagtgtgtcagcactataatattccttctcttgattaggtactaagctaagtatatagttgttcacttcatcaacaatctcattagttgtagctagaattgctctatttttcaaataatttggattaaagaaactatttttgaaatctgggtatgtaaactttaccaactcttctaatttgttttctcctgtgtttattaataaattttccggcactagtataatggttgtatctgtgtcttcattttgagcagtactttgtttggtatttattttaccattgcctatatccagaatccaattattaaagtcattgatttctttatattctaaagtattagatttggttttttgtaatcgcatattttcaaatagaaatatttttttaacatacccccaaagatatgactttacgattgatgcattaataatttccagttttgatgcattttctataactggtaagatttgtttagggtctcctcctagaacaacaactttacctccaaatggtttatcgatagcattaatatatttttctgataatatatctcttaatgttctatcaagagcctcaaagcattggcgatttgtcattaatgcttcgtcccatattataagagaagtttctattagtaattcagctaattttgttccacgtttaatatcacataatgatagttcatctatatcaactggtattcgaaatcttgaatgggctattcgaccatttggtagtaataatgatgctactccagacgatgcgactgttagaacaatttctttttagctctcaaaaatgatacaatagtattccataaaaatgttttgccagttcctccatggccagatacaaagaaaaaattactttctttatttattacactatttactataagatgaaatgctttcttttggtcatcgtttagctgtaagtacaatttgttagcttgctcttctaaatcatttgcattataatttaattcatcttgaattagtgtattagttgaatctaatttgtatcttactgtcatctgaggaagattaaatttatctatacttataccacttttggataataaatattctatttgttcaattagaatatcttttaattctatatcagtcgggttgtacttaattgggtgatattttgatattaattgaaattttatatcatctaccattttttccaatttgtctcaaaaaatttcctttcatcttctaaattgcaatacaatagtaggattataaataaagatcgtagttgtggagatgttgcccaacttgcagcttcgtcaaatgttttataccattcattatcatccattaataatccacgtgctgcacatgtttctttaaaagttttataagtaataccattgtatgttctaatatcttcatagttttttgctcctttaactatcattaatagcatacgtagatagaaacgttctccttcagttggtttgacataatataaacgggctattttaaaaccatgttgtcgtttgacccatttcctttcttttttatcccatttccatttttgtgggaattcacagtatgtcaagtttcttgcttcttcatgtaactgatttgccataaaccattctgtaagcatcgttctttgattatctggattttctataatattttttagttttgtatccttagttaatttgaccatattcattaagggaagatgaacaggcattctttccactggtggccaatgataatgtatttcatatccaagtaatctccacataccatcttgatcacaaatatatctacattctaaatattcttctatttcatctattttttctgtttgctcattttcagaatgatctattccttgtttgatacgttggaaaattattttagctttatcccctcctttgtttacatatttacataaatattttaacattctgctttgattaacaaactcaacatttaaatgggcttgatatctttttaataggaataaattgtgtggaacaacccatctattgtccaagttatggttatctttacgtatgtatatattagtatttctacgtttatattgtgcaaatccattttcagtaaaattagtttgatcattgaattctttagggtaaaattttgaacatttgccttttttcatgcatggacaattttcattcttggctccacatggtccatgcatcatatgttcagctataaggatgtatcctagaggatcttctctaggatctggtatttcagttgatatccatttatctatcatttcaatcgttatttcacttggctttttatctaaccaaactaagatatgtacatgtggtaaacctcttttttggaattctaccgagtataaaatagctgttgtaggtccaaatattgtgccggattgtatatcttctattaattgttctagctttatatgaaatactcgaactataatatcaggtctatcattgggttgttcgttttctaagattgtcatagtaatttcaggccacctaggattacatgtaaatgttataaataaatgtggaggtccatatacacgacatattgctatgccatcgtaatagttttgcattgtatatcgtttagaaccaacatggcttgatggtaatattattttttttcctatttggtttccttccgttaaacctttttgtactgcatcaaatattccttttaaacattcagctcgtaatttgttttgatttttagcaataaacattagtctatcttcatcttctattgcacgggcatcaactattgcttgttttgataatctaccataacataaataaggatttggttgatttggtcgataatgcatatgatatttgtagtattcatgtactgtaattgttgatcttgtttttttactctttttatttgtattactattataatatggtatgccaagttgaaatcctctttctccataaggaaataataaagggtattgtaaagccatataggctggatggaatatagatatgcgttgtaatccattatttttattttgaacaataatatctcttttataattttctagatttaattctccaactattaaaattgctaaatcttctgtatgtggcatttcatattgtattggatcacctttatcagcccctattattcgaatactaaaatcaacacctttatgttcttcaaatagatcgcgagcatagcgaaatgtttttaccaatggattatattcatcaaacattttttttaattgttcaactatatacggattgatatctgtacttcccatttcttctttatttaaagcatgtattctattttctatttcatttttagtatcaaaaatatatagttctgcaaactttggaatttcattaggcttaggtaggagacatccaatacgatgatgtatttgtccatttacacgaaacacatatggtccatcgccattatttatatttttatctattgtgccacccattgaagtaaaagaaaataaactattatattgtctaatcttctgcataaaatgttttgatagattatcttctttattattaagtaacctagcaagtgtttctggtgggttctggaatggtggtatttttattttgttatttttacagcaatttgaatatataatttcaccttttcttttctttgtctctcttttatttctttcttcaaaacaaaatatagcattgcaatgtttacatttatactctggcatacctataaatgatttgttttcatatgattcttttagatatttaatgtattctggggtaaaggacaccatgccatgtgaagttgataaatatgaagatatatggtctatctctaaacatttcttttttgcaattttttctagataatctaaattatattgtatttttcttttatttttaatatttttttgcttttctgtatatattatatctcttatattactattttttgatgtttcttcttcatctttattacattttttattgttattatgcaccatatttttttcttcttctctttttcgctttttctctcttagaatttgtagtctgatatatcttcttttcttgcaatctgatttatcatattctgctatttttattggatcttgctttctctttgatggcatattaacacttctgattatataagcacaaaaaatagccaaagtcagaaatgaatataagcataaaattaaatatgaataattaaagatattggttgaatcaatacaaaacttaatcattcatttcaacagctatatataatcagaaaattacacatgaatagtaaaaaaagtgttagctaatacaaacacttcaatatttatgacgacaaagattaataggagctacaattattgatcatacatacaatggggcaatagagctattctattgccattctctaataattcctagcgtacatcttttgtacagtacatccattccatttgtattacagtttcttacaaccatcgcacaaaattttcaaatttcaatagatagtgttgatatttttatatatatttctgattggttattgtttttaattagttccatactaaaattcagtgcatttgtggctatagataaaatggatttgctgatttattggtaaaacaatatcttatggaaataaaaataaataaatacaaaaaaaatgtgaagcttttgcactggttctagtgcaagtattttttctgtcttcactgatgttgctacaattctccaattctccataggaacattgattttccagaagggttgtagtaggatcttggtatgtctacgcatccagcataatataactttttggtcattggtacaacacatccagtacaataaatataaatataaatatatatatatatatatatatatatatatatacatatatatataaaattttccagctcgttattgttttttacctttttgtacttcctagcttcagtgtcttgctcctgtttatctccttttcttttccttattcttttatcccctgtaaaataaacatttactaatatcattgcagatgatcaatgtacaatgatgaaaaatactaaaaagaatagacaatgttttttttttctggtaaatatccatactacacgaaatgttattcacagctgattggttgtgctatagcttttctaaatagaaagtaaaatttgctgtaacttgctgcaaattatttagaggaaaagattagactttgtgactaattgatttacgggattgaagttagtataattacatgtaagtacctaggtttgtcaattaatggtttgtttggatcagaagtggaggctacagctacattgtatagtaccactatataaatcaatgtattttgaataacttttaaaaagtttaattgaaaacagttagtttggaatggtggtcatcgtaatatactatgagttaatttattaggagtacacgaaagcttgacttgttagcaaagatcaaacagaaatcaaaaggaacacatccatatgtcctctctactaagttgtcattggagatttaggtgacagaataagacgtggctggacgtaagatttctttccgattgcttccgttcccagtgacttatattataacaaatagtctaatactcctatatagtgtcagagaagtaacagatatagtatatcttgttgtccatcgtgcacatcatcaggatcagggcaagttgcagtaggctggtgttgatgttctttgattcggtataaatcaatcgatcaaaatgcaaaatactactggatctgggctaatttgggggctttcgtgatcgtgcaaggtaatgcaggcgatcgtgtacctgacctcgtcctcgtgttcactaatacatgtgattcagttcactgacctcgtcctggtgtcgccggacctgctcgccgcagagctaccggccagaggccaccgcctcggaggctcctcctcgtcgttgtgttgtcgcgcacggcgcaggatgtgcttgccgcagaggtactggctggaggtcgttgcttctttatccctcggtggatcagatgtattgccggtggatgttgatggtggtgtttggtgccggtgaatgtggatggtggaacggcaagaaggaatgtgagacaatgacgagaggaaagaggaatgatggagaatgaatatatatacagagaagaagaagagtcaatcaaggaagacgaagagtcgtggcccttccggagaaatcaggtggctttgcactttttcattatactccaacgtaagattgtcttttatattttagtccttttcgcgttttggagcgcacgcacgaaccacgctgtgccacgtggcatcgctaatcgctcgataacttgcacggatttcgatagtaagagatggcatatttgtaccttcatctacctcattgctgaccttctggttcgatattgacttcactaaatgtgcactaaaatctcttctattccaatgcagtagcttcagtttggcttcatgaaatttgagtaaatgtggcattgcctacatctgaactctgattataataattatggtttcacgtgtaatatattttttctattgtagtaaaaagtctgtaaaatatgcacataatgcaactttaattctcaacagcgaaagttgctaacttcaacagttagacttataaaaagtggcaaacgctaatcagaaaaaaaaagttagagcattatattgcttttcctttttcttacacatattctgctttcaggctgtatttaggctaaatacttatattctgctttcagcctaacgtaattatcaataatggagccggtagtcccctgatgagttcccttatctaccgatcattgaagtgtatgaagctactcataaaggtcagtgttttattgagtctatatttggtcaactaatgctgtgttttaattttgctaactcaagacatttgttccatgaacatatggagctaaatattctattgcacaatgcttttctcaggctggtgctgatgttaatggcaagggtacagttgtaacccctttgatgcttgctgcgtcgcagggaggctatactaacttcattcagtttcttctgaaggctggagcaaaccccaatattcctgatgatgtatgttttctattcttctgagtcagttgttgcttctccactttggtctataagtctgattcttttgtgttttattacaactctgaggatgttttgtctaaggtcatgtcagtttatgattaagatacagattttacctcggtttttgttagcaaaattttcaaattgttaaactatgtatttcgtgcgaaaactttctatatagaagttgctttaaaatatcaaataaatccattttcaagtttaaaataattaaaactaaattaatcatacactaatggttttcttgttttacgtgtcccatatttaatattcatccttgtcacatcctaagagggcctaatttaacaaaaacattgcacttatgatttgcatattttgtagtttcctatggattatctgaacctgtgttcttttattttattgtatgtgtaagtatatcttacgagttgtacaaagcatggatgacctttcagcaaccgacgagttctcaaatccagcctatatccaaaataccattttgatagaagttcatatcaatgtccaaaaagcccatggccagctttgaacctacagaccatggtgttttgggacgcaatgagtcgtttggttgaaacttgaaagccacagattgtgataataggccatacactgatttcaccaatattgtttgttttaggttccttgctgaattacgctgtatgaaactatttttcttcattctgttgtgcttgtgcagttgggttggttgccaatagagcatgctgcattacgtgattgcagggaagaagttgaaatgctatttccattgacttctccaattccaaatgtcccaaactggagtgttaatggaataatcgctcatgcaaaagtcaaaaatacaaagccaatggtacgtttcgtacagatatgcacttttgatctttctgtactaaaggtcctgctatgctctctgctcatatttcatgttgcttaccatgcactttgcattgcagagctctatttcacccacttcacgtctttgatgcttgttaggctgtaaaactggtttagcttacatatcaacggcatttaatagtactagatagaaggatcatgtcttaacagtactggttaatagtactggtttagctttgtaatcctaaataaatgttctgatattcaaaatttcaaaagttaacttcagatttgcatcaagatactattgtttacgttgtttaggatcaacatcagaaggagagtagaaaagtcgttttgaaggcacaggcagatttggtattcaagcagaagaattacgccgctgcagcaaaaatatatgatctggtaatttcttgcaccttatttctgattgttaacgctaatcaattattgttgttataaagtttttgtatgttattcttaagcttgggaatgatttgtttatctgatgcttgagcataggcaatagctcatggaccgactgcagttttgtacgcaaacaggagcatctgtagattgctcatgggtgatggtgaaggtgctctttctgatgcttacagatgccgaatgatgcggcctaactgggcaaaagcttgctaccgtcagggtgcagctcacatgctactcaaggtaagactcactgcagttaacgttttgtgatcctggtattatggtcggtgtcctgaactcctgatttactctaaaaccaggagtacaaacatgcgtgtgatgctctcatggatgcacaaaaattagattctgggaatgtcgagattgagagggaactaaggtaatcttctgtttcgctcgagtatgccttccaaataaaaatgtggttgcgcagggaacatgaccattagtactggcattccgttgtgattatgcccacatttactgcaactgaagcaactcaacactcaactgttcttttcggttttatatgccattcttccatctttgggtcaattttacgctttgggttgttataactgacatttttttggtccaaatcttttgtaggaaagctagggaattaatggcgaaacctccagatgagcagtgaggcagaataaccgcataatcgtcagctaagcaggaacttttcttagcgctgcactattttgttggatatgtgatgaaatgtaaataatgcacttcacggaactctcaccaatcgacagccagctgactgtcacgctcacactaacctcccttatctatctgatgctactcacaacccctgaacattgtatcagttgattcagttccacgcaattatcagaacattgctgaatgcttacgaagaaggtacaaccatttttgttatgcatgtacgaaggactccctccatcctaaaatatttgacgcccaaaatatttgacgccgttgatttttttaaaaatatttaactgttcgttttatttaaaaaaataattaattattaattcttttcctttcatttgatttattgttaaatatacttttatgtatacatatagttttacacatttcacaaaagtttttgaataaaacgaacggtcaaacatgtttaaaaaagttaacagcgtcaaacatttagggatttagggaagaagagggagtatattgcattgtcgtcgcacgtttgtgcaccggtccgatttctctgtggatattaggcccctaataagctatgtggcggcgtgccgttcgtgggccagccaggcggccacctactatcttcgccgctgcgccggcggcaaccttgggccgatggcaaattttttaaagtattaaacgttgtctaatttaataacaaaacaaattataaattccgctaagaaactgtaagacgaatttattaagcctaattaatccgttattagtaaatgtttactataacaccacattttcaaatcattgtgtaattaggcttaaaagatttatctcgcaatttacacgtaatctgtataattggtttttattttttccacgtttaatactatatgtatgtgtctaaacatttgatgtgatagatgaaaaagtttttgttttgggaactaaacagggcccaagtcgtgtgcagtgcaccggtccgcttccgtgcgtgtgtgagatgggcgttccagatcagctccaagtttgcttgaaagcgtcgcttctcgttgcgttgccacttgccaagcagcagcacgtgaattcgttgctgttatcttatctatcctggaaagcgacatcgccccctgtggcttggagttgcacgtattccattccatctctctctcacacacacggatcgacgatccacgatccactgtaccaaccgcggcatatgcttaccttaccggctcctacccccaccagcatataccacggttctaccgtagttgtacggttcagacagcgtgtgatcggcccacccacatgcatgaaccagaagcattcaatcaatcaaacaaacaaacaaacaagatcttccgcgcaggtgcaccagttttggctccaaacggggacgacgacgcgacccacttgagcctcgccctccagcccatcgatcgatccccctttagctgagcgaattattccacaagttccacgacgacgacgacacggccgggcgaggcaggcgtacatatgaacagcgcgacgcggccggaaacggtcgcgtacgtggaaacggccggtgcgtgccgatcgatccgtgagccaccttccaggcgcgcgggagcagaagtgtactatgccattggcagcgacggcgagcgaagaccgcgagcgagctagtggacacgggaggttgctctcgcggcgcgcgggaggggaggagaggagagggagaccggtggcgcgggtgcgctggaccggttcacgccccgcgtgcgcgccggggaccgaaatatctgtccgcgtcgtcgatggccggtgtcgccgtcgagcgagctacggaccaaaacgccgggatctcgaaggggcgcggcgctgcttacttggttgcttgattagttaagtttatccgccctccgttttacgcttttctgtttcccccggttatttaagccagactcaagtttctcgaaatagaatttaaggaagggtgtgtttcacgtcaaaattgaaagtttggttgaaattgaaacgattcgacagaaaagttgaaagtttgagtgtgtagaaaagttttgatgtaatggaatactttggatctaaactcggccatgggatgcatcagtaactgttactgttgctactatatcacttgatattcactttcattttggtgctcaaaataataataaaaaagctttcattttgggtatgcatcgtttgacatgtatatttttaaaatccactttgagaaaaaaaaaacatatagtaacttattctatatttgaacattgcaatcatagaaagacaactctactgtacgtgaacatttttcattatcaagatgtgaaccattcactaaaagaacaaggaaaacactcgttttcgatttctaaagaaaggttttcaaactatagataaccccatccttggccttccccctgccgataaacgtgcttcttttttcctctccagccaaatttccaaaggcgaaaacaaaaccaccggtgaaaaatccccaaagaataaaacaaccgaaaaccccgtgccgttgcccacgggataaaccaacgaacggagcgggtcccatttacccaaaagcgcactccccccatccccaccgcaaaagcgacggcccgcgtgaaaaagcgcaccgctcgatgcgcgccacgtgtccccccaccccccacgcaaccttatccactcgttcgtctccctcctcctcttcccccgcaataaaatcccacctcctccaatccacagcctcgtcgatccacttcaaaattcggagggaggaatccaaatcgaatcgaatcgaatcgaagaagcttggggggatattcttgatttgatttgttgttggaagagaagcaaatccaatggcgattgcatcgggggcggctttctcggtgaggccttcgccggcggcggcgaggccgtgcgtcgcggcgtccgcgtcggccgccggcgcggcgaggttccgcggcgacgggagcggtggcggaggcggaggcggaggcggcgggaagtggtgggcgccgctgctggggtggtcggggcagcccgactacatcgacgcgcagccggcggcgcgggaggaggcgcggccgaatccgatggcggcggcggagcagcgtggcggcggcgggaagaggttcggcgtgctgacggaggagaaggcgcggcagctgcgcgcacggatgatggagacggagagcttccacgactgcatgtaccactccgccatcgcctcccgcctcgcctccggcgcccccgccgacgacggcaagcactgagccgccgccgccatccatggctccccgcctctgcccataccgcgccgccatccaacgccgatgatgatgatgatgttgttgtgtcgttttggtatcaataacgtcgccgccgccgacgccgtcaatggccggagaagtattagtatgaggcctcgacggcggcgtgcttgtcggattgattccatggagatgggatgatttcatcctaatatctccatttctgtaactcatagtatagcagctaatgcatctaaacgttgttgtaacaagaaatttaatctggtttcttcaaccatggcttcttctgtactatacatcacaatcactctgaaattttcagaaatttcagtgttcatttttatctctgaaagtttcgagaattcaatgtttttttattcctttttcttctccaagatatgtgcagcatctaagatcgaagaacttgatcatcgaaggctcctaaatttgtcatctttttacgcataattggtgtcacttttgatctactgctacaaacttcgatctatcaaaaaggctcctataaatttgtcatctttgtacgcataattgatgtcctcctgatcacataacatgattgcactttgtgtccccgtgtgagtcactaagataagtactctctccgtactcggaagtcgtttagaacagcgtcacggtctctaaaacacaactttgacttctttttactataaaatatttattgaaaaatgatatatgtatacttttatgaaagtatttttcaagacaaatcttttcatataatttttatattttcaaactcaataacttgagagttatttatgatttatatttctaaggtttgacttaaacttaaacattgtcctaaacgacttcatttataagtatggagggagtagtaattttatgctaacttatcctaagggtctgtttagttttttagtgtaaagtttttaaagtatacgacaaacaaaatatagactaataacaaaacaaattatggattccgcctgtaaactgcgagacgaatttattaagcctaattaattcgtcattagcaaatgtttactgtagcatcacattgttaaaatcatggcgtaattaggctcaaaatattcgtctcgcaatttacatgcaatctgtgcaattgattttttttccatatttaatgctcgatacatatgtctaaatatttgatgtgacgtttttgtaaaaaaattttgaatctaaacgaagcctaagacacgtcacacatcatagtggtatactactccatttaactaatcatttattacttgtcaagctatggctcaactcactcaattaagcaaagagacactgaaaccgacatcaagcaaaggctagtggaacactccaacttgagattaaggtggtgtttggatccagggacttaactttagtccctatatttagacactaatttagagtattaaatatagactacttacaaaactaattacataaatgaaagctaattcgcgagacaaattttttaagcctaattaatccataattagagaatgtttagtgtagcatcacataggctaatcatggattaattaggctaaaaagattcgtctcttgaattaatccaagattatggatgagttttattaataatctatatttaatatttataattagtatccaaacatccgatgtgatatccgatgtgatagggacttaaactagtgccatctaaaagaagaagatttggacatgacgacgccatcaactgcttcgtctacaagttcactagaagcacggcaattcggcaagacggtgtgctccaatgtcaagggcttctttcttccacaggcaagcgggcccacatgaccaagagccccgtcagcagtcagctccgcttatctagaaaggcaccgtcggaataattgagtactcgtatcaaaaaggacagaaatggagcagacttgcaggaaccggccactggaattggatgctggtttctctagaatcccgtaaccggccactagtagattttagagttagaaaaaccaatcaaatacgaaaattttaaaacaatgatttctagttgcgctgttctatatggtgcgttctagttgcgctgttgtatatgaattttgtgggcaactaattaaatccattcagttgtactgctcttcagtagtgatcacaaaattatttagccattccgaagaaccatagtccataggcactgcataagattcataatttaaattcttcagtttaaacatgcagtagcagtaccaattctgagccgttgttcggcggcagactggttacgagaacacctacgccgtggaaccctttattattattattattattttaattttttgctgcggttgaactcgatcatcgccgcggttttgcctttccgacgcgaagtgcacagaaactctcccaaaacgacgaaccgttggacacaagcaaaagcttgtgtatatgtttgaaattaaacatccaatagtattttttaacatattaccactgcttgatcagactagtgtacactacttaacattatatatgcttatattatttgattactcacagaaacatccttcaagatccaatagcagaagtctcaggaaagggaagaaatggatgggctctgctgggccaggaaggcctaaatgtgtagcccttttgttgggctttcccttaacgtacaggaccttacatcctacatacacagggccttgatgaaagctgctcttcttcatttttcgcttttaatttgttgtgacagcacagtgtaaaactgaaagaccaacaaatttatgcagctatatccactaattttttgaatgctcgtcagccaggtcgaaccgaaatttatttctgagagacagcaagggaaaaatatttgtatttttcttaatttgatttcttggatgtagaattcaaaacaaactgacgtttatgtgatatgttattacaaggcatttttggtacgttctaagtcaaaattatttaaatttgatcaatattgtagaaaacataacgacatctacagtatcaaaatagttttattaaatccactgttgaatgtattttgcattgaaaatgttgttactttttcatataaacttgaacaaacttgaaatagtttaacttaggataaactaaaatgatttataataataaggaacggagggaatagtatatttggatagaggagatctacacccggccccatcggttggctgtttataagcataagcgaaacgtcatatttgcaaatgaaaaataatttacgaataaaacttttatatacatgttcttacgatctaaaagcaaatgctgaaaaacaaactataattaaaaaaataaaattagctctaaatttaaggttaaaagtataaattttagaagtttaagtacagatgaaaatatgaggcccgaccgtctcgtaactttgtctaagctgcgcgtgattatgcttcactaatggtggcagaaactgggccatttttcagagtggcgcaggcgcagtgatatgaggatttgagcagcgtaggcccagcccatttggctagttgtccggtcctgcctgccttagcttgggcatgccatctgctctgacactgccactttgcaaacttcactcaactttgtctctggccagcttgcaattatgcacatctcttctctatcgcgcaacattgatagcgcctgcacgaatctgctccctccgttttaaaatattccacttcatcctaaaatatattattgtaacatacccctttatagtttttcatggaatggaggaaataaaactgaatacaacacaaacatgacacatctattcaaatcattcgcagtactggattgtatctcatctagtacaatgtttctatattttaagacggtcataaaaataacttataacatttgaaaatttgttttaaaatacaacttcttcatctatcttttttttaatcaatcgtaataactaccaatgttgaagttgagactttatatattctcaccttttatgattcaaaagccaaacccaatcgatgaaagtggtaaagaaacatgtaaattaaccctaacattaaatccccattattcaaaattggttgatctttgagttgtagctctataaggataccatcatctgtttttgttgagttatcaatcttacatcccatattgatcacatatacttaaattgatcatcatataatcttggtctcttcgtttggcgtacggtgttttttctatgcatgcaaattgagtatgcgtgcatgcacgtactccttccgtaaaaaaaaacgaatgtaatatatattacagaatctgatagacttctgaccatattcgttgtatcaagacatgtctttttttttatagacgtagtaggtatttaggactagttaagcactcgttttcttgtgcatatggggagctatagtatgcatgcttttttttattctttctcactacacactcgcattaaataaaatacatggttagttaattttggacttatttttctcttatcagttgtagctgcacctatcaaagctacgatactgatgctaatgttgacagtatattgatacactgatgcaatcatacaatattgtgaacaaactttacgatagattttcgtggctccagtaaaaagcagggcaaaaatatactacctccgtcccgcaatagttatcgctttgggtttttcctttcaacgtttgatcattcgttttatttgaaaaatttgtctaaatataaaaaatgataagtaatacttaaagtacttttgataataaaacaagtcacaaataaaataaataataatttcaaaattttttgaataagatgaatgatcaaagtttacaaataaaatctcaaagcgacaagtaatatgggacggaggtagtattctccatcgagattcgcaggagaccgacttacgagtactagtacttactccctccgtccctaaataaatacagttttacgctattcatgttcaacgtttgacgttcgtcttatttaaatttttttatgattaatatttttattactattagatgataaaacataaatagtacttaatgtgtgactaaatatttttaaatttttcacaaattttttaaatcagatgaaaggttaaatattgggcacagatatccaccattgcaattattttgggacggaggtagtattaccgatccccacgataaacaaataccacggcgcgggaccaccaccgaacccacggccagcaacaacaacacacagcaacaggcctaccatatcgcgagaaggcccccagcgtcgcggagccgaaggatcaggattcactccgccctcgccgacctcgtcgccggccgccgcatcaccaccgacacctccccccatcgccgccggcgaggtgcgccctatcatcacgcatcctctcctcacccccccccccccccccgcgctcccacagccaatcgggccgcgggtctgctgttttttttttttcgttttgttatttttccaaatccgtgcagccaagggctcccccaatctcgtacagttccactgttccatttgtggcgccaccggggggctctctgccaccgccatcacgcgctcatgtggcgcagcgcagcgcagtggtggtggtggtgccctcctcctcctccccctcctgctcgctcctcctgcgatctctggtagattccctactccacgcactcccacgcgagagaacccggaaaagtcgctcccctttccgccgcccaaatccgcctttccctttgtatcgcgtcgcgtcgcgtcgggtcgggttgggtcgccactgccacttccacttccacttctcccccctcgtacgcacgcgcgcgcgcgcctctcctttatctggtggtggtggtggtgatgtttgggttgtttaccttggtttggattggattttttttttgtttgcagagttgggtggtggagcgagcgtggccgcgaggggacgcggaggggcggcggcggcggcgattgttcgcgggatgagcagcttcggcggcaccagctccgtcgcctccggtggtacgtttcgttccattgatcggtgttgaatgcgttgaggagggggggattgattcgtgaaatgggatgggattgatgctgtgatttgattgcgttcgtgatgctcctgattttgattcgaatgcgttgggggatttgggatcgaatcgtaaaatgggggtgggattggatggttggatgcaggtgggaagaggctcgagtacgggcggacgcatgtcgtgaggcccaagggcgcgcacaaggccaccatcgtctggctccacggcctcggggacaacggagccaggtacgcccaccctctcctccccaattccgccgccgtccatcctctctctctcgtcgcgatcgatcctctcgttgtgattgatgtgcttaccggatgcgtagatgaacaatagcgccaatgcacttttttttcccaactgtcaacaaataactgtcaatttattgacatccgggcatccggttagcttactgccaaatgccaacgatggcagtttctcattgtcaatttcctttcttatagccccgggttattgcaagctgattgctcaagtaatctgattggtgtagtgtaccgtgtacacaaatatcctgctctgtttatgttgtagtgatttttctgatggtttcttcccaaattccaccaccactgtacaatgaactttttaacacgcacacaatttattagtattggcgaaagaggtagattgtatgaaaccacgcgtagataacaataactctgattgcgacatgcaaagcttttgtgcgttcgaaaaaaaaaaaaactctactgcatcattgcaagttaaaatttgggagatactgatataaataatggatatatttgcagctggtctcaactactggaaacccttccccttcccaatgtaagtttggacatagatttcaaatatctatcctactccaagttgttcttgtgattatttcctttgtgtatacatcgctaaatccagtagctccccccccccttcataatgtattttgtatcaaccgcagataaaatggatttgccccaccgcgcctacaaggccagtggcagtttttggtgggttcccatcaactgcatgtaagttccatattttgtctaatttcctcctttcctcttggtcatacttctaccaacctttgggaattgctctggtatgcatgcactggtattccatacataactttgaccccctctttttttgtatttgtagggtttgatgttgctgatctttcagaagacgctcctgatgatgttgaggggttggatgcctcagctgcacatgttgcaaacttattatcaactgagccagctgacagtatggttcccgagttattctccatttgttcatttattgcggcataacatgatctttttaacctactttatcaagcaaatgtgacacatgagatcacatatgtttcctttgtgaatatggcgtatgacatggaaagaagctatgcaagagaattaagtaactacccagccaccagggatatcaaagctaaaactttatctcctatgtaaaactttgtcaaaaaagtgatgtactgtggagctcacacattattccccagaaacaaactaatttgacctcttatattgataatgcaacagacagaggccccgcaataatgcaacactcagaccagcctttatctctaacattgtcctatcacattgactattgcagtcaaacttggtgttggtggctttagcatgggcgcagctaccgccctttactctgcaacctgctatgctcatggaaaatacggaaatggcaatccatatcctgtgaacttaagtgtgtctgttggtctcagtggctggcttccttgtgccaggtttgtcctagtatgttcacgtgtttaggtatcactgaaatttcagccctgtaaatgatattgactgatatacttgttggttatcacaggtctttgaagaacaaaattgaaagctcacaggaggctgcacaaaaggcttcatccatacctcttttgctttgtcatggaaaaggtgcataaactgttctgtgaccttcattagtatactaagtttctgttacatgttacatttacatgtaatggcattaccaaatcagttggcattgttctaacattcaacttgaggtagtttggggtttatacttgtttcgttgctttatgctagctgaaggcataacctaatataccaggttctgagttttgacaatagcatggcactattcctaggaaagaaaggctacatgagtcttataatccacagcccaaatttgaatttggaaagttaattttaaattaatataggtgtttttttaactttttctattattcatatgacattcagatgttcacaatgtgtgctaacatctcagtgaatgggaggtcgtaattatttagtggcatatgcaaggatttttctcaccaactgtgaaaccgatatatgctctcaccatctgataggcatataaggaattactcccagaaaacaaaccatccatcctatatttagtgttttgtttcgattctatgcagctgatgatgtagttctctacaagcatggtgagaaatctgctgacgcactgaagacaactggattttcaaatgtggtgttcaagtcctacaacaggtttgatgcccctccctatttacttattgatgtaccagttctaatcacttacatgctatttgctccctcttgaagacttggacactacactgttccggaggagatggatgaagtctgcaaatggctcaccgcgaacttgggggtcagcagctcatcgtcggcttgattgaagaattgagctgtccgaataatacctgtggttgttccaaacaaaattgagaggtaaatggttgaatgaatagcgaagaacttggggcttgggtatacggccatggggtagcctggcgtgtcatcatgcggacatgcctcacggcatcttaactagaactcttataatttccacagtttgggtctttgttttgtttgtttcccttccctcttaaagcaggggacggcatcgtggtgtattatttgttttggttagcacggatgtttttgtttggtacgccgtgtgttcttccgattgggtcagttgtatgtttcctttatgagttatgagatgcattgggattttgggttcatcagctagtatgacaatgcatatatttctcatcacttgtcaatcagacgatatacgtgctcggttgtggtgaaatatcaacatgagatacgatatgtgtaactcacaccgtcgcacaaggatgagatcggataacgcagcaaaacccttatatgcgctagtgctgagaattggttggttaataatcccaaggcaaagtggtactacctccgtttatctaagtacttcccccgtttcacaatataattcccctgtttcacaatatagtcattctagcattttccacattcatattgatgtattcatatggatgtatctagattcatttaacatcaatatgaatgtgggcaatgttagaatgacttatattgtaaaatggagggagtacctccttgtatatgcacaagttgtttgaatttttcataagttaaaattctttagatttgatcaagcttatagaaaaatataacaatattttcaatgcaaaacaaataaactatcaaccgtttatataagtacctccttgtatatatacaagttgttttgaatttttcccaagttaaaattctttagattctttagatttgataagcttatagaaaaatataataatattttcaatacaaaacaaataaactatcaaaatatgttcacgttagatgtaatcaaactaaattggtggcataaatgttactatatttccttcataaacttgatcaaactttcaagaaatttgatttaaaaaggggtcaaacgacttataatatgaaacggaaggagtaaaacacaacagtccgtacatgagaccctaatcatttatagtcgcagcttagcccgaaacgatacaaggacaagtggcatttatttatcgtgaaaaagcttgtatacaactggaacagagggttattcttcttccaccatctttgacatgaaaagctcaaacgataggagaaagcaaatccatactacataaacgggaacgaaaatttggaaaggaagaatccagctcccatactgatgctaaagctcacgtgaccaaaatggcgtactattgtcatcttcatgatgattctttttgctcatgcttttgtgcaatatcgccaagcacatccttaagctgacccttctgaagaaaattatacaaaataaggaatcaactactgagttaagaattaaattgtagatggatacacctggtaataaaacctggggacaataagctcacttgcctgatgcatatctaatatgatatcagaccccccaacaaactctcctttgataaatatttgtggaaacgtaggccagttgctgcacaagcaaaatagaataagtagtgaatttgtcgaagaataaacagttacctgtttctaagaaacagctgaaaggcacatgccaatccatgtcttatatgatacactatatttcaactcaatgaaaactaagccttcagcaagtggagctccataatattgtagtatgggacacaggctggtgcctctgataatatattctggaatagaatgctgtatataaagcctcaatggtgatcaatgccaatctaatagtcaaaactcatcttgggttgtggttagcttaagccatatgatttttttagcataatcatttcttgaaactgtttttatgacctcaagttttaccacataacatcatactgtgttcatgtcatgaagaatttaatctcccagtctagttccttcccatgttgaaaaacataagttgtctatcatctaaaagaaacttaatgcaagattaggaaggcatgagaagaagccacttacgtgtgggctttgacacactctttgagcttgaggtctcccaaaatatctctagcactgatagggacatctgcaatagattatgatatatggtttaagaatttatggcgcacccacgtatcatcaactgtatttcaaacaaatcagaactcagtgttaacttaccatatagcttgaggactttaactgccaatgcactgaatccacacataggagactcaggaaaacccttcatgtagatcaagactgggttctctttgatatcctgcccaatgattgtgttgtagcattaacaaatggcagaaacacaaaatgaaacatttaagatatgcctagcctttctagaaaataagctcatctcatcaatttaaatattccaaaaatccatttataaatgttaatacctgagcaacaatgtcatcaaaagacatgttggaacttttgcttgtaggctggaaatcttgatgtgtatcaggatcagcagctactcgtgttgaacttgagtccccacttcctctagaatcaccaccaagtcctggtgagtagttcctaaactgctggatagctggttgtgacacagcctattattccggttatcatgaaaaacaagtttgttacgcaaacatgagatcaatagggaatatttattacccaggtagcataataaacaccaatagaatattgctaacattttaagtgcaaaatgatgaccccatattgcataactacgtaaaaggcaaagctatacaatttgcttgcagaaatttagcagtgaaagattagtctctaaaacattggaagtgtaagaaaacctaagaattatataccacagggatggaaggttaacaacacaggtgaaatctggaagacacaatggccagagaaccatatgcattgcaccaaattaaagcattaacatgggatcaaacctaaaccgtgagaagaatatgatacgtactacatgaaaactaaacagattgcccccacatcccattaaaacaattttgttcaccagatggaagctatgcacatatacagttttttttgaaacctatgcacatatacagttactgaataaaaccaggggttttatgaaatttactcaaaagctaatgacgcacaagacaagagggcacagcaatccatactccaaaccctagatacagcgttctcatcagataaattgggtgagcaattcacactccaaatcctagatacagtgttctcatcagataaattgggggtgcaaacgaagaccaaaacgaaattatggagtaattacattacagaatcacctcaatgaacagacaaggcagacaaaatgcaccaaactatcgattaagaggacgcggcaagagagtctcacatacagctactctcggcgcgcggctcgatctcacgagccctctcatgagagcggtcgacaccaacctcgccatgaatcccctgcagcaacaacaacgaagaaaaatgttaaatcaaacgcatgaacccccctcgatctaccaaaaaaagggcacaaaaatcaactcccatccccattcccacccacagcgaacccgcagctacggtgtgaaggttgcaacgagtacctaggcagcggcggagcggagccctacggtggtcggaggagccgccggcgatggccggaggagggtagggagagcacgccgccgccgcgccgccggatatgctcgtgccaacgctggtttgctgttttgatcacggcaactgcttctgttctagtacattgggcctcaaaagcccaaaagttttaggcccaaatctaggcctaccaacggcccaaatcgaggccgaattttagcccatgttgaggcctactgaaactactccggatttgtctcgggcttcgtcggatcggcggcgaggctgcttccttccccggcgccggtgtcggtgaggcggcgaggaggaggccggccggcgcggtcaggtctcgcgcgacggggcattttccctctacctgcggtctccgcctccttcaggtgttcaggttcgtgctctgctctggccggcgcgcgtagtgtttctgtggccttgccgcctccgctgctctgcatcgcgtgtaatcccggcgatgttggtatcgatttgatgctggatgaggcgagggggggaagggttgccgtccgcctctcccggcgactgcggtggccggccgtggcggtgtgatccatgggccgccattggtgtgcctcacagtcacaactcacaagtacagtttatatattcaggagtatcatcgagaagctgctatattgcgcttgattgtctttgttgtgtagctgtcagcagttgtattagtctatcatcgggaagatttctgattccgtattgtattagttggggtgattcgaacgaggaggtgataataattgtttttttttttcaggttaaagggtggttatgcctcatattttaaaatggagggagtatgaaactactagtgttccaattactaacagcctgaacctaactgttacagtgggatgcacacagcacataggttatatagattggtagattagacagggcggaacactattctttttaacggagtgtgattagtttacatctctttgagtgctgtaactgggatttcttatgtggtttccacatgagacggttgtggagagtagaggccatgtagtttcaatttttaactgctgcttctctagtctaaaaaagtgtttcctatgacgaaggaattatacttcatgctttttatgaatgattgttcttagttctatagcattcccagttttaagtgtatcatacaaagatttcagctatgagttcacaaatttattagagctgcagcttgtcagtacatatatatgaaaaatcgccgccaaatgaacattgctggtctttacacaacagttttgttgaaaatgatacacatgcagacatgctccaccatcttgtatttagtgtgctggtctcgtgttacatttgcatttggttgattgctgatgcactcggtttctacctaagtgcattcctttgtttcttgcaggctaatggatttaggtaaaacttaggccaattatccttttctattgatttagtaagaattacttgttactatatcatcgacaatttccattcagcaagagataacgtagggcatgcttgcaaagcctgatttgcaatttccattcctttgtctggaatgcagccacattggacctttttcttgcatatattgaataccgttagcagtgttcatttactaagtactgctatttatcattgtgaatatatcgtaagggatgttgtttttgcatatttgcactacagtgctatctgtgtttggtttaggttcaggccttcaggggatgagtataataaaaattctgcaggggggcacacaaaagctttgcatgtcattccattagagtagaaataaagttgattacacaacaagaaaactgggagcatacaggctccaaagaatttagtttttaaaaaggatttagatcttgcataatggtttgcacttcgacgacccagtgcccctccaaactctgagttcttggaagttcttggagcatgttctcgagaacctgctgtattggtgacatcttgtttctcaaaaccgcgtgcattgagctccttccacattgtccactctaatgagagtacatgggtggggtcctattcattcttctatacctcttggaggacagaatatgcaaattaacgagaagacatgcatttgtttgcggagaaggcgagaactgaattaacttataaaaaaaatgtgttaatcacccaagctcaagagatgcgttaagtgatattattactctaaccttgaccaaatgggacctcagggtaggagcactggatattatatgagttgtaggcaaagcaagtctctaaacctgtttgcaattgagacattttccttctgtggaccaccgacccagacaaagtcggaaatgtggtactaagtgaacactgatgttcacgggctacagcactggtccatgacagaatgattctaattattcaagtctttttgcaaataactgttgtgcatcactaaaaacaaactttatgcactgttaacctgggacctgcttgctcaagctgtcaataatcacatacatttttccatttcattttaagagaacaatcatccatgctgttatactaatacaggtgaacggtggcaggcaagccacgatcaaataaccatcctgaatgcgaggtttagtctatatcactatcctgttgattagacgcctcctatggatattcccttctattattgtcttgttaccttttgtttgtggacctgcagtgaggccattcctttctccagctcttctccaagccatgggtaatggtatctggctgtctacagtgttggtataattgcgggaaacaaaactttttcaccccgatcagaaccttttttgaattggtctcgtttggcaatgattccaatgtgctatgctttacagtaagaacccttttcttcttggtgctacccaatggtttcggtctccaaggtaaaaggtagcactagatagtgatccactgctatggtactgtatattctgcataatgtcattgtgctttttttggataatacaatattagttgaagtgctgaacagtatcttgcaagcttatattatgtcataactgcaaggtttgcattgttccaatccatgcacaatgcccttgaatagcttggctcattttaaaactgtggaatcactaggttggcttggtttgttacaaatagagcttgagttttcatgttcattttcttcttgttttgtttaaactttttttccacgtacaagactacaagtatgcatagtttagttcatctccttaacacttgaactattcttgatatggtgaagtgttaaattgctacctgtgctttactggttactgcttcttatctttggtcgactctattcaaaccaaccgagtaacattatgcagggatctacatgtatttgcagcacataattaagagtttttgtggcttctgatacatacataatcttgttagctgcacccctgctcctcgtaactacgtaaattaagtatgatctgatatgtttgcaatcgcaatgcattttctgcaaagtgactgggcaggatctgccatcgagatatgtgggctttgaatgttcccacagttccacttgcaaatgtcttagtgaatcctgctagacaggattgtacaaaacattgacctgatatgacgaaaatatgacatatggcccttgtgcttgtactggcagtagcaaaaacacactataaaaaggcatagaaaatctgggcaaatgaaacatcatggtccctgactccctgtacgctatatgggagtagaagtatagagaactgaactaccactaccactactacttacctctgtctgacttgacatttgaactttttcctggtacatatactcttttgttctcatctgactgtcttgtttctcgcaggtgcatataggtcatatcaaagcttttgctgcttgctccaatatcacctccaaagaaactgcttgatgcaagaatcagcactagcaatggttcaaaggggacatttgttagcacttagcacgaacaagacatgacctgatgctgttcatgttcttgcctttctgttaacttcaggcaaacagctgatgaacagaggcttaggcaggcaaggcagcatctaaggcatgggagaaacagatggaaggaaggcagctgatatgtacagtgcgacgtggccactaaatggactcacatgaggtgattatcccttgaagcaggtatgcaccaaaagagagagatgaaaaaggagaagcatctcctttagtttcagtttggcgttaccgcctgcacgggcgatgcatgcagtgcttgtaactttcaactgcaaagctttacttatctccttctttctttaataccaaagcaaacctacttgcccttggctcctcttcatgtgactccatccaggcataaagcaaagtgtcaccatgcttacacttcactgtgcatagcatgattccatttcccctctagtttctgttctgttatttatacatatatactacacttttacccatgtaatacttactgctttggctttcacttggtgcagctgcttgtggacactgagccaggtagttccaactatccttgggggtccaatgatgtaatgattgtttgcacataatcatccatccaagtggagaaaaaaaaaggtgacaatcaaaactctagatcctggagaatagttagtatatacttggcaagcagatactactctacagtagaaaagctgggctgtgtggctttatagtcttttgagctcttgccaccatgccgggaaactattctaatccctcgaggggatgttccctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagtgtactgtttatatctaaatttgtcttttttgtttctcgatgtgtagatcgaatttgaacatgaattttggtggactagtaggtatcattatactctacattgtcaatttttttcagattttttcacaactatttgcatcgaatttagaagaaaaaggtatacgaggggatatccctcgagggattagaatccactcccccaccatgccatccattctctcaaggtcacaacagctgcttatatagcaaagaagagagctggaagagctagtagctagcaagcctccttatttttgcacttgcaaactgcattgtttcacttgtctgcagctagtttcaatggctgccatcaaagaggaatccgactacgacagtagccggtcttcgctgacggcgccggactcccgccggagctggatcagtgacattggtagctccagctcggtctcggcgcgctccttcggcggcgacacaccggcgtcgtcatgccggtacaagccccacaaggcgaaccaggccgagtgggaggccatccggcgcctccgtgccggcgccggccgcgtcgggctggagcacttccggctcgtccgccgcctcggcagcggcgacctcggcaacgtctacctgtgccggctgcgcgagccgtggtcatcgtcgtcgatgacgacgacggcgggcggttgcctctacgccatgaaggtggtggacaaggacgcgctggcgttcaggaagaagctccggcgcgcggaggtggagcgcgacatcctccgcaccctcgaccaccccttcctgcctacattgtacgccgacttcgaggcgtcgcactacgcctgcctcgtcatggagttctgccccggcggcgacctccacgtcgcccgccagcgccagcccggccgccgcttcaccgtctcctccaccaggttcgtactcgtacacctccacacccacgtcgaacgtgtgaatgcatgcgtgcccccacccatgacccattcatgtttagttactgctccactagcctttttctttgttttaccactactactactgtggtctgaatgaatgtatctgatgatctgaagagtgggggagaaatgctctgttccagggtcaagctttgtttcagtgtcacttttgcaaaagcttagacctcagctttaggttagtgatcgtctttccatgttgcattggggctttcatccaaatcctttttgtcttgctgtgccaatctaaacagatttgttggcaccacttggggttcatactaagctaatgatttagtaagatttaaacccaaaccattgtgcagcttaagcttttgatactcacaagagggggaaaaaagagagaagagaatcttggggttattagcattcctagtctcttactgtggatggattatctttgtcggacagtgaactgatgttgctgaaaacgaattaacattgtgttgtgtatggcaggttctatgtggcggagactgtgctggcgctggagtacctgcacatgatgggtgtggtgtacagggacctcaagccggagaacgtcctggtccgcggcgacggccacatcatgctctccgacttcgacctctccctcaagtgcgacgtcgtcccgaagctgctccgccccgccaggagcgccgccgccggtggcaagccgccgctgccgccgccgtcgtcgtgcgtgccgccgacgatccagccggtgctgtcgtgcatcttccgcggcgtgcacaagtgccatcacgccaaggagtgcgccggtggcggcgcggcggcgggtaacaatggcgacggcgacggcaacgacgaggaggcggagaccgagacggcggagcccgaggtggtggtggtggagccggtggcggcgcggtccaagtcgttcgtgggcacgcacgagtacctggcgccggaggtgatctccggccagggccacggcagcgcggtggactggtggacgctcggcgtgttcatgtacgagatgctgtacggccggacgccgttcaagggcgagagcaacgagaagaccctcatcaacatcatcaagcagccggtcaccttccctcgcctcgccggcgccgccgccgccggcgaatgggaggagatgaagacggcgcaggacctgatgttgcagctcctggcaaagaaccccaagaagcggctggggagcaccatgggctccgccgaggtgaagcggcaccccttcttcaagggcgtcaactgggcgctcgtcaggtccgtccggccgccggaggttcctgcgccgccggcgccggcgccgaagaaggtgatgacgatgagcaagaaggagcggcaagagccgtacaactaccgaccggaaaaccacttcgattacttctgatcaagtagctgccatgcatgagcatgatgcatgatgcatcttggttaattaattaattaatcacttgtaagaggggagattagtagtgtacatagagtgctaatcaatgagtaaccagtgttagtttctcagtgagtgagtgagtggcaggcggccatgggtggtgggggtctgcatgcttgctctcatggcgcggttgcgcacgcgcggttcgtcactgggttgggctagtcggctacccgtgcgcggcagacacgagcccccaccagttccgtcggtcgatcgatcgatcggtgaagcagcagctttgtttgcgtggccccggacaccgtgcgcgcatctcccagccgatctcgctgctgcgcctgcgcgcaatttcttgtgccgcctttcgcggaaataaagccagccccctccccgcgaagtgtctaagtaacttatcctaaaatataacaactttttctaaaatataataacttttgacttatcttgtcctaaaatataacaacttttagctaagtgtccaaatttataggtaaaaatgcttatattttgggacagaacgagtatactctatactcatcatggaaaatgtcaagcatgtctgttcttaggccgcccaggctagtcgacgaaaactccgttaaattttaatactgacgagtaaatcgataataaaatttaaatttttatagtaaatactagttatattgaaatttgctcatgcttaaaaaattttcgggtaggcttttttcccctaaaaccaagtgcaaacgttgctcatttgttcacatttatctctataaatatacactcactatctatataattgtacacatgcaatgcacatcttatctctctggcctccgtaaaagattagactgaacggcttattattaataggtatatagcatgtcgctaaaaagaatcattaaccataaatataactactcggaacataaccagctgagtgtcagctagccatacaatttatgttcaacggtgccaatgatggcaatgctaaattttgctataaaattgaaaatgcgaacttgaatttcgatctatggaagcaattttgccaatagtttaagaggtcactaatggccaaagttgtaaacagttctgatgacaagtaaataggtaaggagagtagctaaaaataatagtgatgttcaaagtattaaaaagaatcaactcgaaacacatccaagatggattttggtggacaaaatgaatatatatatataggcacgtaatccatccgtcccataatataaggattttaaatttttttgcttgtattgtttgaccactcatcttattcaaaaaaatttaaaattattatttatttttttacttactttattatccagtactttaagcacaactttttgttttttatatttgtacaaatttttttgaataagatgaatgatcaaatagtgaaaataaaaagtcaaaataccttatattatggtacggaggaagtataagtgtcatggtgggtcagagctagcgagaatgctgtggtttgattgactgattagttagcacgatctaaccaacaaaccacgtctcacgactgacagctactagtagtaccaccaatttaccgaacgaaaacgcaatacagaaatggacacacacacaccggaattaatgaaatcatgaatgctcaggggttgaaatagccaggtgcattgcatatatagtcgccggagtttcgccgtccgtacgccgtcgtcttcgctcaacagtcagcaaactggagtagcagccgcagcagcagcacaagctctcggacatactccctccgtttcattttaagtgcaattaagttttcgtgtccaattttaatcgtctgtcttatttaattttttataattagtatttttgttattatgagataataaaatttaaataatactttacatatggcttatgtttttcaatttttttaaaaaaatttaaataagaagaacggtcaaaattatgcatggaaaataatgactgcgcttaaaatggagtatgatgcctccttcgctttgtctccaccctctcggagccacctgatccgtcacgtcgatcgcccacgaaactgcctagcttaccatgtgcatgcgtagccatcgaccggtcactcgctcgtgtagcatatacgtgcgttgatgtgatctctcacccgatccatcggtgtcggtagactggactggtagtagtagactattcttccttcgattcgattagacaaatcggatgaaatgataaaatcactcacgtgtgattctctttttgatggttatactcacgtgtgagtgtgattcgcttaattaagaaaatatgaactatatttagctcaatatggacgacatgatgaggatggagtagttgatgatcgattattagtagtagtatagattgagctagctccatacatattggagtacgatatgattcgatggcgtatatacaaaccatgacatggatatatatgatgcatgcatgtaaatgtggttgttcgctgattgagatatcaatcacaccattcgcagttctctttcatcaagttaatgccctacgttcgaaagcattatttttgcgtgtttttgtaaaatatatttggacagaagtgtgtctagataaattttgaaaaaatatacataaatgcctagggtttatttgattcggtggaatttgaatccatatgaataggaaaaatggagaaataacattgtttgcacacatcaatctagagaaatttttccaagaggcttgagtacatatgttaatttcttgtgggaaaataatttttcctttgatttttctatactttaatcctacaaaccgaatgatactcaatggaattaatccttagtgatcaaatcctcagtttttcctcaaaaaacgaacgagctcttgtagtgtttcgtagcggatgtagtagcatgtgtgctactccagtccggtatgctgtgtttgttttggtcatggcgagaatcaaagagctttgcaactccttttcctcagctgcattattgtatattggtagttctatctcgatctccatgcgcatgcatgattcgctgcacgcatgtgagaagactgtgagagggcactgcactgccccgaatgatgatgaacggctacggaacggatcatcatgagcttctcctcctgcacccctacctcccatcattgctcaacgtgctacactaatcaaggcccatgaaatcctaggcccaagattctagaaaacccacctctccggcccatcaaaatacccagctcttcggcccaagataagaactatctaagcccatgtcgccgccgcggcggcggcccagctcgtcggaggcggtccaagagctcgagagagaggcagcccagctcgccgcgcggcggaggcggaagcgagcgtcacgttgcccacgcgatcgattcgatcgacgagaggagagagcacgagaaggagcaaaggagcaaccgtttattgcaccttcactgcgtggagtactggagcgtatgaatccgcccccaaatggtgccaaatcgcagccggtggatcgaccg

SEQ ID NO: 52756 - DNA, 5922 bp, Oryza sativa
gcggggaggggtgggatggtggagtgggaggtggggcggcggcgggattcggaggacgtgatcgtgctgcgccggggccgccggcgaggaggcggccaccgccggtgaaggcggtggagccggagtccggcgggttcgcgtacgagccgccggagaagctgttctacaagacgagggtgtgcgagacgttcgtgaccagcggccggtgcatgttcgaggacggctgcacgttcgcccacggcgacgaggagctccgcccctcgctcaccgcgtgcgccggcggctggaggaagccttcgccgtcgttgtcggcggcggcgcctcccgtggcggtggcgccgacgcctccgccggcgcaggtcgtgcacgagctcctcgccaggggatccggctccggcggcggcggccaccgcgccatcaccaaggtgtgcttcgagttcagggacaagggcatctgctatttcggggagacctgcgccttcccccacgtctccgctgcaggtaacgctcgctcgcgatcgccatagcttagcttagctaggtcgatcgatcacacgtacgtgcgcgtgcatggccgatctcacgtcgatcgggatctcgcggatcacggctacacctgacccgtcctcacgtgttcgacgcagagatccgccagggctcaaggctgtcgtcgatgtcgtcgtcgtcgtgggagatgccggcacggaggagcgtggcggtgaccgtgcccaggacgttcgtctccgtgccgccggtggcgccgccgccgccgccgccccactaccgtgtcaacaacagcagcagctacaacgcggcatccatggccgccgcggcgcccgccgccagcgacgccaaccttgtcgcccagcagccgccgccggagcagggaggccggaagatgacccgcctggagatgctcagcctcaagaagatgaccggcatctacggcgactggctcgaggggtatgagcatccataaaccaatcgtcgatctctcgctcgccatgattgatcgagctccacctgccaattgccatgccatgcatcgatcgatcgtttcgcgttgctaccttagctcatcgatcgtcgtcaagaaccagaacaattttatatttaatttattttccaaatctgctcccaaaccgaacattgatcttgtcattttaccatccgtgtctgtcggactcatgtctgtatgtgtcttaaactgttgttgaattctgtgcgtgtaagcagacctgcattgccgtcgtgtcgtaagaactggaacaattttatctttgtgagattgtgtttgtgtccttccgtcttcctctgtggtggcttgggccgtttcctgttcggtggcaacgcggcccaatgggcttgcagaccatcgctttgccgaaggaaatggttttggtttggttgttggagaattgtatatgcagggcgagagagatgcggatctggtgttctttagtgcaggtgaagaggaggagaccggaggaggggaagagggggaggaggatgggatctgggattggagccgtgctggtgcttgttgcagcatggctaacatttgcgccgcctggtgctctggcttcttcgcgcaggtattgctgttcttgctcttgctaatttttgatgcaaggttctctgattggatttggcgcccaagaaatctgcttgtgtttagggaggaatatgtgtatggatagcatgattcagtttctaaggttggattttcatgagtgtcgatgtcttttgcaacagttgctgttgtgggtaattttgacccaccccacactcaaaaggaagaacattgtaggctagtggtagtgaacaaaaacatgtctttgaagtctaaagtataatgttgcctgtcttatattgttccctgatgatcttgtgttgattatgatcatggtattgatgcattaggattgatttagaaggtcttatgtaatgtaaagagcaatagagcattatctgaatgctggtgttgttagtataaaactttggatgaatcgcttcgattatcgtgggttgatgcaaccatttggtggcatatgtgagattcctattataaaactgagtccataccaattaaatgattacaatcaagaggcagtggagaaggggcaacatagatgggggaaatggtaatgagggctaagcctgtcatctaaaagaatggtaatgagggccatgagagaagggggagacttctattttgtctatggatgttccttctaatttttttatgggggtctggaaggcgctagaaaattataaaaaagcatacgaaggaggggagaatggaggagaaaatgttctaacattgataagaacaggaaactgagatgtaaaaaggaaaacacggttttgagttatttttctttgcagaaacttatattatggaattcatgtattactcctttcaggtttgatctgagtattgcacaagaaaagttagtgaactccacaggtggttcaactgcttcaagctcacaccttgtttttgatccttcaaaatcaaagagactctcatggcatccaaggtcggttttgtcaacttgatatgactagtaatatgcctgtgctaaacactacggtactactttagttgtctttaataatttttaaaattttcatgttagcaaaaaaaattattatatgaattgtgcatttgagttttaattcaatttatgtcatagatcaaatatatttcatgtaaagtataataatatgatataccaattcatgcagatatataatgcatatatctgtgccttaagtcatatgatattaaagatatatgataatacgtatatttatgccttaagtcataataatgcataataatatgatatattatgcatatatccgtgacacgcaaaataattcacaatggcgttgatatcaatatttattcatctcacaagcgccattttatttattcatattgatatggaaggatcaatatttatttatcccacttccactgatgtgtttacatatcttattatgagaacttgggttcttatagtcatgtacttcaaactgtctcttaaacatcttaatttttcagatatgtcttgttttattcttctttacgtggtgggcaaatcccatttcttaccttaatataggatcttcttgtatgaaggttttctttctgacatggagtgtgaccatttagtatctatggtaatttttgtaacactgttatcacagcttattatttgcatttgtgttatcgaagcttatctgcttatgttttcattatcacagggacgtggtaatatggagtcatctttagcatttactgatggtgatagaaatagttcgtataacaacattgaggtaggcctcaaagtgtacctagctaatagcgaagtgagcatacatccctctttcataatttgtggtattttggaatcatgcagaaaatatactctcattgaaataaatacaagagaaacctccaatccctatatttgacaatctagtatgatttagcctgtaatttgatggttagctgtggctgcagttaaatgaaattgaagttatatacctttcctgatatttatttcttcatcattcttttggatatgtagcttactgtaggtgttaaacttgtggaattttttaaaaggatgaacttatgatctactgtatgaagtaccattagccgtggactgtgctacttctaaacacctatattgttgtactcttgaaggatatagttgtttccaagattgaggacaggatatcgctatggagctttcttccaaaaggtaatcactcactcgacaacacagaaacattgcatgccgtgtactggctgctgacattcctgctggtcttcagaaaatggagagagcattcaggtcttgaagtatggagtgaacagaagtggcagtatcaaggaggaacctaaatcaagcagtggtgcccataggcttgcgaccattttgatgtatctttctgatgtcaagcaaggtggtgaaactgttttccccagatctgaggtaattatatcctcaccaggcctactttttcagaacaccttatcagaataactatgcactgcttatagtctaggcacatgtaatttcttcagtgatttgattcagttgagcagaagatcttatactaaactatgattttagatgaaggatgctcaagctaaggagggggcaccatctcaatgttctggttatgcagtgcgaccagccaagggcaatgcaatactgctgttcaatttaaggcctgatggagaaacagataaggatagccaatatgaagaatgtcctgtcctcgaaggagagaaatggctagccataaaacatataaatttgagaaaatttgattatccaaaatcatcacttgcatccgaggatgagtgcacagatgaagatgataggtgtgtgagttgggctgctagtggtgagtgtgacaggaatccggtgtttatgataggaagctcagactactatggctcttgccgaaagagctgtcgagtgtgctgattattttgcaattttttgctagtagaaatattgatgtcataggcagagaatggtgtaacaaactgtatatgttgcccgtttttcttttatgatttactttgcgtttgttaggaaatttaatttggagttaatggattgaccactgttcccaaattatggaaaataattttgttccatcagatgataatgatatatgcacatcataattaatcatgatatgattgtagcttatattgttggttaaatgaccttattctttcagcatataatcacgagaaaattataatatgagaaatggtaagcaagcaaggcgtcagatgtaacttaccaaattgccgttccatgtgaagacaccatcatacttggcagttggcacctcatttataactctcggctgtactcctgaaataaataaaatacagtgagaaaattataggagatattcttacagcccactgccttagtttttatttatgaccatttccacttacagctatgtgcaatacatacagagttacacactaatacttgtctattatacaaacaaaaaggttataccaaacgctagcaagccttgcatattaaaacaggagatatttgccatatctatctatttctttgaaagctagagaattaacagatgaccatatatacaaaagtggttgttaaatgagtgtttctattacaccctagtgaaagatgattcttatcacttctaccatatatttttgcctatttctaagcttgcttagaattttagttgaagtttactgtttcaattcattaactaacttgctacttgaagaaagtttcaaagggtattacctaatactctgtgaatgcatactcaaaattgtacgtactacatatataagatatatatgagtgttttgcctgaaacaatcttaaataatcacaatgataagtacctaaatttagagggctatcatgcctacttcaccatcggccatcccctctgggatctttagggttcaaaagtagcagccagtggtggagccacctctcgggtaggtcaggtgaccgcctaggctccgtcatcgcttctcaactgctaactggcttcggtgtctacaaaaagtggttgcacattaaaaaatgctattagtcgcgaggttcaagcgctttgcccactggtagcaacactagatctaacggttaacatggcaatcacaagatgcagatctaataatatgaaggaaagtggattacctctcacggcggtggattgacatagatccacccatgatagcatcaaagacaaggaaggtggcgacgaccggtagagatagatggcggcggataatcaactaaaggattaggttagatctgtgttcctctccgtttcaattggtagcatggcacgaggcgtacgaccatggcggcg

SEQ ID NO: 52757 - DNA, 1235 bp, Oryza sativa
acaatggctattgaaaggggaaagatggagatgcaagagaggagcggtggtgccgtggcggcggtaggtggaggggaggggataataacaagaggaaaagtagcctattagggttaggttgacacatcatgaatttcatacgctaggggataatctgacggttgaaaaaacaacccgctttttgaataaataatttattaattgtggcatcatttcttccttgaaaatgtatttaacatttcaccgttgtattgtaatgattatggtttctaaaaaatatgctaatatgaaaagagtttatcccttatcagacattgtcataccgattcatagttgatcgacttgcccttcctataccgcggatgtagcagttactttcatttttctgaagaagtgttctaatgacttataactctcgactagaaacttgaaacttgaaattccaactgatttaaactcccaattgaaagatcttaaaacttccatattatatgaaaaaaaatcataactttatctactccctccgtcccacaaaggaagtcgctttgctcagtagaaaatgccccaaaatactcgacgctgaactttcccatcagctagtagtagcgcataaaagtgacagtagctaatgaagttttttaaatgatgggaccggttggattactataatccataaagttggtaccaatgtgtaccgctgctgcaagcaccaactattaattttatcatgatttaaatgttcttttttaagtagatgtggcagtataactgattattgcagtgttgtagcgtgctactctcaagcctccgcatgattagctgcaatcctataaaacatgagcaatatgtcattttcacctaactctaatttggctgacaatacctagaacgacatacttcgtgggacagagtaagtagttggtttgaaagtttgaatcaaaccttggactttcaaccaacagatttgatataatctgaagatacattatttggaataatgaaaaagagaatatgaaattccactctcaagtctcaagttgtgatttttcaaccatcacttgcggtaataacggcggaggcagtgaagagtgaagaccgaagaacaggactagaggagtcgcttttgttgcgagatcactgcgccgtgggcccacactgtcagcctctctctctctccctctactcccaccatccgggcgaaatcactcgagcttcacacctgtgtcagatctcgg

SEQ ID NO: 52758 - DNA, 12583 bp, Oryza sativa
ccgatttcctgcatcctaccagaggctggggatggctaatgatgcgaacacctgaatgaacagtagtccaaattgttcgtagcataggaatttaaggcgactttctaggaacagaatagtcagccaagttcaaatggaaattttcatatatgttccatttgttatggacaaggccaagtgtaaatgtgttccttcaggcatactactgtcaaatacttaatgcacatcaatatgttatctgattatggattttggcatggtcggataaaaatggtaccgtgtagggtcatgtaggcattctagtggtggttctgtatggttttcatgccataatttggatcctctacattgctgtctcctagatattgttttttaagtggttctgttgcctataatctcatctgatcaccaatgtgttgatgtacaaagttagagaatcctcttcagatcctggctgcagcttgcaaaatttgtgataatctaaattattttcctagcaatttagtctttatacttctttactgttttatttctgcattttcttccaactgacaattctttttcttgcttttcagcgcttaacccagacaagtggctagagttcaagctccaggagaaggcaacagttagccacaattcacaattatttaggtaatattggtaaaattatacatttttggacaacaaattgctgaaatattttttcctgctacgtacactgcaatttgtctttgttgcatgaaaccatagactattctctgctagcatatgtagtatattgctatgtaatgcttctgtattttgactaattgcacccattatcaatttcccgtagttcacgttagtgtctttgttttcctcctcatgttttgtttattgttctcaactttcaaaacagatatatcaatgttcaagatattaaattattcggtgcatcgtattttcccttttggcaagtttgaaattttcaaatcattttattgtcttgagtattaattcgaatcattctatcttgttttgcatgcttctgtcttaattgaaggcttatgcatgtgatttgatcttgcagattttcgtttgacccatctactaagttgggtcttgatgttgcttcatgtctcataacaaggtatccctttactttctggcatatgttagaatacctctactgtgagaatcatttatataaattaaacggaatatttgtttttttttaaagaatgtgtatagatgcagatgctgtgttaataaccttagttgaaacagtgttctagctaattattattgttgtcgctactagcctgtaacaaatattgtgcaaagcaaaataccactttatgttaaatgaataaatagttcatgtttttcccccatgttaaatgttactgtttagcagttagccgtttcagaaaagagagggttttatataccattctgtacatttcagcagcaccttgtttaatattttggccttctatctactcactcttttataggcgtgaatcattttgcatctacttttctgatagtatgagctagtattttttatatttatttcttaccttggagactctaaaaccattaattcatctcagggctccaataggagaggaagtggagggaggaagaaaatttgtcattcgcccgtaagcagagacaaaaacagttatccattattgcatacataacatatgttagtacgactgttcgattagatttttattggaatctaacatgttttctgcaggtacacacctatctctgatccagattctaaaggatattttgacctgctaatcaaggtaacacaaagtttaatgtctgaagttcagaacatgctagttgcttttagatcagcagttcttgtagtccagtgtaaggtagtactgaaaggagagttatttttgtgctatatgtatgttgcaggtttatcctgatgggaaaatgagtcagtatttcgcaagtctgaaaccaggagatgttgttgaggtcaaagggtaatgtgaaatgaaaatccgttgagttttctatgcatgttattggctatctgtaattgatgtctttctcttttttttttccaggcccattgaaaagctcagatatagcccaaatatgaagaaacaaattggcatggtaagacatgacttcaaccttagccaagtgtctatgtttgccaattcaatttagcaagcccaaagctagaaaaattctgaagttatcaagctggtctttttttttaaaaaattttaacaaaatgtatgtatatgctttcagatcgctggtgggactggcataacaccaatgctgcaggttgtcagggctatcctaaaaaaccctgatgacaacactcaggtctgttgccatcacaatttttttgaacttatttgcaccgacttgcacccttgtgacatccctttgagaaactatcattttatgtgaacgatattgctataccacgtaactttgttatgcatgctgacatgacagaacagatcaatgtatccactttcatactgctaccagaaataacattattagctatataatgtttgactaatgttttgttctaatctgatttatggttcttggtatttctaggtttccttaatttatgccaatgtgtcaccagatgatatcttgctgaaaagggaattagatagacttgccagtagctatcctaatttcaaggttggtattactacagggtttaattcattttgatctgattacatgggatttttttgttagtgtaacacgccctggtaatttttctctaggtattctacacggtggacaaaccatcaaatgattggaggggtggtgttggctacatatccaaggacattgccttgaaaggtttgccacggccaggggaggattctctgatccttgtgagtagtctttgtcatttctgcttatagttctgctgatattctttaagcttttgacaagagtttgtacaattttaaagctcgcttataatctccatcaacattatcttcattcatgtgtagcataaacatgattattaatgttggaatgtaagaaagcatcagtcattcaatggtttttgcttggtcaggtttgtggtcctccaggtatgatgaatcatatatccggtgacaaggcaaaggatagatcgcagggcgaggtaatgtgaagtcactatctaccttttgtgattgtagttagtgccatatttcttatccttcttaattggatgaaaacagtagaatgatatctggatgaacatactaagataattcctagctaaaagcgacaattttcgcttgccaagttccagctaacagacctgtcaaagctagccagggagcattccagtgatctaaatatcccagttgtatcctagttcctagatttgcattaaccactacaacatgacattcgttttatcactttattgccctcttttgcttggccatgttaatgttttactgatcatcaatttggttactctgcagctcaccggcattctgaaagagttaggatacactgcagagatggtatacaagttctgagtgcgtcttcaagacgttagaatgctgacatgcttgctgcaatggcgccatggcaatgatcaaataaaccacagctgaacacttcttttattatgccacagcagttgggttccagacttgagaaagttttgacatttctcaataatgttcattgagaatcacatctttttgcgtggtttgcttctgcgatatgttcttgcggcccatgcacctggatatgcattgcttcagccgtttatgagatggtctggaattgccgtggatgatcttatagagatagatccattcacagatttgagactaccttgtgcactgcatttcgagtttttacctgacgaaacagcaaattcatacaaggagagctggagaggtgaaaattaaacatgtgtttggaattttagttgccgcagaaccacagtagcacgacgattagaaaggtttagttttgaaaaccaagttttagagggtttgtttttaaaatttaaaccaaacaaacggctaaaagaactctaaaagcaaaacagttatccagcttcatcatctttttacttatacttatcagctaaattatttattttcaaccaaatttgattttaggttttttttcagcgaaatttatttttcaccatttactttaagattgttaaaaacacgtactatatcaaaattttatttgcaaattatttttcagcctcgtttcgtcgccgcttcctctcccacacggccacggccacgccgcgacacccatctcttcttcctcgccgcggcggagcggggagacggacggagagggaggggcgcgtctccggctggaccgtcatgcgcggccgcttcccgccaaggtacgcgtgcgatgcgaaccccatgcccgccacacggatccgcgcgcacccatggtgctctgccgccgcaaaatggcccggccactggttgctcctgcggctgcgtggtcgtggtgccgagggggaactcgggatcgtcgtcgtcggtggcgtagtggatgtcgccgtcggcggggtggtgggatttggaactggaaccatgtggtagcatctaggagaggctttggcttcctcttccctcttctgggatgggattcgtgtggaaagcgaggagagaagaaggccgctcgttttggcttgttgcgtgctagggtttggggaataggggggcagctggaaccctcgccttaatcgccctgataatcctgtctagattgctccatcctggtgcttggcacttctctcctgtagtgaagtgatccggtgattcagtcacaatgtgattgtgatgtctagaaccgtcattaaaaatgcgcatgattgtagtgtatggatagctacatccaggtgacaatatcataaaaaaaatattcaaaccatgctgtgttagcacaaggaattctaattaagaatttactactgatttttttttctggttggcagtagtttgcttgattatttgcttgtcttacatgcacaagagccaaagacgtagttatattagcaccactagtctaagaggataaatgattctgttgcgttgtcgatttatcaatcaattgctcagatgctaattcagtgtgcgggcaaaccttcctcatccttgcccttatctgcctgtcaccatcacctgacccatatcccttcaacttgcaatatttccaatttgtggatatatatgctatttagccttggtcataccattctcttgctcccttagtcctcattgcataccatagaacattcctagatagagaaccaccgtgaggaacatggccgcgctacaaagatcttcgcagacatttagaaggtccggttcatctggcttggtctgggatgagaggcttatgttagatggtcatagcgagagagatcaagaagatggagccttagagctgagacactcccgtagtgttgggttgattgggctgcagcgtaggcatggcgatggtgcagggcacaccaggtgcaacaacagccaggcgttccatactcgccgtgtgcccccagcacaggatcctccttcacccaaggttcccggatgcatcttctgtggaatttttaggaagccggtactttcagagccatctaaaccaagaaggttctagccttttgtgctcttctcaactatctgtgcagagctatcagtttcttttttctttgtggctttgtagtcaggtccatcatgtatagatgtaagtagtaagtcatatagttgcagttgctgtcagctttcttctttttatgctactgttctgtttttttttttactggtttccctcttgttagctcaacactagttagcagctgtattctagaatgcccgcctctgccatcatgtacttgatagagtatgtgcatatcgttgtatcatatgtataagccctttgtacatataaatacataatatgatgtatggcgttttctatcctttttcatgtacgtgtcttgttccacagccactccttatgagtacatccattcctcatgaaccagcgagaacttacttcttttaagaactatcggatacttcaaaatattttaaaaacacatctttggcagttatgctacagtttatgttcctattaaggaaaaaaattcgtgagcttatcaattattaggtcatatttaatcttatccataagaatcaatgaacattccaaatatttgcaaattttatactgattgtagcttccgtctttctccttgtggcttaagagttccatacaattatgagttctagaagttaaatatgtaggtaagcacattcgtgaagcagatgaagcattgtgtgtgctgctagctaggagttttttttccctttactgatgtcctacattgattttagagatcttgatgtaaataacaatcttaatgtcctacaataatattgtctaataaaccttaactcttgttttttttggcttaccatttcaaattcttgcaaaaagcatatgcactttgtaagttagtattgcttgcagtgctgccattattaatttcatttcattttaatgaattctttagctactacaaatcttttgagctgatgcaaatcacacaagaaactggaatgctagtgtttgttagaaatgttaattttgaatttgtagtgaagttctgttttctatttcagactattttccggtatattgctttttcttttagctgaaaaaataggaaactctcaaaggccatgtgggtgtatcgagtttgatgcagacattacttaagttaatagaagagtacgtgcccatagttgaagaacaggaccgggactagcaaagtttctccactagtggtttccaggtggactagatgacctagtgcatttacacttggttggagggattgattttggcccgtgtataggcatgctatggacttcttttctgacgatgaaaggtgtagatatgtgttgggcttaccttttaaacttccagaaactcatttcatcctttggagcaaatagatatattagttggcttccactgccaacatataagaaacagaatgcggcagtaaagtttgtgtattcctatctcatggatgtccagatactgtcagacaaaggtttaaatattgaatgactttgaagtgaccatagacagataactgattatttccattcaaaatgagaacttttttttcctgctaaaaaggagacaaataacagctttaactcattataccaagcaaatagtgggacataattaaatcaccggggtacctgcgggcagaaatttgtgaaaacatgtgagagagagcactaagcaatatatgtagcagtactgagggattgcccctaattctggaatcaggacagcctgttgaagttgaggttatttcaaagagtacagaaattttagatcaagttcctcctcactccgaaatctaagatacagatcaaacaaaagcgacattgttgcatgtcgaatcaaacatgaggatattattcaagaaacatacaagtatgttactttttgtaggtccttgtcgtgtcctatttgggatcacgcaaccagctattgaccttcctgccaccccttaagtcttctggtacttaatacgatcattctcagcttaattgcttgaaaagccaaccagttatctccacacatacaactttttctttgccgtacgatattatgttcttaacctttttgttccttttgtttaaaaagattgccttatatttctgctagcaacagttttcagtgtgcatgtttacatcatcgagtctgttcttttagttttgaacagagctgggtttcagatctttgcttgtgaaattttgagtgccaatctgcattggctatgttagcattactttatgattgatggtgatgattggcttcagtgcagacatgcaaatatgtgatcttgtttgattaaaagaagcaggttttgtggagaaagatgtgaatgcacaaaatgaaaggaaatacaatcatgctataaagttactgtctgtacagattgctcttattataattttcgacttttgctgtgaagaacatctctgttttcttttggacaagtcagaaatgaaccttttcttttaatcgctgagttgctgctttgttggagtcaatcaatcaattgcgaccatgaatatcttattagggtctattgctatgtaattattggtcatttattcaatattttagtgttggtacgtgctgaagttaattgcagatcagattgtgttctccttctaacctgtaatctcatattactgttgtgtctatctggtgagctgctgcctgtggtctagtactttgtactaaatcattaaaggacatatctggtggcacttgtaacttaagtgctgaagaatttcgtgtttattttggcctttaatatatgacatgacattctgggccatataaatatttgtttagtttcattggagttctttgcttgacttgctaagcataggtaggattatcagattagttggggaagtactactacttgattagcagtgatgttgaagcactatctaaattgtcaaagcaatatgtgcagctgcacgctccatgattaattttgcagcctttcaaaagggaaaggcagtagtagggtccggattacaggaataagttgctgtctcatcattaacacgaggggatccttctggaaaacataagtctgttttccattagttatctgtggacacattctaattgttgcttgggtctaccaagagcatgtcttaacacctaaatcttcttaattaaacacaattatctctaattcttgtggttgtgacttgtgaggggttgtggtattgtgacatgagacgtgtgactggaaaatgggttggattaccagatggccttccaagaaggaaagaggggagagagacggttaaccgatagtaccactgcaacacatactccttccgtcccccccccccccccccccccgaaaaaaaaaggctaaccttggcatggatgggacactttctagtaaaacaaatttggacataagaaagtgtcctatccatattaaaggttggcttttttttttggatgggggaatagctggtagtgacagtcaatgcaagggtgtcaatatattttgtcatcattttggcactattatggctcaagctcaagcccctctcatggacatccatgaaaaaaaaaacatgatgtggtgtgggaagcataagctatcgacggactgacaacaggtctctccgctattagatctacgataaaaatggtcacggaaattcttgaccgacctagtgattttcgtataaatggcactattacctgactgtttttattttgaaaatatatgaattttttttttaaatttcttttaacgtcgtattgttagtgataccgaatagttaaatcaataaatatgataaatttttgaccgacagagaatcattttgaaaaaaaatgctaccgatcacaattccaaccgttttcgttcctagttagatgaaggacaggtgttagtttagttatagcacaagttcatgtcagctataactaatgctagcttgtacaataatcatctgctactaagcccttgtttagttccaaaccttttttttaaacttccaactttttcgtcacatcaaaacttttctacacacataaactttcaacttttccatcacgtcgttccaatatcaactaaacttccaattctgtcatgaactaagcacaccctgaggatccgattggggagcgtaacattctgattaatggttggttggtagtcagtttctgagaagctggaaaagacttatttatagtacaaactaggtgataccctacgctttgctacgggatttatggatgggtatatgtaaaatattattgaaatgataaaagttaaaaaataatgtgagaaagatggtttgacacatatttgttgatctatataatataatattatagacgacgtgtcatgcttacataggatttaaaataggctagaatagtcattactagtgagtaaagatgtggcatacttgcatgggattttaaatgggctagaatagtactccatccattccaaaatataagacacaaccacccttaacccaaagaccaagaaataattattatcatcttgtagtttggatcatcataataaatataatgcatgcatctaatatgattagataacatgagagtggagaatttttttaaaaaataatttaatggagaagatgtcatagttaattgcatgcttgcatgcatgccttatattatggaatatctaagaaaagtggttgtgccttatattatgaaatagagggagtaattactagtgggtgatgatgtggcatgcttgcatgttgagctttaacttctaataattgttagtggataccaaatactcctctgcatgtagaattccttatagtttgttaagtcatctacattgaacttgttctctttacctacatgcctgactataattgaagaatgtacttgtgagccatttttactgtatctatatgaaccaaaacacgtaattacaatatttttttgaatttagtaattacaacaattcagggtatgatctttatatttctacttttacctgtccgaaaaatcatggctagaaaaatagaaggcgatgataaaccactaaattaattttaaagttagtttgtaaaattcaaagtttgtaatataaaacttcagttaaaggttaaccatttcgaattgacaaacttgcatgttttaattttaagaggtagagtatagtgttttttttttccaaaaaaggtacatacataggcacttatatacacgcgtgcatgttcacctctatacacacacatcctactattgtaagtatgtccgaagactcagtttaatatatgatgaagattgataaagttagcattagtcgtcacattatcagtggatatggctcccatcaataaagtggagcatagtattctcctgttttaaaatataaatgattttggtttaatagtatgcattctagtaatcgtattactattacttggatatgtcatattgaatataaaaatttcctgtattctgggatggagagagagagagtaatatacatcatttcatggtctggcacaattgacacgtgaaagaacggggagcatagtacgggtggatggcactcgtagatattaggcatgtcctcttgttgagtggtacacggtaaaggagaaaaaaaagagagagcccggtcgccttattttattttaaaaagcccatgatttctttgtcccattcgatctcgaagaacatttttgtctctacacgggtaggagtaacaatccattttttttcgaaaaaaaagtatatatattactcgaatcctctctacccgcagcgtgctcacatggctcacagcttccgttccgtccgagaaaggcaagtggttttacgcttttacgaaatcggatggatggggatgccgctacgcttccggggaggtcaccgtcagatgcggtggatgcgtgtatggtgccttcgcacgccacgctccccgaacccccaccgtcggatggctccggagtggacggcccggatgacggccacgtcgccctccaaaaccccccaaccccaccgacctctcctacccatttccccccatctctctctctctcctcccatcccgcagcagagcacacagactcgttttctctctcctccgctctctcgatttctctctctctcctctcatccgatctgcatctgcttctcctttccacacttgtgcttcgtgttcgtcgtggtctcttgtttcttcttcttcttctagatttgattttctttttttttcttccctttttcgcggcggcgaggggcgaggggggagggtgagtgtggtgtggtgtggtggttggtgggggagatcttgatctggtcgttggagatggcggcgcaggagcaggagcaggagaagcagcaggtgaagacgagcacgacgagctcgctgccgtcgagcagcgagcgctcctccagctcagcccccaacaacctcaaggaaggaggaggtaacgtcacgttctccgtcggccgtccgtacgccggatttcctttgcttgttttgttgtttgctgctgaattgagcgagcgattcggtggcggcaggggtggagagcgacgaggagatacggcgggtgccggagatgggagggggcggcgggtcggcgtcgtcgggggcgggggcggacgagcggcaggggaaggaggacgggaagcagcagggtggtggcggcggcgggcggcggcggcggggggcgggcaggagcaggcgccgccggcgaggaagcgagggcggagcgccggcgacaaggagcagaaccggctgaagcggctgctgcggaaccgcgtgtcggcgcagcaggcgcgggagcggaagaaggcgtacatgacggagctcgaggccaaggccaaggacctcgagctccgcaatgccgagctcgagcagcgcgtctccaccctccagaacgagaacaacacgctccgccaggtaaagccccctcgagctttgcttcaccattctcaa

SEQ ID NO: 52759 - DNA, 16914 bp, Oryza sativa
ctggttattaacataatataatacaaggaatttatctacagttctggtaggaattgcagctcattcctgcgtttcaaactgtagactgtcaaagttaagcaaaagtaaattctgccatgacgcgattagttttttttaaaggaatcaacataaagcacaatataaaaccatcttaacaggaagcaggaagttgaaacttgaaagcacgaacctgtaagagaaatcaggatccatgagaataatcaagatgtccgtttccacgcaatcaccactattttattcagattattgtcaacatgttcatataccaggcatcggtctctgctgtccgtcaatcgggttacacggtattatcccgaaaattctaattccctttcgtgtaatagtcccctttctacgacgtactagtagtgatcactgatcaggatttggttgttcccctaatgatcagcagcttacaccctttattcagacatcaacgctagtttaatagcactactacttctgttgtcctctaaaagcatctttcccctcttgaacgtgagcttcatttcagatcgtgcgaagaattagcgcactgtattatgagcaccaacactgggtactttccagctcgctacttaaaatctcatcccctactagtaagtgtgatttttcggcattatcgacgtgtcagctagcctcaaaacggccatcgcgtcaacaggtgcactgaccttctctgctacgtgtgcgtcgatctcatcgtgtattccgctacgagcttggagaagagagacgacttgtcctccagtagcctggtcggcgtgtcgcgctccacggccacacctgcaaaagcattggcacggtgtttcggtcgtcagacagacgcgacaaacccatacaatatgtaagataaattgggattggttagttggaactgtggttattgtcgttataaaatcggagattgattagtggcatctgtgattggtttgggacttggaaggcgaactaaactcaccgttgtcaaggagcaagaccatgtcgctgtcaaggacggaggtgatccggtgcgcgattgtgatgaccgtcgcgtcggaaaactgctgcctgagagttttctggatgaggttgtccgtggcggtgtcgacggaggccgtggcctcgtcgagcaccaggatcttgctccgtttcaggatcaccctcccaaggcacaccagctgacgctgacccacgctccagttctcgccgttctctatcactgcaaccaagccaagccaagccaaatcgggagaatattcaccaagaattaccaagtgtaaaagtagactttgaactgcatgattctgaacaggaaaaagaaatgagtccagatgcagagaaccgaacggacctggtgaatcaagtcgcagctccttcctcctaacttcatctcctagctgacagcgatccaaggcctgaaaaggaagggcaagatattcataaatcataatagaacttcactgcaagtccacaaatagtatgtggcagctgacaatggtgaagcatgtgaagactggaactacctcccagatttggctatcagtgtactctccaataggatcaaggttggttctcacggtaccctcgaacatggttggctcttgcgggatgatgcttagcctggatctcagatcatgaagtccgatggtgcagatgtcgatactgtctacgagtatctgaccaacggtagggtctatgatacggaaaagggcctgtatgagagttgatttaccactgccggttcttccaacgataccggtcttcatgcctccagggaatgtgacagtaaggcccttaagaacaaatggcaaatgtggagcatatctcacctgcatcaaattgaaatgttcagagatatgtactaccaggttttgaatttgacatattattggacctgaactcctgttcatcttattggcagtgggaaacgatgcagcttattcaaaaaagggaaaaatattaataaataaaatgggaggataagatgagtgagctattacatggacgttattgagcataatttctccttctgatggccagtcctgcgtcaatttatcatcttgtacagaaagagggggctctgcaggaatgctcatgtattgcagaattctctctactgatatgatcttgttctccagattgcacatgctccatacaacccatgcttgcagcatgttcagattaagcccgtatgtgactgctagaccagaaattcctgaaaacaagatacaacattagctgcaagctcatattaacaaagttggaatcatcttcagtacatatagtgtcaccatacctggatcgatgagaccagtcggaagattgaccaaaaatatcaaagagaaggcaaatgtaagggatgcagcatatccaggcggaagcaaagccattccattgctgcagcattataaaattttggtctagaaaatgcatccattaaatggctattagttgatacaaactggttttctttgccaaaacttctgatggttgttgatcctgttattgattctgcaaaatgctgtatgatgggagctttgcaaacccctactagtctttgcaactctctggctgtatcgatgtagtaacgctgcaaaaccataaacgtggtgaggattgaagagtgttgatcttgcagttgaaacggcaagaagaacaaagcaaaagtacctgataccagaagcaggcagcaagcacaggaataaaaacaacaaaaacctgccatgcaacctgagacatcacagcaataattccaacaagttgtatgatggaaaatgcaacagatcccatctggtaagcaatgctggtgtccacttcgctttgatccgttgaagcctaggcaatttaaacctgttagcacgagcgcagaaaataaaccaagctttctagaaaatttgtgcaaatgaacatgacttactctattcaaaatgcgcccactaggagtggaatcaaagaatgacattggagctctgaatatggacatatgcatcttgttgaacaacagagttgctgtcttgtatgcagctgtgacaagaatgagtgctcttacgaggttccaaaagccagtgcaacatagacgtagatcagggttgacatgcttactggaggctcaacgtcctttgagacaggagcagcccaggccatccagtaattgctagcaatctgaagtacttggaaaagtatttgggccagcaagatgaatggcacaagagctcccctgtaagctaaggtgaggtacttccagtagacccagaaccccacccttcctttctccctttcctcttcctgcaccagctgcccactctgagcattggcatcgtcttcttttccattctgtttatctttcttctcaactgacactgacctggccaggcttgctgtcttactagaagaggaagcctcgttgcctccatttgtgacatctatcgcatccaatgcggtaagagcatccttgtgagcaccaaccagttccatgaactcttcccctgatccaagtatttcgtcatatttgcctgcctgtgctattctcccacctttcatgacctacattatagttagtcattaggcatgtacatacatttcatggcaataaatatagatgaaaacttttccaatgaaatcattaccagaataagatcagcagcaggtaggaattcaatctgatgagtgacataaacaactgtttttgaagccaattctccaagcaagcattcctacaaagggtataaaaccttaagcaatttacgagcaaacatgccaaaggttatgcacttgtcgatattgtagggaataaatcatgaaatgctattgaaaatagaagatcatatcataccttgaacaagtgggatcctgtatgagcatcgactgcactgaaaggatcatcaaacaaatagatgtctgcatcctgatacagagctcgggctatctgaatcctttgcttctgaccaccactaaggttgatgcctctctctccaatgacggtctggtcaccaaacggcaatatctccaagtctttcttcagcgagcatgactcgaggaccctgtcatacttctcattatccatctgcttgccaaacagtatgttgtcctgaatcttaccactctgtatccacgccgactggctcacatacgccatcgtcccacaggtcttgacctctcctgatagctttggaatctcaccaagaatgcaagacaacaagcttgattttccagagccgacagtcccacagactgcaatacgcataccttgttgagcttgaaagttcagatccttcaacgttggcacttcaggtgaggcatcccaagaaaagcacccatttctgacctcaattgcaacatctgagctaccacttggaagtttcagcacagcatcagtcggcaattcctcgaggcataaaaaggatgctatcctgtcaagagacaccttggtctgaatcaacattgagatcgtgtcgggaagattgtatatcggttcttgcagcacgcggaatgtggccagtgcagatagcaccttccctgactccaatggtatccccatgagcatgcaagctatgaaggtcaccactgccacaaatgttggggctccccagaacacaaaggtaacaatggtcgatgtgtagagatatttcttgagccagtttgtctccgtcttcctcaggtcgatgatcttggacaagaacttcatctcccacccctgcaatttaagaatcctcatgttgcgtaggatctcagatgttgctttcatcctgacatccttgcagtccatcagcttctgctggaacttttcctgcatttgccctggaggcacattggcaagcatgacaacaacagtggcaccaagcgcagcaagcgaggcaagcccaagggtggagtacaggatgaacaatgccatgcctacttggagtggcaccaaccagaggtcgtgcatgtaccacgagaagaggccgacgcggtcggcgtcgacgctgatgatgttgatcatctcgccgctcgtgcggctctgcctggattggctagacagcacgagccccttctggtagacgacggcgacgagcgccgaccgcgcgcgtatcccggcctgctgcagccggaagaaccagtgccgttgggacaaacactcgaacaccttggcgacgatgaaggcaaggacaagcagctgccccttgctcgcgtacctctcgtcgccgttgaggtattgcacgagcgagtcgatgaggtaagggccgacgtaggtggagacgttgtagaccagcgcgtagaacgcggtcaccgcgacgtgccaccacacggtgcgcaccagtgccttggagagcgtgaacgccgtgaccttccgcccagagccgtcgccggcgagcgcctcgaggttggtcttgaacggcgggagcagaccggcgactctgtcgccggggtcgaggcccgggacgtcgtcgaggtcgagggtcttcctgtgtccgacggcgaggaggggacccatccacgagaaggtgaggacgctgaggaagccggcgccggtgaacatcgacgcatcggcggcgcaattgttactgttgttctcaccggcggccgtcgcgcttgcaccgctaccattcaggagaggctcctcgatagcagagtcgcccggttccctcctgcccaggaacccggcgaagagcagcaccacgccagcgaggaccgacacggcgtcgagcgcccacgaatgcgcgggcacggggcgcccgtcgagtcccgtcacggcgtggacggcgacggcgaggacggagaggagcaggaagagcgcccaccagagccgcagcggcgcggggaaccgctcctcgcgtcgccacccgaaccggtactgcaggtacgccgcgagcagcagccacgccaccgcgcgcgccgcggcgtccgcctcctccaccaccgcgccacgcgaccacccaccaccgccaccgccaccgcccaggtacccctcgtacgccgcgaggatgaccccaaacccgccgagaacccacgtcgcggaggccgcgacccaacgccaccgaaacccgcctcctcctcctcctcctccccgcacctccccatccttgccgcggcggcaccaccagccgaacaccatccgcgcggcgaccgcgaccgcgacggcgaggtgcgccgcggcgcccgccgcgtggaggaagaacaagggcacgtcgtcgccgtcgtctcgcccactcgccgccatcgccgcgagcggcatcggtgcggcggccaagggcatggggagtgagtggctcagtgtagctctgcaacagatgggccaattagggggggttgtggtatagtaggcgcgcgcgcgcggcggtcaaaggcggcgggcggcgaggggggctccttgcggtgcaaggcagcgggagggagacaccgccaccgccgtcgactcgtcgtctcgtccccacgtttcacttcaccgcgagaggatggcaaccaccacccgccgcatcctttttaccgccggcccgcgacggcgaattggggattttattttgttttttcacacctcggggagggcagatgagtcgattttttttttcagttttaaatgtgacaattaagaaattaccaatctcaccatctgtaatacgtggatcctaaattatcttattaggtaaaaaattacccaccatgccacccccactcccttttacacttgcaaacccaataatccaggctctaataatttaggaaagaaacaactaaccgcttattctagtacagattataacaatcaagtttatagtaatatgactcaataatctagattataataatcccaaactgaaaaaacagggccttagtttccttcaaacttacaaaaattatgtcacatcaaatatttagacacatgcatggagcatcaaatgtggacgaaaaaaaccaattgcatagtttacatgtaaattgcgagacgaatcttttgggcctaatcacaccatgatttgacaatatgttgctacagtaaatatttgctaatgatagattaattagacttaatagattcgtcttgcagtttacaggcggaatctgtgatttgttttgttattaatctacgtttaatacttcaaatgtgtatccgtatatcttaaaaaaattgaaaattgaaaaggaactaaacacggcctatgacgtgtgcgtccggtgataaatttttaattgtaactagttaaatatatctcttgattttaccgtggagataaaattaaaaaaatatataattagtgcgggagacgacgtggggtgggttctcgatcgaaggtttagtaaatgtaaatctgggggttctgattgtgtttatgcacgtcgttcggagaagaccgagacgtagatgcgagattagttagataaattcaggttttgttttgtttgttcctagtatgtttttgattttattattattattattattattattattattattattattattattattattattacaaaaggaagggcaactttcggtttgtgcgcgacttaaaaatgcaccctggtagattacataagctggtgagattgtcccaacttttacacgggaagagattcttgcaaaagttatgtagtactactattagtttggcaaaagttatggagtattttcttcctcgaacataactgaattttatgtgtaactatgtcgatcgctcaacatcgtcatagtctaatctctcattgtaatataattgaacagtgtatatttttttaattcaattagtacatttaagccccgctatttcctcccctcttataaattatcatgaaatcgtttcctattcttctaaatggtacggttttttaaaaaaaaactttctatacgtaaattgcttaagtatcttttcaaaacaatcttttaacgtagcaatagttaatatggttgctcttttgtattcttccttaataatatactctctcctttcctaaatgtttgacgccgttgatttttttaaacatatttgaccgttcgtcttattcaaaaacttttgtgaaatgtgtaaaactatatgtatacataaaagtatatttaacaataaatcaaatgatatgaaaaaaattaataattacttaaattttttgaataagacgaacggtcaaacatttttaaaaaagtggatggagggagtactagatatggatcgatggatgtagcatttgttctctagatacaacttcacaagacgtgtgtgcaagtaaaatggcctacctgtttgaatgatttgatgtcttttgaataccaaatgtccaaaatgcaatgtattgcttatgaaactacttattaaaaatatacctatactgcgtatataactcatccagtaccaatctaaatactattaatacaaacttacacatgtagcaccatcttattttaaaaaaaggaacaacctagaaatgtttcatggccgtaatgctttatttttctactgcgatgcatgcatgtcttcaatttaatatgattttaatgagtttagaaccgctgtcggtctcagtttttcatgcgtatgcctacgtgtgtgttatacttaaagcaagaatattagtgagttaaaagcctactatatgtttaaaaaaaagttataaacttactataaacttattagagaagagatgtaataaaaaaagaaaggtgttgactcgaatgcagaagctagcttaacacgtactcaagacaactatatttaatatataagtgagagaaaaatagtggagaagaaaaattaaaatcaatcttatatatgatctattatactatatgctagttttaagataagctaatatttattaagctctactattaaacctactcttgcatgactacacgagtcgtagagggcgtgcaatttcagtcatcttttaatttgccattcccaactgtttggttagttctcggagtacgtgaagagagagagagagagagagagagagagagagagagagagcatgcaacatatcttttctgccctgatctcgctcaggataaaaaaagttatactgcattagtattttaagattgccgaggtatttcaccgaggcactagcaccacaacaatatatattcaccttgtctttcgacttcttaattcgtgtgcgcttttttaaaaatttagccagttattctatttgcacctatactgtggactagtcaaatctagcacaaaagctaaggtgccatcagaaagatatagaaggttaatgacgaatcagtgacatactatatttgaaatttcagtgatacactacagtgcaaccaataattaaaataatatagtatgttttggccggtcgctttcagaagatgcgtcagcttgtttagtgtgatttagacgatcaaatttaaaaaataatgctgattctccagctaaaaggtactctattggctagtgcttcctggtaattaaaatttaaatatattatatcctcatttatcttattagtactctctccattttaaaatatagaatgcttcgtttcattaatacaagattttaataatcaactattttgtaacgatattatttatgtgacacaaaagtacaatcataactaagtacttagaataggaatctgatatatactgataaagtaaatgttgacaggagtcttattctaataaaataaaatatatcatatattttgaaacggaggaggttacactggtggataaataatctttgctgggtcaacccaaagccacaataatcctggttctaaaaagaaccgggagtcccggttgaaaaccccataggcattctatgatcttaccaaccgggactaaaaatcatctttagtcccgattcatcccctgattgatgtcagggggctgaggatctttagactaaagatcagcactttagttccggttggtgttcccaaccgagagaacaccaaccgaaactaaaattcaaagcatagtatataatctatatcccttatcctctcctccacctgtctttcccttcctccttcgcttcctacatcctcaacccgatccatcccctccacctcctcccctctcctccacctcctctccccttcccctccacctcctccccttcctcctcccctctcctccacctcctcctctcccccttcctgcccatcctccccttcccatccggcagccggcggccggcggggccatgcccggtggcgggccggcggccgtggcaggcggcggtgggccggggcggcggggccgcgccgggcggcggcggcggcaacggcgttgttttctctcttttttttagtttgtgatttacatgtataattttgtgatttattggatggatctgagatgacctgtgatgtatttgatttgtgtgtaattttttaggatttgtgatgtatttgatttgtgtatatatgtaactttaagatttgtgattttactttatttgtgatgtggatttgggatgttactttgatttggggatatgcttcccacttgataagattagggagaaaataaaaaaaaagaaaaggagaccatctggaactaccgctattctctctttactcccggttaccaactgggactaaaaagaggataacaccaaccgggaccaaagatccatttttaatcccgcttatttgaactgggactaaagatagcgatttttagtcctaaattcgtagtcccggttagaaaaccggaactatagaggagttatgaattgagatcctaagtcgccagttgccactgcatcatcagcaggacggaatagattcattcccgtagttccatgagggattaagagcaatcatacgcgacttaaccgtacttaagttctccaaacaagtgataaagaaagctgttgagaaattccgtcaaaagagaggctgttcaaaaagtgattaataagaagcacttatctgccctgaaagaggatgttcagaaagtgatcagtaaggaaagctgatctgttcagaaaagcaatcagattccactagtgcataatatctattcttaggcagtatcgaacccataaatatatggttcagaatattccaaatcaaggaaatcagatccaaatctgatttcaaggattagggtgtgtttagttcatgttaaaattagaagtttaattaaaattgaaacaatgtgatggaaaagttaaaagtttgaaactaaactcggccttagttctcaactttttcttcaaacttctaacttttctatcacatcaaaactttcctacacacacaaattctaacttttccgtcacatcgttccaatttcaatcaaacttccaattttaacgttaactaaacacactccaaatattattattggccatgtataccagctgcagctatatataggctatagctaccagcatcctatattcatgctgattttctttttaatgaaaattcttagggcctgtttagatcccctgacaaaatttataaccctgtcacatcgaatgtttggacacatgcatgaaatattaaatataaacgaaaaaataactaattacacaaattgcatgtaaattgcgagacgaatcttttaagcctaattgctccataatttaataatgtggtactacagtaaacatttgctaatgacatattaattaggctaaataaatttgtcccgcagtttacatgtggaatatgtaatttgttttgttattaatctatgtttaatattttaaatgtgtggtcatatatccgatgtgacacgcaaaaacttttcaccctggatctaaacacagccttaaaaaacaaagagactcatatacacatacacatatataactttaacatactagaccaatgagtatgtgaagtcacatacttccgcagtccgaaaaaacgaatctagcactagatgtgacatattctagaataatgaatctggacaaatgcatgtacagattcatagtactgggatgtgtcacatccagtaccagattgattttttatgggacggaggaagtagtatgcttctttgttgtaaatgtcaacacctatatcaagtctagatcttgttgggtagggttcgccattagggcatgtacaatggtgtttattagtggtctctctctattaccatgcaagtaaatttaatgatatggaaaaaagagaaaggagtatggttgttatgcatgaacagcttataatcgactcttagcatttattagagtaaattttgttgcatggtggtgaaagaaaggaaagaaaaataagaaaaagtagtttgatacattaatgattagagaccatattgtctctaactgttgtagaatgctagtctgtaaataacgtagatctcgtatctgactttacctttgtacatgccctaagttgcctagctagctgagctgcgttgagttcgtaaaatcgtaccaatcaagacctctcacaattataattagcatgtgtttccctccatttcatttcatggtgtaagaagttttgtatttgtcataagccaaatttgttctaatttaactaagtttgtaaaaacaatgagcaacattctcaaccccaaattaagttttattaaatccacccgtgaatacactttgcaatatattttttttgttgaaaacgtatattcttttataaatttaattaaactcgtaaaaatataacttagagtaagacaacccaaaacgcctgtgggaatagctcaacatgcgacggcagtaacaaacaaattgagttaattaacttcgaatttaccgtgtgctcgaccgcaacaggtgaatctttttattttttaaaaaaacaatcagcaggtgaatctaaaaatgatttggcgttgacgacaatagcgtcgtctttgacgtatgacgggtgacggcgatgcactgtaagctgaatagttggttgcaattggtataacttgattgcaactgttagaattatagaactaacgtgcgcgccagtagagatgcaagcggattaacccgtaaacccgattatagataaaattagtgagtaacccgtggattgatttacgggttacctattaatttgacctcaaaataaacttatgaattgatctacttgcatctttacgacacgataagctaagccatgacgtgaaactcacggattattttttattaaatatataagtaggttcacaggtcggtccgactagccagtgaccatttgagcaaattggcagcttaattagctatacagaacttggccccccaagcatcgatcatcgatcgatagcgatcgcgcaaattttctgaagaacttcgccgctgcttcttcccgtttgatttacttagcggtgactcattgtcgatcgatcggcctgatgaatccgggagtctgatcaagatcgacagcgatggatgatgataggagaagctaagtactttggcgccaaggcagcgaccggcagaattatgtctttttgatctttgaaaagtgaaaaaaaaaagaggccacgtccgggacaagagataaataattaacgccacgtgcgacgtaaacgaaggtgcaacaatctctgttgagctcgattaccatcttagttttttttttaagataatggacttaaataaaacttggcctctacatcctaagggatgtacacagccacaaccatgcatcttggcttcttgctgagaaacaaacaattgtagtttgcgagacgcagcagaggaggctagagggtcgaattaacggacatcgcgtcagtgtatggtcaccggttttggagggagatccaacacatacctataagatctgaagatatgctcactcgtatacgctcgtataaatacatatgtacacatatccctatcagcatacataggtatatcatatccctatcagtaccttttaaaaactgttattgaattttagagatgcatatgcattttatctcattataaacttccgtgcaaacgtgtaaaaaaaacaagtcatgaattaaatactttgtgataatataagaaaaagataaaaaaaaaactggagtgagtacattttgtacgcaaaattgcaaaaaggtacagaggttctgccttatgggtttggttcattgttgcttgttaacatggcggttttagtatcgtggggctttgacatatgaacgccggctcaacagatgtctcacttttttcactcctaaaagactaaaagtgcttttaatcacatttcctttcgtatagggagtgccttaattaaagaataaagagtacaaccggagacctaaagacttaattaaagaataaagagtacattttaatataaattttgtaaataaaaatgtaacagattgaaaattttgtttgaaagtaggacagtggatttttttttggtcgggatcatttatataaaaaagaggagcatatctgtaaaatattatcgtgagcatcagtagccctatatttatatgaatgctccttttttcatgactttttaataaataaaataaatacatactgattttctttcgttatctaaaaataaaatttgtcataaataatgtgttgcacaataaaatcataactataatagtttcatgcagcaaatttttgcattttcaacaatgtaattcatatatttctatgttaaaccatgtgtaagggtaacatggtcatttttatagaaattagatagtcagctgatggaagaggcatgaaatggagcaattagacagtcaaatgacgggaggagcatgaaagagaacaagttgaaatttcagggatacaaaaagtatcgagtaaatttcaagggtttgagaaggattgagtggtttttcaagggtatacaaggaatttactctattctgtataatctttcaaagtttatactaattttatttactagcaaaatgcacatactttgctataggtaaaagaaaatatataacaatatgttatagataaaatatattttcattaaatgtgctagtattagttgtttgcttatttggatacatggtattcatttgattcaaagaaatattagactatctgttgacgaaaaaatcgaacacaccggcttgggagatctgcttaactccagtgcaggtccaaaggttggtgagatgcgagcgtgccagtcagtttgatcctgcaactgacaagatatacaaataatagatcaaacagccgatcggctgacaagccgatggagtagttccagccgatagccgataatagccgatgccgacaccagccgatagcgatagggtttaagcaatcgaccatatgtccaatgtagataatgatataaaggcaatcggctgatgatgataaaatctaacaataatatagtctagtagaaaccaatcgactagcaatggtatgatagaataagcactgattcgaaggttaaagcgtacattggctgaaggtccgatgccataaaatccacagattagattaaacagtgaaacttttgttgtcatcggctaaatccaacttgtatatatatgtaatccttatgagccgatgcaatgtccagataacttatcggctagcaccccgataaaacattagcatgaacctatcggcttaacaagacttatattatcaacaacgatctagtagatcgaacctaaccgatgcagcacgagattgtatatgataatctaatattcgatgagccgatagatctgtcaaatgtgatggatataacaaatctatttagaacctcattatgattgtagagatatatcggctaagacaggagatcagacctaaccgagacagtcccaactaaaccgacgcatctctaaacacaatgcaattagagatagaattgagatatcatgtaggcaaatatattaaccaaactagagcgatccaagagatcgaatcgatgcagccttgaacaacaccaacgtagccgacagattcaccagggcccgacagaacgtaggacttatcccttcgctggagatcgaaagctgatgcatccctgcgtcaggtgcccaagttccgttggaagataagtaaaaacctcagggaagagggtggcgatgcgccgagagtattattgatcgatagattgatatattacaatggccccgggtgtacatatttgtcacaccctgaagttctcctcctagcctaaaattgaattaataagagactctaagaaaacaccggtgcaaagcaagagtaaaccctattaaatcaatgcaaataataatcggaattggcatgtggaatttttcttgagttctacatgtcgaaattcactaacaagatttttagtggaattttcagagctctcgaaataattttaaccatttaaaatcgagcttgcaatattttaaatcccagggaaattcttttcctcttttctttttttcctttcccctccttttcctcttcttgggccgtcggcccagtccaccccgccgcgcgcgccctcctcattgtgggccggcccaagccgcccctccctctctccccgggacgccgacaggtgggccccacctgtcgggcccgtctccttcctccagccggcgccgccgcgcccgcaaccgccgccgcgtccacgcctccgcctcctccgggccacgtcagccacgtccgcgcgtgcgccgcatctcccgcacccatttcccctctctctcgcgcccgcgcccgcgcccgagatggccgggattcgattttcgaatcccacctctctctcctcccccactccccacgttggccggcgaaatctcgcctctcccggccacgtccggctccccctctccctattaagctccgacgccaccccctctctctttttccccatttcgccgaactctcccgagctcctcatcgctcccgcgccgtgcaaccacccaccgccgccgtttccgttacttcagccgccgctagccgccgctagggtcgccgccgcaccgcgccgtcgccgccgtcgggttcgcgaggggctgca

SEQ ID NO: 52760 - DNA, 1172 bp, Oryza sativa
ctgacttacttactataggtacataacattcggcctaaaatggtctcagtgcttcgtgaaaaggtcgcccacttgaacttgacattttctattggagggcagattagttttgatgtaagccttctatcctcatacaaatgtgccagaaattattggtttcatgatatttactgctgtatcactttaacaggtgttcccacaaggctgggacaaaacttactgcttgagatatcttgaggaatttcaagaaatccatttctttggggacaaaacctacaaggtgatatgtactctttttagcaaaaaagtgcttcctactttatgtgtgggtaagtattttatccatacaatgctagaataacaccttatatatgctttgccccttttatgttcactacaggatattcttgttgttatctgtctatcatattcaactatataacatttccactatttagttcttcgcctgacttttttttcattcaatagggaggcaatgattatgagatatttgagtctgaccggacaattggacatacaggtgtgctgtttgtttcataaaagctattattctcatgacattactgtatatgcgttggacttgaacttcttgttataacttaaaacttgtgtataagataggattaggtttattggacacaaaaattttataatgttactgtgagacattctataaccatcagcacacagtcgtagatcagactgtgaaacttgggtattgacccaaccagacaggctattccaatcaagcaatactgcacagatcatgcaaatgaatgttcagtagcagtatacttgctggcagtttccatcattagaattgaccaattcaggttaatgttcatgaataaaattcagtttgaaacaaccacaaacacttgggtcaagtcttgaataaacaaagcaataacattttcttctggaaatacttcacaagttccattatggttgagctgtatcctcttactaaataggaatactcttgcaagcttctcatatgtggctgagtcttgtttgccgaggttaaacttgctttaaatctttctgagctaatacatgattgatgccatcaccaagctgattccatcatttatatttgcagttaccagtcctgatgatacagcagagcagtgcagatctctcttcatgtc

SEQ ID NO: 52761 - DNA, 1742 bp, Oryza sativa
ggctttgagcaaatattttccaaatgtgaagacattcgtccgagcgcatgatgtggatcatggtgttaactggagaaagctggtcaacagcggtaagtatgtgtaacaaagttgtgtgcaatgatttcagcagtgtctaggagtctaggtgatgacatactcctggtgcaacttgaatggacattactccatgtggttcagtgcaagtttttttttacacattttattttattggaaggaacttttaaaatccagtaacctgcctattaacatttgcggcaagtagtttttcacaaatatatgaattgaaatgtttattaaaaccttaaaccttgtggcagttagttttggaacctggtagtacacacccttagttgtacagtcatttgcatagaccattagaaaaaaaatcttttggtcactaatgaattaaatgttgaacatggaagggttttaggtgctcatttgccactcatgggattacccaagtatctggtcggtgcaattgtaatatttggtgtcatcatttggtaccgatggttcttctatacttgtgggctagccatttcgatatgatatataacctgccattgtgctgcactgctgcataagggcccattctttgtcttatgcatatccttttgttatatactgtattctatcaccgatttaataatactatctcctaatggaaccacatctacttttaaggttgtccctgagaccttggaaccaagtctccagttggctgctgctgttcttgcacaggtaagcaatgctgttacagtattatactgttatgctctttcatcaagtgtggaatttaatgcaccacatcaatttttcctattctgtatttcaggcaaaactcccaatgtcagagattccagcagctgtcaatgagttcagaaaccatcatcagtcagagctcacacaggtttgtgactgcattgcaacttagtgatcttagtcataaactcataatgatttcaataaaatccatagagctgtaaatttttcctatgtttattgaagaccttatgaagtcctacgttggtctattggtggatgattttttattcaggttcaaatgctaactgctaagttcttttttctgacagttatgtgctacaagtggaagttctctgggctacggatactcgagagtcatgtccatttccaaatcaaagaccgtcacctctgatgatgagagtgaaactgttgatggagcattggcgatttgagctgatgcgttagtcacctcccttagactgtacagtagataatctgtcatcaaagataatttgcgtatagaaaagtagtagcaaaataattcacgcaatgacgattcccatttttgaaaacttagcattacccctttttttaatgtatggtaggacataggatattacttatcttctaccatcagttcatttatttgtagcccttttactccgttagcaagtaatttcttgatggagaactaggacgatgcttgcaccttacatggagaacactgagaatttcacaagtggcctccaaatggcgcatgatggataagtcgtagtcgtctcttatgaggaatccatacaaccaagattttgggttcagaactaaatattatgattttgttagtactcagagctgatgttggaaacaagtggtgtcgggtttcttttgatattgcattatatttttaacagagcttgtttattattgttcttgtatagtatcttttgtta

SEQ ID NO: 52762 - DNA, 793 bp, Oryza sativa
gctcacagaggacagcatagtgaagcgctgtttgtccttcattgtcctgaatataaaagggacatggacagtgttgctcattgatctcattataatgtttagactttttcagggaagcagtgcctatcaaaccaatatatatccactagtagtacctagccgtggcaatctcatatttattgacactattatatggccacaatgaatagcaactttttattcaatgtagtacataatgtaatcccaatgaaaatgccacgccaagatatattaccagcttcttgctccaattacatactcaccaactttatcagcgcgtgaattctactagaatgcactgagtgaagcattaaaggtagagtcaagtacctgagcattcacgtcagcatttgcattgacaagaatctcaacagaatttagatggccacggtcgacagcccaatgcagtggagttctgccttcactatctgaaaccatcataaatgaaactatgcttagatgagctatgctaagcctaagctacaaagagaacataatggtgaacagttcagaacacaaacctctcatgttgacttctacaccaacaaccagatgcttcgctatgtcatcaattgctccttcccttgctgaaacatggatatcgccaagttcactgcagttacagataagtttgttgcaatcatggaaacactgtcatgtaactagatgactgaataaataatgcttaatagcaccaacatggagataattaattgcatacttcatgaaataattaatcatgtcattgttattt

SEQ ID NO: 52763 - DNA, 1532 bp, Oryza sativa
tggaataataacacagaaaatgtagcacgttcatgtcgtgatgtgctctccccacgttcttgtagtacctagagaagcaaaccataagtgctcaacacccagtgtaactaaataaatgaagaccacaaatatatatgtagaaaggaagtttccacaatactctggtatcaaagtttgaagcagagaaaaaaaaggtttccaggtgatcaatttattccaattgtgatatgatcacggtgactatgagaaatatcaaaatgtcagaatctatgacacaagataaatgccagttataagtacctgcaaaacaacagctgttgaggacagagccaacccactcccaataacaattgctgctggtcccggtagcactgcaaaacggtgagctatcataccaacagctgctgtagtagccagcacctgtcaattgctccaatttgttagggagtatccacatggaactattgctttactggttgcatagcatgagtataacctgagcagagcctaacccaaagacatacttcttcattgagcttagcctttccacagaaagctgcaggtaaaaaatggtaagctgatatatcctgcatgaggattaaggaaagaatctaaaagaaactcagtttctacctcaaggccaatgttgaacaacaagaaaacaactccaaattcagcaattgcttttgttccatggacatgacggatgatggaaagcccatagggaccgattaggacaccagcagccagatatccaagaacaggactacctatgatatcaaggtgcatattagaaaaagaaatatcggacagtgaacaaacgttcagatatttcaaattagaaaatcaaagtgaatgtttgtactttgtagtgttcggttgaaacttgaaactaaaactagagtagaacagagacgaatttgtttgatatgatttgtaaaaaaaaggcagatggataaggaaagtttgattgccatgataccatgctatgcacatatagatgtcagaaataaatgtatcacctccaggtattttctgaaataatggtacaaacacaacactagccagaagcaaatataatatgtcgaagagtgaagcttcttcctcatttacctagggtaacaaagagcagaagggagttagacacaagccaaatttcttatctaacttgtgtgagcagcaagagaatgtactcacaaaaaagggaaataaattcgccaatgtacaggttcagttgacagggaacatacctcttgatgaaggtagaagctaataagcttttttacctcgtgtgggatctttcgcatcttacgaactatgggctttgcagtggaggtaacttcctcaatacttgtgggtatttcttgctgctgaaataattgactactcttctcagtccgatttaagaagaatgctctgtggacagagaatagaaacaccgtttcataaagaattggcttatcaacattaatgaaatcacttaactgttgtaagaacaagtactttcagttatttgattatacagatagaaa

SEQ ID NO: 52764 - DNA, 2756 bp, Oryza sativa
caacttgtcagtgctttcgtcatcagacatttcacgggatgattcaagttgctcaatgccttctacagctaagtccccaacagttaggcgctcaacatttgacacctcgtctctttcaggaatatcatctatagcatcactgctgtaatcatacacttcagaaacattgtcttcttcatcacttacttgctcctcagcaggtgctggtaactctacgacggcatcaaccgaggagatggccttctccgctttctgcaatgctagttccgcatcatttgctcgctgtgcagcttccatctcaagagctactgcctgttcagccaaaaccattatatttgcaacatcctcctcagcttttgaagcatccaaaagagccctctcagcaagctccgtcaatctatcaacctccttctgcaactccattttcttctcttggatacgtctcagctcctcctcacattttgacagactttcttggcactccttaatctcctcttgcgcggacgcaagggcctcctcctccacatcatcaatgctaacttccatcggcccgactgatccccttttggcatccagagcttctgacgccaactgcaagcgggcctcagccatggagagcgccattgtagctgtccggacagcctccttggcatcagcctccttgctgatgatctcctgtatggtcgtcacggcagaagagacgtcgctctgagctttatctgccctatccttcagtgcgatggccgactcggatatccgctgcgccttctcctcgaacatggtgctgttcaacctggccacctccagctctttcctcgccttctgaagcaagtccctgagattttctgcatcatcatcacccttctcctcatcaacccagagctgtttgcttcgtcctcggtattatcgactactgagccattggtaccttccaaagggccatcaacataggccagtgagtcatttccctggcacctcagcgccctccctctggtccggagggcaagagggctcccatggtttggagccaagtagaagaggctacgggaaccgcagcctccgagggcggaggcgcccatggggttcccgccgcagacacgatacctgagacgccgcagggagcatgcccggaagccattcccggcggcgccgatctgcaagcccggccgcggggcagtaaacctagacaaatccatccccacgcgccccctgtacgaacacaatatcaacagaaacccaaatcagaaccccggaggaatccaacaaaatgtttggctaaaaaaagtaagcggcattagattagaaacacgggagaaaaaaaaccaatggctgttcgattgaatcgttgatacatcacgctgaacgtccccacaaaaaatgggcgttcatccaatccgaccgaactgatgaagcgggggcggggcttacataccgggattccgggaagacggatggcggggcggaagggacgaaggtttatgaactcggatgcggcagcggaggaggaggagaggggcgtcgtcacgtcaccggagaaggggagaggagccgccgcctcattcccttcccatctctctctgcctctgtttgagtctgtgcgcgactcgcgagctctcactctcaagtctcaaagctgctctaggttggttgtgcagtggaagtctcttgggatttgttagggccgccgcctcttatgttgtgtgtgtgttttggtttggaccggagctgagctgagcggaggagacgaggcagggcaggagagcgatgatgcattcgtgactctgccacctgaaactttctcaaacaaagaaaatctaacccaatatgaaatttgtgtagtaggaggattccttctcttcggattttacgggatattcctctcctctcacgtgcgatggaccgatggtacgcccccaagtggatgaatgggccggcgcccctgctgggctgggctggcctttcttaagtacgccttaggatgtgctgcgttcagcatcctcctttctttccttttagaaaatgttgctgtgctgcgttcagcatcctcctttctttccttttagaaaatgttgctgaagtactccagtagatagattagtgtaacttttttttaaaaaaaagatagatcagtccaaattcaaatcgaaaatatcaagacggaggacagcattttgaagttccaggattatcacaaatagacacaaattagaaacacagggatatttcactgaggaataggatataagagatgcatctcatttctgcatctacacttcaaaatggaggcaaagctttaatatggtttggacaagtctggatacatcaactgatgctgtaactacagatttacaataagttacttgctcttccatagagttggctttaacttcaaggtcctccaccttccagatccactatattttacagtctacactgctgccattagcacaatggctaacattagtcccaaaatcgtcttcgataaataacattagtcccaaaatcatcttcgataaatttttagtagattatcagaagatgccaccttcatgcaaagatcagtcaaggcactacattagaaactagtagctagaacgaagcaatacctgaacagaatggaacagcatcaatacctgatcccttcaaaaaaacaaaaggaaaccagtggtgaagtatccactgcttcgaagaacatgatcaccagccttttattgccttcaaggcaatttccctggcttcccttaaagaagatagtg

SEQ ID NO: 52765 - DNA, 2086 bp, Oryza sativa
  unsure (1)..(2086): unsure at all n locations
cttcaaattctctcagaatattaagaatcgtgggataatgagtgacaaaaattaccatgcatttcttctctttcagaagatagtgtaatgtagcataagctatagcagcaccatcatgtgtgcttgtaccacgaccaagctcatcgatgataactagtgaccgagatgagcagttatgcaatatgttggaagcttcactcaactcctcataaaaggtacttgttccatgctgaatactatcggacgcgcccattcgagtataaattccatcaacagcatgcaatgttgctgatgaagctggtacgaaggaaccaacctaaggaaatcagtgtaccaagtgttaggataatctcagagtcagggtaagataacaacaaagtaaacccttacttcctcaggtcctaagcccaacaactaagtttgcagtaactatgttatacatccagaacatgttaacatgagtgaactacaagtgtgagacaatatttatacctgggccatcaatgtaattagagcaacttgacgaatatagcaactctttcctcccatgtttggtcctgtaacaatctgcagtactcactatttgcatgaagctcggtatcatttggaacaaaattgactccaagtagggactccagaacctaaaaaccaacagcatagaaatacaaacattgtcaacataaactaaatgcttcacatgaagtatgcatgaccgtgtgtgatctgccagtagtattggaaatagtgtccgtggcacagtagaatattattttcatattgaccacctgaaataatngtaggtaaaaatctaagctttcaagaaagcatgcagttatcatgacactattctttatagctcttaaaagtgaaacatgcatgcatttcatgcaactactctactcaggccagatataataacgtgttgaacaatggtatggccttggataaacaactttgaccaccagtggccaaaaccccgatcaaattgaaatattacgaaagtacttttcgtgacaaatctgtacacacgacttcccttacaaaacctaggtacctaaatatttgaaaagaccaaaatgcccaaagcacggtagatgtacagccaaaaggaaggagtaattaaaattgaccaatagaactaatcccctcaactgcagtatgagtatctcaaattttcaggttcttctatttgttttcttagggatgcaaaacttgtgaggcagtactgtattacaactaataaaaggaatgcaatgatactgtttgtgatttgcctgttaaaaactgaagttgcattcatattaggaatggagtgggaagtgatccaaaactaaccggatggcggccatcttttatgtgaatctgacttgcttcattctcacgaacaaaatttggtcgtacatatttctggcagatggaatattggttgtttagcaatgtactgttggaacaaagtgaatgtaaaaagatgagcacaaaagggttaagaacagtctattacattttgttttgcgagagtggcaagcgagtataagcagtccagagtggcaagagatttaacagttgcttgaaactgcgcatagtatctgccgaaatccatgaggaagttattccatgttgtcctgcagataactgctagcttttccttagccagcaataaattctccaagtttttcgagacttccggagtgtggtatctaattgttttcttggtgctgtttactttcatccaacttgaaggtacctttctatccaccggtagctgcaggcacaagatatgacatgatgatggtaatattaatcgtataacaaaactgtaaaatattttgctctgtgctacttttctcatggacatcatttgctacttggaactgcaattaacaatagttagaagttaactgaattcaattaagccgacttaacttcaatcaaatgagttgtcccagctactgttttaaactccaagttgcgcacaccaagctgctttcgatactcagtaattaacagctccaatttctgcttggcatttcaacagttgcatgacccttgcaacctataattttttttaaatatgaagacgatgcat

SEQ ID NO: 52766 - DNA, 2113 bp, Oryza sativa
  unsure (1)..(2113): unsure at all n locations
gggattagtctaagcaggatattcatgctgtataatgtcagtttaatgaaataaactagcataattaggtgtcattatcaaattaactagaagtctagaaccgaaaaggaataataaatatttgacctctttcgctgtggctttgcagtggaaaatccttgttattcctctttgtatatcaagagttcctgccagcattctcaaaacggatgaaagaatggtgctcagatcacttctcacagaagatgagcaagacatgtccacttcatcctggagattgttagttgaatattgttgtgatccaattgattcagagatctcagagaccgcgtcatgacgagtacatatttgatttctatcacataaagggtgagtcagctgcaagaaatgtcacaaccaaagacctttaagacaatagtcaagataaacaatagctgtctagttatcacttttcatagtgatatgatgcatcatggattaatattcattccatgaccaggttacagagtcttacccagtgtctaaacaatctggatccaaaagctgtacatgtgttgttcatagtttggaacaatgatccatccaatgaaccatctgagtggttcttcaatacctgaaagcactccaggtgttactttcatatatggaagaatggagtggaaaagtgtattaagaacataggtcataaaaacaaaaagttgacgtgatccatgtgtttctaagaaaagccaactgtaagtctcatattaaataatatatatatatatatattatttaatggataaggggaaattggggcccaaccccccttttttttttttccccctttttttcatatagttaggattcaagatgagacttacagacagtgcagagtaaataaacagaaggtcatatatatgcaaacaaaaaatttactttggcggtgtgtataaaagtctacctcaagttgttgaagagtatttgctgacagagacatttcagtgttagctgtaaatggctgaaatgaagaaccaaagcagattatctgtccataccaaaacccttgagatagcgaacactcaaggccagtgcatggataactagttctggcatagccatgataccctgcttgaaccaaaaagaaaaaaagaaattggaacttactaaactacatatggagacccaatcataaggtgcgatgacagtgagttcagaagaacttaacggtacctcaatcccacgaggattattgttctcctcgttcatctccatcaaatgtctgccattctcaacagttggagcatcaaccccagacttctcaaacaaagagagcagttcagctaaagcaccaccctcactaaaacaaagacgcgaggtgcgctcaacccggacattagaggtaggcccggcatatgccaccatcagctggacaacatgtagaacagaacaaatcaaacagaggggtctcaagcacatcaaaacaggaaggaactttcacacagattgtaagaactttaaacaattctggggggaactcattaaactgtaaggcaaataacccttccaaagttcactataggaataatttgctagaacttaatttggcagagtcaacaagcaatcattctttttttgctgagaaattttaaaatgccgaactattgctgccaaactacccagatgactgtgagtctttccaccaacaatcctaaataagtttccatttagaacaactacaatagctgagaaaacagaccaggtaagttacaacctggaattacttgcagattataacaaatcaggtagcctacaattcgcacatcacaaaccgcacaggtatacctttttcgtggacaggatattggagtcccgaggatgacctcaacgggcgccaagccaagcagcacggnctcaagggcattcctcgagactccgtccatgaactcgccgtgcacaaccttaccggtcgaaacctcgatggccaccaccccgatctttacctcgaaccccttcgtccccatggcgtgcacctccttgttcaccacgcacacgaggtacctgctcccctcgtcgggcgcgccgccgccctccagctccccggccgcggcctcgatagtggcgcgcgtgtaca

SEQ ID NO: 52767 - DNA, 1365 bp, Oryza sativa
gatctttcaacccaaaattgccgcttattattagcactacgcaatgtgttgttgttaccccaagattggaaacccctgaattgccgcctattatgagcaccacgtactgtgttgtttccgcaagatgaactacacaatagtagcgctattagtccgcgtttagtgatgctgctaggtgaagcatttgcattcagccgcaaagtttttagtgacaactgacaagcatgccacatacagacgcacgataatttgcatgtgatggaacactgtaaaaagcttaatcctctctatgttgtcttaaatccaaagcatttttacagttaagagggggagttcctggctagaaaaaaaagctaggcagcctgaagagttacagctacagcatacaacatcaaggcagtaagcatacagagccatgtacaccaacaattagcgtgcagagccaacaaaagatcatctaaaaatacaccaggcaccagctttgcgatgtgatacaaaacaatccaacaaaatacagtcgaaatgcatgtccagctaacagtccaacgatggatccagaatatttttcccaagctaattcatggaaattctctgtgatagaacaaattagtcatgccaagtcgattaggtagttcagcccgttgaagatcccatcaaatagagcctagtgcacactaatctccatctctcatcaccttcacgagctaaccatgttgaactggaacctagacagctgctgcggaatggtggaaatgactggcccatatcgctgcatccacacaaagaaatttcagcaacagtagcaaagtaattgaagaataagcacaacataagacacaaaaaaaactgcatcagaagaataagcaaactctgtgcataagtgatggcctacaaaggaaaggctatacatacaaaattgttcttacaaaagctaatgtggcacattatgattgaacctagattttgcgtaacaccaatctatttttatcaaacttggaaattctgtttgtaagatgtcctaatcatgttgcctcgttaaaaataagtgattatgtgacaactaaggccctgtcaatgacaccaaacaagacgaagatcagggaagtaatctaaatacaagagatggatcctttcttttagaaaccaacttaatatagggatccttcccttctgtataagtatgattttaagtggaaatagaaaaaagaaagaatgaagcaaaataaattgataatatggaaatgcttcctaatgaaacagaaagaaactataaccactggtacatagttcataacgcctcacagatgggaaaaatattctcaaacttcaagaattctaattgtactataggatgagttagattac

SEQ ID NO: 52768 - DNA, 2196 bp, Oryza sativa
caaaccataccataacctacacatgtacttgaatggcacataaaaacaaagggcatacataaagaaaactagccctgtgactaagaggtatacaagacaatgagctgaccattgaagcttcagattacaactttgtgcacataatcacctatgccacaatatgacacacataaactcagtaacattctaatatgtgtgcctgaaataagaaatgagtaacaaataatacagatattgcaaatcaataggtaaaggattgccgaaacaacagttgagttttctctttcttctagatcaatattaaggcaaccgatacaaatcagaaatagctatgaaatttaagacgccatgtggataaccttcattaataccggattaactatgaatcacatgcaaaatgtcaccagatataacttaaattcaaaggaggtgcatctaaatttctcttgagctcattacctgccagttaggtggaaaggaaggcgagttcactgcaagcttactgcataactttcttttcagaccctcaatttctgcaaattccagtagcagaaccaacagctaaatacattatattacaatttatgaagaaactgccgggttttaaaaaagagctatacattccccccattttctccaggtttcaaacgtccaccaggaagcttgcaaaatgtatttccaatttgcatcaccagtatgtgggtatggttgtgttcttgcacctatttaggtcaatgcaagcaaagatttcagtttgtttgacacactgcagtttatatggactagtagtaatacctacacaaaatttgacaactgttggatatttcaaacacaaaattgtgtacataaataatgtgaagaaagtataaacacaccaataggattgcttcaacactggtccgcattccttctttcatgtagctgtcattacagaagcaacttgtaattaacttgcattattggacagataatcttagaaaggaatatactgaggaaggagcctagctgttcataagttacatcggaaacaaagtagatatatgtaattaacacaacaatgcatcgcaatcaactgaagaaacagaaaaaaaattccagtgtcatactattttggcttgacattccgggtattcttctgacaaacgtaaattatcttgtaaaactattcatgacatagtgcttggcagctagatcaacagcgtgagaggaaaaatacatgagcaaataaatagatggtcgtggcattttagctataattcaagtcaacacccaacgaatcacccaccattataagccatgtaactaaaacaatttcccatatcaacatacggatcaaaataagtgcccacgatgaccatctgaacactagggtggcataaacagtcagaacacaagtgtttagtcttaaatcccagttaaaatgtaacggcttaagcaagcatagttcacaaaaaaaatgcctaatacactcctgtttcagtactatctaatttaagcagaccttggacctgttcaaaccgaaggggggaaaaaagcgggcatgatctgagctctagggtttagggttccggggagaagaagaaacctagcgtcagatcagggaggggtttgggggcggggacacttacttgaccttcatgcgggcgaggcggtcggcgacggaggtgtccttctccatcttgggctccttggtgccgaacgtgtagttggcgagcgggtacacgttcaccaccggcgacgaagagctcaccattttcccctcaccctctcctcgcgttccctgcccccacctagggagagctctcctccctccctcttgtcgcgctctgccccgagcggtctccggagtaggtagtcggcggggtgtcggcgtcgtatagtatacacagagatagacagagagagagagagagagggtggctggtgcttgggcccttgggtcgtcggcccggttaggtgagggggcgtggcgttgaaaagcgtctcgaccaggctcggctcgcgtttgggttttggttcggtcgcttttgcctgcgtttatagcgtagcctgtgtgttgggtatttgggtggtgagacgcggggtgcggctgatagtaccgtccgatcgggtccatctcgaaggtaaaggtgtcgctgaggtataaatacaaagtccattgcctcaccggcacgctctcaagtacttcgttttttt

SEQ ID NO: 52769 - DNA, 1509 bp, Oryza sativa
ccccccgcccttgccgacgccggccaatggagttgccccgactgctccggggactccacagacgccccgcccccggccccggcaccgctggcccctgggagtgccggccaactcgtcgccgacatccgcgccatcgagtgcgacgccaccctctccgaccaggaaaaggcacgccgccgccaggagcttctcggcggcgccgcgcccgccggtgccgacgccaatgatgacgagggggacgacgtcctccaggtcatcggcaagaacttcagctgcgccttctgcatgaagctgcccgaacgccccgtcaccgtcagtactcttgcggggcctttcccccattcttcctcttactacttgctttgcttatatgtacgatgatttatcttaacgctagggtgatgatgggggctatcctatcccctctcttcacacatttatattcattacttacattagagttgtatcatccctgattatccgtcaatcttattttgagtggacgctggcatttattcttttctgttggttcaatttgcatttcctgttatcgtttaaggttcctaactagtgaaatgaccatgtccaatttctacatgatattgtttgcttttgctactcatttcttatatttcttatttacgctaccatttgaattccaataacggaacaagtcttctaaaaaggcacccacataacctgcttaggtgctaggcttacatcctcccaccagaccactcttaactgattatcatgaaccagatcatcgatgttacgcacctcgtagagtgatgcttacatttctttatttctattaattgagactgcaatgcttgttacaattcaagtttaacttgttgaacacatcgattgcatgccctttctagatgataattgtttgctttggtaatgccaactggtatgtcactcctaattttcaccacatgcacacatttactatgcctagatatgtttgttttagctcataccaaatcccccgtacaattctgataatgcaaacagtattctaaaaagcaatccacgtaacctgcctaggctctaggattaggcttacaccgtcctgccttgccagcctagctcattacatcacccaagcggctgcctaatcagtcactagacatttgtatgtggtacagctagcttctattgccatcacatgcttgttcttctggattgatgcaataccttgcattgttaaaagtgctgtcttgttcttttggggtattggtttaaccttccagtttctgcacataattcttattttgatccatgcattgtaggtaggtaaaagttcttgctattctgtcaattcattggacccttttttttttgggtagcgtttctaaccatcagattctacttttgtcttgggcagacaccatgtggccataacttttgcttgaagtgcttccagaaatggatccacagcggaaaaaggacatgtggtaaatgccgggcacaaataccagcaaaaatggcagagcagcc

SEQ ID NO: 52770 - DNA, 3855 bp, Oryza sativa
  unsure (1)..(3855): unsure at all n locations
acgtacatttgaagttctcgtctttgaaggtccggccatatatgcttttccctccagtaccctgaaatattcattttttgaaacctactttatccacatgcagaagttgaaagctgaatgatttgatgtaagctaggtcaaaaattcataattcatgaaaccaggcagctgcatgatttaatttaagccatcaatttaaagaaaaaggatttggtgctaatctccttgtaatctagccatgaagtcaataatcactgcatacacattatgctgatcacaaactaccaattcatactcataatgtacatgatgcaaagcagtataatgatctaaaacaccatagggcaagcactgaagtgcataacacaaagttgtataatgatccaaaacacatatataggtcagctttctatccaaaacagcataaagcgctaacattgataaaacaaatcaaacttttttttttttggagaaatagttggctcaatggtgatagatagaaacaaacacatgagctcattcagtgttgtgagtaatgttacactatgtgactttttccaatagagtttgtcagatgaaacagaggaacaagtgcaacataggagtagattataaagaaagtaaataatgaagacatacgttgcccttgtcaaagtctcctnnnnnnnnnnnnnnnnnnnnnnnnnnnnnnnnnnnnnnnnaccccttgtaaccaaaccctttttctcctgaaaaggaaaagggcaatggtatgtgtatcatgcaccaaatctgggtaatcctgtaaagtagtagatgacagaagagaagaaaagcaagaagccctttgtaccagtgcaaagagcacggaagttctctgcggtctggggaacatcatccccgtataggccaataacgaccctcccaacgttcttcccaacagggtttccgatgcttatgtcaaagtacaccttgtttgtgattttggactggaggtccacttcctgcaatgtatgggagaagtttagcaaaactgaaagaataaatttgaagcgtggtatccagttctcccacatagggtaagaataatcgatacttgcgctgttcttttatgtatgatgttaattgaactaaccaacgtcatatattaaaggaaggaggtagtatatcgtaagttaacatctagtggaggaaaacatgaaagcgcatagtgcacatgggaaaggaaaacccagctttcagtagtacagaagggcacacgtgttttctcacaatggtgcaggcagtcactgatgatgaataacgtgtttacattcggtgcacatacaaggtaagacctgtaagtagcagaaccctatggtcgaggcaactaaaattattaatcagagcaggtgaatacataataaagcattggtgatgataagcctgaaactgcaattttggtagcataaatttcacctggtgatttaaaaatctgataacaaaatttgacatacaaaggcattactagtattagttttaatttaatggtgttggaaggtcgaggtcatctgtgctaacccaatatctcttccttcaaagaggcaacaaacaggggccggtattgcggaggctgattgcataataatagtccagtaaggtggagtagtaatttgactgatatactactagacaggattacaagaatggatgcggtgcggcaatagaaagatatatgtagggcagataaaagaagaagatccggggacacagtaccttggggtcagcggtggcggaggagacgaagcgcgcgcggctgtgagcagcggaaagcgcaggagtgaaacctccaaagacggccgatgaggggaggcgtgcggtgccggtgccggtgcggatggagaggagcggcgagggggttttggaggcgaggagggcccgctccgccgccggccgcgcgatggcctgcagtgcaaacacaagagaagaaagagcgacgataataagattgagagctcggtggggaagaagaggagagcagaggccatggatgagtgagcttacgagtgtggcgaaggaggttgcgaccgccattgttgatgttgaggaggagaccctttctctctctctcgctcaggtggattgggattggataggtagatagggcattgcactgggatgaatggatggcatttttgcatatgtgtgcacaggaaatacaataatcacacacaccttcttcattgggggaagtactatattttatttttgggaccaaaagcatctgttaaatcaactctatttgtcccaatccaactatttaaaaattatttatttacagcgtctctttctataatatatcnggaagttatcaattattatacaatataccatcggactatactattttcaaaaatacctaagatacaccatattagggttattatttgatttatcctaccataagtttcagaagaaaaaaaatgctagtttatgcactagttttaagattttacatttttatatttttttaaaaaacattatttatccattatatacggcaagaattttttttgtgctgtttttaatgtaacttttttcgagaacatacctcatttctaatgtaaattatcttttgcgtaagtaatttctctctcataaaaaactcaaaaatattttttttaaaaaagtgaaaacttgaaatttatatataaactttcatgttgggtaagtaagctacataaacaattcatatttttaaacccttagatgaataaattaattgttaaccttatatgtattttgagtattttttaaaactaggacctgagtaaatatttttcttgagttttaggttataagacttcacattcatatatgtctagatctattaacacatatataaatatggccaatgctaaaaaataagaataggaggtggtattattttttttttggtagagaggggaggggcccgcataggaggcaggaggtagtaaaatgggctgatgggcatagtattcacgggggcccatgtaatagatgggatgggcttgaacacacatgtaatgtaccaatagcctcggtcgaggtgaggtggaagaagcaaagcaatctccgtgagcggtgatggcgcaacagtggcgatctctcctcttcctcctcctcctcctcctcgtgcccttcgccgccgccgccgggcaggatgcgccgttcgtggtagcacagaagaaggttgcgctgtcccgcccgggtccaggcgtggagcgcctcgccgtcaccctcaacctctacaaccagggttccgcgtcagtcccctccccatctcatctccctcttcccccagatttagatccacatctctctctccctctcttcactttgttaacctattattgctctatccgcctttccttattgattaattcgcataggtcaaaaacaacgggaattcctactgttagctagacttgatagatagccgcgagcccatgtttccctttctctgtgtaataatgtcaagctgactcacttgttgataacacaaattatcacgctactattgtgcatatatactactcctacatgacatgacatgattgatagtcacatacacacacatcaatcgctaatccatttctccatctatctaaccacactgctattttagggaaggggaaccggaatcctcattatgggggtgtttacatccagggttgtaaagttttggcgtttccgggtattatataggatgtcgcattgggtgttcggacactaataaaaaaactaattacagaatccatcaataaaccgcgagacgaatttattaagcctaattaatccatcattagcaaatgtttactgtagcaccacattgtcaaatcatagagcaattag

SEQ ID NO: 52771 - DNA, 3896 bp, Oryza sativa
cgaatttcagcacggacgttgaggaaaacccagcaatcttgcagggtgtgtttcttagttttgtggataggacaccaagaccttgtggcttcggaagtcatctttgtcggctcgtggttcatatcggaaggacaaggtttggccgtatcagaatccttttgagcttggatgtcgtcaatattccgttctccgtctcgacgggaggatttttcgacatggaatcgccttggttcgtagccactgcgttctcgtctccggtcattggaggaccggttgagatcggcgtcgtggtgtaaatcgggaagatgatttcgccgacttgagtccataccagcattgttgaagcagggagtacttggctgaggctggtgctgacgttgttgtcaacgaagctggatgacatagtagtagaaccttgagtaccaaggccccctacctggcgcgccactgtcgacgggtgatacccgtagaccggatatagaaggtattagggtacgttggtacaaggatctacgtagtacgacatcaagcaaacaaaagataagaattatactagttcaggccccttgataggtaatagccctaatccagttgatgtgggattatatggtagaaaacacaggttacaaagagaacaagggaacttgtcggatccggcgagattgtagtcgagttgattcgactagctctcgatgagttggctcctcgtaagctccggcttcgtaggctgtggaggttgtgttggctttgagattcgatgtctaaaccccctctcggggggccccttttatatcgcagatgtggaggtctcctcatagaactcggaggtatcagaccctatacgatacgccaacgacccagttctgcccgagtaggattcttcccatctatagattccgtgaaaggtttccttagaatatacaggaaatatccgtatgcgcgtgggtatgccatatcaatatgtaacgtatatcgaagggcaaagggtatacctaacccgtaaccctgacaatatgtttttagtgttttaaaacctaaattgtaaaataaattacgatgagaaaaacatcaaacttatttttttaaaaattcaaattttggcaatagcgtaaaggctaatctctccgttcaaaaatatagcaaccaaatattcaatgggacataacctaatactatatatttgaatagtcttttttaaatgtattaataatataaaaaaaacaacaaatttgaatagtctgataattacatgcgccaaagagcaagttgggccagaatgacaagaatgaattggtgatatggatcgctgccaatcataatgggccaatcttttcctcggcctactaaaccagaccggccgtatttttctgggccagtggtaacgtgccctgccatttgtacagcttatccgtctccatctgggccgatgaaatcacatccaacggttcacataaaaaacaaagatgtcatctcccccgcttccggagctcgccggagctccgtcgcgcgcaaacgacgacgagaacacgaggtggtgagagacacccggttcagagacttcgcagcaaccgcgttttccggcgagcttgtcgcccgtcaaggacaaaaatcagtagctctgttttgatcaatgtacactcgaatcacaaattgataggtaaaataattcagaaacagcatatacagtgcagaaataaaacagtaatttgatatcaacccgctacaaaaacacactcattacttgcaccaagcaaacgactgcagattaaactggcagaacaagcaggcacccaacgttactcatctgcaccattgattacttgagtaccgcgaaacctccaagtccggcgacgacaacgattggcacgacggaggcccagacgtcgagcttcccaacgcctcgccgccggtcgctcggggaagcagagacccagcagccgacgcccacctcccgcgcgccgaacacggcaacggcgagcagcatcacgtaataggcgtcgaagagcgccttgctgcgaacgaacacgccgcccggcgacctgaaaagggcgaggacgagcgccgcggcgaccttgccagcgccgccgcccaccagcgcgcgccgcagcttcttatcggcgtcgatgatctgctcggtggccaatgcggtgggcatcgcgacggtgacgaaatcggccattgctcgatcgatcgactcgatggtgcgtgtggtgactgacaaagtgacaaaaaagaaggtgatgagcttggatatgaagtggatgcgatgcgacgaggacgaagaagagatcgccagtatttatacaagcgagccgcgtggcggtggaagtggcgttcagacatcaacagcccgagcccggttgagcccgagagcccgcgacgagccgacgactgatgcatgtgctggaaactggacgattcactcgtcagagtctcagcaaagatgactccaatataaaataactaacaagaaagacgacgcagagatgccgagttgctaacccccgagcccgagcccgagcccgcgttaactagtacgaaaagctggtcgtgagatcaagagaagaaagcattatcatttgtcaacgaaagggaaatttgcaaggaatcgtcgtcttggtagcagacatgggcccggagcccgaatcccaccatgggaagcaacgactggacataaactgcataatactatatgattaattataccacttcgccttgagaactgggatttagtttaattatcacggtgataagcgccaggtagttataatcaggcagaacctccgccggggacgatggaataagtagctagctctgaccatctccgaccatctgcagcctgcaattctgctatgatatcctcactgcaatcccactgtttctttatattattttttcgattaatatatggtccttcccttctctattgctcccagtttcatattataagtcgttcagctattttcttaatcacattgtctttaagttatttatagagaaatatagtaaaattttaacccataacaaatatattatcaaaacatatttaatattagatttagtaaagcttatttggtgtgtaaatgctgttagatttttttataaactaaataaaacttaaagaattttgattaagataaaagtcaaatcgacttacaatataaaacagagggagtgataagtgctacacagcaaagctttttttcttttctaaaaaagtaatataacattttttttatttattcttgtagcgccacgtatacgtcttatgagacgagtactaagtgaacatgttacataggtaaccgccgttcaaaccatagagggatatgatttcaacctccggggacatggtttgaacgggttttttgtaggtgtaggatgctctacatctaattttaggattaagggatatgagtgaatatgtaaaataagtttttcccagtccaaaacacaatggggccttcataggatgaatccttttcctccggtgaaataaccgagacactagtgccacattttgctgggcacatacggctgcgtcacaagcgattgggcatatggtcgtcgttgccgtggagcaggagcctcacaggcaacagtgcatggtgacgatggtttaacaatttttgacagaaatggaaaagtattagtttagcataaaattaaactattaccggtccaatgatcgagtagcagcggatcaagacggtgacgtcagaaaggcctaccacagggggaaatttttttatttatacatttttttattaaaatatttacaaaaataatttttttttgacaatttacaaatctaatcgcctcccgccctttggcagggtgattttccagagggcggcaagggacctaaatgtaaaatttttatttgtgttcaaacc

SEQ ID NO: 52772 - DNA, 805 bp, Oryza sativa
gtccaaacatctactagtaatggcgttgtcagccagtaagttcatcagttcatctggcctgaatttcctagaactcgctctaatgatcaagttccaaagagaagaagaagatcttgagatttcttttttgtttgtttgtttgttatgttgaaaaccttcacttgtaagtaaagagagtatttggcaatggcagtggcattgtgggtgtagtggtatagtgcggtgagacagattgtagaggagtttgttgttgctggattcctcaaagacccacttgcttaggagctcctcaagtaatgtacttgcttaagcttcaattcacaccactatcttctgtatagtcgaaactaggataagttaaactaacatatattcagttcttgcttttctctgaggtgtgagagaaatgaaaagggtggccttactcgtgccggcccaattaaacttttaagtggatcgtctacttgacaagtgtcaattggaaattttgcaagtatatatgttatatagattgactttagcctttaggcgtttgctgaatggagtgcaaacatgtttccgaattttcgcttatgaatcaccaaatttcattttgtcatgtagaatataggtatgacttaatgactgactaaactcttgaaacccggagctatgtctgaagaaatggttgtaattaactaacatattgacaatgacaaagaaccaaaccttcctttccttctctcctttgtttatcatctcactctttcctttctcattaactacaaactgctttacaaaagcatagcgtcaatgccaaccaagc

SEQ ID NO: 52773 - DNA, 1991 bp, Oryza sativa
  unsure (1)..(1991): unsure at all n locations
ttggaccagctttatcttgtttcctttgacacggacctttatttttccatactgaaccatacagctaccatcctccccaagtgtctcgacaacactagccatacttcctcctcccagcccctcaacgtacactttatctccgatttcaggaacatatgagctctcattttcttcatcaccgaaggtaaaatcagttggctggtgagtagcagccaatgaagcagtggcagcttctgcttttctcattagtgaattgtactgttcaagttctgaattcttgagttgagattcaaagttcttgattatttggtccatctgagacttcacaaactgtaactcttggggcaccttttcagactctgttgcccttaaagctgctactcgactatccaggtcatcatcttcagagcgaatcttcatatcaaaatattattaagtaagatttcaagtgaaatcatcaaagaggatccttctcataatactgtggaaaagtcaaaagcagatcaatagagtaaaagagatgaacctcattgtacagtctctcaacgtctgaaagaacagatgctgcttcatttgcctgagactccagaagttttctttcatctagcaaagaaccatagagtaaaccttggcgttccttttgtttgtcaggcaaaagtttctcaacccattcttgtgcacgagcaagcactttctgatcaaaaccaatggacttggcaatactcaatgcatttgaattaccagtactgccccataagatctgatatgttggttgcagagtttccaaacaaaattccattgcagcattctcaaatcgatcgtcaacagctttcaaacgacttagatcagcataatgagttgtcacaatggccagattaagcctactagcaagatacttcaagatgcttgttgaaagggctacaccgtctgacggatccgtaccactgccgatctcatcaataagaaccagagaatcttttgacacaacttgtacaatcttgcgaagacgtgatatgtgcccactgaaagtagagaggctatgctccagcgacttcaatccagaaaagagtttgcatncaataagcatccccanaatttttggggaatttttttaaagggggaaagggggaaaaaaaaacttctcttcaaaagacagagactacctggtgatctccgatatctgcaagaacttgatcgaaccatggaagcctaggggttcctttggctgggaagaacattccagcctttgacatcagagaggccaaccccaacgtcttatggtggcagttttgcctccagtgttgggtccagagatcacaattatcctagtatcgtttctcacctgcatgtccagaggaataggcattggagagacaagatgttcatcagaaagctgtcctttccctactctggttgattcttttaccatactaagagactgttcaagaagtaaaggatgctgaatgccctcgataaaaactgagcattcactatttggattcagttgagtatcactatccctgtcagtaaaggctggcctcacagcatttatccataaagcgtatgaacctctggcacaagccaggtcaagttccaatattttccccatcaaatgcttgatcttcatttcggagtcagctatgcttgaagtaagtagacccaatattgctaattcttcagctctttcatcacctgagagctttacttccatgttgttcagcctgatggcgtcccttggctccataaaatatgttgcgccagagccactggaactcaaaacaattccaccaggaaccagatgcttgtgtgaagctttaacaccgacacacatcctagaacggcgcttagtgacaacagggctatcaatcccaccaccctggaagatctttgtggatgtatctctcaacagagattctaacatatcaatgttcttccccctctccttgcggattgttgctagtttatcgctggcccgatcaaggaccacagaa

SEQ ID NO: 52774 - DNA, 1034 bp, Oryza sativa
tgctagctctctttcggtgcaagaagttgattgcctgcagtcaccattgctggtccacacaatcgactgtgtgcatactatgcagagacctggaagcgttataagaacaattgtatcatttggatgtaattgaccgagttcaatgaaaactttacccttccctcctgtgccattctatactactatacactgcctgcctaaacatagtggttttgacagtgtcctttctctcatgctgtcacgttcgatagccatgcgatgcagccccgtctgtagacacatcttcataaaattgaggtgtctgtttgctctcctcgtaccatgcatgtcgagtacgcttcttggccttgctgaatgcgatgtttttcttctctccttgatctgtcgcctgttgctggactcccaagccaccaagtggcaaaaaggatttgcaatctcagctcctatttttacacgatcttggctggcagaaaggatgatatgataatatgatatgctcactctgaatattcagtgcatcttactactatctcatttctgcagttacagctttgctacgttatggcctctgaagagggttgcgtgtgcagtgtgctacaacaaactgaactgtctgaactacgatgttataatcaagagtgtgactgaggctgtgtttagttcagcgcaaagtttagattttggttgaaattgaagatgatgtgactgaaaagttgtgtgtatatgacaggttgatgtgatggaaaagaactgaagtttggatctaaattttagatctaaacacagcctgaatcttttctcttctttggaagctgtctgaatcttgaattgcacgtgaacattattagctgtaaggctcctttcgtttcacccatttctgatacgttgagattaacgttaagagtgggtcccttgatttgcaaaccatatatgcagaattggaattggattcgatcgatcctaccaaaaattgtggtgtctcatgagattaaccatggctgccatgcaagcagcaggaccatggtgtgatagta

SEQ ID NO: 52775 - DNA, 2377 bp, Oryza sativa
tcacactccccaaacaaccaacccacctccatctccatctccatgtggtgctgaggccgagcagcagcgaggaatcggagcggtagccatggcgccgtgaattcgcgcgaggacgtgcgatctctgagagaggggggagtgtagtgctcgagtgagtgattcggaggcggtgctgcagctgcggcggcgttcggagatgaggcattgttggggcggtgcttcctccgtcctccggctcctcctcgcgttgcagtgcggggtggtggtggtggtgttgcagtgctcggcgaatgcgttgggcagtgacggtgagtgttgtcgcttgcgcggttgcgccgtgtatgtgtgttcttccactgacttggtgtttttctttcctgttttttttggtcggattttagggagttttgtttgaattcgtggtgttttttctaattatgcactgcctgtgaattccatttctgggagacgttttacgggttttttttttacatttttttaccgagtttgaaatggctgttcagatttttggttctgatctatcttcttcgaaatttccacctgttactcggtggaggcgatgcaaatttcgagatttatccgcgaaatttcgtgcctaaaactcgaattccacctccatttgtagggtgcatttctgatctgtgaccaacggttttgttgtgtctcgtacactctcgttctgttcctccatgagaaatgtggcgttctgctcacacgcgctttgctacgccttgtgctagtctcggcgctcatcgcgttcaagcgcgcaatcatcgaggacccccggtcggcgctcgcggactggagcgatgcggacgggaacgcctgcgactggcacggggtgatctgctcctcgccgcagggctccgtgatctccctgtaagaaaccccccccccccccttgcacctgcactcagctagatctcactaatgtttcacctactgctttactagttactactgtggtacttactagccggtaatatcaaatcctgttcaacattactgtgtacataaagtggggagggaaaagagtttgttatggtgatttattaatgtttacattagcaggtactacaattttgtaggtgaagacttgtttgatactataagcactgccactagcttatcgttggagctgtacaatgctgtatatgtttgacatagacgcatattgcatgtgcaaacagctggaaataatggagtatgatgtgccatttagatatgtagtcagtagattttgtttgcaatgaaacgccaactaaaacccgtacttgcgtgatcagtcaaaatccttctgggatggaatttcttctcatgtgtcatgactcgatgattccgcaccttgcaggaagctgtcaaactcgtcgctgaagggatttatcgcgcctgaacttggacagctgagcttcttgcaagagctgtatgttctgttttattgttttttcaactggttatgatgaattagcttcaaggtttctgaaggtctcctttttgggcaggtatttggatcgcaacatgctttttgggacaattccgaaacagctaggttcactgaggaaccttagggtcttggatttgggtgttaataggcttactggtcctatacctcctgagctggctggattgagcagcgtaagcgtaatgtaagatgccaattgatttgcttatatattcagggttttcctgtctctggtgcttctttgctattgaaactaaggctgctttcattcatctgctgtagaaactttcattccaatgggttgactgggaatataccttcagagctgggcaagctacagaatcttgttcagctgaggttggacagaaatagactgaaaggatcaattcctggaagcaatggttctggtttttctcctacggccaatagtgggttggtgacttctccttactccatttttatttgatgatcaagactgtagatgcattttctatatatattaaaccataaaaatgtcacttaattcccttcaggttcctgtgctcttgtattctatgtctatatttctggatatccatgccatagtcaaaccattttattcatgaactgaacaccgcagctatgatatcatggcgattgtatttgtgtgtccctcttaaaaaacattcgttcttacatactagttaatttggcagtaaattttggtgacagtaaaaaggataagactaggtatcaagtggtggttacttaaggccccatcgtttggctttttccctaataagccaaaacggaataaaattaaatttgtaggtaaaacttttatatgtgtgttcttggtgacttaaaagccaatgctgaaaaaaaaaactacgttgaaaataactcaaaatcaat

SEQ ID NO: 52776 - DNA, 2436 bp, Oryza sativa
gtatgctactagttatctccaaattgatgctaataagaattatttattcagtcatctagtcacatcacagtgtttccataattgcaacaaacttatctgtaactgcagagaacttggtgatatccatgtttctgcaagggaaggagcaattgatgacataccaacattggctgctggggtagatgtcaacatgagaggtttgtgttctgaactgttcacgattatgttctctttgtagcatacacaacgtcgcaaatgtcaatgttagctgaactagatgttttatgaacctcatcgaatcgaataagtcgttggcaaaaaagatgttggtgtattagtgaaaggagatatatcttgtactgcctatacggtttacactgtttagtttgtttgtgttgaacatcaatgtaggctaaaaaaatgattaccagttctgtaatccatgggcatcctatttctgaatgcacctatcggacttccttatttttgcagatgattgtttctctgtagatattgaaacccttaatagcaaactgatccaccttagtacaagaagtcgacaatcccttgtaatcttctatagaagcatgatgacacagctgaaagctcctccaattgtactgttcaacttcatcttcgtagtttgtgttagggtgttaggatttatttttttacattgaatttagcagcagcggaaaatttgggtgaacgaaatgatttttctaattaatcaatgtgaactagaatttataagttaaatcaatgtaatagatttaactcgaactatattcatattgtacttttgataatatgtatttctggttattaagactttaaggggttccccaaggtttaaattttttttttttgggggccccccccctctgatgtgggcacacattggaattttcccgggtccaccatcttgttgtgccctatcaaaaacatgttatatattccatcggaaagtataaacgcacaaatgtcatattacttacgcgtgtagtacccatatgtacacgttcatattgtttgccataatttacaggttatatcatgataattcgtgtgacatagggaacagtttatatataccgccttggctaaatttgccacctaagctcatcgtggatattggtgccaatgtcatcgtagtcatagggatcatccatgtaaacaatattggagaaagataggtagtggttcagcatctcttatagtgacaacttgttgtccttgttatcatcagcctatgtcattatcatatttgccaaaaaaaaagggagtttatagtggttatcaattaaatagtgaaaattgcttactagttatatttggtatggttaggcagtcaccttcatcaaaagctttgcatgtgatttagcatatgaaaactctcccgagatgaggctctggattactggacgtgcttcttccactggcaaatagctgaaaaggggaaaggtggagtaaaaaagggttatcttgcaaatattcactacacaaagtggtgctattttcttctgtgtcaagtattacccgtcattgttagaatcgagctctcgaaacttcttctcagcttcagcacaactagtatcatcatcagcactatgctctacaatggagttgtggtcgatcatgtgaaactgactgataaactcatccaaacttaatttcccgtctctatcgtgatccattccactgtattccatgcatccatgcagatgaaaaagataaatcaaatacatcaatttatcatattagtggaccgtaattagcaacattataagtatatgcaagtgtttggacactgcttgccttaatttatccttcaacagccataatttcactttctcctggctgctatcttctggatgcaagaagctatagtatatatgcaacacacatagaccaagggttaggagagtttaatctattgaatttccgatgtactcaacaatctaaaaaaaggttcagaaatgagtgtggtactcgttgagctctatgaagtccatggcgccgctatgatctctatccgcgcttatgaacttatgcagccaccatcctggttcgccgtgctccgtgtcggtccaatctatgcagttaataactcataacccaatgaaattgttaacgcttaaatttggcactagtttagatttatagcaagttcaaaccaaatatgaaaaataccaaagctttcccgtgaagactggtctgaccgccaatgtatagccggttagaccaaacaataaactacggtcagaccacgtatgtctgggcggtcagaccttcagcacatagttcgaatcgaattgagttttttcatttttctttccttaatcttagggttttcttgattgtaaagctttccaaacgtgaaaaagagtcatgtaaacgtaagatcacccctcctataactatagaggctaaggc

SEQ ID NO: 52777 - DNA, 3703 bp, Oryza sativa
  unsure (1)..(3703): unsure at all n locations
gttgcatttgtagcagcgagctccgaggatgacgcattgtctcggaaaccgatggaaaaccacaccgtgcaaccctccacgccatggtcgccatgtgctccgcgtgttttgattttgcgtgtttcttgagcagaaaatgcgtgccgccccagacgacaagctcgtgttttttttccccgttgggcttggcccattacgagccctcctataggctcggtgggctaaatagagcgtagagcccatgcaaaattcatctgtacatgtccgatgggtacgcgtatgcctgtagagtgtagagtagggataaaaacagagcggatacgggcggataatgctcataccatgttcgtttttatattttttgccatatatagaaacaaatacggataattttgaatatgaataagaattgaatatgatcggacacgaatacggaaataatttttttctcggaacacgaaaaccaactcaacttcttatagaaacaaatatcaacatatataattagctcattttatataaaatgtaatataatttataaatatattataaaaaggtaaataatattaatagtgtgaactagtgttaagatatgaactactgttaaaatctaaaaaagctatattaaaggtcatagatttataaaaaaataaggtatgtctcatggcttctgtagatatccgaataacactgttcactggatatccgaattattatccgtatccgatagaaaccccgataccatattcgtatccgtatccatgagaaaatattcgtattcgtatccgaactatctgggaattatccgatctgaaaggtatccatattcgttcttattcagagcatacagaaactatccgctccgtttttatcccactgtaaagtatggggtcgcgtcaacgagatactacttggctctaaagaagcaatagagttacagtcatttgaaagagctaccgagggacaggcgaataatttgaaagagaatatacatatttcaactttgaataccaacgatacaacatgtagtatatgtaagaaataccatggcctgctcacaagacctagtctaagtcaacactatactatgcatagaggtcaccccatcattatctatcagtatgtgatgtaaagtactaatcagatatactcccattgtttcatgttgtaagatgttttttttatcaaatatagtaatatttatattaccaaattagttttatttaattaatagttaaatatatttttataataaacttaccatgattcgaaaatattactatttttcctataaacttgaaacagtttgtctttaactaaagtcaaaacatcttataacctgaaacggagggagtatattactatctccatatcattttaagtgtagttgtaggttttggtgtccaacgtttaaccgtccatcttatttcaaaaatttatgaaaaaataaaaaaaatagtcatgtactattcatgttttatcatatagtaataacaataaaaatactaatcataaatttctcaaataaacctgtagttttcaaataaaacggatgatgaaacgttagatataaacctgtaaaactatagtctttttgaaagaggggtagtactaatagtatgtttatgcaacatttgtagttttgtactaccaacttgcctcctgcactagcctagctcacccatcccatcctcgagccaacgcaacaatctctgttagtgaaggccgaaagacagggacacctttcttgtattcctccgaaacctttacttgctcttgcaaaagaaaaagaaaaagacattttattttccatgtaccttcaccgtaattaacgtgtaccactacatgcatgcagtgacgacagtcagtagcgtgctccacgaactgcacccacacgattggtcgattcatttgaccagaacgggcaacccatcggccgcgaacagtataccaaatccagccatattaattaaatctcgctcttaattgcgaagcttactccattgaccgtggttaatgatccagtcttcaccaaaccgtttcatccattctcttttctggatttaaatctaagcgaaatcttttgaaacaccatcaaatcttggacaaaaatttgtgcgaaatctgtgaagttggtaaagttttccaggttnctttttcccccttgggggccttttttttccccccccccaaaaaactcttctttttacgcagncgcagcaagcaaaagccaaaaaaaaaaaagaaaagctagctgcacacactgacaagctcatcactccaccagccagcttgagctcgcccacttccgctcacaagaagcacaaccgcgagctaccacagcatcggatcgagggcgagcggcggcggaggcggcggaatgggagggccactcggcgccatcataggcaggcacccggcggcggcgggcggcggcgggggggatgagctgggaggtgtcggcggcggcggcggcggggatggcatcattcggcacaaccggaggtgccgggatttggccttcctcgtgctcttcgcggccttctgggtcgccatgatcgtcaactccagcttcggattcaaccagggcaacccactcaggtgaggtgacccgtgacccacccactcgccttcacctctcctctcctcaagattcgccgatctgtgctgtcggtgctgtttaatttcggttccctgtagctagatgctaagagcgttcatccggggaacttttcctttgctgggtggtgattaatgccgcggtacattttgagctgttcttcagacagcaacaatttaccaagaacggagcattttcaggtgttacgggctatgttccttgttggatgtgtttgggtgtttagtgcataccttcgcattcttgttggctcatttttttcgcgcggatcctggtcaattcttcaacttgatgtgttattttcaggctttcagtctaattgaactgacatagagtgagaaaatgagggtgccacttgctactatggaacattcagatgacttttttttaggctattaaatactttaatagcagatcttgcttatttcggaatgaaacttctagctcccgactttgttatttgtactctgaatcgaataatctttgcttgctttgtttcaacctcccaaccggataggtaaagaatcccatttttgctttgcaggagaaaaatgtgcctttagtggttactcttatatattagagttgtgtggtccttggaattgtattccctccgaaaaaaaacttacagcccagttatacaggatntgtgctccctaaaggcaattcacactacggttatatattaatagaaaccaaaacccactactgagtgctgaccaaaagaaaatttgtttagggataaaactcagtgctgtgcaacttttgcatggctatcattttactattattcagacactatgatgagtaaccatactactcctatttagtacatgctgcatgtgtatctaagtaatacagatgtcttatattgttttgatgacacaggcttacttatgaactagactacaaagggaacatttgtggcagtaggcatggtgacccggatttgcatgagcttgatgttagatattggatgaacccaaaccaggtgcaccacagtggggtcaaggacaacaagattaaccttgctgatgccaaagccatctgcctgatggagtgtga

SEQ ID NO: 52778 - DNA, 1329 bp, Oryza sativa
cggtccaaccagccgtcgacctaccaaatttcttcctggtaatttcttcatacgccgccaacgccatctgtccgtacgctgctgctgccgccgtcttctccctacacacggtggagccgctttcctatccccttcacgacgctgtctccctctccgtcggtacgccctctatcctctcctttcagcaggaacatggtcttttcgcattggaaaagggttttggtaaaaagattttttttttcttcaaaatatggcaaatcatcagtttcatcctttttggggtttaaacctaaacatgcgacgaatttaggggcgggcaaatactcaaattccccacttattatattctagagttcaactgtcccaggccacgatattgattgacgaccgatcagggaaaatttacaaatcgtaatgtttcccctcaagttgtagtaatgacatcacatgtgaatttggtctttgttttatagggataccatggagatgggatttgatgagaaatttgcacttctgaggagcattgcggaggagtgcatatgcgaggatgagctacgcgtattactgaagaagaagcctaatcccatctgctgtgtttggtttgagccaacctccatgatgggcatagagcaggtatagcaacaacaataagaaaaaaggttatgtcggtcttagaaaatatatatctatactacttcctccgtttcataatgtaaaactttctagcattacccacattcatatagatgttaatgaatctagacatatatgtgtgtatagattaattaacatttatatgaatgtggacaatgctaaaaagttttacattatgaaacggagagagtacagtataaaagataatagtggtggtggtggttctgccattagcccctgatattaaggacaagttgggcaggctaggatgaaactcatcaagaggggtatgaaccaagaaatatcataaaaacataatggtggtactaatataataccagtagtatatttgtagtagtacaagaagcttgatttctatgccatggttcagacgtggatctctaatttttatgtgctcctatgcaaatccaattctctggttgcatttcaaacactgctcacagataactaggtcatggtctgttatcattttcagggtattatgaagacaatctatgtcaacaaaatggttagagctggctgtacagttaaaatattgatagcagattggtttccgcagcggaaccctagattcacctgtaacctaaacaaaatacaggctattatccgctacaatatcatgatgtggaaggcaattggcatgcaccttgacaa

SEQ ID NO: 52779 - DNA, 775 bp, Oryza sativa
ttaaaaaaatttacacaaatatataaaatataaatcatgcttaaagtattttgagtgataaaacaactcacagcaaaataaattataattacgtattttttaaataagataaatgatcaaacatgtgataaaaggtcagcggcgtcatctattaaaaaacggaggtagtaataagctagtgctcaagtgctttttgataaaaaaaaatggtgcttttagattgcagattaataggaaactgaaatgtcattttctgtttgagagccttatctcaaagcgttatattttgatttcactagtcgaatcattcaccccttttaaatgtattttgtggtaaatcatgatattcattttgggtcattttgacagtatattagtataaccccttcatagagagataagatgttatacatcctaaatggacaatgaggtttatcttttttggataatatgtggctctcctggtcactgttttctacgaatgatgtttttgtttactgcaggatgatatagaagaaaaaataagttgtgctttctgcccttcgagagtagtagcatgcaacccatgtttggagtatataaaatctgttgtccttccttggtttgggaagtttgaggtcgttcagaaggaagggaatggtagcaacaagtactgttcttttaactcaactaaaatcttctgaaaatttcttctatctatttcttgtgagacatctattttgtaactcacgttggctaaagagttgtgtgctaaccaaatataagtactataagt

SEQ ID NO: 52780 - DNA, 1133 bp, Oryza sativa
tagaccctttttttttagtttacctcatgtagtatgtacatgtttttagtaagagcacctagcttgcaatttatattttactaggtactcgatatgctggaacaaatccggttttcatgaagttgtcttaggaacaactgggagaaaacagggtacatcttcaaaggcagcatgctcaccatccactgagtcattgctctgcaagtaagagggtgcatcctttcccattccaagcatcctgatgcaaaactgttatggtatatttatattctgttttttaactgtaggagaaggttgctagaagcctttgtgttgattgaacatccattagtcaaaaagttacatcgcgaggaaatgtcctaccgtcaaatcaaggtatttcatcttatattggaaaatacagtagcttagtagcgtatgatgaactaacccttttgtcaaacgattctagtgtctgatgaatatgagaagtcaatgactgactactggaaggtggctgatgttctttgcaggatatggctcatgaataccagcagacacttgagcttctcaggaaggctccattttttagccggtggagtgctaagcctgcatccctcgattcattcacggtttcacggtgagattaacccccaaatggctctttgagttcccccagaatgatgttttcagtgctagttttagtgttgaggtgtgttaactctgaatttgttcagaaaatgtatgctcttcagccgatgcagctctgaactactgtacaagctgtcactgtaacaaacctacaaaacttttggcgttattaggttaagatatggataactcatgctgtcttgctcaaatttgtaagggggtaaattaaagtctcatttagacttagacaaggtctcattttggtacggagacccactgaaaatctgaaatgctggatgttaggttgatactactaaattacagtttgcctatcaatggatgttaggttgatactactaaattacagtttgcctatcaacggcccaacctttccttttactgtatgtcatttttttaaaacatttctagccattattcagatgatgtttcacatttgtagttatgttaaaacactagaattccacatgaatttcgtcagatat

SEQ ID NO: 52781 - DNA, 2068 bp, Oryza sativa
cccacatattgaatcatcattgccatcgtcttcatcatcataaaacacacgttcatatggttcttcttcctcactgccatcttcatattcagcaccagaattcatcttgtcactgaaaccctcctgctgagcagccaaagtcacttttccacctcgtaattgtgcctgcaactggttcacaaagaagaggttctgaaaaaaaaaagaggattaccaagtgtttgagtaccagtacacatgcaaaaaaaaaggaggattaacaagtgtttgagtaacagtacacatgcagaagcttagagcaagtacaataggagaattaagcaggctataatatatccatcatggcaaaaaagctgagttggcggagggaatcaaggacagagaacttaagcgggcgactatattagcgccggctgcacgcagcctccaagactaggtgaatttactgcaattggccatacccttgcttacgcatagtgattgggtactagctgttcaggataaatggtgattggacagcaatcagtttgtgcatgcagcttttggcctgcccaaggaagaaaacgcaagctacatctatatactatatagcctactaaatgacatggcgaattttatagccagcaacgggcggtattattgatcctgctcttataagaagtaagcaatgtgcctcccaacagagagctgtgaaatctgtttatatatagttcaaactcatgtaaatttgcactgcacaacttgttacttctcttgtagttctatgttgcttttaacatcaatgccaacatgttatagggcacacattggtgatgccatcatgacaccatatttcacacatttatccgtgcaaaacaagcaaacatacacacaccttcctaaaaatataataatttcatacgatctgcagcacagtgacaccccggtgagatgacaaagtgcaaataatcaaacatcgcgttacacatctctagctgccccattgtagcaaatttgtggtttctttgccgtcaataatccatgatctctgcatattatcattccatcacagaccttctattctcaagaactcaccatgctttataccaacacaaacagtagtaaagaaagcttctcaaggaaatatgtgcgcagtaacacaaacagtacacatgcagcagctataataagcaagcagtgtgcctcccaacggggagctgtgaaatctatctagttcctcacagcttggcgcccttgcctattaatctttgcacccatgtaaacttgttagtacttgtcttgcttttaatttgttcttaagatgaaatagtcaaaaatcccgacatgttataacttataagtcatctttttttagataatggaagctttatttaacttataagtcatacgctggttatggcatcaagattcaagaggcaccacaattttacataaccttcctcacaaaacaattaatactagtgatttcacacgatcttcctccaaaatattaccaaaaggaaaaaaacaaggaaacaatttcacaaaacccgcagcacggtgataccatgacatttttaacactccacatctctagttagccccctgcaacaaatttgtggtttctgtaacgccaataattaatgatctttacatttttttagcatttccatcacaacccattaattcgcaagaactctccatgctttacaccaacgcaaacatcactaaataaagctttcgaagagaacaggtgtgcgctaactgaatccttgcatcaaacacaaaaccctaaaaaaagaaaaagaaaaaaaagagcaaagaatctaactataaccaaaccccacggcacaatcgcacagcacaaacaaaagaagcacgcacgctggctgaagatcgcggggggttaacaatcaaaccgattgcttcccagcaagaagatgaacccagaaggccaagaaccatgtaccatgttccaagcggatgaactagtacacaaaaattaaaagaaaaaagaaatacattccaaaatgccaggcttgttgcagcgcgcggggttcgatcctggaggggagtagaagtagagggg

SEQ ID NO: 52782 - DNA, 902 bp, Oryza sativa
  unsure (1)..(902): unsure at all n locations
tcgcctcccaagcggaacccgcaacctctggagccaatgaccaccaatctctcgacctccgaatcatcatccaagactcctctcgctggctatagcgctgctctccaacggattagctgacatgagaagactctttttctgctttgcaggtcagatttgatttgtttttcttgctgcttgtaggtttgcagctcgaacatctgcactgaatcttctttttcgttggcctctagttctcgaatagtttttctgcttgtctactcaagttctgtagttcttggtacataatttttcctcctagaagaagggattcaagttgaatgccagtaaactgaatccggagcaagtgagcttgttcagaatggctgagcatgacaaggtggacaagctaatgatcactacgtcaatgaacgcttgagagaatcctggtgtgctatgtcctgtaattncctatgaatcattatctcaagatggctttgggtggccttggctttgtactgatggccatgttttttttttcaaaactatagcctattaacagcttgtggttttgaaagtgcctatctgtgtatatcatcgtttttgtacgtggttcaatgtatattacttgttgtaattgcaattgtaaagtctacgtaaaaaaacataccggattattcttccgttgccttgtatctgtcattgctggattggagtgtttcgatttgcccatcgggtgtaatattcagatatataactaatatatttaaattttacatgaaacaatcaagctgaatggaaaccaaatacctacagcaagaaacatctatggaacgcgatgcacaagcgccggcggtggccggacctcgcgatctgcttttctttttctttccctgcgctctcctttttgatggagagcgact

SEQ ID NO: 52783 - DNA, 6825 bp, Oryza sativa
atattcgtgatttttattacgtttcaatcgtgtatcgcatcgatccttcgctgactttagcactattgccgttgttgccctattccggtagatctcagccagcgttcatcactgtccctacgctctgcttcgataatgtcagcaggcaatttgtttggtaaatttctcacatggtaaatccttctggtattttggtgtgactccttgatggtattttcgtgaacgaaaatcttctagacttttttctaaaaaccatctggcgttagcaacactcaaaacattaccattatcctgttcaaaattggaccgtgtgtagtacactaccgataggtgattggggtgacgtcgtccaatctcagaaagacttcttttttactgatcaactgttttttggagccattgtcatttacacatgctcacagagctacagtatagatagcgcttgcactcattcgccgaacatgacgtcgcaagggctcagaacatgtaagcatagttgagatcagataaaaacttgatttctaaaactatacaattcaaggtcctaggttttcctatgtgcaaaattacaaccttatcccagtttcgagccaacatcaaagaagtcagagaggcattggaccaataaacatgtaagcacagttgaggtcacataaaaacatgacttttaaaatactccttgagcctcgcattggcatctggttattctcctttcttctctagtctctgataagatcagaaacagcttcgagcctccctcaagaaactaaacaaataggagtgcttcacagcactaattgtaagataagatagaaaatattatgagcaactaatgttagtcaggccacagataaattagtagctgtttacccgaaagttgatccggagatgtgttgcaaaggcatcggagttataggatatcatcctgtaaccaatctattatattattaaaacagccttgaaaggaggcaccacgttcgttgtgggggctagaaattctcacattaatcaaagaaaaagaaaagaaaagtccaagtagaaatacaatttaaaaatagctgaaattcggaattaaaaataagcaatattaaaagaatagtccatataagaacccaatacgagattaatcaaaattcagaataaaaataaaataaaatccaaaattagaaaagaaaaggagagtccaagtaggaatacaatttaaaaataactgaaattcggaattgaaaataagaaatattgagagaatagtccatataagaaccaaacacgagattaattaatattcgtaataaaaataaaaataaaatctgaaattagcaaaaagaaaagaagagtagaaatacaatttaaaattaaccgaaattcagaattaaaaataagcaatattggaagaaaaatccatataaaaacccaatacgagattaattaaaattcagaataaaaataaaataatatcaaaaattataaaaactaaaagagagttcaaataggaatataattttgaaacaacttaaattcaaaaaaaaaatattaaaattacactatatgatattaattaaaatttgaaaaaaaataaattctgaaattagaaaaataaaaaagatttcaattaggaataaaatttgtaaataactaaaattggtgataaaaagaaagactattgaaagaaaagaccgtctaaaacacatgacgagataaattaaataaaaatttgaaaaaaaatataaattctgaaattataaaaagaaaaaaagatttcaattaggaatacaatttgtaaataactaaaaatgatgatataaaataaaaactattgaaagaaaagaccgtctaaaacacctgaagagataaattaagtaacatgcctataaaggagtacattggtggacggttaatacgacatataaaaactgttaataaaacaccaaatagaatcctaatgacgattaaaaggagggacgacaggcaagccgtgaagcaaacaggcaaggcggttgccgggacaaaaaaaataaaccccattgataatcatattcgatttttaaaatctcaatgtcaataaaaaggagaagcagcgggcggggtgcataggagtagagttgcagagccgccgacggttggcgggacttctagaaaataaaaaatgaattccaacgatagttatgctcgatttttagaatcccaatgacaataaagagtaggcgacagatgggtcgtagaggagtatagtggcatcgtttgactggacttctaaaaattataaaaaataaaacctaacaagacaataaactctaaaatctacaaggttcaatttttaaaggttcggaacttctaaaaagtaaaaaaaaaacccaatgacaataaagaagggaggcaacgggtgagccattaaggagtacagtggcaaagccgctaatggtttggtgggacttctagacgtaaaaaattgacccgaacgatagctatgttcgattttgaaaatcccaatgataataaagagaaaagacagtgcacgggctgtagagaagtataatggcagtgtttgacggaacttctagaaattataaaaacgaaacccaacgagacaataaactctaaaaactataagatctaatttttaaaggtttcaaggagaatgaatagaaatagcggtagatcgagcaagcaaataaaaaaggatatgacagaagtaaggagtagcagctggtgtgacttttaaaaactatataattagaaatacggggatgatagctatttagtttagtctttcaaagtcttaagacaacgagatagctatttaataaattttaagtaaaattatactaaaaaatatacgattttgtttgggtgctagccgcgcaattgcgcgggccacccagctagtttcaataataacatgagtaaactcaactccaaacaacatgcacggtgcaggaaatggatgccaaataagaggcaacaatgctgtgaggcttgccagcaacacgagggagtggacttcatcagggtactcaacagaacacatttgttagctgtaatggaattactataaatttttcaatatactagttcacaattcagttgtgagttgtaggatactagtattttctggtagcatacaaacatgcacagttgttgcctcctcctttatgcattgtactattgtagttcttttaaagcctcaagatttctgtcatgcattatccaaatatatgtactgaacctactactaacagcctgaacgaattattttcgtttttcaaggtctttttcccgaagagaaaacagctgatcagtacattactaaccaatgctaaattgatagttccgtaaaagaacaagcattcatctaatcagtcatacaaaacccgactacagaattcagtttttacattcaactacaccattcgaatagagcaatcaaagatcagtaactgatctgcatgggagtaaatggaaggacaggacgttacctcttatgtgatggatgagcactgcatttgtgatcgatgatcacagtttcatacataagagactggatttttaatgaacagtaggtacagaaggtagcatcactgttatgttctggtagaagaacacacctcataacagatggaacagttgttcttcatggagttctcgatgctgcagtgcttgtcgttgcgcaggctgaccgagtagcatgatacagtgtgtcaacagataaaagtggaatcgagagattcatatcaaaccttctcactagcaaatagtaatagcttgggatttcagtaccgactaccgagagatgtaggggtatactcaccacgtcgccaagcccgcgctatcggtaggctgaggcgtcggaggaggtgagggcggcagaataggcgagggaggcggaggccgtaagccggtgagggcggaggaatcgtcgagggcggttgaggcggcacacgcggcgaaagaggtgagggcggcggacgaggcgagacgttggagcaggcaaggtcggctgaggcggtgatggcgggggaagggaggagccacgaggcggggtcgctcggcgtcggcgccggatgcgatttgggacttctcttcgtgcggcggcgtgaggaacgaacgacggaggagagagccctactagggttagtgaatgtaaaagacgattgtacccctccgcaaatattttttcatagacaataataccctccacgattctactaccgttaagagaggtggtagtaaaaataatcttgaaaccttggattaaatgagatcaacgatccagattactttctactccaagtagaaagcaccggagtgagactgtgtgctccttggaattgtattccctctctctctctcaaaaaaaaaaaaactttcagtgcagctatgcaagatttgtgctccctaaaagaaattcacattacggttatatattatagaaaccaaaactcactactgagtgctgaccaaaggaaatttgtttagggataaaactcagtgctgtgcgacttttacatggctatcattttactattattcagacgctatgatgagtaaccaaactactatttagtaatactgatgtcttatcttgttttgatgacgcaggcttacctatgaactagactacaaagggaacatttgtgcagtaggcatggtgacccggatttgcatgagcttgatgttagatattggatgaacccaaaccaggtgtaccaaagtggggtcaaggacaacaagattaaccttgctgatgccaaagccatctgcctgatggagtgccccattccagcagcagacggattaaactttgtttgtgattatccagaaggggacattcgcctctctatcgatgattggatcaacagggactatgattattttgagtttctcgcaccagatatgagaaatagttctcttcagctgcagggtccatgctaccctgtcatatttccaagtgtgaatggtaatctttgctcagtctgtactacttccatgtgagcatggattaaattaagggctttacttcttcatgcaataagttaaaatgatgagatagctgatccaaaatctttgttcccttcagtctactggagctgccaatttattgcgcgagcatccaatgtctctttgaagcattggcagcagatgggtggtatcaacatcgacgaaaatattctcatagataaaacaatacacaaggccatcaattctaaatcttcagtcttgaaggtttgtaaacttcctggcactgttttattacctgcacattccttttttgttgtcgcaaacatttctgatttacgttggaagtgaaaagtggcccagctattcctatagctaacactgaccgtacattacaccacagcaatactttttatccttacaaaagaattttgttgcaccgttgctctgaaagaagcatatactttcttgcaactaaaatggatatgcattttgaattattctgagaaattcctgatgcaatatcattcatatagcactggagtcccattttgtctttgaagatattaattaccatttcctttgtctgcagagatacgttgctgacattgggaagtcatggcctgtgttaattgtttgcggtggactgctccctcttttcttgtcagttatctggttgcttctgattcgttattttgttgctgccatgccatggataactgtagtggtcttcaatgctctagtaatctctgttaccatgtttttttatattaaaggtatggttcaattttgcatgtcataattccaaaatatagcaagggaaattccattgtatgccatttaacatgttacacacatacgatcctaattggctacattttaattcagctggctggttaggcaatgatcccttaacagttgtaattggcgaaagtgatccatatgtccacataactggggggtgagtataccaattttgactttttcaataccggggccccttttttcccaattggtgtgcctgattgttcattcttttactaggaaataagccaccttcatgctgctacagtggtgatgacagtagtaatgattattgcatttctgacctccatagctattatccgtcgtatactgatagcaacacctgtcctgaaggtacgtgaatcattggatgtacaagcttgattagctaactattatacactgtataagcagaagcttggttttgaagacactcagcatcaatgccattcctcctctttgaaggcaagaatatagttaatagttcctaagcactaacctgataaattattatcttcaggttgctgcgaaggtcattggtgaagttcaggcactaattattttcccagttgtgccatactttatcctcgctatcttttatatgttctggttttctgccacactccatctcttcagctctggtcaagttctccgaaatgactgcaatacagattgttgctcatatgatctgaagttgggcaaagtaaactgtgacaactgctgtgggtacagcatccattacacccctcatattggtattgccattcttttccacttatttggctgttactgggcaacccaattctttattgcttgctcttcaaccgtgattgctggatcagttgcttcatactattgggcacgtggtgaaatatctgtaagtgaattgaggcacttaaaatttaccctatatttagcagttagtttacttctcctttccactgactatttgagctattcctatgcagcatgacataccatttgttacagttgtttcttcaatgaagcggttgttgcgttacagccttggttcagttgctataggttcacttgttgtatatgctg

SEQ ID NO: 52784 - DNA, 1604 bp, Oryza sativa
aggtcaccgatgacgatgacgattgacgcgaagatcaagttaccctacttaggtcaaatgtctgctgatctgctcatcaatggctatggtgtaatcatcatcagtatcatctcctatcttatatggtgctccacttaaaacttgcatacagatgtatttacttaggctctgatggggaacctagcgcatgattaattaaatattagctaaaataaatttaaaaaatagattaatatgattttttaaagtaacttttatatagattttttttgcaaaaaaacgcactgttagtttgaaaagcgtgcgcacataaaacgagggaggtgagttgggaaaggggagataagaccctgtttagatgggactaaaacttttaagtccctatcacatcggatgtttggacactaattataaatattaaacgtagactattaataaaacccatccataatcttggactaattcgcgagacgaatctattgagcctaattaatccatgattagcctatgtgatgctacagtacacattctctaattatagattaattaagcttaaaaaaattatctcgtgaattagtttttatttatgtaattagttttgtaagtagtctatatttaatactctaaattagtgtctaaatacagagaaagttaagtctctggatccaaacaccacctaagaacacagccttaatgaccctaagtttttttttattttgggagagtgatcccacggtacaaatcgctcaatttataattataacatactccttccattccataatataaggcacaaccacttttcttagatgttctacaatataacgcatgcatgcaagcatgcaattaactatgacatcttctccattaaattattattatttttaaatcctctactctcatgttatctaatcctattggatgcatgggttatatttattaggatgattcaaactacaagatgataataattattttttagtatttgggttaagggtggttgtgtcttatattttggaatggagggagtatatagttgagaattatatatttttcatattattcttttcaaataggaatatcgcaaatattccatttcatacatattttagaattaatcattaaaaattaaactattttttatataatcccatacatttaatctccctagctcttaactatatgaatttcacatacattggtccatccacatgaacaatggacttatcttacaccataaaaaaaggaaaaaggaaccttcatgagatatacatgcaagatgcaaccgcctcttaggtgtggaagttccaattttttttctctagttctaggtgccctagattagccggtttgatcagggtcaatacgctacattagttgaaacagtcgagtgaattgttttgcacggttttaatacttaggagacgcgagatataacccggtttacggttgagatatatgggttagactcggccaatagtcgagggagtaaaaaattgacttgttttatgtaaaacaaaaaaaggggccggatcggataaacgggttgtgcttatggttaggcctggccatatttggttccttcatcctcgctatcttttatt

SEQ ID NO: 52785 - DNA, 3193 bp, Oryza sativa
ttcctcttaattttctccttctgttccttccgtgtgtagggtttcagccgccgaaaatcttgggaatccacagagaccgtgtcgatcgcgggcggcgatgagggacggtgagcgtgcggaggtcggggcggccggggtgaagaggaaggaggcgagcgcttcgtcggactcggagccggccgggaagaaggcgaagaagaagatcctcccgaagtggagggccaatgcgatcccgtgcgaggggggcgaggtcctgaggaggaagaaggaggcggtggcggccagcatgctgtggcgcacgccggatgtcccgggggcgagcgatgtctgggattcgatcgaggtcccggcggagatgctggagctgtggctggagaggcaaaaggcgaaggcggaggccgcggctgcgaagaagaagaggaaggtgttcaagtgcagggtgccgaatagcctcgtcgaagtgatgatcacgcagccctacaagtgcgttgatcacaatcgctctcaggaggagctggccgaacttgctgtgccacatcgccaaatctacatcctcaggaagttcatcgatgaaaagaagatgaactacgagcagaccctcatcgaccagtacgccacacagggctacgcagaggacgaggaggaggtcaccatgatgacgatgacgacgaagatccagctaccctaacctaggtcaaatgtgtgctgatctgctcatcaatgactatatatggtgtaatcatcatcaatatcatctcgtatgttatttgcaaccggtgattattcctgtatatgtaccttgctactggtattaattgctacttttgcaatcgatgaatcgatacatgtgttttatgcctgtattaaaatcactggttcacaatatttaatttgctgctgattagtcctagtgcatttgcaagatcctggaaggttgtgcgttgtgccaaaggaacggctttgatagcttcagggtctatctctattcttttgcgaccacaattaaagttaagcttatttttcacaccttctatcccaccattctgtccttcccgccacaccctctgcacaactctaactggcacatcaaactgcagtgcaactgccttggagactccatggtgcatcacaggaggatgtgtgcatgctagcaatttcagatatatggcgatcttcaagtcatccggatagaaccttctctttttcacagtcccacctgcaaatgacaaagaaaaatcaatagtgaaattgggaatacggtagtgtagcaatccatacaaatactgaaaaaaaacagtttaattctgaaaacatatgcaatccatacaaatattgagtctgtaactctgttgctaatattttcaggttggtactagaagtaattcataaagacttgacatgatatatatgtctgtggtaggtggaagctaaattcatgattgaaggatagggttgtttaatttcatgattgaagctaaattcatgattgaagggtatatatgaccgtggtaagctaaatacatactgttttcagatttttgcagacaagatgttttctaacctacaggagtcggcgaacagatgttttgcaatgataaaactatactcattgaactataagcgctgaacagatcatgtaggcagagagctaggcaaaaacagaaactaaaaacaaaagctatctggtggcagtacctccatctccggcagcggcatctccttcgcctccatcttgggcggcagtacctccgtctccggcggcagcacctccgtctccggcggcagcatctccttcgcctccggcagcatcagcatctacgatagcaaactgattcaaaatcaaactataggttattaggttcctaaaccaaaaacaatggcacatagataagtaccttcatctgcatcagcccacaccatgtcataatcaaggtcatgagccggcccaatccaatcgccaatggcatcccaatctatgggaggctcaagattgaggtctaacaattgtgccgccgccattgatcatctacagctttgtgtgtggtagaggcaaggaggagaagatttgaaaactgaactcgttggtgcatgcccgcgtcaaatcgctgcttatatagggccattgaacctgtaaaattcaatttttgaatttttcccagacataaccccatccattttcaccgagcgatcgctaatatactagctaaaaatttgcctggcaaaaaattatttcgcacgatctctatcgctactaatccaaacagttaagctaaagatttagcagaaccgaaacatcacacttacatgcacccagctttaattgtgggccgacccatacaggccttggatagctgataagagcctgggcttatctttcttagtctgtgtgtcaagctaaaatatgatgatcaaaaatagatggagggagtagtattcttactagtagttgattgatatccccaatctcgatgtttcactacttctgccgtaaccttgttttgtaatcatatgtatgttctatttcttcagttgttttggaatccaccggttctcatttcttggatcaatttggctttaccgtccttaagccgttgttacatgatatcagagggcttgtttggatcaatgccttaccaattttttgtagtgccaaaacataggcaagttttggcactaccaattatttggtagaataaatttggtattcatcttatttagtttgctatcaaaatatagccaagttgtgatactatagtgaagaaagttctagattgccaccaaatttggtataggcattaccaaaaagttggcatcaatccaaacaaacaaacggtgggtactatttagactacgaaaatattggtagagcaaattttggtagcaatccaaaactgtccagagtcttcctcgtcaaatgacataaagcattgcattgttccttcaccaatgcacacatggtacatctctgtgtgcattggtaccaaaaccagaatattccagagtccaagtgtccaacttgtatatgtagattgcggtcatccttatgtagtttgccctgcaaagcctgccgtcatgtccaggtattatattttctgtcaatgaaatgcatttttacattctatggaagggaattaactactcccatcctagaattgttgaaggaaatgatcaacagtggattggcaaaacagtg

SEQ ID NO: 52786 - DNA, 1457 bp, Oryza sativa
tctcctctgagagcgtcttcaattggtcgaacaccctgcgtgcggcacggatgctgcgcccgactccacatatctccctcaccgcaagcagccgggccccagccgccgcggcgatggcggcggacacgtcctccacgccgccgaaatccagcggagcaggcagcagcgcggccgccgcagtctgttcgagcagccgctcgctctcctcccggctccgcccgacgggcacccgcccctctccgcaggcggcgcgccccgcggcggtggaggcgaacccggccagccgcgcgcacacgccgccccattccagggcggcctccgtctctacccgcatctgcttcgcctccggagtctccgccgcgacaggcgacgttagggcctgggaggcggcggcggcggcggcggcggccctgaagcgtggcggcgaagaccgtgcgctgcatacgaggccggtgggaagagaaaccctagaagaggggatagccacggagacttgggaaggaaaagggaaaaaggggggggtttttttggggggggggggcttcgcggcggcggcggcggcggcggccgccatggctgtgcccgtgggagaggcgggagagctcggcttggcttcccgccggaaagttcgccttatcctggtttgtccccatcgaataccgctttagtgtggacttgacgtattcttcttacgctttcatgttgctgcctccctattattattattatattattaagatagctttggaagaaaacaccgtgttcgccatcaaggatacaaattcctactttaatagaaaaaaaaagagagaaaaaaaatctaaaatattagatcatgatgagcctatattataacggttgaggttgattggatacctataagtattaaggttagacaaaatatagagagaaattaattctactcaaacttggtaaaaaaaattgctaccctaaaaaaaatagaaatcatgttggaatcatatccggacaccattcggacatgtctcacacctcactaccacgtactccatgtttttttagagtacatgtttttcttaataatactataaaaaaatatttatgcattgtaacgggtgaatgttattataatcttattattgttatataatttagttaagatgaaattcaatgtggaaattcacttgggtatatactttttagaaaatcataagctgcaattaagagcctgatcatctcaagttagcatgcgagttttttaaaaatatatcttatacgactccttccgtatttccaaaagcgaacctaaaacctggctcaaatatagatttgtatttttaaaatcaaacggatttaaaaccgactcatacattgtatgaataacgtatcaagatacactatacgcagcatcaacatatggcctcatatgtatagttatacatgtctatgaataaatatatatggtgggttgagaatat

SEQ ID NO: 52787 - DNA, 798 bp, Oryza sativa
tttccgttgcagtgcacagtcattcagctggtagatgaaacatcttgagcttccatatatttattgatacagatatataacctgtttatttttaacttttgtttggttcaacatgaacaaatatctttgcaaaatcctattagcatttatggatccatagcttttttgtatgtttggatcggcagcacgaacagacgacctcactccacaaaattcaacgcaagttaaccatagcctataataatttcatcataagtccatttttagccaagtattatccaaatagccacctcttgcttcatgtaaatttgcagctcttataacctgtcaagagaaaaaaaaatcatgtaccactagtaataaataaaaaaaaggacatttaaacttaattaatgaaactacactattattgttattaagtagaagataaattaatatactccatccattttatattataagtcactttgacatttcttctagtcaaacatttttaagtttgatcatgtttataaaaaaaatagtttttcaataaaaataaacatattatcgagatatattcaatgttagacttaataaaactaatttgatgtcgtagatattgctagatttttttataaattttaggaaaaaggtcaaaacgtcttgggatagtacttactaggatcgacggttgtgataacgccggtctggccgaagtcacagtcaaactcatgctggccgttggattgaaagtaaagattcatcgcgaatgctgcgtgcgcctgcacgttgttgggatcgtagcacgaacccccc

SEQ ID NO: 52788 - DNA, 1544 bp, Oryza sativa
gtacctcatgaggtcagttttgttccttcactaaagaatctgccattcctcctctcctgtttcacctgaggcatcgaggtcctcgacattgatgttgccatcccctgagatgcccaacacatcgtcctgattgtacatttgttttgacggttgaaccgactgcacaacagtgaagagtggtgctccattggctttatctactagctcagtggcgcgagaacagaaatcatcgaagtcatctacataagcaggcagacagtaaataagaaaaccaagattagagtgaacttaaaatgatgacgcgacatttgttcgacaatcacagttcacctttatcacggcagtaaaaaccaatagccaatgacggatctatcaggtctagggccaaatctcgtacagtgctgtcaaagtgcagctagataataagttttttcattattgaaaaattaaaaggataacgaatattaggtaccatttaccaaatcataactgcaattgcgaacatacctgcagtggtatgaagaagtgtctgcctctatgttatcagctgcaatatcaactgcctgagatgtagagaacaccccactgtaactaccatagctcaaaaatgaaaaacaaaaatagctccctagtcattacattgataaatacaaaatccatctacttctacaaggttactaaccaaaatggattccaagcaaaaagggatactgcaaaaatagccagataataacggtcgctgactgcatgcataatagacaaaggcgaacactaatataccgctttgctgtttttttgtgttgccattgttgtgaatgggaggacagggcaccattaaaaaggcatgaattacttatcacattgatgaaatcaagattctaaattacaacctactacatatgaaagttttacttattgaccagattgcagatagaaaaacacatctataaaattggcgctcatatatgctaagtaaataatgcagttttaccatctgaacttcatggggatctaggtagagcgccctgtcatcctgtaccccagcaatgtaggttgatgttccaggctttccacccaaaatccccaagctctgaggaaatgtgaacgtctcctttagtaaaggaatgtacctgatagtaagggcaatggcaggaagtgataatactagaaacaaccatcagtagaaacatcaaccgttcaagggtgaccatatgaagcctacaaagaatgagatttaatagcttgctgcttaccttggattaattttgtcaagaccaagaaccagagggaccagcaaaagaatcggtgaccaagttgattgacctttgttgaaatcacagcaaagctgagcagcaacatcaatacaaacaactggagctccacctctttcaccatcttcatcaccggataccacataaagagccatagggaaactttcattcccatcaacaacttcatgttgctccctattggtgcggacaagggtttgccatgcccgacacatggcgtatggacccacccatgatccagcagccagaccataa

SEQ ID NO: 52789 - DNA, 1292 bp, Oryza sativa
ctctgccgccgcaagaaaccctagttcatcaacctaggctcgcttttcggcgaccttctatcggcaatggacctcggcaaatcagcttccactagtgcaacgttgaagaaactccaggaggatggcgctcttcctggccatggaaccatggagagggaagcaggaggtactaatcctcagcccatattgggtcgcatggttgcgatcgaagattatgttctctgcggttttctccctccaccttccaaattcttctcctggttttgaatttctatggcctctctcttctccatttgaaccccaattccatcgccttccttagcatctttgtgcatctttgtgaggcctacatcggggtagagcctttccttgatctttttcgcttttactatgaactgcgttggatggaatccaacagggtatctggttgcgtcgggttccgacttcgggatggcctgaagtcgcgttacattcccttccagtgcccttcttctcacagcaagtggaggaataggtggttttatcttgagatcaaggactcgaaccctgacttcgtggttcccgaagatcaaccgaacaagattccgtcttggaccgcaaagccccccttgaccccctctcttcagtcgtttatcgacatcatcgacaatctctgagtacggggtttgtcgggatatgaagtcgttgcagacttcgttggtaggcggatccaaccgcttcaggctcgggcccatccagcttataactattccgggccagaggacgtgacccgggtttctcctcggggtatctttctcgcatttatcttgacatacttgtgttcgcattcctcttgacttatcgaaggttggttctcgattaacaggtctgagcggggaaaccgtggagcgccgcgtcggccaagtgatgatcagtggcccgaccacggcgagtgacatccctatgtccctttgtgaaaagggggcggcggaacgtgatgaagccatcaacgtaagtatattcgatgaacatcccgcattctcctttcgaaatcactttatgacttgattgagcgtaggcccttcctttgactgatatcatcggaccgctcgcggaccatcaggtggcgtcatctctgaaagtgaaggtcgtcaaggaggcgtctgatgctgccaccactagcggtggcaatgttctgacaaagccgaggaaactctcgtctgtaatcggacaacgtcgcaagggggcgaccccctcgggcatttattttatcggtaaatcgtgcagcaagaaggatttttccttactttgcg

SEQ ID NO: 52790 - DNA, 2539 bp, Oryza sativa
  unsure (1)..(2539): unsure at all n locations
atcgagccgatatgccggggggcacgtgttggcttgcttacgagatcatcgcccgcacctggacctcgaacatcttcgtgagggttttgctcgttctcggaggactccggcggagatagaccatctggcaaggtcaatgtcaccgttggccaagaagatcttccagtctatggactggcgttggccttcttggtagtactcgtaccctgtgacaaatatcttaggaaaagatgtaatgtagcgaaagatttgtgaaaaaactgtaaggagtattttgtgaataaagaaatctatctttgacaaatgtctcttactctggatgtcatgtgtaagagtgcgttctcggttaacgactttagtcagccgtttgattcgtacactctccctagcccctagccttgtcgtcggaggagttttctcggaggataaggctcttggacctttgacctgccttggttgaataagctctgatcctagcccccagccgtgaagttgaaaagttaatttccgatttcacggcgtggttaatacgcacggtgagaactcttacacgaccagatcttacatggtctttcgtctctacaggatctgacaaggccttatcggctctgggcgtccccagccgaagatcccttaggttcctcgaaggccttgtcgagacggcgtaaagggacataaggacatgtttcaacgctaggtgtcatcagagtgagggatcatcgggcgaaacacgttgattgtgatatgggcctagaaatagcctttattgatactgtaagggtgctacaggtatgaatgatattgactcatacaaagaatttacgtagttggtcaatgttccaagaatttgctaattcgcgaccgtcgccgtctgcgattttgaatgcgcctggccgcaagacttgtgtgatcgtgtaaggtccttcccatttaggtgagagttttttggcccccccccccttgagncctttggcttttgaactcgtcggaggacatagtcgccgatcgaaagtatgcgtgcacggatgcgcttctcgtgataacggcggagggtctgttgatagctggctgctcggacggcaactcgttcccgatgcttctcgagaagatttacagcgatatctcgctgctcctcctggttctcgtcgagtgcttctgtactcgtgtactctgatgttgtagctcgcctgggagcatggcctcagagccgtacacgaggaagaaggatgtttccttattagacgttgtcggtgtggtgcgtacggcccatagtactgacgggagttcttcaacccaccttttgtcgtgtgacatgatcctgtcgtagacgcgggttttcatcgcttgtagtactatgccgtttgccctctcaacttgtccgttcctttagggttagagaccgagcggaagcatattttgacccccagcccgatgcagtagtcctggaaatcggcgctgatgaattgagagccgttatcagttatgatgcggtgtggtagtccgtatctgcaaaatatccctttgatgaatttgatggcgttgtcggccttgatttcccccgtgagtactgcttcgatccatttggtgaatttgtcgatccgaaaaaaatataaatctgtagccgccctgtcctcgtgggaatggcccaagtatatctagcccccagcacgagaatggccaagtcagagggatagtctggagtgcttgcgcgggtagctttgtgtgtttactgtggaattgacaggcttcacatcgctggaccatgtcgcatgcatttttaagggcggttggccagaaaaagccttgtcgaaaagctttgccgaccaatgtccgaccggcggcgtgtgacccacatatgccttcatgtatgtcgaggaggaggtgtctgccgtcgtcggtcgagacgcatttgagaagtaccctgtttggcgctttcttgtataaatcattgccgaccatacagtagatctttgctttacgggttattttctcggccactgtgtcgtcctcgggcaactcctcgctgctgatgaatttgattagtgggatgcgccagtcgtctgtggtttagatgtcggcaacggcgcgttctgcctcggtgacctccgagctaatgtcgggggtgttcgggctgacttcaccgctaacctctttcaccgatgacttcgtcaggatatcgagaaaagtgccaggctcgagcgattctcgtctggacgcacgtcgtgctaggtcgtctggctcgacgttgtccttgcggtagacgtgtcggacctcgatcccatcgaactttttctctagcttcctgacttttgcgagatacttggataactcagggttagagcatttataatctttgtgtacctggttcgcgactagttcggagtcccctttgacgattagtcgcttggccccaagtgtagctgcagctcgtaccccggcgagtagtccttctgcagtgttattggtcgccctgaagttgaggtggattgcgtgcttgaattgatcttcggagggagacgtcaagataaatcctacccct

SEQ ID NO: 52791 - DNA, 1552 bp, Oryza sativa
atgattgatcgattgattggtcagggccagacaataagcgttgcggacgcctatcttttaaaaatgccaagctaggaaatcttctcttctgccatgtggcaatttaatcttcagaatttcattagcatctcatatggagaaaaaacatgattgactagattcacatcccaaggattggtctcttgattgatcagttgttaaacccaccacctaatggctctcttgattgatcagttgttaaacccaccacctaagggccggttttagttcgcaaaaatgaaaattttagagtgtcacatcggatgtttgattggatgtcagaaggagttttcggacacgaataaaaaaactaatttcataactcgcttggcaaccgcgagacgaatcttttgagcctaattaatccgtcattgccacatgtgggttactgtagcacttatggctaataatggactaattagactcaaaagattcgtctcgcaatttccatcataactgtgcaattagtttttttttcatctatatttaattctccatgcatgtgtctaaagattcgatgtgatatttttgaaaaaaaatagtaactaaacaagacctaagtcacgcgcaactcccactttgtcgtgacaacctacgtacgatcggtgtggattgtcgggggtatccactgatccttccatatttggacctctctaccatctccaattctcaaattaaacctttctttagtaactcaagcccatatcatacttggtcccacatatcatacatacattatctcttgtagtttatgttgtagctggttacaaatctgtaggccgcttctcttatctctcttcatttatctttgatatgtgttttatagctggcttataatctgttattgtatctgctcttaaccatttgtattttatggtgccatcatttctaaagattacgaagcttatcgtgtacatgaacaagggaacaatgatcgatgtagatcaagaattagatgactctgagtctgagtgtataattaatgagtgaaaaattaagtgaaaccagtgcatgtaggggtgcggctaatgggcggctaggctgggcgcgcggcggctaatactactaggactactgcgtactatttttactatactaccactataaaaatatatacgaagttttatacgtatatatttttttatgtataaaaaaatatacacatatacaaactttatatatgatgtatacaaattttttatacgtgtatataaactttatatatatatatatatatatatatatatatacatcgaatataaagttggtatacgtacgtatataaagttatatatatttataaagttatttgaatctctttataacgcattgaacccgttaattttcactgatacccggttttgcctagcacaaattgtaaagcagatgaacggtggatgattttggagcctgggcaccatggtgtcccaattattattattggtggtaatatatatatatatatatatatatatattaaaaaccagaaagaaaaaaaaagacacgtgagctc

SEQ ID NO: 52792 - DNA, 704 bp, Oryza sativa
tttcttgttacttttggattaatgggccttttgtagtgaatttctcaccaatcttgatatatttctgaaaactgaatttctcaccttcctttttcttgtcaattttggatttaatgggctattttgtttgagatataatcagatgaagggttggtggtcgagtgcccagtggcctaatactgcgtgccttgcgccatcagaagagctgtggacacaaacatgatatcttagttggtgtggcctcctcaaccatcaagcaatacagacaaggacccctccaactgcaagaaaaactgccattttacagctcaaatccaaaatctaatctcctcatcttgctaatcaaccattgcctttgccagaaggagaggcctacttttggcttccttgaattatggatttcaataagctggttggaagatgaggaacacttggtgctcactgcaatgatattgctacgtttgaattcatgagctgcttacacatttgcaaagaaccattggccaccatcaatctgaaaaacgaagtactatatttttaacaaagtgtaatgctccccagaaacagtaatctagtgtcagggaggagacagccatctgggaggttttgccttttgctgttgctgtctggcctgatcacatcaaggctgcttgcttccaaattactcaataccaatacagtttagtttatacacacgatggcat

SEQ ID NO: 52793 - DNA, 2943 bp, Oryza sativa
acacccaggccatcttctcatggccatccgaattccacaaatcttggggaagtacatattagccgtaacatacttagcctctgaaattagttctgcaatgtcagaaaacaggttcaacttactgcagacctcttttgctaatttccagtcatcatcatcaggagcacaaatatactgttcctctatttgccttaagtgatcaaagacttgcttgtagcttatggcaacatttaacatggataaggtagagtaccatctattattacaatcaagagtcaacttcttgtcgagattaacattcaaaccacgagcaacatcagcaaacactacatctctttcagttgttgctgccaaaaatcaacactggcgcggatcctatcaacagcacctcccatcacacccaggcaactattggcaattctacttagcacataggcgcagcatcttatgttcagcaaagacccacctaacaaaagttgttcggtatccagcctttgctttaagagccccgtaaccgtatcatctgtagaacaatcatcagccatcaccattgataccctccttccaagattccattcgttcaaacaagaagacagagtttcagaaattgcttgagctgtatgcgggcatggcacatgtataaagctgcatgtggcaatcaaagcacaataagtttttacattaaaatagtctgaatagaactttggaccgagaaaactgcaactatatttgaaaatatacatacacacatctatgcgctcgaaaaataatgaaaaaggaacacacctcagtagacggcactggaatgtccaggattggtcgataaaatgagctctgacagccacataacctctattttgatcatctgatgtccatatatctgctggtattgcaatccgacctttagcctcccacaaaatttccctggttctgaccctctccgtctcataaatgctgataacatccttcttaagactactgttgggaaccagctggaacaatggttgaagagccctaacaaacctttggaaaccgtaatgctccataatagacaaaggatattcatgcaagataatcattctcgcaagctccatcctggcaacatcctggctaaaggtggagctttctaaagaagcaacagtgggttcctgatcaatatcctttgtacatttggagggagttggcttgctgactttattactcctgcgacgaggacatttgctgagatgatcgtgcaaatgtttggtgccattcttagtgtcccctccgagcctcttatggcaccataggcactcggctttccacttgctgacgattttcttcctcttgaattctttccacacactcgatgtcagctttctcttactaacatattcttcttcaacagcatgactggaatcaggagcagcagttgagtttttggcagctccaagacccagagggatgtcatctttcataaccaactctgaattctgcaaagtagaacaggcaacaggggtagtgagaaacaaatggcagtagaaagatgataattctccctggattttctttttcacttgggctaatttctcatctctatctctactattataaaaattcaagatgtttttgcggtactttggtacgtcatccgtgtatgagtcggtttttaagttcgtttgcttttggaaatacatattcgtatttgaataggtttttaagttcgttcgcttttggaaatacagaaggagtcgtataagaaatccttttttttaaaaaaatcgcatgctaacttacacggttggactcctaactacagctcatgatttttgtaaaatacatatattcaagcgaatttctacagtgaatttcacctgacttaaaacatataataataataagattaaaatagtcttttcccgttgcaacgcacgggcattttttctagtcatcccttaattgaaaaactagatacaactcatagctcacactctcaaaacaggataaatcttgtccccgtttgacatggttttgagcagcataggaggtgaggtccacttgtcattgaggataaatggtgggcccacacgacaaacgatgatcaagcaggtcccatctccagtttgggtaaaacccctgttaaacaggttggaggtacatgtttttacccggtttcaagagttaagggactgatcatatatgtatattacgcctagtctaaaaggaaggagaaacataaattttcttataatcttattgagcaattgagcaaagctgatgaattttctactagctgtatcgaactagaatgaatacagggaggcgcgagaattcagaatgtgtaggggcggagaggaggagggaccttggacttggagttggagcgagcaagatagtcttggatggacttcattgttgaaaccctagctagctacatgcctctgccgccgcccatcaaacggacagaaagggagcgccgtagctagggggttggatctggccggaggagcgtcggcgtcggtcgatgggcgcggggcggcggcggcggcggcggcaagggaggccgggagggagggagaagcttcggtgcggtgcggtgcggatgaacaactcgatccggtcagttcagtgcaggtggggcggaatgggttgggctgcccggcccaccatgtaagcccataaaccgcattccggccctgtgctgtgtccctttcttttctctttatctttatctttatctttatccttaccaatctaatctaacctaacctatttaaaaaatacttaatttttcgccgcgctttcctccgcaggttcacaattccgacgaaaaccggtcgaattctatgaaatttcgacgtttcgacacggctcggaattaagtttcgattagaatttcaaaggttaaataatagatttggtcaaaatttatcgaaaaccgatcgaaatttatagaaaaccgtg

SEQ ID NO: 52794 - DNA, 2063 bp, Oryza sativa
  unsure (1)..(2063): unsure at all n locations
gttctttgaatgtttcacaataaagaaattttaccatataataaaaatagaaccccatatttagaaacacgtgatgccccgttttgacagtaatggatccccccaaatccactcacctccaacagttggttccccatctccatcatctgtggggagagagcccgagaaatttagggttgagaggtgagtggcgacggaaggaatccacaagttgcaagggtgtggaggcgaaggagtggcctcgattggggatcggaggtggtgaatctcggtggagaggcacaatccaaggcgataagcgtcgatttgcaagggtggttcgtgggcgaatggcgaatcaagggcatccaggcggagggtggcgtcggcgtccaccgtggtgagaaaggtcgccctcccgcagtggcgcaccaggggggctcctcgcaagctgggagtgagcaatccaccaaggctggaggtggagagatgaggggccagatgaacaaaggggggaagctgcagcaatatcgtccagttcagaaggagaagaatcaatctgaagagaagattgcgacatctgcagtgactcctcagactgcaacccagcaaccaactccaccacccaattctcgcattggtatgcaaactaacccacagagaattttctgccacagatgcaaaggttttggccacatggctagggattgtagcaatgttgtcttctgtataaattgtgccaaacccacacataggacagaggattgcatctatgacaagcagccgaggcctatggcaaagctagtagggtatggtgctccaggtttaggttgcatcttaattcaaaacactaagcctgacccacctaaggagcataataatcctctggctatgatctctactgtctttggtggagaattgacagaagctcaacttgagcaaggtttcacgcaacaatttaagtggaattgggtttggaaagctaaagcaatgcctaatggaagctttcagatgagatttcgtaacaagataaagtttgatgagcttgcaaactttgattatttcaatgtcaagggcactgatgtgcaagttaatgtgaaagaatggacccagaaatctgaagcagttggaagttgcatattgtctgggtcaaaatcactggaattcctgagnaaatgaagggttaccaagctttgtatgaaattgggtcaaatctagggcttgtcttgnaggttgatatggctactttcagagctagcaatgtgatcagggcaaaagtggaatgatggagctgggtgttctgcctttgaaactagtgttaacttctcccaagggacttttgttccaagctcatttcagtctagaggaggtggtggaactggggtggtttagtgatcagctagatgacacttttgagaaaattgagatacaagaaaatactctggagggtagcagtcagagagagggtaagcaagttgtggtggtggatcccatgacagaagatcccatgtcagtaagacgggtaacgggctattgaagtttgtcagaagcaagtcctggtgccagaattgatgctgggagaacataagatcaaatgtgcacagatcttgagagacatggagttggcaatgcaactgcagaaaggagactgtattctgactcagtgctgtgaagaaggaaagaggttgggaaaaaggaaatgtcacaggagcaggttgatactctgcagcaaccgatgaatcaaaagttggctgaagaattagaaagctcttagacagatgttccaggggataaggagaatagagtcagttttgatatgggtttgaatcaagaagacaaggacaaagtagatccgggggacagtgaagattacatggattctcaggagtctaagggaagttttgctaagaggttggggattaatctaactgaagaagctcttggaagtcaagatgaagagatgaggagaagcaagagactgaaagacaaggaagataagaggtcccaagagatggcaatggaaaggaaagaagcacaaaatgctttcatcaataaaaattccctccttcatacatgaatcaaat

SEQ ID NO: 52795 - DNA, 1270 bp, Oryza sativa
ttgtccgtgacgccgtcgttcacccggaacagcacgtagtcgagggtgtcgttggtgagcccgccgtagaacgggtacgcgttcaccatgaacggcgcgcccgtcgcgcgcaggaagccgagcagcggcttcacgacggcggtgtcgtagccgtcgtggaaccgcccggcccgacggcggcgtggacgcggccaggatgccgagggaatgcggcgtcgacaccttgatgatctcgcggcggcgcggcgacagtggcagcacggcggccagcgccgcgtgcagggtccgcatggccggcacgaggctgagcaacagcgtccggttggcctgcgagatcacctcgtccccgacgaggacccgcgagacgttggtggcctccgcgtacggcgcgacgctggcgcgcacccaccgccgtgcggacgcgcggctggcggcaaggcgcggaacgtcggcgttggggacggtgacgtccacggcgaggccggtgccggcgaaggcccgcagcgcgcgcgggtcggcgtccagcagccggacgcggtcgaagatggtgtcgcgggagaggacccgcgcgagtcggccggcgggcgcatggtcgtcccccgcatgccgtaggtgacgccgacgccgccggcatccgtgcctattccaagaagacgaaccagtgcttacgtcatgtgtcacgtcacactgattcacacactggctcaaatttgcatagtgattagtgaccttacctttgacaatggaaatcgagagtagagcaactgagaggaggacaccaagcatgtttggaagcttgtgtgtgctttgctctagcttgttaattactgtcactgacaagagtgagtcttgatttgtgagatagtggcaatgcaatgcagcacgcaattcttaaaggatgggagcttaggttgttgcgtgatgacagagtaatctgtatcgtgattctttctggggagaggagatgttaaagcctaggatcatatgacttcagtatcgcttatgttttctggacagttcgtagggttcctttgtgttgtagatgaaagggattcttttctttggctttgagttgtaggtgtctttggtcgatttgtctgcgctttttgttcttgctcgttagcttttgtccctttcctcacaaacacttttgagacaaattggagatcggtgaagcttcaaattaagtggtctaaatgtgctgaacgatgcttatttcagccctacaccacacgatctctgttgatcaaaagaaacagagcacaaaaga

SEQ ID NO: 52796 - DNA, 1359 bp, Oryza sativa
tcaaattttacttgcatagcaataaagaaagaccactaataaaaaccgttgtacatgccctaatggccagacggtttcaacctgtcctcgaaacctgttcacttcatcaccactttcaactcagcaaaaatttattagggtaacaaactaagcattatcgtacaattatcattctaccaattttgggaattctggaatttttttctcttataaaaacgatatcaaatttaagagatgcatcgaactaaatacatccaaacactattaaaatttagcaatgccaaaatttactaaaatcggcattaaaatgaacaagccctcgttaccatggccctcaatatatatgcccagatgggccacccagtccgacatggcccaggcacaactgggcctgagccaaggttagtcgggtcgacacggctcaacttacgcgccgggccaggttgggcctacccacgggctgcacccacggcccagtcatggcataataggactcggcccgcggcccgaaggcacaaccgcccatcgtgcttctttataaattaagtctatttttccatcctcatctctttgggttgtgccttatggttagaataagtctattttgtcccccttcaggcatggcacaataggactcggcccgcggcccaaaagcacaacagcccatcgtgcttcttcatagaataagtctatttttccgttctcatctctttgggctgtgtttcatatggttagaataagtctattttatccctcttctctgtgggccatatcttatatgaatgaattaagtctaatttagatccctcgactatttttctttgaccatgccgtgtcggaccggctcaccgtgccaaggcatcgtcctaggcacgggccatctgtcgggtcgggctggcacgggtacgacaccaatcgtgctgtgcttgtgcttcaaataaccgtgccgtggaccgggccgtcgggcctcggagcttatggccatcgtcttcttgttcgattcaaactcttcgtgctctgcccgcacggttccataccctactcgttgtgttgttcttcttctacgtacgtcttcgatgcaatgcatcggtgatcgtcgaagctcgaaggaccttgtgtgattccggacggcgacctctatggatttgttcctgtttcaagggccatggacaaggtcgatgtaccggctgtcggtgtttgaaaatgacacagttggacatggcccatggacaagtggactttgacacagatttgtgttgcaatattcggcaaacatagctagcttactgtaaatgtgtaataaatcatatcgatttacttatagtccgtatgatcgtcgccgaggtctgccgtgacgac

SEQ ID NO: 52797 - DNA, 1093 bp, Oryza sativa
caagggctataaatgtgcagtggcacacatgcatgcatgtaggtgtgcgtgtttagctggcagtcaaacttagagtcaatgcaaaaatcatcaacggataagaatgccaactaaatgaaacaacagccgactcaccagacgacctccagcgattatggctgttatagcagctattgcttttacagcagccattcccatagcttctgctattgcttggaaaccaacctataagaagcagaaattgtgtaagaaagtttaaacagaaagaaaaagataaaaagagaacattgcgacaccacatggttatggaaagactctgcgagaagcaaccatggtcatattgcaattaaaactcttgctaaattaatgtctttggctgtgtccaagtgtcaagcatacatttcaataaacatatataacactagctgatcttacacaacagttacttatgttatatttctgtcaatttaacctatgtcatcagaaatatagaatgagcacttagaacaataaatagatcatctggcttaaatagcctacaaagggcaatgcaatggaacatggcttttaaagtgattcataaaatttatcaccaatcaagaaatttaacaattttaattggtcaattgatcatgctataggataaaacatctagattatctcatcagttcatgtcatgattatactgactgttacaagagtgatgtagagtacttgattgttcatgcacgaagaatcatttgtagtaaacacgttgatcattttgcaccaacaagcaaaaatgtcctaactcagacagggaaaaagaacatggcatcaaaaaaggttacccctccttttgaagaattaggtgatataagaggtattaatatcaacaggaccaccacagccaaatcctgcatacaacagtatgtcacaacaaatatctatcagaagaaagacttagattacattaacactagtcaggtcaatgcattttttttcctgtaaatggcaatagatatgggaagaggaaacaataaaccctaagcataagcatgtgcttgcagatgagtgtatgtctaagtccatgcttgcatacatgcatggcaag

SEQ ID NO: 52798 - DNA, 727 bp, Oryza sativa
gtcttgagtggtctgtacagctgagatggatgctgatggggaaaggcctgcaactctgacaattatcatttctcctccaaccaatgctccattcattgctgcaatagctttggtagcagattcagaatcagtaaacttgatgaaaccatatcctttggctgaaaaggtgtcaggatctgccaccactcttgcatgggtgatcttaccaaatggaaggaaaagctcaaccaacttcttggtgtcaattgacgatggcatgttacagacatacagattagacatgtcaatttccttgacggttctggtggtgctgggtgattcaacagctgaatttctggtggtgctgggtgattcaacagctgaatttggcagtgttgaaggtatgccagatactcgaacctctatctttctccattgacaagacgtccattcaaatggatgacagcctcagctgcatggtgaggactttattactgcacaaagccatatcctttacttaagccttgtgtgtgatctttggccacctttgcattagttacttccccaaaaggcagaaaaagatgaatcagcctgtctgtgttcatggacaaggaaaggttgcacacatacaatttagccatgtcagtttcctttgaaggctgctggctattatcctctgatgatggaaaccagctactctgacctttagagctttttcttcaaccaagcgcccattcatgcgcttaat

SEQ ID NO: 52799 - DNA, 720 bp, Oryza sativa
agtcatccgcaaggaagttgccaggcagggcaatctgccaatcagagaacagtgagttgtttcttaaaaacaagttcaactggcatcttggtgttctcatgaatcaggaatttagggtaggagagataattaccttctcgcccggcttgaatgctggtagacctctgtatgggcaagtaccacatcgaaatgcatcgcccaacccacactgcaattatcatttcacacataagcataacaggaaggcaacaaatctgggtaacaggatgaaactatggattttcagagggagaggaccaaaggcaaaaaaaaataaaataaataacacttaaaaagcagtcatgctcacattgccacaagctgactgagggttattgatctgttctgatgtgagatttagcttctccaccttctcctcagcctcagcccggccacaagtacagttcttgcatgccttccttgtggctcccacctcacaatccccaactggtaaaacataagcaaaccttcaggatctacatattaaatttatagacgttgaacaaagctgaagggttctataaaacagtaccacactggaagttctggtttcttcaagtcgtcttcagtcaagaggctgtcttcatcaatcagttcagaatcatcatcaatctgaatctttggaagaccctttgtggctttcttgagggggaaggaagagcccatgctccaagagacctt

SEQ ID NO: 52800 - DNA, 1453 bp, Oryza sativa
aattatatttaggagttggaactgtaccaaacagacccttagagaaaagtggggctctttcactttacgttagaggagctccgtccccggggacatggacggttggatgcggttttgccgccaatctcctcgcgctgcatgaccaaagcttcggcggcggaaacgcccacggcgcggctcggctcggctctgcggaaaccgggaaaactttcggtgttatcaagggcaaagatgccggtggaatcttagcccgtggcggtggcgtgagtgtgaccaggaagagagagaataatcacgatgcgaatgcgattgggcgtggacgagccggagccgtgtgtccatgggctcgattcttctattcaaggctttatatgggccttatcgaagcggggacccagagagaaattaggagtatcatgggccgagagcccgacagagcaatgggctgggccctttcgtactgtagatttaacttaaaaattaggagtgtgagtctggacgcaagttcttttcttttttttcctttttgcaacttggaattttcgatgtgtagactagtagtggtacgcacttgtaatagagtgggttccctctgaaatcaaggtttacaaagttaccagtattatagtgcttcctccgttttacaatgtaagttattctagcattttccactattatagtacttcctccgtttcacaatataagtcactctagcatttctcacattcatattgatgtcaatgaatctagataaatatatatgtctagattcattaacatcaatataaatataggaaatgctagaatgatttacattgtgaaatggagggagtactacacaaacgacgcaagaacccagccagtgttgaaacctgctcatctggggaactcaagcacatggtctctaccacaaagctctaatttttctcttgtcattttgtcattgttttgtctttacggttagatcaatagtggtccttgggttaggatgatataaagcttgtctgctcttattctgaccattggtgctactgctatcctgcatcaggtttccttccaactcccccctctctctgaagctctgggactttggattgctaacagattgcagatatgtagcagtaaaaatgcagtatagttgtattggacaaattaggagtacacatggtaggacatagagaatactggttcagaaaaaaaaaacactctgcacggcattaccgattatcatgtaccgattgtcaattatggcactataatggagaatactggttcagaacacctgcaaaggtactacaactactgtacgtctgtcacatggatcacccctcaggtgaaaactgaaaaccatcttggtactacactgtggatttttcacattttggtccttttgaaaaacttatttcgcaaatagacccctagaaaaacttatcccaaaaatggtcctttttgg

SEQ ID NO: 52801 - DNA, 782 bp, Oryza sativa
gtcaaacattttgaaacggagggagtaaagtcagttgtaagcacatgtggagtagagaagagaagaaagaaggaaagcgatctacagatttatagccaactgcacaacaaactccaatacgttgtgtgtatgagagacgtgaccatatttttttttgatcaagggctgcgcccctattccgttactagaaatgagcagagctaaaaggttcgaggcgtgaccatatattaatggtttatagataatataaacaaactattaaattagatatagataatttaaagtcagtagttgactatactattaaacttgctcttacttatgttagcagatttgcagataccaaccgcgctagctacatgtatagcccgctgttcccgggatcgattcaatcaatcctgcgaagtcaaagccgagcacatgcgtagcaccaacgagatgcagctgctaaccacatctattactcttgtttgaaaaaaaaagaggagaaaaaaattaaaaccatgtgattgacgatgctcttattaacttctaacttgacgatgctcagaggcgacgcaatgtcctttttatttttggtgaactcttcagctttataaataaccacacatgtggcttgtgaagactgacaacacaactgaacaaacaacttcctactagcaagttagcactacatgagaaccctgtgaaaaatcatgcgtcccaaacgccctgaaatcaaattgaatattccaatttgcagatgaagttcagctcccctgacaattcaatcaaaatgaaaa

SEQ ID NO: 52802 - DNA, 1062 bp, Oryza sativa
acaatcacgtctacatcttatcgtgccatattcaatgatcaaaagcaacaacaaatagatgtgaagtgcacgtgaggacgcaagcagcaaaagagcgatgaaaagttgaaaacgataaagcaatgaaaacgatggtgaaagtttggaagggaagaggagaaaagaaggcggctcccagcatttggaaagaaatatactactccagtagagatgaaggcagagacaaaactgtagcacttctaataggaccaaccatatccaccaataggggaggagcatacatggaccccatggcattcaaccccacctgaaagtgggatggcctaacgcatctcatgtgacgaaggaaacaccctggagtatacaccatgagaaaacttcctaatactacatccgataaggccccacaatacagccagcaagagtatatagaccaggttcaccaatatgcaaccgagaaaaattgagccaatgacagcacgcggcctgcaccatcccaagctgacaaccgcactccccgagctgacaaccgcactcacgctcgtttgcgcgcaagatcaagcatgcacagttgtgcctcactacataggcacattccatggtaggtccgaaagcaatgctaaccatatggcctacacgccagcgacaccaaagccatagaccaactgcattgacaatgcatcgcccaccgtcaaacacaccgaaaattcacaaacgcaattgaacgacaccgcacaaattatcacggataaaggccgcacgatctagggcctgtttggttggtgccacattttgccacacttgaggtatgttagtttgaccaaatgtggctagtgtttggtttgtttctataactttagcataccacactttctactcttttggtcccactagtcatagaccattttcttagccaaagtttgccacaagtgtggccatcaaattttgagccacacaatttgcatcttgccacacctttggtaaaaaaaactatggtaaattgaggtgggcatccaaacagcccctaaatcaaacggatagggtggcaagcagccacaaaag

SEQ ID NO: 52803 - DNA, 2100 bp, Oryza sativa
gtgcgctctgctttcggtctctcccgtttcttgcttgattcccctccttcaagcttggtttggtggggatttgtgtttggtttcatggtggttaaggtaggagcggggatattcctgctccctgattttggtttcttgctgttcttgattagagcagcaaatgcttcaaatttttgggggtgccatggagctccttttcgttactgttcacttgttcagggacattgcacaaattaggagcattagattagatgcctatgattttggtcagtaatagctagttcttgcagctcctcgttttgttatggttgcaatgttactcgagccgtaggagcaggaagagaggaaaaacaaaaatacacgcaaaaatgtagcatctttgtttgcttttaatgttaattaagaacggaagcccttacgctacagcttccaattagtgcttatcaacgcaatgacaacgagaatctttcttatgttgcttctatttgttaagcaatgtcggtggaggtttcaccgaggggaagcaatacctcttggttaaatgctggttctgattgattattcattatactattgtttcaaataggattgtcaaatcccaatgggctaaatttgtgtcctgtgtttttttaccaggaacaccgagtgcgaaccagatatggctctgtatctgtttctgtatttggagatgaagacaagccggcgctcataacatacccggatgtagctctaaattgtgagttttctgatgacctttcaagtttgtaggtgaaagcttgctaatttttccatggcagggtagctgatgttgctatttttttttgtttggtagatatgtcttgctttcaaggattgttcttctgcccagaggccgcgtcgctgttgcttcacaatttttgtatttacacatcactcctcaagggcatgaaggcagtcatgaaggctttttcttacccaatattattgtagcattcactgtttgcccgtatttgctctgatacttacatgtgttattttgtcctacagttgggagcggcttcaatttcatccgatgtgcccgtgccatctgttgatgagcttgtggatcaagtcgcggatgttcttgatttcttcgggtactggattaccaccctggccaaattgcgccttattattcggtggtgcttgatccaacccttttatgcggggcttttggctttggttattccaattaagaattgggatgtggttgggtgtcactggccgggccttccttcttaccctttttggaagaagtattactcttaaccgttatttcaaagcttggcttggcttttctttttctttttcttaagaatggatggatacattggcacagaccaaataccgggatagagtgattggccttatgctagtttccgcgatatgcaaagccccttcttggagcgagtggttgtacaataaggtactaacatacatttaaatctgtcggtactgcagtattggtaatgtgttctgtgaattaacctcaaactcttatgtaccaggtattattaaacttgctttactattatgggagtcgtgggctagtcaaggaatgcttgcttcagcggtattttaacacggtatactttggtcttctggtagctgctttttatttgcatccttttatgtatatcagcttcgctcaacagttttctgatgctatgtgcaggaagttcgtgggaatggacaagaccctgaatcagagattgtgcaagcctgtagaagtgtaagtagttcatctcctcgtcagctttctgatatgattttgacaagattggtagctgtctacttatagaaagttagtctgaagcaataggtttccttttatgcagttacttcatgagcccagggatctaatgtatggcgattccttcaggcgataaacgagtaagtggacaaattatcttctgtgcattgcctgaacatgcaaagaaacaggatttgaacatactcaagtgaatttttccatccatcaggagacatgacctgacggaagcgttgaagaagcttcagtgtcggacactgatttttgtgggagagaactcacagttccacgacgacgcagtccatatgacc

SEQ ID NO: 52804 - DNA, 1090 bp, Oryza sativa
attgctaccagattaggcatcactgcatgagaggatcatatcatatgtatgcatgtgcagatgggtaaaaagatgaagatgatattgttcactgttgacaaggaaatgttatgctaacctgcagatgggctgaggtaacaaacaatatcctggtatccaagagaaaagtacatattctaatgtaggagtatataattccaccattaagtaggatgtacaagcacagaaaccaaccaaaagttagttatcttggcacatttgcgcacagttgctatgggcaaacaaagccctatgagcaaattgagcatccatctgctcaccaacattaatcagtactactagcaatagcaagcctaacagaataacagcttgcaatactttagaaaaggctactatgttaacaaaaggtgcgagatgtagtgttagtcctgtcacatgtgatcctttatcttcatgttgatgcacatatgcagggattagttccaggtaccccactgccatctgatccccggataccttagcgtccaaactgatgtcgcggcttggcggatatcatcgctggagtcggcatggaaaagaatggtcacctcgcaagatggagcacagttattaaacaagggtgcaagatgaggaacatccttcaatggcggtagatgaaacaggagtctcctcaaacagcttctaaactggttgctggtgcataacatcaggcaatgcgtcatttcacatgaaaaccgaggggccaacttgacttcgctgatgcccgcaaacagctgaagaagatactcgggcttcactgcttcaaaaagttcatatttgtttgtagaagtgggcagctcaagctctaatgtagtgatatcatgattctcggcaaatacttgcaagaagggactttagatccaatgactctatccgcaaatttttcaaactcacaaggccatcggcttggacatttggtccaagtttatcaactgttaacttcagagtaaacatggatggggtatccaaaatgagcatatctggtcgaacacatttcagctcaagaccaaccaagttaggcgcacggattgttaatgaccgtggaacattt

SEQ ID NO: 52805 - DNA, 1099 bp, Oryza sativa
ggtatgcaaaatatatacataatcgcatctctaatttttttctagttatttccgtatagaactgttatccaacactatatggactcaagattgaatacgagaaaatatatagtatccaaatctccttttcttttttagttcatatattcagttattcacacttcaggaagaaaaaggtttgcgataaaacgtacatctattaaacttgttacttttactcagtaaatagtctactacaccaatttactccgtaccaacaattaaattataaaatcatccatatagtgataaaaggatactctgacatagaaatttatcatattgagcggtgctagcattacttcctcaaacaaaaaaaacaatcctgagtactttcgtagtatcaatcaatttatcaatgacacagtgattcgtgtatcttctgtataatgagtttgtaccttaaagcttcactaatttatcaatctggaaatttaggggattcgcaaaaaaaaaaatgcatactttctcaaactatcctgcattttgcttctaattttgctccctacaaaagtttcaaaaactcttcggtatagccatcagtgatagtttgagaatttagcattagctacaaattttcacacaagaaaagatctgacaacatttcattgacgcatgggtagctccaatcacaattgaggatgaggaactacatcaactttggtagtttggttgcctcttcccatctgcttgttctttaagagaacctctcttctcttccgcatgagatatgtcaattaaaaactcattcagcttaagctgcgtcctccacaactaataaaccccatgggggaggttcagttaatgaaaactctatattcttgttaaaacccccacaacatggctttgcagactgcgattccatttccgacctgcaagtctaccaataaaaaagaaaaaaaacagggttttccatcaggggggcatccacgcaagtgttcatcatctatactactattaaaagaaagtagtggtggtgctgagtcttcaaccatcactgacatgtgggacaagatattgggatttgggtgagtatagtcgaactgcagctctttaattt

SEQ ID NO: 52806 - DNA, 827 bp, Oryza sativa
aattttagcataacgtggaaataactgatacatgaactggaatgtaagtcacatgacatagatatgtcaatacttcgaacctaacagagcattaacaaacctgttttgtattagtctggaaaaaggagttggcagatatctggaatgtaagtcctctcaacatctctgtaatggttggtttcccatacaaggtatattcttcttcccccacagatgtattgccaacagacgtattcacattattcatgatactgacctacatcaacactacaggcatatcaatattgtaggaagaagtaattaattatttatttggcttaaaacccaacgggatttctgtacagtagaactctgagtgacataatagtcagtacatgaaaagtattttaaacattacactgttcgacatagtacacttaaaatgagaaggcaccaattacataccacttctggtatttttgtgatattgttaacaagaggctccaatagctctggcttataacatgatgtgacaaaattaaccatgacttctggagctccagtggtgatatttctggaaaattaacaaaaaaccaatgttcaaaagtgttcatcatgcaaaaaaaaaaggtaagaaaagaaatgttcaattggtaacaaaaggttaaaaatttatttgtttggggagggaaacaacatgacttgtttggtcatccctgtcctatcaaataaatttacttttaactgaacaattatagagaatgtgtttgtagaccgagatatttggcagcagctaatgaagccaaatgcactaacttcagtaacatgtttaaataccaaaatgatgc

SEQ ID NO: 52807 - DNA, 819 bp, Oryza sativa
  unsure (1)..(819): unsure at all n locations
gccgcagcaggcaacagcttgccacccatgatgttctctctcgttctctcagactgaattaatcttgcagtgcaaaatttatatgcaatggcagtgtaggaagcaacactgcagtacaagaggcaatcaagcaaattaaggtttttgggtgtgtgagatgagatgatccaaggttccaagtgtggaaggggtataaataggcaaatgaagttatatatacctatgtgaaaaccactcatgatcatgtaattaagatgtcagagcgctgctcatagctgtatgcatatagaagggttcactgttaagagatgaccgacttttttagctttcaaaggattaaagaattggagctcgagcttgaccaacctatactaactactaagcttgatgattctttttgcccaatgattgattgctcactctctctctctttctccntgactgacctttcagtaaaggaggaagttagcaatacagacagtgtagcgtagtacagctgtaatcagaaattcagatcgtcgtctgcaaattaaggcagcttccgttgtcgccattctccggctgatcgaagaaattcaacagatgcagcagcagcagcagctcaagccgtcaagcccgtgcgatcgtgtctacaggtgttacgccttatcttctcctttaacccaaccctttgtttaatccaggctaatgcccacgtcgtcatcgtcctcttcatcgtcttaacaaaaccagctaagaaaaaaatttatgactatagctctgttaccatattaagttttaatttatcgtctgcaggtttgatggttatgaatgtcactc

SEQ ID NO: 52808 - DNA, 971 bp, Oryza sativa
tgtctctcaagttgcaacctgaaactctcatccttatcacaaacaaagacctgatttatcctagttgtctcgtcctaatcatttgcatctagattcttgaactccaaacactagattgtttttgcagatatcaacagataaaaaaaaatcctctaaattgctgtgttttctacacctgaaattctgaacatgtcaaactcatcagttaactgtcatcaggtgttccatggactgaagaggagcacaggaaattcctggtagggctcgagaagctcgggaaaggcgactggcgcggcatttcccggcacttcgtcacgacaagaacaccgacgcaggtggccagccatgcccagaagtatttcctcaggcagagcagcctcacgcagaagaagagaagatccagcctctttgacgtggtaaacttcaaacatctttgcaacaatatctacacagacagtttcagacagcaagaatcatgtatttatatgagtgagttacagtaacctaacatgtctgaaaatttgatgttttttttcttttctttcagattgaggatgcagaaaaggctccgagtgtgaatgaacgtctgaaactgagacacgagacagcctctgtgcctgctgaaatgggattccctgcactgtcactgggtatcagcagcatggcacagccagaagccatgctgctgcctcctccatccttaaccctgacgccagctgttcatcaccagcagtgagcagcagcagcagcgaacaaccaagaacaatccatccttctctgatggtggcaaagcctcagtgcaactgcaactacaccacctgatctggagctcaagatctcgactgtccgtcagaacgatcagcccagttcgtcgccgaggacgccttttttggggacaatcagggtcacttgaacttaaagagagagagaagaagaagaaaaggaattatcttagagattactgaattatt

SEQ ID NO: 52809 - DNA, 1136 bp, Oryza sativa
  unsure (1)..(1136): unsure at all n locations
catagagcaaaccttatttcgcaaaacatttgtaccgataaccgcatacaagtaacaaaaaaataattggtatctgtgttggtcgatgttcaaatggcaatgcaaaaataaattacaatggaaaaccataaaatcagtttcaaaattaaaatttttgcagcgacttgtaagctgaaaggtatacaatgggatttacgcacctacccatgcgtcttgtgtagatgacagttatttgaagtagtacggcgttcagtcaagtgttttacagggaaagcatacagggttcctctacattgacaagatcaggttcacaatcccaatagaaaaccgatgaaatccagttaaattttgttaaaataaaataaaattcggttgatttttttaacttggcaaaaaagagagagtgaattgtgctttctacctattctggaaagtccagcaggatggaattgtaaaccctggacaagattcctacagggatgtgttccaagcagtaggaatcttctccagacttaaatccaaaaactaaagatcagatatcttgtagactaatcgagtgatgtccaataagaaatacgattagtacattaagtacagggcgttgcacagaaaacatatcacaaccccatgctgtgaacacacgctaaaacacatacgcgttaaacccacacacacagcttcaaatcttcatcgaggaaatctgaagcttgagcatacacgttgtcacgtaactacacaggcgcagctgggatcggaaacaacaggtagagtagtacggctactgcttttttcttgttttgccataacaacagtgatgaaaaagaatcaggtctctcctcgaattgaggagagtggaagagattgttctagcctctgtacacgccggagggatcagcgttttgaactatccaagggtgctcgaggagcttgtggaggggcagacgatgcgccgaattcttcacgagcatctgcagatcaaaatgctntcttgaggttcacactctggtggatgttctacttgtgtccaaatgacgatttacttgtcacagttttacagttatgtaaatcatcaggacaggagcatgcttcttacctgtgaaattaggtctttcgcagccggggacacgaatggtttc

SEQ ID NO: 52810 - DNA, 747 bp, Oryza sativa
gtcgtagcgtatggccaccctactacctctcgatctttctcccgatcttctctttggcagatcgaaaaactcttaaccgcgcaagctggatgtgatgtcacgtacgcgaccgatccagccgtacgtgacagtcacaaatcacagaaacgagagacgaccgagtgaggcgacggatccgttcctttgccgtcccggctcctcccggccgctggtctcgccgtcacgcgtcgcgacaaacacaaacacacacacacggttcgatccccacgcgagcgagccacgtatagtgctccgttgtttcaattcggcgcgatccaggcgtgacggtttctttaattaaaaatttctgcttttggacgaaacggacgctgcagaaataacgcagcgggtcgcaattaattggggcgtgaggtcagccaaagtggacgtgcaaccgcgcgggggccaaaatggcacgtatctggcccggaaatgggagacaccgctcgcacaccccttcaaattttggtaacggccaagcggatgcccatagcgcagcgcgcagtactactgattgcgtgcaccgatggcgacgttgcacagcgagagcggccaaattaacacagctgcaagataaagattttttttttcgcggggaaataaacgatcacggtgagattattatgctgaaaatctttactcctactttattgtgctatatttgttgctgtaaatggaacgggggtgggaggctgagattatggaggg

SEQ ID NO: 52811 - DNA, 844 bp, Oryza sativa
agtgttaggatcagtacatgccacatttccgagtgttcctgcaagattggtcgatcgatcaaacatcgcgttattacaagaagcgtgtagtgtacttgaacatgagaaaattcatcaggtgcaaagttagatcacttgctatgaacaaaaagctactactagtattttgctgtgcttcaaatgtggtatctacatgttcgtttagactcaaaaaacaaatctgcttcacatggattcgtgttaattctcgtcttgtagtttttcatgtttgcgtgtgaaattgcacagagagtttgcatgggccgggaagaacagaagatagctgatggtgatcctgaggatgatgagccatgatccgcctcgagattcgctttcgtccatgatgtgccctgctgctctgcaagtggccaatatcaattcccctaaaaaaaatgtgggcaatatgaaatcacggtcacaaacagagcctgtaattaacaaaaaaaacttgtaatgctaagcttacaaaaataagattttataaattgtaatgctgggcagggcagacagccggggcccacatgaggaacaaaatcggacagtacttgtactgtagtttcatggtagcagggagtacacataggggtacatggttagggacgcttgtgatgatggagaggcgacatttaattccaagctcacatgcttagcttagcctgattgatcacacttttgtttgtatcaggcggtgaatttttttcttttgttatcctttgattctgcttacctagtctgtgtttagttcagtgcaaagtttagattttgattgaaattggaaatgatgtgactgaaaagttatgtgtac

SEQ ID NO: 52812 - DNA, 18648 bp, Oryza sativa
ctcaaagacagttgcaagagtgttgttcttgttggatttctaatggagcactccacttgtcactttgatactggagtatatgttcatttcattatagaatggtggtgtagctttggttgaatcttctagtgttattcgtgtcctgagggcattaattccagcaataggcatttcatttcttttcacccataattgatcacttattgtctgtctagtgcactgttgtacaacattgaaccgaacagtagttggttgttggcttgctcgcataggtgtcataattcgcgcttcgagatctacatatgttgcccattaccatgataaatggaagttgagctggcattgttgtagttgcatgcttttatttacttactagtaagtaatataattgattgatcttatagatatagttcattatgtaaaagaattatcatattttgcttgtgggttgtttactcatttgcaaatttcattactcttttacacttggtagctgtttactgcaatgccagttcatgctgctttctactcttaccaaattaagtctctgggcagatgacgactgctattgccattgaagatgtcagaagagaagtcagaatattgagttcgctgacaggacacagtaacctagtgcagttctatgatgctttcgaggatgaagataatgtgtatatagttatggagtaagtgtgcacttattccatacagtgctctcctttaacttctttttttgccgggtcgtctcctttaacttctgtcttcatttgttgctgtcatgcatgcgattcttgtcttgtatacattagaaggttcagagatgaaaaaaaaatgttatttcatcttggtggaatgtttggctttgttcctgtcattaatgtttgtgaaactaccctgatacatgagaatccaagcattgatatataaatagatcattttctgtcagcaaggatttgtactttcaatctcaataacatattcccatcatgccgttgttactataaaaaatataaaatttcgtgcatgatgttgatcagagctcctctatgatcagttgtttataattcaagataacatatcccagtcaaattaaaaatccaagatactcataaaaaatggtgctttcctgcaacttgcatcacttgattacatttaacttaatgtgattgccttttctgtttcaggctatgtaaaggaggtgaactactggataggattttggcaaggtagagtcatgatatttattttgtaaacaatgcttgtaactaattctgctagatttgagttataacttactttctttcttcacagaggtggaaaatactctgaggaagatgcaaaggttgttatggtgcaaattttgagtgttgtgtcattttgccatctccaaggtgttgtccatcgtgatctgaaaccagaggtaggcttgctgccaaacaattaatagccaatgttaagaagttcatgttacaacctaaaaattgttaatgttgaatatgggctctaactgacataagacattttctcttctattgttatttctgtaaattttctgaattttttttacccaaagtctactattgagtctagcagtcagcagaccaaatgcattattttgtaaataaccatatttgttgttcccctttccagaattttcttttcacctcaaaggatgaaaactctgccttgaaggtcatagactttggcttgtctgactttgtgaagccaggttagatttacagagtccagttttgattcttctttagtatttatccttgccaaaccaaatttaaatgtgttgagatatcatatcattgctatattctgcagatgaaagacttaatgacattgtcggaagtgcatattatgttgctcctgaggtgcttcatcgatcttatggcactgaggcagatatgtggagcattggagtgattgcctacattttgctttgtgggagccgtcctttctgggcacgcaccgaatcaggaatatttcgagctgtgctgaaggcagaaccaagttttgatgaggctccatggcctactctcactgccgaagcaaaagactttgtaaaacgactgcttaataaggattaccgcaagaggatgactgctgcacaagctctcagtaagcatcagatttgtttgtcagtgtaatattgtggcactcgctttttatcgaatgatggttaattgctcacttgcatcatgatatctgcaggtcatccgtggatccgaaattctcaacaagtgaaaatacctttagatatgataatctacaagcttatgcgagcttatatcagttcgtcttccttgcggaagtccgctttgagggtatgcataaacctttgtgttgttcttatctggtctgtaaatgactattcttgctgcttatattttttttcattttttacatgtgtcaagttatccatgtacgagcaatatattgcttttggttgtgcagtttaagtaggcttataccgatatgtcttgactctgatgacatcaccaactagccattttaagcaatgtccatacattttgcaggccctagctaagacattgacggcaaatcaactgttctatctaagagagcaatttgaattgttgggtccaaacaagaatggttatatctccttgcaaaatttgaaaacggtaggtattctcacctttgttacttgatctaatttatagcatgcaattgctgaataagtaaatgttcctacaggccttggtaaagaattctacagatgcaatgaaggattctagggttattgactttgttaacacggtaagactctttcatagaacattctcttgtgttagtatatcggactgagataaacactgacctgctcaagccatggtactaggtgtgcactcttcagtacagaaaattggattttgaagagttcgctgcttctgccgtcagcgtttatcagatggaagctttggaaacatgggagcagcacgcacggcgtgcatacgagctattcgataaggagggcaaccgacctattgtaattgaggagcttgcatcggtatgatttgagctgaagtaactttttcgcatgattattaaacatttctaactgttatatttttcatctcttaggaacttggacttggtccatcagtccctcttcatgttgtactccaagattggatcagacacgccgatgggaagcttagtttccttggattcattaaacttttgcacggagtttcttcgcgatcgatcccgaaagcttaagataaaatcattcttgcatcaaccaatgaggtcaaattgatggctaagccaaattctctggatggtgttcgttgtgttgcgcggtttgaggtggttggagaggatgtcttgaaaatcagacaaaaaaaagaaagtgacagtttgtgtaagaggtgaaaatgttcttgctgctactacttctacccctccccttcgccacgtcggattgatgttgtactgaagctgtgtagacgatgtacagatgatgaggataggaaaaagaatatggaagggttgaaaagatttgagactggtgtttgtcaaagtcttgcattgtagtagtgcatcttttgtctcaaataagacatttaacgtctcaccccttggtctctcattgtgttattatgccagtatgcgacagccctgaggttacagattcaactgtgtgctgttcatttctctgtacttgttgttgcaattgcttctactgcagccttctggtaccaatgcaacaatctctgctcctcactgtccattgatgatgggagaatctgcatttttactgcaaggctgcatctacccaagcatatgcatatattcatggcgatatgcatatatcaccaatgaccttggccgatccgcagaagccggggatctaaaccatttccattctctaaaattcagagtatcaccagaattctgaagaagtgatctctccaaatgtaataagatgccctggaagagggctattcaggatcaagacaaccacttccttttttcagggtctcaccccttgttcagcaatcagtagtatcactgtctgttcaagtgttcatagcaaaagaaaaggcatcacacagtgacattgctgatattggtgtgtgcaatgcaatgctgttaatgccgcgttgtcgctgtctgtgcaagaatgcaaaagcactggatctggggtgcccgtacggcaaagcaaatccggtcaaattctgatgaaggagtccggcaagatgggacccactgacagtcaggaagggacccaacatggttgaaataattgaaatgctattgaagttctaaatttgaccaccgataaattttaaattatagtgtttaaacgaataaaaactgcgtgctcatatttaacatgcaatgcactttcataacatgtaagaggtaaaattttggatacgaacaatatccggtgacaattatttagggatagagggagtaatcatattatgatattatggtattgcatgttcttagatggataatatatttgtgagcaattttatatgtcgaaagatgtttgatgatcgtgaaaggaatgcaaaatgtgtgaagatttttggcatggtgtgccacgtgacatgccaaagttcaggtttttcaggctgtatggtcctcggtttggacctgtttggctgcatttggatggatagtgtaaaaccatgagcacaggttcagtttagtagagtgactttatgtgcttgtttttactgtcacaaggttcctcgagcaacacacagtaaagtaatggtaaaaatttactacttattgtacttgcttctgctgtgatatgaacaaagaaggttattaaaaaaatgggaaagaaaaaggaggcctcttctcaaaggtcgcaaagaagcagaagaaatggctcaagcttctgaactctgaagtctcctgcactttgtatgcagttaagtataacactgaaagtttcttaaaagacttgagagttgcaccaaaagctcgaatcatggcaaatgatgtgagctttgtttaaagtctgaagaaatcttttgtgatgtttaatgttaaaattcgaacactggagggtcataaaagacagacaacagttagagtttcgaagcaagatcagatatgttattaacacctcaaaagatgcatgatttttgtgagtggactcaaaagctgcatgatggcatgcatacattgttcagtctacttcagaaagaaaaataaattacgttcattggaagttcaaatcgaagtccattcaaaccaaacatgccggacataataataatgtctgaatcgttgaatgttaaacacaatagattagagaaaaaaagcaacattcgttactgtaaaaactactactaggaataaaatattttaacatggatactcactaaaaatttacaattaatgtggagatgcggggtatcgatccccgtacctctcgcatgctaagcgagcgctctaccatctgagctacatccccaatttgacatttttctatcatatattttacttatcagttaaaacatgaaatggcatcgtttcatatgaatttgacacccttagcgtatattgcgggtcttattcgagcagaaatttctttagaaatcattcaacttgggaaatcctccttgatgtcaggttcagttctaccggtaacacagacagtagacacctaattttcccgtgtgattatctagttcaagactaatcctccgttcctccttgatgggatgaagctcctgcttcgccaaataatagtaataaaaagatctgcatatcttaatgtggccttaggctgagtttgaaggagcatttgggctgaaagtttctttaatttaccatgttcacgctttcaaaactgttaaacggtatatttcgtataaaaaaattttatatagaagtttcttaaaaaaatattaatttattattaagtttaaaataattaatactcaaattaccatgtgctaatggtttatctcgttttacatgccgctaagttgctaagcccaaatgctcttccaaactcagcctacgccaagcaaaatttaaggcccgttagccagtaaaagagcgagattacagtcctattgggcccaactcactcgcatgggccgaaatccagcctatccatagtctggatttcactcaatggaggcccaacaaaacaaggcctcgcaaacaattaacagcccaataaggcccatataatcagatcccttacttaaccttctcctctaatctcaagaaaaaccagaataaacatttcccccaccaccttcgcctcctcctctcccatggcgatcccctaccggatcaccgccggcggcggcggcggcaggcagcggatggcgctgccgctgccgccgaagggcgccctgctggccgccgtgacgacggcgtcggtgctgtccatcctgtgcgtgctgtccttcaccgactcgctgtcctacctcgggttccaggtcaggggcgtcgacaagagggagagcagccgcagctacctctactggggcgccgccatcgactgccccggcaagcactgcgcctcctgcgccggcctcggccaccaggagtccagcctccgctgcgccctcgaggaggccctgtttcttgacaggtaaccatggtttggcacgtgtatagattttgattcgtacctgcattgatctgtctgggctgttaatccgtaatattcccacttaggaggatggaaattgttgcaaagagccaaagaatgtaatgtgggatgatgtgatataataatgtggatatgtatgaattagtttttgttgttgtggcagaatatttgtgatgccttcaaggttgtgccttaattcagtgcacaatacaagggggattattaatcaaagcgatgcgacttccaataaaaggtttggcttcttgttaaccacctacttctatgtgattatatatcttcctgtatcattctgttttcctgaaatcgtgctagaattgaaactcaccaactcaatgttttggcagtggcaggtgggaaacaagttcatgtgcgatggaatctttgtatgacatagacctcatatcaagaactgttcctgttgttttggacaatccacaatcatggtatgctatagtatcaagaagtacgaagctaggagaggaaggagatgtagcacatgcacaaggagttagcagacaagaactcaaagaaaacacactttactcaaaggcattcctcataaaccgcaccgcaagtcctcttgcttggtaagaatgctagctcttaaagaatagccttaagccttcaagatcacaccgaattgaacctatacaccatgactagaattctggtatagaccttaatcatcattacagttcaggtttatggagtgcaaggatcggaccaagcgtagctctgtgatgttaccatacaattttctgccatctatgccagcaagaaaactgagggatgcagcaaacaaggtatatttccataagtttgcctccttgctcaatttaattgaaattggttgctccaatcggctgaaaatgatatcttgttttgcaccagattgcttagcaccaagttaataatattgttcatttctgtttatatcgaattgctcatggaaatttgccgagtagaactatataacataaaattcaaaatcctaagaatgtggctttagtgtgcctaatgttagttccccacttaaaaggactaacattgatgtcccactgtaaataaatctcgtagctgtcatttttgtcagcattgcgtgcgacataagatgtgtagcactgtagcagcgggcatctgcttgttgaaagttaaaattcaccggcaaatggtgaattattgcctcatgctgccatgggattatgttttattactccactccttcattgagaatttcatgtttgtcatggttgttctggaataccgtgggccatggtaccactctatttaccctatgtgcctatgtaattgttcatatgctagctttgcatctaaaaaagagctttgggacctattgaggttattggattactttccgaaaagattttttggtaggacaaaattgcaaagcttttgtctttctaggtttggtcaggcagaacatcataatatatcctgtatataaatcatttgtactgtactactgtttgtttatgttaagtgacatccacgtattagtacagcatagtatgttactctgctttctcccatctaaatcagtgtgctttctttagattaaagtgatacttggtgactacgatgctattcatgtaagacggggtgatctactgaagaataggaaagatcgatttggtgttgagcgaagccttcatcctcatctggacagagatacccatcctgagaacatcaaaagaagaattgcaaagtggattccgcgaggccgtactcttttcattgcttcaaatgaaaggacaccaggcttcttttcacctctatcagacaggtaatcaacacattgtgtcagctgctcttcttgactcaccagcattaggatctcaggcacgatttacatttgcatttggtttctgcaatcaatttagatgtgactttagcgattcgtgttctcatggatttaccacggcacatggtttgtcttcttctgttatcaattacttcctccgtttcacaatgtaagtcattctagcatttcccacattcatattgatgttaataaacctagatagatatatatgtttagattcattaacatcaatatgaatgtggaaaatgctagaataacttacattgtgaaacggagggaatacttcaaaaacatcccattcttaagaaactcgactagttgctgcagtactaatgcactttgtcattctggaatatttattttgtttggtatattcattttttttatttatcacaccatggcttaccaatagaaaaaaacaaataatatgtacatgaccagcagtgcaatgtcataccattgaatgcttataatttcatgacacaagctggctaacatacttatgagttttctttggcgtggatacagatacaagttagcatactcatcaaacttcagcagcatattggagccagtaatcgataacaactatcagctgttcatggtcgaaaggttaatcatgcaaggagcaaggaagtttgtgaagaccatgaaagaattcgataatgacctttctctttgcgatgaccctaaaaagaacaccaaagtctgggaagaagcagtttatacagatggctgatggttcgtatttgaccgtatttgaccttccattgcatatgaagtacagctcgcaaactatcactaatggttttgcatagataatagtataatactgtcatatgaatatatatgattaaaaagttttacttctgatctgaagttacactcaagctaggacactcaagtcaaccgacagaacaaggggaagcatgcatgtttcctttcttcagacaagagatgttcaatttgttcctctctcttttttctttgatacacctgggaagagactatatatgctggtgtgtgatgtaacttcatcgtggttttgatttaaaccaaattgtagtgtatatgtaataggcaattacctatcagctaatggtgaatacatctgtaattaatttgtcaatctggaaattgattcctttttggagaaaatctggaagttggattatgtttaacctcttgcagatgaaaaggcaaatatacataccatctacagtgcacgcttgttgcagatgtactgcatgtcagtacagcagaaatatgcaaggtacagcagaaatgtgcaaccgtaggtgtatatttgcatgcaaaagttttttttttttgccaaatgcaatgcacatacatgtgataattaaacaggtgcatgattaaggtgcaaaaacttagatgccttggacttcattagtaccatttaacatccacttagctagctaattaagctagttcctcatctgatcatcactcttcaccagcatgaaaggtgatcagtactctctcacatgatgcatggcatgcatgatgcatggcaagatcaaaataagcaagaacaaaacaagagctacctaagtgcaattaagcactagcagtagcagctagctactaattgatttgattgatcctaattacctcctagctagctactcctaccttaacgctaatcaactcttgtcatctcatctcaaagactaattaacaaactaattaacacctgcacccttgcgcaaatcaatcgtcgtcgtcgtcgtcatcctcctcaagaaatcaagcagcagcatgagctgagctgatcgatcgagctagctcatcatcatcctctcttctctatatgtacacgagatcgagcaagcatggcggctgcaaagctcgctcacacctcgcttccctggtcatggacgccgtcgtcgtcgtcccggtgcgcccgcttcttcctgccgtgcagcgacacgccgaacagcttcaccgtgtcgccgccgtcggttgctggagtcttgggcggcggcggcggcggcgagtgatcgggggagtcgagctccatcagcctgcaggaggcggcggctggaaggtggtgttgcgccgccgccatggccgtcgacgagggggtggtggtggtggtggtgaccggcgcgacgtggttctggaggaagtagatgatgtcgttgtagagcttcttcatgtgcgccagctccgacagcagcagcgagttgcgccgccgcagctgccggttgtcctccgacagcgccgccaggaagtccccgccttcgccgccgtctccggcgacagtacagtgcgccgtcgtggcgggctcttcttggattagatggtggtggtggtacgccggcggcggcggcggcagcgagaagggattgaggtggtggtggtggtggtagggttggtgcggcatcggcggcggcggcggctgcgacgacttccgccggtgaatctcggcgaggaggtgcttggctcccttcctgaagaactcgttggcgaactcccacctgtcagctactatcttcctgaaaccctgcaattaacatcatcataagttcataacaccaattaattaatgcccaaagttaaacatacatacttagtattagctattagggaaaggattatgaacactcgagaggatatctcctaatcgtttgcatgtcatctaaatggttataaaattttagaaaaaaaatcaacaagatgattaatatgtgattgtattagtagctaataactaaaaaaactaagcaatcacacaaccaatggagctagcaatcacaaaaaaaagagagagagagagagaaaagaagaattggcaaatggcaaaatatactactacctccataaaaaaaagataggcagagatgaaatctttgtaaaatgaaggcagtactatgtaggagtatatggtaactgatgttcaatattgttgctagtcatgtcaagtggtgctaatatgaatggtggagtatatacttggcacagaataccaaggtacatatatgcatctctgtttattgtgtcaaacttttcccaatgattgggagtggatagtgcactgctaattctctaaagatgaggaggatagaacaaactataaatacatgtaaatggattattcatggagctagaattaactactactacggcgactacgtactaataaatactaatccactgcttactgtgcttgcacatttaatttgtgcactttgattttggtcaagactcaagaggcaaagggaagattagaggaagtactagcgaagtacattaattagggaaggtagaacagtggtgctggagcaagtagggtaagaagtgaatgtacaacacagtcatcaacttatagtggttcagaagaagaaagagaagatcagcaaacagtcagcacgtactctcatgctgctcctcacttcaccattgagagaaactaattaatgtgcatcagataatgttcagtaaaagaggcacaaaaaaaatttaaatctccctcatgttaaccaggctaaacagacaagaaaaacagtagatgagattaatcatcagcacgaattaatatacccccagctctactctatcttttcatcagaagcaagaaatatatttttgaaaaaaacaagcaaaagagattaatcagctcgttggaaggtcgcactcaaacagcaatgcctttccagcgtgcaacaaaaatctggtacaaaacaaaagatcgatgaacaaaaacttttccaaaaccctgtcacattctaggaaacaagcttgctaaccaccacatacacaccaaatcacccatcaaaacaacaagaacattaaaccatagtccatgcatgccagcatcccccatgcactgactgaccaaacctctacatcaaattaaaaccaaagcaagaaactatagcagctagaaaaccaactgatatatgtatgtatagctagctatagatcgattcaagaacaagcaaagaaatcaagacactacaagaacccgcaattttcttggcggccaaaaaaaacagccgccaagttcatatatattattggcggttctaaccagctaccaagcatatacatgtttttttggcggctatgcacaaccaccgtcatgtttttgaccgacatgaaaattacggattcttatagagcaacaatatatatgtggcaaaaatgtgcaatggtagcagcagcttacataggtgttgagctgcctgacgaagctggagaagttgttgtgcttgaagtagttggggaggaggtcgcgggcgaactccggcggccgccacacgacgaaggtggtgtcgtcctcgccccacgacacgatgtggtcggtgcaggggtcgtccaccagctggtacgtcttcgtcaggaacggcgccggcaccggcttccccgccgccgcgccgccgccgccgtgcggccccatctccatcgacaccaccatctccccgcacctctccaccaagaaagccatagctagaagaggaggaagaagaaggggagaggagaaaggctgcagtgtctcactgtctcgcactcacacagagagtgagacagagagagacgcacacgcacacaccacgaaccccgcgcttcaaatattctcgtgtgggctcacgtactctctctcagctcagctgcctggacctctctctcatgagctctagggggagtgtagtagagaagagagtggtggtggtgtgtgtctgttgcatctctctctctctctctctcatgattatagatgcatgtgcatggaaatctgtgcaaggagcagtgggtgcagggtgtgtgagggcggttcaaagtgctatggtggtatagcttagcttattagggcctgtttagttcgcgaaatggaaatttttgggtgtcatatcggatgtttgaccgaatgtcagaaggggttttcggacacgaatgaaaaaactaatttcaaaactcgtatggaaaccgcgagatgaatcttgtgagcctaattaatccgtcattagcacatgtgggttactgtagcacttatggctaatcatggactaattagactcaaaagattcgtctcgcgatttccctcctaactgtgcaattagattttcttttaatttatatttaattttccatgcgtacgttcaaagatttgacgtgatgtttctgggaaaaatttttggggaactaaacggggccttagcttaggtgttggggagaaggacgcagctggagtaggagcgaggagcttcttttggcacttagcattgtggtaatcccatgcttaattggccgtttagggcatggtcatggggttgagttagtacgtgttgagttaagagggggagagagagattgagtgttaaaagaaaaacaatatttgaagggagagacattcctctaaatattgagttactacctctgtccaaaaatatagtaacttttgagtatgaatctggacatactccaaatatatagtaactctggagtaatatttaaagggagagacattcctccaaatatttaagaagaaattataagcgtgttggggattgaacacatgtcctcgagattgaaaccatacatcccttgccactgcactatcaagtgcatctctgagaaattgagtgttgtttggagaagagagacctcgattaaaccatgtgatttctaactaatgaacatcatggatcaatttgtagtgtgctttcgttagttcaaaggtgaagaaggagagcataatttgggtcttagcaggagcaaagcggttaacggagtttctaccttaagcaccctaacctaacattatatttactttcacacttgtaattaaataaactttttttctactgtattcaatgaaattagcacgtctggtgtccgttcatgaaaaaaaatagttcgatggaggtaatctttgggcagctgttttttttcctttttttaaaaaaaacaaaccatataccatatgtcatatgaaatatgaagtatacggatttgctaaatgatatttgataaaacaataatttgtggccaattcctgcaacttcttgactgtcggatctgattcatgattcgagttccaatgacattcctgctcgatccatctccggtgaacttccgcgagctcataaatctagtggattgcggagttagggttcaatgttgggctagggatgttgtacactcaaaatgcaaccatttggtatctgttaaaagtatgaagatggggcatgttgatccctaccaaaggagcccatatattgcaccttttgatccattggtgtgatcttttcttcccccctccagttacaccgtctctttggtccctaccatttcgatcctaattatatttccaccgcaattgtacattactttttctacatacgcaggggcagagctatgtatagctaggagggtgcccacgaacccggttaaaaaaatagctatagtttatatattttcaccatatatataccccgtcagtttaaacttagtcacccatatcaagctaaattcgattcaaaccagagtaaattaagcaagtggaacccctttattatgttgtagctccgccaacatacacactatatatactgttatctcttacccgataatattttatttatgagtgattttacggtcctcgctaagatacatattagaggtataaagcactgaaaggtactacttccgtttcaggttataagactttttagcattgcccacattcatataggtgttaatgaatctagacaagaaatatatatctcgccacggtatatcatcatacaattaatttctccttgctcatattggccaactcagtgttgtgtacgtgacaactgacaacctctcatttggtgtgtttaacttgcttttgttcatactagctatttttttccaaatattgagaatatagtacttcttagttattgctacccttttacagtgaaactccaccacagatatatagctaatattgttctcttcaatcatgatcgaattagcatatatagtattggtgacacaagcagacaatacagatatttgcatggtgggagaataatcaataaaatagaatgtagcatggacaagatgttgacagatctagtgctgtgtagctttatctgtttctttttaatgaaagaaagcatgaaaggaatatcctgtgtatatactgatgataattaatatacatatataccataacaaaaggtaactaatcaattacaaagttattactattgattacaagtgggaggtaagttaagctagtgatacatttctttataaatcgattgcaaattttcaatacaacaaagcctgcatctggctagatatagctcaagctagctttgaacatcagaataggtccaaaattgaagtcaccgtgggtgtacatgcacgaatacgtacggcgacgatttgacaggaaggagcagagatagaatcatagaaagaacaagagaccaactcgatcgcacgggcatacactcctgcatgcagatcacaaagctatcaccataaacaaaagaaatggaaaaggaaaggagagaaaaagcagagatgcagatgcagagcacgcaacacatgcaaagaaagaagaagagatcgaggcctatccgatccggccgtgcaggtgatgcagtggattcactgcagagaaaggaagagaagagagagagagagagagagagaggcagctagcacatgtaattgtgctaggctgcacggccggtatcctcatggtatttagtgaccaaattgttctctctatccctagctggtagtagtggcatgcaggggaagtgcatgcacacatccatgtacagatgtctagttgtaaacaaccaaagatacttttgtgcctgcctgccttgcccctgcctcctgctggtgacttgcaagtttcaaggcaggcccgtgacttccatggagcagcgaaagcacagaaagtaaatactctactcactccatcactctttttaccgttcaaaattggtcccataataacttcttcatctttgactaattataattattcttttattaaacttctctacttacttactcgtttctaaccaatcataacttaataataactatattttgagacgataaaaatgctacagaaatacttgtattttaagacggagagagtgcttatagttattctttactcgtttctaaccaatcataacttaacaataactatattttaagacaataaaattactacagtttgagacggagagtacttacggttattcttcacttggtggtgagtggtgggtgcagccatgcagagccactggtagctagggatccacttttgatgcaacatcattttctattgccctttcctctgccattggcctgctgcatgggtgtgatgcaaggctgctgcttccattaatatcatatcaatgtgcaagaaaacaaacattcccccccaacttttcaaccagcattgaaagaaacaaaacaaagttttttttttcactccttcctctttggtcccagctgtgtgtagcaccatgtacacactatactgaatactgatgcagtagctatagtcactagtcagcatgcagatgcagtagctaggatcaagtacttcaagttcaaatgcacttgtaacttgtgtaaagattacatataggagtatacaaacttagctagttcctccaccaccactctccattttccttttgcctttccatgttcctagcaataaagcaggagtaatagcttaatttggctcagtcaaactaggctttgtgacccatccttttcccagggctgcccctgcaggtgatagatggatatgtgcaggaagatagcttagggttttggcatgcaagtactccctccgtcccataaaggtgacgtttttgactttttatttgcaacgtttgaccattcgttttatttgaaaaattagtgcaaatataaaaaaagataagtcatatgtaaagtacttttgataataaagcaaatgacaaacaaaataaataataattccaattttttttgaataagacgaatgatcaaacattgacaaacaaaaactcaaaaagacaagtaatatgggacggaggtagtacccaagaagatgccacaacctgcaagcaacatttgcatatgcatcaatgcaggtgggcagctatatatgtggcctagtgcagtacacactgctggtattgtccctaggtgtgtgcatatatgcaacagctacagtttacatagcttgtggaccaaaatgcaacaagaaaagaaaaaaagacaagggaagaaaaataaatcatagcatataaaactagcaagaagccagttatcttacaagctataggactgaggcctatagatgtgcaaaattgaagcttgcatacatatatacatgtgtgcaaaagtcttttgcttcattgtgcagtgtggattggctggggagtttgaatattatggaagattctgttccacatatgacaagttgctttaatatgatatgttttgtagtagacattttatgagtacatcacatgacctttctccatctccacatgtggcccactgcatttgtggccaggtctagatctatctttgactgccaaaaatatgcataaaataatgagagaaattaaaaaaatgatggagatcatcaaatatcatatgatatatatgtacgtgatatggaagtgtggctagtgaaagacatgaagcaagaaaagaatgtcatgttcttctctagatcaggcccacattatctgatgatgatgacacgatgcatgcatgctagatgccgttaaaaaccagttctctagacatgttgtgtgctccacacagtgtgcctctcatttcgagattcctctgaaatcactactaattctttatcatatcatgcattgcatgcaagagctagatactgtggcgcttatatacatgtatctatgtgcatacaatttgctgcatgcgacaccactgttgtttgcatgtcgaagaacacctctgttttcgtgcaatgaactgattgatactcaggagtagtttgctaattagctaggggagatgcagaggtgactagaataaggaagatatactcactagaagatggcatactgtgcaaaagatgtagctgtttgtttgtctacgagtagtagatcag

SEQ ID NO: 52813 - DNA, 4855 bp, Oryza sativa
tgcatgtttatgcatgcagaatgtagtgccggacatatgcttgatttgctagactattttgattttgcgattaagttattctaagcatgtaaagtccaaatcatatccgtgagcagcaatgcgcaagtgcaaccatatacatatttgctgatagcctgatactactcctaatgatgatttgaggttatcatagataggcctggtgcatttccaactgatcaatttgtatagcaaaagcaatgccaactaatagatcatatggcttgatcgactcgatctgcatatgtggagcacgtgatagccaatactcctatatatacgcaaggtcaatggatgagatcaagaactgaaatgataacccagaaaaaggcccaaaagagtggttttgtgttgctaagaacaaagctacatgagttcttgtacttctttagtaatccatggcgtacttcctatcaatttcttcaactcctaattaattgatatgatgcttcaatgtctacattttccctcccagccatagaaattgtttccaagaattaacaacaatagaaacagtcctgatttattatctgaaaaggcacccaaagggcaatactggaaatatgccaatatttggcagcaggaacactaacatgggatgctagcttctgtagagcaaaaaagagaagtggctcaggccagtagagaagtgcatagctgcatatgcagggaattaaccaagtgatggaggaatgttgcaagcaatgattgtcctagcaagctcctttggcacacatgtctcgctagattctgatgcaaagatttagatctccaacagataaaagcaggcagtagtagtgaaagagggcagggggggaaaaggaagaaaagctaaatgggaatcattaaaagttgccagctttcagaaccctgtgggtccagtttggatcaaggagaatcacaaggcccaaagagccctccctccaaagatgaggagttttctaaaagcctgtgtgagctccatattgtaacttatctaccaaaagaatgttgtgttaagacatgcatggtagagaaagatgaaggctgtctttatagggaaaaggagtactgccggtactgtattgctacacacttttttaccatggacagcaggaatcctaagtagaaggatcgaatttacttgtagctacacagtgaaacaaccggctactgattgcctactcaaaattcgctttaggtcaaacagataggacagacaatgaagaacaactagaaaaccttcagaaaagcaggctgctaagcattccacatttcctccctacacgtgtattaattagtgtgtatgctcgtgtatgatatgaacaagatttctgctgtatcaagacaacaatggacatctcctggtcactctacgttgtacatacatgcatagaggatgcagatttgtactgtagagaattcagatacgtacatacctggcacagtgcagtcagtcgtcgatccagggagatggaagaagccaaggacataagatccaagcagaactggtagattcctctagctcggacgtcctctcctcgtcttggcctgaaccatcatcagcaagcaagattagacgaccggctctgaagcctgaacgtgaagctagtggtaaacaaaacaaacaacaggatagcctggccggcactgcaaccgtctcgtcaagccgaccggtggacagggcgcctgcaaccggtcatgtgcgccgcgcaggacatctggccatgcatcccatcgtcgatgcctccgaccgacgatcgagccgttgcaacgaagagttgacggtgtacggcgaaattagcttgagcccggccggcctcaaactgaagtggagccttcagaaatgaaggagagaaaccaatcatcacaggcatgcagcaacgtacgattcgtcgtcgtcaatggaggttcaggcgtgtcgccggagctgggagggacaagatggcaaggccggcaggtacagccacagccacacccacaggcaggctagccgggatgccggccggcaagatcgatcggctccagctagtttagctcccaggccagtcaaggtagaggcagctcaaagtgtagtcatctcttgatcgttgattgctccagtcctatcccatgctcctccttgagctcccaatcattgagctctcggatcctctctgctcttctctgatctggtgtcgttccagtttccaaacatgttgcagaatgaagaacactgaacaacaagattataaggtaggtaagtagttgatcatttcaggtttccagagatgataaagcaatcagggatgcatgcacactgatgctgattgtacaaactccaagcaagtcaggcccaggtccaggtccaggtccattaggtttctgttcatttgaagttggtctcaatcagtttcagacaatgttgctgtaaagataatctctcgaactccaaggctatatcattgctggccatactgatagaggttgtgttacctgaaaggttgtcagaggacacaaaccaactgtcacgccgaccatctttcgtcctgggaatgcgaggctaccattaactccccaatgatgtcatttctctgagcaaataaatggtacctcatgtatctccaggaggaccagaatagcagcaagaactgcaggaaagaatgaaacaaagccaagaggatgagccaatctcaaattattacatgatactttcagcaagataagcatactaaacttcaagttaattgatgaatattattacaggattctactggttctcacaaagaccattgaatagtaagatctatagcttcggtcacttcttagaacaggaaaaacaacagtactagctaacgttcagcaaactaactgtacatttgtttgatggaggacgcatgacaaatgcaagtgcgatcataatgaaaggaaatgatatgtgaacagaagtagaccatcatatttggcatcctcattgtgttctctagttcttaagactcagtgtccgttgccgttctgtatgaatcactctgagaacgatgttttctcttactctttctcttgcttcttttttcaggatttttccttcaaagtttctttcatcagcttccttcctccctttctttttccagatcaggattttcaaaatgatagggaactggcatagcttgcttcttcagcttggtgctcttatgctgctgcatccttgagggccgggatacgtagaccccgtcattcttgcactagtatgtccaatgaccaggctggaagcacttctgacattgggtatgtgcagcaagagatgaagttgctgaaacttttggtttcacatccaatattgcagctttctctgtactaatcaggtacatctctcacttagccttcttcctctcctgccagcggcttggtccctcttccttctgcccataggtacattacgggcagcagatgtggcagcatgtttagcttgagacctgttcaaccctttagctgctgataatgcggctgtctttatacggtctactgcagctcgggatttatcatcgtttctggacatcttgattcacccaaattagggcagataatattgcgaggaacctcaccatcctaaaaggaagaaaaaaactatattggttagttatgagcaagggataatttcatctatagtaaacaaaacctaaaacatctggctaggtaattcactaacatggtcacatgaatgcagacataaacttttctgtttactcaggcttaacaccattaagccctgtaaagcacttacaaatggtactgctcataaacaacaaatcaaccatatgtattttacagttaagccttcgtgtatttagacttgttgttgtacaattaaatcgatgaagattctatcatggcgtatacatttcaatcatatagaaccttaaagatatattttaagccaaagtaaggcagcggaaatgcaaaattgtatcaaatgctacacttctacataaatgtccgttccacgaacaaaacctctaatagaagaacatgccagttgcatactctcacagtactacacaatcagcatccaacgtaaccatcataagattgtgagaatacataggaaccacctcttgagaatggttgtcagaatctagcaacatatacagctgctattcatagatataaatatacaaatcacaaatgattgatctgaatgacgtttaccgaaactacaacagcacaactcgaccacaagaagcatgcgaaattctcttgcagcaaggatgattagtactaattagtaacttggtgtgcatagcactagcaaggaagattagtactaatcagtaacttggtgtgcatagcatggcgtaaaggtgaacattctaaatttgcagggacctcgttaatttaaactagaggtttccactacatccatctcgtgttgcttaaaatctataaaaatactccctcctttcatattataagtagctttgacttttttttcttagtttaaagtttgatcaagtttatagaaaaaaattacttcctccgtttcacaatgtaagtcattctaacattttccacattcatattaatgctaatgaatctagatatatatatatgtctatattcattaacatcaatatgaatgtgggaaatgctagaatgacttacattgtgaaacggagcgagtagcaaccactataacaccaaattattttcatcaaatctaacattgaatatattttgataatttatttattttgttgttgaaaatgctattgtattttcctataaacttaatcaaatttaaacaagtttgactagtaaaaaagtcaaagcgacttataatatggatcagaggaagtcactc

SEQ ID NO: 52814 - DNA, 5121 bp, Oryza sativa
  unsure (1)..(5121): unsure at all n locations
ccccacaacgactactcgccggatcccggaggcatcctcccaggaaggaagcgacgatacaggaaggggggggagtgggaggaggaagatcgattaccagttggatcggagcctcggagccggaggagatcgccggtgaaggagagcttcgcgcgcgctaggtttggcggtgggggagagcgcgtggggggaggcgagaggagaggccgtggacttcggccgcataacatgggaaatgatgggccatagactaggcctgtttgattggaccaaatttcggcccattgacgcatacccgatgtttccaactttgtgatatttacgcatactctgtttattttggaaaaaaaaaagtcatataccctccctatgtttccaactttgtgatatttgccctctttttgttggaaaaagaagtccatacactcctaacacctttagataagagtccgtctaagaacatccccagcagatatgccatccgaacatccatccagaaaatagcggttgagaggagaaaaacgacctcctgcagaaactccatcccaccctccaacattagcgcatcatctatccgggagagaaaaatgccagatttggcgttcctctctcctcacgccatcccgcaactgctagcatccagacccagttcccgtcccccatctggatcaatgccccatccaccgccgtcgtcgcaaagtcgtggagtcgtggaaagaggatggagaaggagaagcataccagatctggaaggagagcaccgccagcgacagccgtttgcgcccgctgcagtcgccttgcgcccacccgcggaccgtcgcctgccgcatccgcccctcgcccgtctgcccctgtcctatctgcgcctgccgcctgcctcctccccgcccatcggtgccccccgcagacgcctccgcccatccgaaccccccggacgccgccgcccctcgctagccccccggctgccgcctaccgcctccgcccctgtcccatccgcgcccgccgcctgcctcctccccgcccatccgtgccccccgtcgacgcctccgcccatccgaacccccccccccggacgccgtcgcccctctctcgccccccggccaccgcctaccgcctccgccctgtcccatccgcgcccgccgcctacctcctccccgcccatccgtgcccaccgccgctgcctcctcccatccgcgtcccccgctcgccgcccgcccagctgccactcctcgcttgccccccggccgccgccgcacatccgcgcttgccagctgccccatccaccctgccacaaaagagaaggaaaggagtagagaagagcagagagaaaagaataagaaaagtgtgaaaatgaggaaggtagcagttgaacacatcacattgaaaaaaaactcactcaatataaatatatcaattaagaaattaccaattaaaattatatccattaaaatttacttattttcgaaagattattgtgataaataacatcattatcattaaaattttagtgatccaaaatatagcccttaaaaaataatacaaatgtaaggtatgttagaaaatattactaaaatacagttaggtgtgatatggatgatctgttggagtaagaatggatatggaggaggaatcttcatatggaggaggaatcttttttggatggtcatccatatgggtatatggaggatcaaatttggatgacctgttgaggatgctctaataccataccttcgaaccgggatatccaacccttcaaacgtatacaatcctccaaactttgcaataattgaatggttttggatggtgattttgcgtaagcttaaaaaagcggttttgaaaagctagtatcacatatttacatatcatcaatcattggtcatcaatttatactctctagtgacgtcgacctaatattatatcgatattcatttgcgagagctaaaaaaaggttaaaaaaagaagatttaaattgaaaatttaaccatatccttttttcttataagttatcccccactaagtgcaattaagatcctaaagctcaaacctcaatgatccacgtcatcattaatttacagcccttggattggtatattagattgcatctgcaccgttggatgcaatctgcctcaatctgcctcggggtcgaacacacctcaatgaacccaggaggcccaagtcgtgaggcccaggatgcccaagtaagtccaatgagggattttagggttcagtatgtctcatctcctcctgacttcctgagcggagcagcggcggcgtagtacggcggaccctagcgctcgcccaccacgtcgcgatcacgcgcaggtggtggtggggacagggcgctcggttgcaggaggcggcgatggcgcgcaggtggtggtagggaccgcgggaggtagcgatggggagccgtgtagcgatgcggcgatgggggagaagcgtctggactcggcaaccagcgatgcggtgatggggagaagcgtctggactcggaaaccctagcgccatccatccgatgggaagaagcatcaggaaccctggcgccatccatggtgaaatcaaccgccccctccccatcctcttggctagcagaaacggtaatcaccatgcttcttcccattccccgcccttaatgatgtgcatttacattagaaacggccaaaatcattatggtactggaggcacgatggttaatacgatttacgtgcctcttgcgnntcacttcgtaagcctcttccaaaccttttgataatcctcttgcaatccccagtcctaccagacgtctcctcaaacatgtgcctctccatcagacatcatccatccatccgcaagcctcagtccatacctccctcgacatcatcacttcatcctgcaagcatattctccaattcggacatgattgcgatcacggcatgataggttagttgtggatcaactttgtcagatcattgtatgtaggcttcgttactaattttgtatgtctgaattgagttggttctttgccctaagtactgattttagtttctgaaaaaaaatatgtctgaattgagttggttctttgccctgagtactgattttaatatctgaaaaaaaaatgtgtgaatttattctatttgataagcctgaatttgacatcaattttgtccatattctatttgagcaaacattatgatttcaaccaggcaagatcactatgaaagctttgtaaattggattctctacacctaaagaaataatccctatcctatgcactgattgttgttcgagttatttaagaaaaataaactgatatttgcagtggatacttatatgtcctatgtgattttagtttctgaaaaaaaaagtgtgagaatttattctatttgataagcctgaatttgacatcaattttgtccatattctatttgagcaaacattatgatttcaacactgatttttgttccagttttttaagaaaaaataaactgatatttgcagtggatacttatatgtcctatcactttaatgcatttgagcagttggtgaggagccagaggattgctacatagatgtcctgacatagcgagaagctactaacctgctcggtatgtcttctgttgagctcaccccatgctattcatgtttcctgttaaaatgtgaaaaaaaatcatttaaaaaacatatgttaaatgttatcaaaatttttgaaactgtgcacatccatagttcatgttatgatgcgtttttgtcacgaaaaaggtgttaaaatgaaagcttttggatgctttagtgagtcagttcagtatgtgtaaatttcacatgatttttctcagaataatatttgagcatacattgtggattttgcacatgcaggagacctatgcactgggtacctgttttagtttcttaaaaaaatagaacctgcagctttatactgtttttcaaactatgcacattcatagttcatgttatgatgcatttttgtcgcaaaaagtgtgataaaatgaaagcttttggttggtttagtgattcagttcagtatgtgtgaatttcacatgaattttgccaggttatattatatttgagcatacattgtggtttttgcacatgttggagacctatgcattgagtactgttttagtttcttaaaaaaaatggtgcctgcagcttatacttctttcacctaccctttattaatagatacaagaacatttgtttcaccacttgaggagaagcctgacaattgtcataaaagcagataaacttgctcggtatgtgtgctgttcaactcatcctatatttttcatattattttgtacatctcttttctgatttcatattccagttacatcttatgcgtatactcctacatttagcaaatataataaagttacatccgatatttgtaaatatatgatcagatgctttgttcattaaaactaaaaaacaaaaggttcagcccatggatgctgggcaaagtacttcatgttttccagtaggacgtcgccggtcaagacgtccactggcacatattttggtccctcaccctgatcatgctactgctgctgaatcacgacgaaaacgtaaactcatattggatgcccatagaggtagaggttggttccccaatttaccccttcaaattttttagtaatgtaaaatttatcgttgcctacctaccttagttacccggttatagcctatctaattttgtacccacattcccttcacaacatatagcatcatcttcagaacaacggtccttgcatcgagagttgaacagaactgaaataggctcttcatctgcatctactcctccattggctaatgaacaacgaattattggaatatcctctcattcccagtcagctgagagtaataattcttcatctgtgtctacatcaaaccaagtatttcgccatcgccgtatgttatcatatcctttatacgtaaaatttgacatatgccaaccttacatcttatatataacagtatctgccatcttccattgatatactttgttaggaacaatctatgctccacttaatcttggcagcccccagcattcttgcatccattgtggtgctttattttggtatgaagaacgagcacgaaaagaaaggcacacgaggaacccaacat

SEQ ID NO: 52815 - DNA, 1540 bp, Oryza sativa
aaacatttttaaacggaggaagtatcatgctattgtactcgctctgagaatgccgtgctagcccaatcgcttcgcctgcactcgattataagttataacacttattaaaagaaataaaactataattaaaaaaccatcaaatcagttttaaaatttaaattttaactacatcttatagatttagcttaagagtaaatgaacaatatctctttagaaattaaccatgtgttgttgataaatccaaacgccggggtcatgaagccgccatgctcgccaatcgccagctgctggtgttgatccgatcgatcgatcgatcgatccatgtcacaccataacagcgaccacgcatttcttcgacacaagacatacaattactactagctatactagagtagccaatcactataaaatgcttcagttgctttctaccaataatattataatctacgagcatatcctctctttgtcccctaaaatataattctagagatgaaactggacaagcatcgaggagtacatctctagctagtacagtagctgattagccatgttacgactcaagtcgaataatcaaggagcaatctttgtcatgtgtcttcaaaaaaaaaaagaatccttgtcatgtctgcaatcatgcataaatggccgtggatttaagaagaggatgattatccattgaagagaagtcatgggtgtccattatctacgatgtcctgaactgataacaatcataagttccaataacatactccaacattggagtatttggtgattcaggttctgtatctttctggctgagctgagttcaacacttcaacttgaagcaatcatgtactccaacattggtagtacataaataatggcaacgaaggcagatcaatgtgggacaaaagaaggtgaaaggataaattctgaatctatcaacgccgtgtttagttccaaaataatttttcaaacttccaacttttctatcacatcaaaactttcctacacacaaacttccaactttttcgtcacatcgttccaatttcaaccaaacttctaattttgatgtaaactaaacacagcccaagtgtagtacctggatttttcacattttggtccttttgaaaaacttatttcgcaaatagacccctgaaaaaacttatcccagaaatgatccttttttggacgccagagtggctggcgccgtcatccaacaggacggcgccagagaggatggcgccgtcctcctgccaccgtggcgcacgcgaaccgacgtggcaggaggagggcgccagccatgctggcgccgccgcctccattcctgtttctctatatagagttgcaacggtgtcatttttattttattttttcggatgttttttcacacttaggatcacgatacaaccaaccacaaaaaaaatttaaactcgaactaccacttaactaagtctgaaaatagctagcataccacttagtctactttgcaccttcactaaaattagaccataattcctttagtaaaactctttgatcagcatgttaaacataatgcact

SEQ ID NO: 52816 - DNA, 798 bp, Oryza sativa
aaaaacaccaaaaatttatggccatgcaatatcctattttattcccatatggtgaagaatgggtttccatgaatccatcatgtataaccaaacaacaagttcatctgccttgcggcatgacaaagcaacaatggttgaattctttgcttacataatgcatgatagagcgggccaattcaacactccattacgttgtgggaggttaacccaatcttatttggttgatggctattgttgtgttgaaggtgagcacatacaacactataggttgcctagttttcaacacaaatatagattggcaccattcaattctttagccagctctgtgtctagaggcattacagctggttcttcggctggccaacgggttatcttaccagcctctcatactggaagccctcggtatctatatcaaaactaccaagactgcattgctatttgtaggaagtatggttgcccatatctttttgtcacattcacatcaaatgcatcttggccagaaatcctacaagctctagcacctggacaacaacctttagatcgtccaaatatcgttgaccgtgtgttcaaaatgaagctgaatatgttaatggatgacattaaaaaaaataatttttttggtcccatacatgcaggtaatttccaaaacaactttcaatcaaaattcttagatacatatattattcatcaaatccatataatagttaacccttttgtacatgttgtctacacggtagaatttcaaaagcgtggactaccacatgtccatataatcatttggctttcaaaagaagaacc

SEQ ID NO: 52817 - DNA, 1770 bp, Oryza sativa
cagtagtagcagtacacggaacgcagcagctcagcaactgtggttcattgtgttttgtttatactccgtagtaaagcgtaacgaaccgttgggcgtaaacggcggcggatcacacgctcagtggtacgtaggagtagcggattccacgaatacactagtgtagccgtactcgtgcggagcaaataatgaatagtagtgttagagtagataatagcaggctataagccagctataaacatattttaaagaagtaaagaaagagagagaaaagtagcgggctatagatctatagctagttgcagtacggactttaagacgtaatgtgtgtatgacaggtaggaccaggtattaatagtatagtaagcaactattgtacgaattggctattacattggctatagatgatttgaagctagtagttggatatactattaaacttgcacttagaagaactagtactactgtactaggctttcttctccaccgaaagagatggtcccatcgaaaccacgtgggcgacacgcacgcatgtccttcggttggtccattttgttaacgtgttccatgcatgttttgttttccttggcaagataagcaatgccccgtcccctgcaggaataacttactctctaagtgcaagcacaataaattgcatattagtagtactaagagcacccgcaatggtaaagtaaggtattatctataaaaacatgtacatctcagcaatatactagattaatagtaaaccacttcaatagtatgtctacatgggtatctatagctctctaatccattgcctcgtttttctctatagactatctccaggttagtagatagctttgctctctctcttcatttaatctcttccaagtaggaaaatatgctgacatatatctctcgtagagagcctatatataaccattgtaggtgtcctaagtactactgtcagcgagtcacctgagcagtttagcatcgtaatgtggcctttcagtatagtatatatttggcactctccattattcttctctggtcacaactctttctccattattccaaccttcgatgtggcctttcagactttgagtacaaactctttctctagccacaactctttcctgggcaggtagtagtagcctacagtatttgcctcgtggtgctccgttgtgcaacgcaacgcgactccgagattcgtggggcttgatgaaactggtagatacatatttcctccgtctcaaaaaaaaaaagacaaaccctgaattttcgtgtccaactttaactattcgtcttatatgagattttttataattcgtatttttattgttgttagatgataaaacatgattaatactttgtgcgtgacttgtctttttaatttttttcattgatttttcaaataagacggacggtcaaacgttggacacggaaaccagggtttgtcttttttttttgggacggagggagtacacactccacccacccgacacatcgggttctcttgccccatacccacacccacgatgtctaaatactcccacttaaatacccacacccgtcgcgggtacaaaactgtcctcatacccatacccatgcgggtaacgggtatccaacgggtacccatacccatataattgacttgtaatatttatagttttgtactataattagccatattagagctgtaaactatcaatattttctctagcaacaatgctattaatattagtgttcaaaggcgagtaaaaaaattatacaaccatattacataatcaa

SEQ ID NO: 52818 - DNA, 6056 bp, Oryza sativa
ggcggcgccgccgccgccgacgcgccgacggcccagctcctcctccaccccgagggcgccgccagcgtccctagcctctgtagctccgaccgcgccgaggtcatcaccgacgacggcgccgtccctcgccgcgacgacgaccccgtcgccgccgagaccgagcgcatcaaggccatcctcctcaacgaccaagaaaaggtcctcctcctcctcctctctctctcaccatcctccacttctcgtactgaatctgttctgccatgttgatgcagtcggaggcgacgttgctcgagctgctccggcgactgcagcagctggagctcacggtggacaccttgacggtgagaccgccgccgccgccgccgcagccatgccaaaccaagctcatgtgttgactagtgtgttcatgcggattcgtctttgcaggttaccgagattgggaaggcggtgagcagctaccggaagcacaactccaagcagattcgtcaccttgttcgattgctcatcgagtatggccatgtgttcccatctcgtcttggattgttcatattcaaatcgaatttgtttttcttagccagttgcattcgttgacatgtttgtttgcgaatcgaatgcagaggttggaagcgcatagtcgatgagtggatgagcagccgcgacgccattgtaggtaggaagcaagcaagaacagttcatcgtttctaagtttcaacctctgtatcatgatttagtagagaattaagcattctgcaatgatatgatacacagatcatactcctcaatccatgcatccctctggcttggagcaggatgaacgggggctctcttctccttccatggatgagggcgctctcttcgctacgccgagcacttccatccgcctatctgaggtaattggaattgtcggcacatccatccgaaatcatatctggttggtatgatctgacacagctccctctgagttttcctcaggaaaaccaaggttccaagttcttcgatggtatggatgatgatggaagtgagtgatcagacccttgttcaatatttttttgtgatggttgttggcttcttagctggtgtttgacatcttgattgttttgtggattatctgtagacacgaggagcaatggcggcagggataatggccggctgtatacaaggaatcaagaaccagctagaaggccgctgccgccaatggcccagcaatatgatccagaccagagctggaagcaagaacaatctgcgatgaggcagtcgagaccacaggaactgagcaatgggcagacgagagagcaattcatcgcggcgatgcttgcaaggccctcaaacccagagtccggtcctgggcgacctcaaccgaggactaagcagcatcaagatgcctcgccagctcaaggcagatcgcaacctatgccatctgatgtgagcatattgctttatcgacaaaatatacatgcttatttgattgatgcaaatgcttgtttgaggtcttaattctttgccatggctgtagaaatcggcgagccatcacgatgaaaattcagttcgggcaaagctagaactcgcgaagaatgcaaagcttgaactcacgaatagtgcaaagctagaggtgacaaagagaaaacttcaggaaggctaccaagaatatgataacggtatgtgttccgccatgaaattgggtctattatcacttgttgcaacatcaactggatcatggaatttgtttacttgaaccacaatatcttgtcctctgtttggaatattatagtactactactattttttgctgatcagtaaatttcattgatttgagtttctatatgcgacgagtcatggttatatttttgtgtaaatgcagcaaagaagcagagaactatacaaatggtggatccacaaaatttgccgaaacaagcgaaccggaattggcagcctaatggcaggccgaggaataacagcaacttcaacaacaaccggaattggtcaagatgaggcaccaattccatcatccagcaccaagggatcatagactcccatctcccaattccatccaaatttttcttcttttttcggctaaagttagtccagccaagtacataaacagcaataaggctttccttcaaaacttgcttccagtgccacacacacacaccacaaacacttcttgagagctgtgttgctggtttgcactctcttttaaccttttgatcacgatggctggtttttttttcctagtggtttgtcaaaaaaacttgtaaagatagtgctactgccaatccgagatgagtttctgcaataccgatcctgatcttgagcccctaaatttgctgtttgtgttggtgtttcctcggttgaaatgcaaattgctttctaccctgccatcggaatgaggatgtttgctgcctactttgggtctctgcgccctgcttttcaggctcaaagaccttttggggtctgtcttttcgctgaattcagcgtagcttgtcccccctgcgaagacttggactggaacgccaacgtatcagactgtacatagcctcaagtgaaagtttcttggtaaattcaaaattctagttgatgccaggaaaaattaactatgaagttacctatggtcaagatcacactgtcaaaaatagtaggaccatactctccgtaagtctttttgtcttgttaaaaataaaaaataatttattgatttttttaatacatttgttcatagcgatttaaaagtcaatactgaaaacaaattacgttgaaaatatcttaaaattaacttcgaaaattcaaattttagcttttgctttgtcttattaggccaattgatgcggccctaaaatggttgaatatccaaaagattttgtaatgaccattcgagggcacttccttcgtactcgtaaaggaagtcgtctagaacaatatttaagctaaactttgggaatataaatcatgaataactattaggttgtcgagtttgaaaatataaaatttatataaatagatttgtcttgaaaaatactttcataaaaatatacatatataactttttaataaatatttttatagaaacaataagtcaaaattctgttgtgtccataacgactttctttacgagtacgaagggagtacaaataaatgaatcaataattataaagttgatataaaaaaattgacaagaaatttatacatggaaagttttttaaaaaatcacaccgtttattagcgcgggagtacctttgtgctgcttcttggaacttggaaggaaacttgagttccaccctttgggagttggggtccaaatgaatgaccttggacggctgaatttcggtggatagaagtcaatccggtccattcttgtggatggattccaaattcaagttcagagtaagaatgagcaggctttgtgtgaacactataaactatttttgcggctgttttgaccccccaaaaaataaatccaaacagatcatattcattcatttcattcatcggccatgattcactcatgcagcagttgtgctgttgcttcgaggagcttgctctacttgcgttagcactgtacgggtgactgccgggtgggccccagttctgcggcggttaggtatgggcccaccgtcagtgtcatgtgtgtaccacgtcggggggtgcgtttaaatatggagggaatggacagcattgggggggctctcttggctgcttcaaagttcgaagcactgcacttgtggcgttgaaagttcccagctatgatcatctgtgttcactatctctgtgtcccatgtgtggccatggaaaaaaatgcatcatcttatacttatcagctaaaatttaaattttcaactttaaatttgaaactgattttggggtttctttcatcgaagtttatttttcagcttttgcttttaaaatgttaaagaacacgtatataaaaattctattcataaattactttttgttcgcaaatataccgtttggcttattcaacgtataaacgaaatgatggtgccgaaagtgtatacacttgagcatatttgcatttatggagtacttgaaatctttcttaaaagttttttaaaaaagggagagtagtactggtacatttccattgcaattaatgaaagatctgatatattctctcccttcaggttcagcatatgcggcattttattgttcttttttcttccgaagcatttttgttgacgttgctcgatttaaatgccgaacgatttcttgaatatttcaactatagtagcatattgttgcggctgcaacttctctgcagccgctagaagatggttgtcgcaaaatagctgaagcaaacaacaaacccactatagtattagtacttgctccgtttaaaaatataataatttttatacgattacacgagtattaaaaagagtaaaaatacttatttgctttcttgaaacggcgaggtgtatgaccggactataataaagtcaaagaatagtacgtgtagtatgggtaatttagtggcaaaaataacatttacatcttgttatatttagaataaaatctgttttttttaaaagaaaagtttattatattttgaaaccgaggaaggaatatactgtactaatagtatgcataaattgatcatcatatatatttatgcaccaagactaaggataattaaatcatatcaattaaaacatcatgcacatattcttccacaatacatgcatcgattaaaacactatgctaattgtatcttagcatgcacatattctcccatcatgtattaattgtattttgataaaatctttgtccattcagttatatgacgatcaattggagaaattttaaattttattatgtaatgattaatttgggaagaacggagtattatgcttgccagaaagtaaacttttcgcagccagccgggcaccgaagagattgagatcctgcaggtcaggtcaatatcttcagctcgtgacggcggagcagaacgcactagttttgataatgatatcgtgttggaaacaccacacggctacgccaaacacaaacaaaaacaaaaaacaaaaatcaaatgacgctcgtttttcgccgcctaatgacgggatttgattttcttctcactttaattaacatagacgatacgcaatcgcatctagttaagaaaatgcatcggatgctgattgctgtcgctttcctttcggttttctgtttcgtgttttttcttggacgaaaaaagaaaattgcccttgttttttagtaacgggtgttctgctctaacaatccagctgatttttatatcacgacagctcgagtgagaactaaagctggacacggattggagaagaagcaaccgattataatcatatagaccaaaataatcgttagtttcatgtcgaaatcacacccaagtaataatatgttgggtcttcaattaaaaaaaagtttcaaaatgatacatgtcgctttgttggactgaagtgtactgtaaactagtgctactagtatttgatcctaattaaactggagaggcgaattctagtggcattttgggtctgattagttgccggtaacaacttgctacaatctgtcatgtcctatgttaatcaagtttaacgcatagaagcccttaattagtttgaaaaatataaaaaaaattggggatttcaatcctataaaaaaatctatgaaattctatgtgtcttttaaaattatatgaaataatttgatagagattttggaggaaaatttacatgaggtcaaacctcatgggaaatttttcttgagtctctcatctgattcatgcgtttatttgtcttcaatgaaacaatcttccttgtgtttttaatcatatcttttacacttgtatttctatcaaaattctatgtttttttatctattcctcagttttttatttttgcgattcaaaggacccttagagaaatatacctggttacaacatacaccattcatccaaaaagaataatgccaactatatacggagtacaaagacatgcctaacagtacaaagacaaatacatgcctaacttcatagctagaagcacttagactgtgttcgggaggag

SEQ ID NO: 52819 - DNA, 9315 bp, Oryza sativa
cctccccggcacgcaaaacaaagcacctattattatatactccctccatctacttttgatagtcatatttcatcttggcacacagaccaaggataagtaattctacttatcatccatttaaatatgctactagtcattcctcgtaaacaaacgattcattaatatttacatttctcaatgcccatgtagccaatcatgtgtggaagaatgaagagtcatgcattaaatccaagaaagtcattaagatgataagttgttggattgaaatatgtctatcaaaaataaaattttcagatttggaaatatgactatcaaaagtagatggagggagtaattaattaagtatttactattttttttaaaaaatagattaatatgattttttaagtaactttcgtatagaatttttttttttgcaaaaaaacgcaccgtttagcagtttgaaaagcgtgcacgcgaaaaacgagggagggaggttgggaacccctggtaacgaacggagcattagttgtgacaagatcccgttccaataaactgagggcccctttgaatcaaaggaatttcataggattgaaatcctataggaaattttcctatgtagctctttgattcaaatgattgaagtttttcaaatcctacaaaattcctatggaatggcttattgcatataggttttgaagggaacttagcaagaggtcaacctcttggtaagaattctttgagtctatctctttcattcgattcttgtgcttttcctgtgatccaatcaaacgatcattcctgtgttttgcatccactgttttacacttacattcctgtcagaatcctatatttgttctgtttctccgttttttcattcctacgattcaaagggctctgattgtgggaaatatgtggcgagatgtttgatatgacaaatttgataaaattttattgataaataattactacaggtccttctatctcttaacaaaattcagagttaagagcataggaggaagacaagaacaagtcggcaggaggcggacagcaggtgtcggcggacggggttggttggttagccagcggccgatggagtggacggctgcgatcatgtcaccttccaacggcgacagctctgacacccatgtctgtcttcggttacaatttgtttgcaaaaccacgagcatttgaaaattttggagtggatctcgcaatgacaaaacaggtctcgttaatagtataatgttgctgcaattgcagtataaaactacagtatcctcagatgacaaagagtagtagtttaatgtctttgataatcatctttgtccgtccttaagcatgttgaatttgtctgtgattaacttcgttgtaaagtgattccaaactgactgattaactcaaatgtactagacgagagagtgaatggaagagagaattgctagtatcacatgcatgatggagtatattacgtctgcatcatcgctggtccctgagagttagttgatgaaccatgcatcagtgcaccgtgtttcttaatttccttgatcactttacaggtgtagagagattcagaacaatgatactagggctggatgattaaatttcccttgggcggttagaacacggaatcagatcaaacgagaaaagcaattaaggctaagttctttagttgagttttccaactcacattgattttgattaggatctactccaacttaattacaaagttgattttgattttttttcattgtaatttatttatagtattaacttttgagtaaataaaaacacatatataaaaaaattacacataaattatttttatcattaataagtataacgggttttaagttataattagctgtatacgaaatagaaaagttgttagttctatgcttagtagtgaatctagctcccgggctgactgggtggtcatctgaacttcatcgcagacgttgctactattgaacattaggggcggagacacgagtagggcagctagggctgtagcactagtcctgatcctaaatatttattgaaattttattttaaatttttaaaaactagaagataaaggtaaaactttatacattcaactaattgagccctaggtttgaaaaaattctggctccaccactgttgaacataaaacacacctcgacaaattaaccaacaaccaaatatacgctcttcgtcgtcttagttccatgagacatctttggcttcattgttgactctacttacatataagtagtaatctatccatcccattttaagcgcaaatataagttttcgtgtccaactttgatcgtctgtcttatttaaatttttttatgagtaggactttattgttatcagatgataatatgaatagtaatttatacgtgacttatattttaaatttttttaaatttctatggactaatgtttagccctcaccttttagcctcaaattaaccctcaggatccaaacaagtgggataattttgagctaatatgaattagcccccctcaaaacattagcccctccaaagggtgctataggggctaattttgtgtgggaccataaaaaagcaactgtctctccttctctctcctctctttttaccctttccaccttttagccttgaattagcccatggatccaaacataccaccctagactaatgtttagcctaccaattcatgactaaacattagctctcaaaattagccctgagctaatgttccaaacagggccttaattaagctggttgttatgatcctttcaactgtttgatggagcatgtatagtgggtaggtatcatttagcactgtagcaacactctcacccaacagtgtctcgaattaattgtggccttgatcaagtacttgatcacctctgcgtatactcaactgacctaacacacggtgttgttaactgctgatagtgatacccaaagcgtgaagcagaagtaatatgatgaactaattaatccgatatcgatcggtactatatatgtttttcacgcgagattaattgcctcgatgatttttgctatacagcgaacacatgtcttattctagcctgcagatgacaattgagccgaaaatctatgctaaacaggcctggagaatctgaaaagcaccggctttcaggactgtttagggagcttaaaattctgaaaagtaactggtggtagccagtttctcagaaactaaaaaaaagctgggttttccagcttctggattctagtttattttctagattctataactatatcttcttaaaatctaaaaaaaataaattatttggaagatcttttgattgaaaaaaactgcaacagttagaaactatcccaaacggacacttgtgcgttgtgctaggagaaagtgagaaattcgaaggtgcggatgccatctttttttttttttttgacttggttggctgcaaatgcaactgccagcgctacagtgtagtgcagcaccgatgaatttggcgcctttagccaccaactcaaacacacattatttgcatgcatcggcatgtgatgcaaggggcccctggctggcacgtctatatccatcttctgaattctgatcctttcctgtgtcaacgaagacagtattgttattgtttctgttaatcctagcaagtagatgctattaccaaaccttcacacgtacccacgtactcttcctgtcacataaaaaaaacttccactacatgtttggatttatctttaaaagttaatttttttagacgaaaggtgtacaactttgatttgttgtaacaagtcggatagcgagtttgacttgaatataatcttcacatatatctcatcggtttaggcccatatatatctcataaaaaaattagagattttaaacttataagggaattttctttaaatgtatttgatacaaagaattaaatcctatcattttcgttaaaatttctatagaatgcacgatactatacagattttagacaaaagttagtaaaaactcaaatcatttgaaaatttattctctctcatctgattcatatgtttttctgcgatgtaatcaaatattcgtttttgtatttttcccatgtcttataatcctccttttgatatatacttatattcatattaaaatcccattgttttttttcttattttccctttttaaaattcaatgtcttaaagaagcaattactgattgtctgatttgttggctcatcatgtctagatcatgttgaaggcgaatcgatatccaaaatccgccatctataaacgttgctagcttgtgatctcatgagtatctgattaattagcagcagctgtgcaaggattaactatgtggacgacgtagcagcactgatgcgtgatccgtcaaattgcgcgtgaaatcgatgtgaaccacaaggcgcaagagatttttttttcttttctttttttcccagctaaagcagctgtgtccacttgaggatgtgtttagttcacgtcaaaattaaaagtttggttgaaattggaacgatgtgacggaaaagttaaaaatttgtatgtgtaggaaagttttgatgtgataaaaaagttgaaagtttgaagaaaaatttccgaactaattaaactcggcccaaggtgttgccacatcagcggcgcactagctcactgcactgcagtggccgcgagatcccatatctatctcacgatcatctcgccattggagcggaggatttgtggctgcctgaaccggagctgattgctattcgattggatgatccggatcgggttctacagtagatgatcgatttaccgttggatttgttcgatgataatgagtaaaacgagttggtgaattataggatagcagcaacaataagaacaacatcaataacaacagcaagaatttgtacacactccgagacggttacatgggtgggggtacaaagaatgcaataacttggctaaaccgagcggactcctaagggaagggtgaaagaaactaagcaaagctatgtgtcgtgtaaatgttgaatatttgtttgcaaatagttggattagttcttttgccagttcacgcagatatcatcagcttataagagcagatgcgtaagaaactgctgcggaacaagtcatcacagattatcacagtacaacaagagtgtgtccaccaacgcagagcggaaattggagaacctctggatttctcaacccactcccagcatgctttggtaccaatattgtttactactcctgcatatgttctagctgttgacatggtaaaaagacagctacatggtgtgacagagtttggaaccgtcagggaactggccccaaatatcatttgtctccctggtaatgtctctccccaagcataatcaaggtaagcctggaaataatctcagggtaatttacattgtatcatcacttctccagtcagctgcactactgctgctgataagatattagatttaaattttagtcatggctaaccagctgcagataacaattaatagagccgaatatccttaatgaaatcggcagagctcctacctttaccccttggaaaaaaaaataaacagggcctggagaatcagagaaacaatggccttggtgtcttttgctatgagaaagtgagagattagaaggtgcggatgccatcctttttgacttggtcggctgcaaatgcaaactgccagcgttacagtgtagtgcagtgtgcagcaccgatgaatttggcgcctttagccaccaactcaacacacattattttgcgtccatcggcatgtgatgcaaggggcccctggctggcacgtctatatcttctgaaattctgatcctttactgtgctatccatgtccacgacgatactcctactattgtttgtgtttatctgagcgagagcgaacatatgctactactaacaccatcttcatattttttttaagataatggaatgaaatatttcgaactttgctcatcataactacagtcaattattataaacgaagagtatagttcaaaataaaattaaacacacccaacaaaataaaagaccaaaccgagataagaagtacacatttattcaagtctatttgtgaatctccatccatagtttgtaaaaagttgcataactgttgtcacaccccaatctgataccgccgtacaacggcacctgataggagcgtgttgtagggaaaacggcgtgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaaacaccaccagcagcagcagcagcggaaccaacggtctaacacccaacaccacaggcgacggctgggaaccaggacgaaaccctaatattcacttcactttgccttctcttcagggcggaggaactatatatatatatatttatatagagcaagggtgagtactttcgtactcagcaagtcacgagaacttaggtgtttaatgcaagcttggaagagaggtaaggttgttttgcaaatcttttatttgaagacattttgaaatcactaagtgatttatttctttctaagtttgggccgaaaagagacttgcgtctcgattcgactttaagagatgtttttcaacagctcatttggtaatgtaccgacctcccgggtcagatcattacttatcggctcccagagccattccacttgattaatcggctcccagagcctttttcattttctcggactcccagagtccagctgcctagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcagaggttcgcaacaaagcctttcccaagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaatacaccgacaccacatgtcgggttttgaaggcttcacaaacccatttcccaagttttcgacaaacaatggtgtatgtgggatatttggtatacgtgctcagagaacacgaataccgaggtaccacaagggtggagcgacaaggaatcagggtagtatgacctacggaaattagtgcgactactgggtaggtccgtcggttttggcacgcaaaccgaggccaagcaagttaagtgtgtgattctaataatgcaagttgcaaacaaaataataatgaattttcaattataggggcaattgatcaaagggtgacttgccttgctcaaggtcttcacgaagcttcacgaatcttcgaggaaacccgcgatcgacgaaaatccgataaccgcaactatacgcaaacaatcgaaaacctaaacaaaggaccaaaagaaagatcctatttagactaattagtagtgccaataaatagatctcaattttacggaattactggaagtggaacggagtcaatcggagttgcgaattaggtgatatgaattttggaagtttaattggagtttctggaataggagaaatggtttatggaatttatagaaataatattctcaagaatattattgacagtcactgacgcgcgggaccaaaggaaatgatttgtggaattttgggaataaggaattgatttatgggacaaaggaaggaaaaaaaaaggatttattaatcctttggataagaaatggaaggagggatgggatttagacttctttgggcggctcgggtacggcccaagggataagcacggcgcggccgagccaatgggccgggcgcgggcgcggggaggcggcccatggccgggcaaggcgcggcccaagcgggcggggcgcgcgggaagaaaaaaggggatgggtccgggtggaccgtatccaccttgcggggtcccgggtggggcccgcttgtcagtggcgcggctctccgtgggagcggcgcatgagggcagcgctagggtttcgggtgagcgcggttcacgggcgtgcactggatggaccagggatgcggcgggcccacgcgcagccggttggtgcaccgtggaccgcgcgcgagagggggggaggaaggaggcggctgaccggctcggctcggtcaaagccgaggtggcgccgacgtggcgcctacgtggcagccacgcgggccggcgggaggaggaagaaggggcggccaagatggacggcggacggcggccgagttcaccggagctcgtcgcgacgattcgagagagagggagtacaccggaacgatgggacggacgagaggaagtgagccaccggatcggattcgccggagggaggccggcgatgacgaatcgcggcggcgtacgccggcggcgagaaaagggggaaacttcaccggagcaacgggggttcgattaaaaggggtgggagcatatccggggttcaaggaatccgttttcggcgccggatgggacagaggagcaccgaggacagctggcgacgagcggcggcctccgggagcggacggcattggcggcgaggccatgccgggcggcggcggggctcgaggcagcgtcctcgcgcatttgggaaggtctaggctagcaatcgcgcaagctagggggaaggaagagtggggagggagaacggaggctaccacgtcgggagatcgccgggaagggtgtccgacggcacaggcgggatcacctcggtctcgggccgagggagagagggcggccggagtccgcgtcatctcctcgtgcgcacgccggcttcaccagcacgcgcgacggcggagggaggcgaggac

SEQ ID NO: 52820 - DNA, 5859 bp, Oryza sativa
gggagtcaatgagagagagagagagaaagggtgagagagagcgaggaagaaggagagagcgagcgcacacgcgcaacgcacgtgcgagggggaggaggaggaggaggaggaggaggagcggctgagaggagatgggccgaggagaaaatggcccacaaaaatccgagggaggcataatagactttttcggaggagattgattcgaagagaatttgaacttggaatttgacttagattttggaattgggatctggatgagaggaaggagtagacggaggattcaagatggggttttggatattttggatctggggaagtatttggcgatgattcaaagagagggatagaatttcagagtttgatttggagacttgagttggaagaggaatttcgaggaggcaatttttgatggtgacgagagggatcaaggacggatttgaattgagatcttggcacaacttagactcgcccacaaagaacggaaattttcgcatataagattttgccaaattagtttttaacgtctcacgaaaagcggagcgttacaactgtcctctcaagcctacaacatgcaaccttcataagctaaaaaaaaactatccagagtttgacacgtagaggctgttcagattatagccaatataaatcttaccaaataccaaaattttagtaagttgataatatcatcaaaattttagcatgatttcttatgtatttgccaaagtttggcaaaaaaaaaacctaaatatataggcatatctttaacaactttgccaaaaaaaattgtatggtttaaaatggcatcaatttgaacagccttgtacacatatccggattctggagttaaataagcaatacttccttttaaaatataaatagtttcattttagaacggggaagtagtaaagtagtgtcctatagaaaataaatctaggactggatatgatatattctagtgttacgaatctggacatatgtatgtctataagtattaggatgtgtcacatatgatattatgttggttttttacgggacggagggagtatatctcaatataatcagtttacttattgcatattgattgattgcctcgtcatgtcgatcatgttcaagtgattcgatccccaaaccgtgatctatagaacgttgcttgtgatctgactagcagcagcgtgcaaaggataactatatgaggacgacgtagtagcagcagcaacagcactgacgcgtgatccgtcaaattgcgtgggaaatcgatgtgaaccacaaggaatgcgagagatcttttttcagccaaagctgtccacttgcacggcgaaagccgtaaaccaaggcgctgccacgccaggtcggcgcactaagttcactgctgtagcctcgcgcgagatcccatttaggtctaccaaaccgtttggcgtaaagttatcatcaccctacactacagtttaacggttaaggtatataccgtgattttgaaaactgaaaaggttacagcgcatgataatcgcgtggtaaccgtacggtgttttatcaaccttggatctcatccatctcatgatcacctacgcctcagcctcgcccaactccgctttgtggctacctggaactaaagctgattgttcaaggagacggatttggtggcgacgatgcgagcgagacccgcgtacgggcggcggcccagcaaatcgcgtggatgtggcgtgtgattcgcggtcatgttggcccattggcaaattgtgcggtggtagaaaggccgcggtctttcgtgcccaaagcccactggtggtggtggtagggagggcagagaaagcagcccacaacgccaaacgcgtgtaatattatgatatgtccctgcactatacctcaatcttaaacgcatcactaaacaattaaatcacaaattagatgtgaaggcttcttaaactatcaaatattgcttttttttccttctatcatttcttagaacagaaccaccattgaaatctctagagacaacaaatcgagggagcgcccatacttacttcataggctaaagattttatttcctaccctctccgtttcacaatgtaagtcgttctaacatttctcatattcatattaatgtgaatgaatctagacatatgaatgtgagaaatgctataataacttacattgtgaaacggaggaagtatttatctaacaaagtatgtatactcacatagccacacgcccacaccactctatattttaaacattttaaaatgtgaaaaattgtagatgggtggtcgaccattttgcatccatcccttcacaaggggcatgcagcactatgccttggatgttcatgctcccaagtcccaaatcgcaaaccttttcaccctagctccattcacatacttctcaacattgcatcggaattcggaggaatacacatatacatacataaactttcttttagttttagcccgctaatatggtatacaaaaataagcaaaaggaaaaggacaggatgccggatgcaatgcaccactgtacatacatgccgtgcatgttaaccacagttaaccacaaaaatacatgcacgcatgaatgtctcctactgcctcctgaagccagcactttgtttactgacactgaggcactattacgaaatgataaacgctactactacctattgtcagcaagaggcacctattgcatttcatttcattcccatcatcatctggagctcttcaacacggatctccttgtgctccttgcctcctttcttcctaccaaatgcgccgctaatcagcttcttcttcctctcctgcagctccagcatcctctcctcgatgctatccttcacgatcagcctcaccactttcacctccttggtctgcccgatccggtgcaccctgtccatggcctgctcctccaccccagggttccaccaagggtcgaagaggtacaccgttgatgccgcggtcaggttcacgccggctcccgcagccttcaggctggccagcagcacggtcggagaatcagggccaacgcatccgaattggcggataacctctgacctcttcttcgccgtcatagagccgtcgagtcgtagtatgttaaagcctgctgctttaagtggcccttcaagcaagatcagcatcttcctgaactgagagaaaataacagactttgacaaagggtcttcgctctgtgaacgcctcagtagtttcagcaaggcttgcaccttggaagaaagaggtctatcaagattgactgaggaatcctcatcgggatgtttaatctctggcgcaataaagaggtcttctttgcatagcgagcgccggcatattggacagcgggaactagagctcttgaggattttcatgatgcaagtctggcagtatatgtgcgtgcagctcgttatgacggttttggctggtggagcgagacaaatcggacattcgaagtcatctccatcgtcaaccaatgaggccagcttcttcaacagctctgggtttttagacacatctacagcaagcaacatgtttactataagtaacagttactctgtaaatgatattttcaacatgcaagctgttatagcgcgtggttgataaatgtaagcaatgcaaccctataagaattgaaagaggatagaaaacaaacgatctcatcaatacttgtttttaggagtccaataccctaacaaaacaaagtctgaaaatggaaaaaatttacgcgtgcttgtcttcacttaaaaaacaaatccagaaaagtgataaatcatatcatacaaatggtgattattaattcaagcgactcaccaaataacctggacttccaataaatcctaatatatcaatcaaaacagtataaaagaaaaggttaaaaaaacagaatttactattttctggatataagataaagtaatccctgaaaataccaaaaaaaaatgtaaggagtgaggaccttactgctaatattgttatataaacaaggaaaacatttcagaaagcggaacttttatctgtagaagtataaacagaaatggactagagaaaataattcaaaggaatatgggaatatgatttcactggctatgcagcgatttctgcggtttactaagttatattgatataatcaacagagcagttgacccattggagaaaatgacggataggtagcaagtttgtaaagttaagctggcaagcagcaatgtactgatgcaatttgtcgattcaaatagataaaccaattacactcaacttgctagtttgacactctacagtaagatggaacagttctaagaaaaatcaaaagaaatactactatcatacaatgcttagtgtgcgaaatctctttggcaacaagatggttcaatctaaacagcacagtttaattttgatgagtgtattatggccatattatatcatcacaaaataaatccagaattacaaacaggaaaaaatgccataccttcaagggagctgccactgccaggaagccatgatttcaggtctaatgggcatagtgctatgtcattgcagagctggcggagcctcagaatgaaataaagcacagttgagtaattacgcaaaatcgaatccctgtcaccaaactcccgcagtttgtttttcccttccaattccatctggtcatagtactcacgttcctctgcagaaagctcaatataacaagctaaaacagttttgggcggaatgctgaccaagcttttgctaccactctctgtctctttggttctgcgcagggaaatagcacctaggaggctctgtaataagcagataagaagaatttaattatcagaaattgcaggtatgcacgtgactctttcagatcctttccaacaccattattaaagtactacctaagtatagttactagttcatgtgaattgtgaattacaaaaaaatgacatgtaatgacaaggcaaacaattttccaaacttacctgcaatcgtgccaacccaattccgttattctttctctctaaggggagctggatcaagctctgccagtagctcttgattgagaatggttggaatctcaaaaatgccatgagcgggtaaagatcaaatgagctgttctgaatgggcgtccctgtgaccacccaccgcctctccgcgttcaaagcaatcaccgccttggtttggcgtgctgcagagttcttgatcacatgggcctcatccagaatcacacggaaccattcaatttcctttaccggtgagccctcctgctcaagttcttgccccaaggtgctataagtggtaatcacaatgtcatatttcaacagctctttcttctcttttgtccgctctccatggtacaaatacaccttcaagctaccggttttcgtgtgctcctccagttgtgtcacccaagatgagaacaccgatggcgggcacaccacaagcgttgttcttgactcctcctccaccgcctcctcaaccttcctccttttcgcccctctagccttcttcccacctacattgcgagctttactccttccgatcagcgacaacagcgtgagagtcttccctagccccatatcatcagcgaaaatcccacccttcaacggcggcggtctctcattcgtcttctgatttgtaagaacattcttaaatcccccatcattatcttcctcccagaatggtggaaggtcgcatgactcctcacggtgcaccagccaccccagcgccgccttctggtgctcgaacagttcggacaccaccacatcccgcggcgcctccatgggcgcaatccgagctctccctcccttccccacatgagagaacagcctatcgacatccccgcgagacctcttggtctgctgctcctgcacgatggcggactcggagagggcgaactcggggtggt

SEQ ID NO: 52821 - DNA, 6065 bp, Oryza sativa
gtgggtttgaatcgaatgggggcaagtcaagcggaaggagatgagttcctctcgacttctctggttgggtgggtgaaagattggggaatttttacagttttactgtctcgcagactcgcactctcggccttagttaatactttttatacgtttgaccattcattttattcaaatcttttatacaaaatataaaaatatgtatatcatgtttaaagaatatttgatgataaattagttaaaatataataaatgataattatgtaaattttttaaataaaacgaatggtcaaacgtataaaaagtcaacggcgtcatacattaaaatatggatgtagtaccatttttctcttctatcgataagttatatcatcctaattatttctaacatttgaaagatagatctataatctaaattgtctcttctttcttctcttttaaaaacatgcaatctcaattacttttaggctcaaaattatatcaaattatttttagttttgtacaattatgtaacttaattttccacagcaacacggggtattcattaaccatttaaccgttcctttgaacagaagggtccgattattagccaccaaaaaatatttatgagtatattcttagagacttaaaagtttgcaccaaaaaaggtactattaaaacattttaaaattaactttaaaattaaattttagaatttgaatattcgaattgattgatttcatatagaacaacgatgaggagtagagctgattctatttggaaaccgcgaagcgagcttcttttatcgttgcttgtacttaaggggagccacctatatactcctattaggttcaaatcctgttgcccacaaagattatgtacataagtgagctttcaacagaattttctatttagtgagaccagagatatgacgcaaacttccatctctttaagtgtgtattaggggggacattctctggtgtgttgttgtatgtgtagtaatgtttgcgcgtctccatgtaactgaaaaaagaaacacatgtatattgaccaagtttaaaaataatttaagcattttttctactttttgataaaaaaattatctagtttttcttgcttttactcggtaaccgcagctcaccacagagaaggggtaaccccattatcgtcaggattgagatcatctgtagttaaaaacacggtgcctttatcactgacatgagaccattccctaacaatctgttatcagggagaagcacaaccgctgaacaaggtgtgccatgaaatcaggctaaaaagcctctttatatagatttccgggcagcacagctagaagaaatctcatatggatcgtaaacgctttgtcaaacttagcaaacaaattcagaagttatgatagatttctacaatacatgctgccgtgcaaagtgcaagtgtaaaatataatgcacagctatctcatgtagcatccagccaagtcgaaccagaatcacagtcacagaggaaagaaaagaagggaaatccagacgagcaaacaagcatcatgtgagaactgagaaactatccacgaaatcgtcaagtcagtcatcatccttgtaggggtattcctctgggacttgcttggtaagcttcactcgcatctcgtaggcatcatccccacgaagcatatcacggacccatgtaacctctgtcttcatagaaacctatatgacaattgcaattcaatcagagtagcacttgtaaaagatttctctcgactgataaacaagtacaaaaatatcatgtgctgataaaggaaattttggtatgctattatggtgagaaacacgagggcataaccccacataatagagcaggttggttgctgatggcaccttaacagtcatctagtcattatgaactaacttaaatatgtataacaagaccatgagaattctgatacgaaaacgacaacatcctgtcatgcatctatagatcgttcaacatgaagagggaaggagaaggtagaggtagctgaaaaactaaccatttccagtgcacccctaataactccacttagcacattgcagtactgaagaccttggcaagtatcaggaagttcaacaaaatctacaagaggattgtccttcaatacaaagctgcagcttggacccttagcatcccaattggtgacagttggcagtcacacccaagaacattttgaatccaagctgttttaaggagagacaaaaaacctttagaccatacacccatatcttaatgcaccaccaagtctgggatatctgaataagggcaataagctctggaaacatgtaataatgttaccgactgataatgttcctattcaatctgaaccatataataacaagtttaacgaaatacctttgcaatgacatcggcagtctccttgaagtcaacacaccttgatacatttgatttggccaggaactcatcaaccaaccgagttccaatgttgtagcccctgcgaagtgaaaataaatatagctgtgacttatttaggaaacagataaaaggcaaaggcagatggtagtagtaaattatgaaaaaatgcagccagcaagccatagatattgattactaaataagaatcccaatattcgccagataaccacttgatttattatctactacttcaaagtcaagattcagttaatatcatccttacatatggagatattaattgtcgtggcacactaaccccattagtgcttaactaagtaaagaagttccaaaactggaatataataaatttgtacatattatttccccacattggaccatgacacatgaaagtgttgtgaatataaggtgccgtgagcccgtgaaatgtcatatcaaaatgatcaattaccattttgtcgcagtgtaaaatctgcactaaattggaaagtcagattatccaggtataaggttgaacctctaaatcccaaatcgctgtaatacaccttcatgaagaagtttactaaaagttacctttacaaatacttcaatcattcagactacctgaacgttacttagtttgctcaaaattccatagcaaagtctacatagatcctcttactgaggccattgcagctgcttcactgtaatttgaggggtggcaaaaagtgaatatttccgaattcctactcctataacacgatcggtccaaagtacccacgaaactccctaaaattgaaccagaaaattagacaccgaggaagagaagaaccacacatacatctgatcaagctgcttgttgacctcctcgacctcctccagatccgtgagcagctgcctcacgatggccccatacgtgagcgtgaacagctccgcgttctgcgagcaaaacgaagcagatcagggcccagatccagtgggggtttctgactccctgtgaagcaaacagggggggaggaggggcgggaacttacgacgcgctcgacgctgccgaagagagcgtccccggacttgggccccgtgagcggcggcatctcccggatcgcgcggcgcctctcgccggcggcgaccggagctcgtcggcggcggtggtggtgatgcggaggagagagagagagagagatcgggggagaggccacgtcgcgagaacggcaagtctataggtgcgatggctcacccgcctatgggcctcgtagaccgctagttgggccgaaacgtaatcgcgggctcacatgcggcccatattatctgggcccgaatgtattgcggcctacgtgtggggccgtacttattgggccaaaagggtaatgctggccacgtgaggcccattattgttggggccgaaggcatgggcgtagccgcgtagatacaggcaaaatcaatcgttcgtactattcataatgttttgcaggtgatgtctcttcaaccatactcccagtcccataaaaaaatgaacgggacattattacaacaaatctgaatatatgtatatctaaagtgtttcattcatttctatgtttgttttttatggggcggagggagtaaggctaataacactcgatatgattattatattttattttcagaaggattgcacttgaacgtcatttcttaattagaataaaacaagcagtctactgcacaaatgattaatatatacgccacgtgaaccacaccttctgtacgaaattaattgaccgcgtgatcgcgtctctatcactcatactatactcgcaaggcagcagatgataattcctgtttctcttcagttcttcgatcaccaaatcgccacatcaattacaacttatagtacaaattttatatttttaatccgtctgagattcttgtttatgctgaccccccaactgccaaatccttcttagcattactttaaagggtgatcactgtgcatgagttgacgaaatacggtgcaaaacaaatggaaaattttaaacgcagtagaaagtcaaccgcaatcttaaaaaatatcataaccaatgaatccagctcgatcgaaaagctaatttcgaaattttgtaatattttttttaaaaaattgtcttcttcccgatgaaagccacattctaaccgaaacattttggtaattaatttggcgtaagcatttttttgcagtgagccgagtcataataatctctctatatataggctcaaatcgagaaaggagaggcgccactggagaagccattttgcatatccaagctccaaccatggcgacgaggccggcgcggttgtctgctcccgcagtggcggctatacttgtcgccgccttagccttgtgcgcagccacggcgtcggcggcgaacgtcacgacgacgacggcgacggcgccgagcggcgggtgctacagccacctgttcaccttcggcaactcgctgatcgacaccggcaacttcatccactactccacctcgccgggccccgtcgcccgctccccctacggcgagaccttcttccgccgccccaccgcccgctggtccgacggccgcctcatcgtcgacttcatcggtaacgcaaaccacccatgagcttagcttagctatctctacctagcgccgccgccgccgccggagacgatgacgatgacgacgatgtgatggattgatgcagtggagaggctggggttcccgtactggacgccgtacttggccgggaagagcagggaggacttccggtacggcgccaacttcgcggtggcgagcgggacggcgctgaaccagctgctgttcaagaagaagcacctcagcgtcgccggcatcacgccctactccctcgccgtccaggtcggctggttcaagaaggttcttgccatgctcgcctccacagaacaaggttaatcatcgccaattttatactaattaagtaatccctctatttcaattcgtaagatgctttgacttttaaattgctttaaatttaattaaatttatatataaatatagtaatatttatgttacaaaattagttttattaaattaataattaaatatatttttataataaatttatcttaggtaaaaaaatatgactatgttttttataaatttgattaaatttgaaacagtttgacttagtcagtcgtcttataatatgaaactagataagattattaatctcagcgatatgattaataattaactggaattgatgttgatgttgctgtttaattcgtacgcatgctgcgtgtacgattcaatttgttcactgttaatgtaacacgacgatgagcgaattatatcgatgattttgttggaatgttgggccgatgaatcattgaatcagcagcatttcgttgagactgtaggtcagtgtaccttgtttgtacgcgaggaactgcattactgtcggcactgttaatcacgaacgtacggagaatagcccataaactgtagtcagatctcgttatttctgataacattttttaaaattactaaacgatatacttcgtgtgaaaaatttttatatagaaattgttttaaaatattatataatttattttttcagctttgtaataattaaaatataattaattatgtactaatgttttttcttgtttttcatgccataacttcatctttatcttaataaaaagcgaacaccaactttggaac

SEQ ID NO: 52822 - DNA, 805 bp, Oryza sativa
ccgcgcacccgggcgtcaccatcgcatacgccgactactacgcggaggtgatggagctcgtgtcgaaccccgcggcgagcgggttcgacgacgccctgaccgcgtgctgcgccggcggcgggccgtacaacggcaacttcaccgtgcactgctccgaccccggcgcgacgcagtgcgcggacccgtcgcggcgcatctcgtgggacggcctgcacatgacggaggcggtgtaccggatcatggcgcgcggcgtgctcgacggcccgttcgccgacccgcccatcatgtccagatgccacggctactagcctactagctagcttaagccagtttgggatttgctcatttgttaatttgcacggacaattttttttttcgaaaattcgatttgtcgcctgtttgttcgactatctaaagtcttcaaaccaactgggaaatgcagcgccctcagcgttttgcgctgccgtggccatcacggggtcgcgacgcgtggacgcgcgctggagagcggatggatttcacggcctttcatgcgtccgcgtcgcctctgcaaattttacagaaaagccctctcttttatagatattttgttatacgtcctctctgttcttttctcggtttaaaatattgcgtttaggccctttgcatcctacgaaattcaatacaaaggagacaaaaagaggaaaaaaggactgcgccctgaatcctagaaactgaaaaggggccattttcgcaaaatttccttttctttctctctctctctccccttcgcgagaatcccaggcgcgtaaaaaaaaaaggaaaa

SEQ ID NO: 52823 - DNA, 1290 bp, Oryza sativa
tatacttgttggacttacagcagggacttatttaggtcagtccctcaaataactttttaataccccctctcataaacaacactactcacttatgtgctacaattttaaaaggcaaaacagaggctacatcaagtttagcaacacaaatatattttgactccgatataacagagattgttgaatatcaaagcaggtaacttatatagcttattatcatactgattttaatttatattttgcttcaaaaatgcatcaatcttccttcaagctaccaatgggatattccaactctccaacaacaaatgccacgagttgagcatttaactccacttcaagcggctggtaagctatacaaacttgaagaaatatcaagactgcccatttctgctttcgaggtacctcattcacactacatcactaaataagttgctaatctaattaaataatcatttcaatatttcttacacactagggagggaattcatacagttgcattgcaaaggttcagcgatagtaccatatacaaattggtactacaaaatatgcaaatcatgtactgcatcatacaatagcaactccgacactccaagatgtcaatgtcagcattccatgccaaaaccaatgtatgtgacatatctataatactaatttttcttattaattaattcgtcttacatttctataaacaaatctaatatactcaaacaaactttcaggtacaaacttcctttaacaattaaagatgaattaggaactttggacgcagtagcattctacaatgtggctgaggatttggttgaggtaaatgctactcaagctacccagaacttgaaaattgatgcaaccgaacatgccatagctcttgatacagccattgggaaaacaagactgtttcacattgccatgaatacaaagtactcttcacacttcactatcaattatgtcctcaagaagagttatcccgttgaaaatgaaaatacaagtttgatgctacctactctggaaaatacaaaggtagcaaaggtatacaaatgtttgtccttaccatatcttctaccaaccatctataatctaaaaataacttttttcaggaatcagccaccaaacaacttgcaacagatgaagggctaaccaccatggaacattacaggttaaccaacatatgccttttttacttattatattctgcttaacatttctatatttatgactacaactaatagcagcaaagaagaccaacatcccactacgccaccgtccctacaacctccagaaacaactctagacaac

SEQ ID NO: 52824 - DNA, 10858 bp, Oryza sativa
  unsure (1)..(10858): unsure at all n locations
accccgatgatggaagcgtgaggacaaaagatggtggtggcaccaagaactcgacaagcgttgaaaccatgagcatggcatgaagccaatcaatgctgcaggaggcagtccacgtccagatggatggacatggcattggcaatgacatatcttggcacgaatggtctcaaagcggcgaggttacctcccaacaataatcacgagcaccccgggagctaaaacgaaaacgaagtgccggctaaaggtggctccttttttccaatatcctcgtgcttgaatcaaccaacgttctaccaaatactaccaaatggagctaagatgcaaaatcagagttgcatcaaagtgaacttgattaaaagaaccccgcaacaaaaaaaaaaagaaaactcgattaaaaagaaaataatggagaatccgaatgccataagttaaatctgcacgtcagaaatgattggatcttaacgacaaaactgagcagaagcagttgattaattcacgcagggaaaattattttggtcaaatgcagaggcatgtgttccatttcaagaagaagaaagaagcgattgaggcgtggcaatggcgggaatccgaccttggctttggggatgaccttgacggcgacgtcgtggcccttgtggtcgcccttcttggccttggcggagcaggtgtagcccttttggccgccgcccaccttctcgccgagcttgtacttggccaaaaaatgcttggagaaacccaagcccttgtcgaggccgaacctcggtctcgccgcctccgggatgggcgcctcgttgggcttcaccgacccgtgccgccgcgccaggagcgcgcggatgtgcttcgccggcgacggcggggggaacggccgcttcaaccccgccgcgcgccggcgtcgacgccacgcttgagttcgccggcgagctcttgtagctcgacgccggcagcgggctcggcaggtagaacgggaacttcggctgcttcggcgtgcccggcttcgccgccgccgccgccgccgccgccgcagccggacccggcgaggcggcgccggcgacggctacaccggccgccgccgccgcctcctccgcctcgggctcccgattnggcttggcttgtcatgacagagacccatggactggatcaagaacaccaccacggtttgagctcaatgaccaaactcgcgaaattgcagaattctcccagaaaaaaaaaactgaagcaatggtgggtcaaagaatcatcacgcgttccaaaggccccgagaaatcatcccgaattgctcgcatggctttgccgaattcttcaagcgaatgaatgaaagaaagaaacctccacacgaacagcgagctcgcctgcaattcggatcccaggaacagaagaacaataaaaccagccttcaaaatccttttcttggagtgaccaatgcaacaagcacagagctcaggcagagcaaaaatggcacagaacgagagagaagcctggaagctggaagatggagagtcggatcagaggaaccccaagaacaagaacatattccttgattcttgaagtggccaagcaattggaaaagctggaagctttgagtgaaaggcttggatcagaggggaatgggagggcacagctggtgagtgaatcttgtgtgaattgggagaagagaagagaagagagaaaaaaaaaagggagggctactgcctctgcctctgcctctgcctctgcctgcctggttgctttctctcttgctttcttttgagcttttttttttcaagttttttctttctttcttttcttttcttttggtcctctttgcctttctcttttctaggccttccttggtgtgtgctgctgtgctttggtgaatggaatggtgagggaagtggggttggggtgttccgggaaatttaactatttgccactcttatgacatggcaattaatgatttgccacaccctgtcaatgacatgtgggccctcatgtgtttttgacatatgagtctagtggcaaatcgttaagcaccactcgtaagagtggcaaatagttaaaagccccggggtgttccacactgccttggtcaccatttcttttattcctgtttttgttgccatcttacttgggccccgtttagtttccacaaactttttcccaaaaacatcacatcgaatctttggacacatgcatagagtattaaatatagataaattaaaaaattaattgcacagttaaggaggaaatcgcaagacgaatcttttgagcctaattaatccatgatagctataagtgttacagtaacctacatgtgctaacggcggaggaattaggctcaaaagattcgtctcgcggtttccaagcgagttatgaaattagtttttttattcgtgtccgaaaaccccctctaacatccggtcaaacgttcgatgtgatacccaaaaattttcttttcgcgaactaaacaggccttgttacttgctagtcatcactcactcatccggggaaaaagagcaactgtactaactaaactgtcacacaatatacagtttctcccattataaaacttttgccacaacattttctgaagggaagttctctactagaattagcatgcttcgtttgatctattgagttacatgtaccaaccagtttaacccaaagcttaagacggacaattcacttatactctagcacgatcggtatttgatgtgataaaattgagagaaactacttctggtttcatcggaatgtatctgaatgtgtcccaaagttttcatactacagtagtgggaattttatttgtggtgatatctcacagtcttctctgaagaaatgccacagcagcacaggcacaggcacaggctgtcctgtgatctcctccaacctnccaagaagagagtattaaacaggggagtaatggaggcatcaatgctgcttgcttagtactcccccctttcctcctccctctgctgctgcgattcatctcatctccttagctaaagcatgttgacttgagcctgtggggttcagaattatttctgattggtttgcatttgcccctctgatctggactgtttcctggtcgtcggtatcatactcagagggtgtgtttagttcacactaaaattagaagtttgattgaaattggaacgatgtgatagaaaagttgaaagtttgtgtgtgtaggaaagtcttgatgtgatggaaaagttgaaagtttgaagaaaaagttgataactaaaccaagcctcaaaaggtttctcctcctgcctgagatttgtacatgggattgaggtaataaaatgtaaggtttaatactaaattttacacaaatttgctgctctaaattgaatgagcataaaattaattagaatgtgctcggtgcttttgtgtcaacttggtgtaaatggttgaattctgaaagcctccatcatctaaaagaattaattgaaaataaccgtggcttaatatcaatttcaatgtgtaagtttacctatcataagatgatgatttacagtggcacaccttgcattcagtcacaagctaaacaggtgcagcactcatgtctgcataaaatggtgccaaaatatgttgcaatggcaagtggaattgtattcctatagtgacgcgcacatctttcgcgtgttcggggaaaaaaaagaaggtggaattgtatccccccgacccatgctaggtagcctttttcagcactatgaatgtgtcaaacttacaaaactttcggatacatggaaagagcgcaccgaatatgaatataacatttataggaactattagtcaaggatttagactccttttcatggagtcaaaaattcaagttctaaggattagagaggtcttcttaagaactttatgttctggaaattatgtcacttaaagattatgatgggtaagaaaatctaagcatctgatgagacactctagaggaagcaaactgccctgttgatttttatgtgtgaaggtagtacattccacttattgggtgtctttggattagccacctatactccctcctctttttatagggcatattttattttgttaggacaaggttttgactaataattactccattaatacataatgtttgtgacataaaattgatgttattaaatttgtattacaaaaaaaaactttcttctggtcataattttggaccacataaaaaatgaaatattaatagagtaattgtcgctcagaatcttatcctgacaaaacaaaatatgccctatcaaaagaggagggagttttctcccccaatgaaatcaaccatttatctccgaagaggaggcaggtctacatttcacaagctgaaaactacagtggccagaaatttccccacacacatgttctagaataattctctttgtttgtacagatttgcacatacaaaccctgctaccaatgtgcttgaactgctgatataccacattctttgaacaacacttggttggagcagtgcctctacattgggatgattgaggctgcttcacctccaaacaaaaagaagaaacaagcagctagcttcaatggaactgtccaattctgctgtcctctcctctgcacaactcacataaagaaaaaaggttggaattagtattatatgcatgttgggactagggttgccacctgcttaatttcaggtttgggtccctcaccagcatcatcagtcccctaattattcagcactcatactacttgacagtttccttaatcattcttctgcttgacaactagtaccagatgctatttattaatttaccatgaggtttcacgggtaactgaaacaaatgaaaagctagtgattgttgccacccaatagcatgggacactgtggcaatattcacattcaccaaatcccaaacaggccaagcaaatagtgccatactgccatcaccttgttttaaacaagaaatgggtgaagaataaagggtagcaatgcattgctttcatcaccccactatctttcttgatcaaattggagctcgatttgcctgccctttctggaggtccacttaggaattgcccatagaaagaaaagaccagatcatagggacaattcagttgaggaataaagagatgcaagtattaaaatgacaggagtgattacagcaaaaaatgtggcagcaatatccacaaaaaaattccatgagaaactgttctgtctctaccagagtagtctacattgagtcttggtccaactaagcctaagatgtgagcttggcactatccaagatttagcccctactaaaataatatcactgttgggttttccaggtgtgagctctgattccaagctctatgcagatagagaactcatgacttgtgaactctaatgcagttatgcatcaatgatctagcctccaaaagggtgagcatttgtactcataccttcatatgtttttgtaactgaagtttgttgatacctctgactaaggacatatattgttcttcaatgccttttggaaaccctataatgatgatcttcttctcttttcgctttcgtatcgtttttactagcatatctctgtgatcctctagattgcccacaactgatgcatcaaattgcttgcaactacaatatgtttctacttaaagaacttgcaagagaagcaagcacttggatgagggaaaacaaaaggtagttgaggtaaggatataataaagataagaggaacatggggtaacatggaccatcaggggtactttcatgccattgcaagaaatccactttgcagttgaaccatgcaatccttctggattacatgagctcctcctactttgatttgcaaccacttcagtatgtgtcatcacctgtgtggaaagctccatttgctggttttgttttgacagtataaaattagtggctaattaagtagacagtccatgccaggaagcaagcttgataccattcgcacatctcactatctcagtctcttacttactgcaagtggttctttgctcaaagcatcatagaagcataaaaaatagttacacatgaatgtcactgtgcccttttttatggcaaatgaaattactctcatgcaccttcctagaactcatccacacattcttcctaccccacatcccttaaatacatggccgtgcgtatccatagttgatgcagagactggaagttatctctattatctaaaaaattccctgtttataacaaaggaaatctagaaaagttcaatcctctatttacatttagatgttttgactagttaaacgtaggcaaaagaagacaattggcaactaaagtggacaagatggtcaaaaacatagtcttagaaagctgaaatgacaagtatctgaaactaaaaaaaaggctaaaactggtgttttctttagtccaaaaaatgacatctgtttttgaccccaaaaatgtaacataaaactaaaattcaagtattagatattcgacagatcactttcttaaacctacatttcaaatcatgtcatggatatgcacgatcagttatgcgtaacctcatcagctgaatccagtggcaacgtagtagttgacttattaaagtcggagtagatgatacatatattggacataatcagagtcattgtactactataccaaaaatgaattaagcagctattaatcaataaatcataagactacagcctcaagtacactatcaatcaatgttttgacagaagatctgatgatagcacaatttgatatttgagaaatctcagtacaaacctaacaagctagttttaacaacttaacattaatctaagaaattcttgcagttaggaggttgtggagatacctcatcagtcatctcacagagaggcacacgttcgttcttggctgtctactgaagatgatcacgtaataatatggatatcttactgcagcgttgaaggggatacagtacacagctcatatgaacttgcgctggggacacatcaataagttatttttcagttcctctccaagacttcaactaatcatatcctactaatcaccagtcaccaccatgaacttattgccattgacctgcttacaagctgccttggttggagtgttgaactaggggacatatcctgcacacacaaacttcgtgttcactaactaacaaatattaccaagaaagctaaaaaagtttgtacatatacttctaatagtgctacacttatatataaagtcttatcatcagattctattatacgtagagcaacaaaaaagatgatcttctgacaaatttacactctaaaactactagattttcatcattttgttacagctaaaatataatgaatctgaagttgagactatgtatataggtgtaacactattagaagtacatatacatttttttaagattctttttgtgatatttgttagttggtgtgcacagagtgtgtacctgaaacttatgtgcataggatacattctcgttgaactgaacacaaccaacaaaaaaacagaattcagaagaaaaaaaaaagaacaagaaaccatatgatggtattgtgagtaataagctcctgacatgtgtggtttctatcactcggatgtctttagatgtacttaaaaaaggctcttaagcaaagcacagcacaagatcaatttgtaccaacaagatgtctggtgaagagcaaaatcacttttcaagtaggagtacttggcaccaatgagccccactgattgtcagtgtgtgttgttaaatatatatacaagctaatgtactgtatagttggcccatgtccagcccatcggatgtccagtccattggatcttgtatcttgtatatacttctctattgctaatactattgttaggttgcaagttagttaagatggtatcagagcaatggtctgaaccctagctgccaattccccatcgccggccggcgcggcggcgtgccgccggcgtttcactgctaagcaacctcctccaattcatatttatccactgctccactgtccttttcaccgtcgcctcgtgggctatcggaccccagcgcgatttgtcgttgaccgccgtcgccgtcgccgccgccgcgactttgcccttacccgcgtgggcctgcagttgcgcagccgcgcgtggacgtcgtccaactctccgtccgccgctgtctgcgcgcttgaccatctacatcgttgctggcttgctgcacaggtcgaggccctgttcctcccattgcctgctgcggtgctgccgcttctgctttctgcttccagaaaatcagaggaggaggctctctgctatcagataaaagatcagactcaagtagctgagttgctagtgatctttggtttatacaattgttttgatatatcatggtgtcagatggaattcttggtccctatccatgtgctggtattgcctcatgttcatctatatcaactgttaccccaattgcctcccaaccatggattttggactcaggagcctcctttcatatgtcatttgatgattcatggctcacatcatgccgtctggttaaaaatggtgccaccgttcatacagctaatggaacattgtgtaaggttactcatcaggggtctatctcttctcctcagtttacagtacctaatgtgtcacttgttccaaaactatccatgaacctcatttctgtaggtcaactcacagatacaaattgtttcgttggatttgatgatacttcatgctttgtgcaagatcgccacacaggagctgtcattggcaccggacatcgtcagaaaagatcctgtgggctttatatccttgatagcttgagtttgccttcatcctccactaacacaccttctgtctattctcctatgtgctctacagcttgtaaatccttcccacagtggcaccatcgtttgggtcacttgtgtggctctcgcctagcaactcttatcaatcaaggcgttcttggttccgtccctgttgacactacctttgtttgcaaaggttgtaaacttggtaagcaagtacagcttccatatccttccagtacctccaggtcgagtcgaccttttgatttggttcactctgatgtttggggaaagtccccctttccttcaaaaggaggccacaactactatgttatttttgttgatgattattctagatatacatggatctatttcatgaagcatcggtctcagctaatttctatatatcagtcttttgcccagatgattcatactcagttctctagtgcaattcgtattttccgctcagactccggaggagagtatatgtcaaatgcttttcgtgaatttttggtatctcagggcactcttcctcaactttcttgtcctggtgctcatgctcaaaatggtgttgctgagcgtaaacatcgccacatcattgagactgctagaactcttctcattgcatcatttgttccagctcatttctgggcagaggctatttctacagctgtatatctcatcaacatgcaaccatcttcttctttgcaaggcaggtcccctggagaagtgttgtttggctctcctccccactatgatcaccttcgagtttttggttgtacttgctatgttttactagccccacgtgagcgcaccaagttgacagcccaatcagttgagtgtgtttttcttggatatagtcttgagcataaaggctatcgctgttatgatccttctgcacgtcgaattcgtatctcccgagatgttacttttgatgagaacaaacccttcttctattcttctactaatcagccttcttctccagaaaattccatctccttcctttaccttccacctattccttcaccagagtctttaccttcatcaccaataaccccatcaccatcgcctatacctccttctgtaccttcaccaacatatgtaccacctccaccaccttccccttcaccctcacctgtatcgcctccaccatcacacatcccagcttcctcatcacctccacatgttccttccactataacattagacacttttcctttccactacagtcgtagacccaaaattcctaacgaatcacaaccctcccaacctacccttgaggatccaacatgttccgttgatgattcatctcctgctccgaggtacaacttgcgtgctcgtgatgctcttcgtgcacctaatagagatgattttgttgttggggttgtgtttgagccatctacttatcaggaggcaattgttttacctcattggaaattggctatgtcagaggagcttgctgcactagagcgtaccaacacgtgggatgttgtcccgttgccatctcatgctgttccaatcacctgtaagtgggtttataaagttaagaccaaatcagatggtcaagttgagagatacaaggctcgccttgttgcgcgaggtttccagcaagctcatggtcgagactatgatgagacatttgctcctgttgctcatatgactacggtgcgtactttaattgccgtggcagctacccgttcttggactatctcacaaatggatgtcaagaatgcttttcttcatggtgatcttcatgaggaggtatatatgcatccaccaccaggtgtggaagctccaccaggacatgtatttcgccttcggcgtgcactttatggtctcaagcaggcccctcgtgcttggtttgcacgcttcagctcagtggtacttgcagctgggttttctcctagcgatcatgacccagcactattcattcatacttcctcccgtggtcgtactttgttgttactctatgtggatgacatgttgattacaggggatgatttggagtacattgctttcgtgaaagggaaactcagcgaacagtttatgatgtctgatttgggaccactcagctactttctagggattgaagtcacctctactgttgatggttactatctttctc

SEQ ID NO: 52825 - DNA, 7253 bp, Oryza sativa
ttttcttggcacttctctcctcacttggaagtccaagaaacaaacagcggtatctcgatctagtactgaggctgaacttcgggctcttgccacaaccacttcagagattgtgtggttgcgttggctactagctgattttggtgtctcttgtgatgtcccgacacctcttttatgtgacaacaccggagctatacaaatcgccaatgatccaatcaagcatgaattgacgaagcatattggcgttgatgcatctttcacacgttctcattgtcagcagtcaacaattgctctccactatgtgccctccgagctacaagtcgctgatttcttcaccaaggcccaaactcgagagcatcatcggttacatcttctcaaactcaatgtggtagatccaccttgagtttgaaggggggtgttaaatatatatacaagctaatgtactgtatagttggcccatgtccagcccatcggatgtccagtccattggatcttgtatcttgtatatacttctctattgctaatactattgttaggttgcaagttagttaagatgtgtgaggtcacagttttatcatcactgtcaggcagcatccatgccaatgaagtgtgccaccaacaactccagcagcttatgcatgaagacgtgaacaagcatctgaactttcctgttcctccaaacaaatatataccaacctctccaaatttctatgcctgtcttgccaactttctgatcaatgacacggcatgcagcacgaacaaattaacaaaggaaaacaccaccttctgaaacttttctttgaccaaacacctcaccttcttggccggccgccggccaccggccaccggcggcggcctgttccggcggccggtagcccggctgtcactgtacccggaccagaagggattttcttgatacctgcacaactgtatatgtattctggtagctcaggaccattctgacagtaagcagcaagggatgttgccaacagcatctgttattaatacttctcacaaattgacaaccaaacagaaaaaaaatcttgaatttatcagttgcccatcagagttaggtactcactactcactcatacatgtatgttttgcagatgtgcattgccattctttcaggattctctgtggattgtggccattggatgatacacattctgcctcagcattgcagggtttattatctgcagatgatccagctagctagcaagcaggaaactgtgcacttctggcagagtaatcagccagtcaggtgtgtgtatggctgttcagaattatgcaaacatgttgccaatggggagagagattagctaagcatgtgcagctgcataatgttaattggatagaaaattcttaaattctccctctcatgtggattatatgccatacttatacacccaatcattgggcagcaatgccaatctcctctctttatgtgtctatgtgtgccccttgggaatctctgcagcaacagcacagatcacagccagtgaggcctgtaaagtcagtaaagaaagaaagaaaaaaagagagagagaaaccctatgcaatcagagatgcaatgctgctagctgcagctgcagctgctgggcttggctttgcatgccatggctgccaagagagagttgtcatggttacatccttttcactttcacttttatcatcatcagtagtagtactcatccgtaaattgctcttctttttgtacatcctttcaggtgttttggatggttgccaccccttcttttttttttccttggccttccttctccctccctttgacctttgttattgcaaaacagcatcggatgcgccgtagaaaagctaaaaaggaagccaatcaatcgtaatccctttctcatctggagcaaagatacgtgtaattctttatatattcagtggaggtggtaggttctagacttctatagatcacatgataagaacagtgcccacggcaaaaccacgtcgatgggtcactgataagtgggtccttatttgatgatcgtcaagcttccgaggtaaagtttttttttttcagtaagaactctgatgctcacggtgaaaccgtgtttatgggtcactgataggtgggatcctttttcaacgatggtcaagcttcaaggggaaaggattttgctagtaataactctgatgccgattttatatcattttagattatgaaacaagatgttgaacaccaagatttggtctttaaataagttggttgcaacatcatggctggagggaggatccttgagcttcaaagcacctggttggaaacatttgctaccaagggacccagcttcaacctccaaatggccaatcagttgccatgagtttatcattgaaaacaatgtgcaaagcctttgttcatgttggttgcagacaaacatactgctacactttgaacaggttcaaacttgttcaaatttgcagctgaagcagtgcaatgaatcagtgcaaatgtgcaatgcatcagtgctaacaggcactgtgctgcaacaggggaacacaacaagatccagtacagttcatgtcatttggctggatggagatccagacttgggctgcctccaagaaaagccggtaagagtgtggcatttgcctccatgacaaagttggattaggcagaggccttgacaaattgtcgcggcaaaacataaaagatggcgaaaccaagaacaggctaaagaacaacccaggattggatccatatatcccatgcattgcaggataagtgaatggtgctgaagcttcagttggaattgacgttttacaggctagctcatggtaattcaggaactttacagagctcagaaccagcaacctcaagcttacgttatgccactgctttcagcaacttcttcctcacaagaacttcagggttttggtcatctccttgacaagatagtattcagagagagctgtgacaaaactactatccatgataatcaaagcattcaaaaaccacatcgaatccctctccaaaaaacctacatcaaatcagcatgacagcgtatgaattgaagcccttcatcaataatgctgtttactgtggcagtgtggtattctttcctcctccgaaaggatgtagtcattcagaggaagttgcatgtacttttcatgactactgatcacctaagcacttcatcaacatgcgcgaagagcagcattatttgagggtaatgtcatatatgactccttcaagatttgagatggttgttcttgtcccatccacctctttgacatgcattccatgtttttcagcttccttgagcactagaacatccatgctggtaatcaatgagagcagcagtgtcttagttaagcgaacacacaagttatttttaaatgatctatcaacacttgaagtagtacaaaatcaattaaagttagatggagagtaaaataacccaaaaaaaaaacatgggatgacttattgagagttgggattgctccagattttactggaatttgttacgagaagctccaaaaggtcccaactaagtgaaagggacaacactaaatagcttaattattttttaccacctttctgtattgcagttttttaaacagtacaatctggacataccaagtattatgctggcagtatgtgcaagatgtcagtacagtaatcacattctggcagtaccaagtaaaatatccacagtatgctgctacctgttctagcccagttaattgtaatcaaactactgcaagccaacctgtatattctatttgctcatgaatgcaactggagtactggacaatcattttgcagaggacaatgaactgtcaggtgcagagtatctcaaacaagcgacaagctgacgagagaatgggtgacataacaccttgttgccatgaaaatctgcagaacttctgtagatctacatgtcactaggaaaaagatttgcctgtgaccatcctctctaagtactaattaacgctagatcatatttcagatgtttaatctgctttacatttgaatccatcagatcaatatattttggatgcagcattttgattatttggtgctattgatgcactcctgatttcacttgtatatatctttgatcagttctatcatgactactcagctacctttcatactaagatattcattattccatgtgtagcaaacccagacctatagtacaagcaagttaatcggtatattaaaaagaatcaatagctaagtcagtccttgttcttggtagacacaataaggataccaccaataaaaatgtacctattccatagttttatcaataaaaggtacaatcatttatattttgatcagaaatgagacacgcattaaattggctttcctaacttggaacagcattcgggtacacgatttcacaaaatattagaaactctggtaaaatatgctcggacaggaagatgatgagttattgagttgagaaaacacatacactttagctcgtgatacataagccaatatgaatctacatttactagcctgaatacgaagaagcctctctacagtatcaaagagacaggaaatgctagattgctgaaagctttctgcgagtcaaggttcacaaaattcacaagatgcaacaatcgatatacgattatatgtcagaaagaatagaaagagaaaggatcagaactgaaattaaatcacgggaaagtaagaaagaagaaatcacagcaaagtaagaaagaaggatataaatatcagctccaaggatgagatcaaatccagaaggatgtttctcaatgatattgcttatatgaacatagtttccccactctagcttctctgctgtcaacactgcaacaaaagtatcagttctatttgatatctggaagatttatatttcagtgattcacataatgatgaaacataattaaccagaagttaagaagtggtaacctgcattggcattcccagaacatgactgcatctctatattcttctttataatctgtcaaacaatctttggaataaatagatgcaacatttatatagaataagtagatatgcaagtggcacaatggaatcatccttgaatattttataatgtatgactatgacaccactttctagaatttgaagataaagcagctgcaccgaataatatgtgaacacaatgtgaaagtctcaatatcttctgtattttgtcaaactaagtgacatcactggaagatattcgtaaggtttgaagcttgcctctagaacttcatcattgtgatcagtcaagacaacttctttgcaaaaacggctgcacaatatgccagtaatgcctgaagcaagtcacaagctcacaatactgtcagattttccaagatcacaaagtgaagtaaacatgagaggagaatgccctcaccaaccccagatcctagctcaattattgaatgatccttcacagtctcaggatgttcagacaagtaggtgttcatcagaactgcacctggccatactaactgtccagtaagatcataatcagctgccacaaatcattagaatgtttgtaagtgttggccccatgataaggaaacagcaaaaatctggcgttatgaagtgcaatgcagcattgtgcccagagcaaaaatacacccaaacaagttaatgtactgatgagaggttctagtttgtaaataagattgttcatatttgtccactgcacaaatagaaataaacttgagtatatcatgctcagatctaacttttgtgttccacggaagagctatctccagataaatgatagattgatagttactatgttacacaaagcagcatagcctcctggttatagaagcagacatgaaggacagaatgaaatggggcataagagttacatgacgacatatatgcacaaaatgaaaaccccgccattttgtttgatcctgtgaaacatggaccattcattgtactgacgtactagaatgacaatgtctgagttggaagggttcccaaaagggacaaggtaaaagtggtcctaaaactacatgattggtgtaatgaaaacccagtttgctactgcccaagcaacaagaatatatgaacagaacgtatcacatcttccagttgaactcatatgtaacaccaaattcagagatgatggagtaatctatagatggtagatgctatgctatgaccttaattcatgatcatcaagctaaaaaggagtggagatactaatttagtatccagtaacagctgattctgtaaatgaagccggttgaatagaacagcgctgttctacatagacttcttcaccaaaatgacaaccatactgagcagtataatgctcaaccaactatgctttttttttttttgcctctaaactaggctatcttagcagtggtttcaggcttccagccaagaaaatttcacccagaacagactagctaagtagaaattaaccatattttgcatcacaattgggcataatagagcagctttctggaaccatttccacatcaaagataactatacctctacacttagcaagaaagaacgagtaggagcaggaggtactaactggaagcagcgcggaggcagaggaggtggagcacttgcgagccgaaggtgaacgtagtcgtctcgtagcttccctcccagatcgacgaaccccagcaacaaatcgggacaaagcttcagcacacaagcaagccgatgcagctcgaccaaacaaaaatcagcagagagcgaaccagcgaagcacacctgcggtcgacgaagaacgacgggtccagacagacgacgtcgtcttcttcctcctcctcccttcccttcttcccttcctctcgccgctcgctcgcgctgccggagtccgccatcgccgccggtgactgcaactgaagtggacgtggcggcggcggcggcgagtcggcgacccaaaccctttattcgctcgtgggctatacaaaggccagagtcatgggctcataatcaagttgggcccaaactcgattacacaagggccaactaagtaataggcattaaatgacgattttgctatatagtgatttcctatatttgtcgcaattttttttctaaacaattcacacatgtaaatatattataatcatagtgtaattatattatataaaaattatatgtaacttttatataattataaaatcgttaaatttgtttcaaggtttatacaagcaagcaaggaagaaatgacagtgcgcgtataggggagggtattccgtcacaacttacaagacatacacgcttcatggaaatagtatgctactac

SEQ ID NO: 52826 - DNA, 1142 bp, Oryza sativa
atataatcatgctggattgctagttacactgttactgttttattacactagttgcatcaccttgctaatgttgattgtttaactctgaatgttccgctgaatccagctcaactctggtaaagtggtggctgttggccctggcgaacgtgacaaggatggcaagctgatccctgttgctctcaaggaaggagacactgttctcctgcctgaatatggtggactcgaagtcaagcttgctgctgaaaaagagtatgtgaactatctctccattgcttcacttgttagtgagaatgtacctttcggcatattgctagggcaatgtaattaccactcgttgcatactatcatagatgatagatcttgtagtgctctcatagtacaataatgtgtatgagccccatcggttggcctaataagccaaagcaaaagcatatatttgaattttcaaacttgaatttgaagttgattttaagatattttcaacgtaatttctttttagcattggtttttaagttgctaggaacaaatatataaaagttttacctataaattaacttttattccctaataagggaatatgggcaaccaatgaggctctcatgacctctatcggcagcatgctatagcaccgttgtttatggctaccatgtacgaagtagtaattactctctccgtttcacaatataagtcattttagcatttcccatattcatattgatgttaatgaatctagacatatatctatctagattcattaacatcaatgtgggaaatgctagaagacttacattgtgaaacagaggaagtacttgtgagtgctacagttaggaattgatcgaatacttggtggtggtgttgctgaagaaccgggaaccacacgtgcttcctcgtttaggctgctttcttctggtagttcaatatttagaatgcttgctgttgctagctattggttgaacgttgagtgggaaaatgatctattatgatgatttttgttcatccaatattctgtatgttcctgatagttatgctgatactgttgctgtcagtatatgatataaattatgttttaccattgctctaataatctttgcatctggaattccaggtaccttctcttcagagagcatgacatcttgggcacc

SEQ ID NO: 52827 - DNA, 1827 bp, Oryza sativa
aagagcctcttccctttttaatctgctctgtcttctatgcatgttcgtgttctctgtgtgctggttggatatgtgtcgctgtgacccgagcttaatgcggagagatcgataagcggatgtgactatgattccctcgttaaatagttgattgattgaattatataaccgctttcatcccatttgattggggaaataaatcgcgctcatcgctcatctatcttggatgaaatagttgattgaaccctcttcacctcttatgcttcaggctgttgaagtcgtgaattatcgcatgcaactttgctgtaacaaatgtcatttcaaaccaggatttaacttaaattacaatatagtataaatcacggatgtagtaaactaggatatgtccatatcccatcaggctctaggttgctatattctgagacggaaggttctaggttgctatattctaagacggaaggagtatgtggttttgtcatcttttggaactatatttttcaccattctcattgtaataaagtttggcagaacagacaaatatacttctagaacagtttcaggcattttcattctcatgaaagctgacataaatccaatcacaaaaaaaccgatcagttgattggaactgtcgtctgttcgggaggatgtaataatctgaaataatgcggctagctcatgtctattgatattatcgtctatcacaattagcagaatcatacaagaaccagcaatcagaattatcaacagcgccagcacgccgcgcctcaataaaatccctcagtttggcgtctgcagatctttgaacaatatctggctataattcatgatcgtttctcataggcattcagaaatctttgagcagcatctaggttcagctctttgtaaacctggcacagagaacaatatcgtgagatctcaaggcagttttgcgtggtggtggttattgaagtgatggctgggagtcaagtccatacaagtttcttatgggcttcttcaaatgtcttgcagaacaactctgcctttgttgctccaacctgagacagtaaccaataacatattagtgcgcaatcagatcggcctgtttcaaggagagatgccactgagcactcaacagcgccattccctcttaaccaacaaaatatgtaccatacagcctcaaaaaacagtgcatgtaggatgtagcttacagatgtactatttatatttaccagctttaattgatggacacctcaaatttttcaaaaaaaaaaaaatccaggacagccatgctcacgatcattttgccaaatatttaaaatctcttaccaaagttcttaaccgcataacagcagacttttatgacaaatcgcatccaaggagatctttgatttattccttactggtttacttattcatataaccgacacatgatattaaacaatctttttgaaacttccatattatactgagcaggtagttttgtgaaacaaagtgaaatatataaagaggaaatcccacctttttctcagcaaccatcttcaattttttcatgaattgatctgagaaacatgcaagaaaattcatcaatatcagtatatgtaagctggtattctttattgaagggcagcatatgagaaatacatctacaactgcaaccaaagtcttcatccccttatgcactgttcatgcaagtcccacaggaagtaactgacctcaactcaagtcatattacaaatatcaccaagctactgcactagagaatatatttgtctattctaaaaaaatcaatactacccttcatccccaaatgtagctattgtccaggtgcatagctagaaatagctacaattt

SEQ ID NO: 52828 - DNA, 13481 bp, Oryza sativa
  unsure (1)..(13481): unsure at all n locations
aatcttcatctccacaactattttgaagatctattccttatgatattcaaaactgcacattgctcagaacacagcctttccttatcatttcagtgagatacatctatagacttctcccatgagagggacttgtgctgcaagtatctcatcaatttctacaaccttgtgccaaagtgtacttaagtttgaaggccacaaaaaagatcagtttgtgcgagtgtctatttcaactctttgagtgttctggttctcaattgaatactggtaactcagactgttgttacagctcagtttagccatccaggaaatcaagcttccatatctactccctattaatctagtttggttatacacagcttcagttgttcaagtcaagaacaagaaaatcctaaatggggaattcaatacctacctgacccaattcataaagagtgatcaaatgatttctggacctcaaattgaagagaaattgatatgtgctgtgaataggagtccagcaacatgccaagttgatcattaatatggaattaagtcccatggaagtcatgagtatgtcatgtctaaccatggagaatgaggattgtggtgtgaaatgacaaacccagggcctcagaataaaggcccaaggctagttagcaattggaagaagtgaataagttccccatgggattcacatgaacagggatgaagcaggaagagcaaactttatggtagtgacacaggacgtcattccagcataagaatataaagttaaatgggtattgcaggtttagttttctgctgtaataattggtaagataagattaaaagcagagcaatcaaatatttatcgataagccttcagtaccagatgactcatttttgttgccccttgttgcctcctgcaaacaatagctttgttagaaataattacaaaatacaactaggtagcatttagatagttaaattagttcatacacacctgagcccgtgattgctgtgtgctgcctttgcttgatgcccctgattcagcctacatccggcgaaaaaaatttcatcagttcatgaccatatcacgagatcgtcaaacaggaaaacaagcactgaccatatttacttcagatcattcttcattgaagcattgcccattgatgtttccatttaaatttacttattattgcagcaaacattgttaccgttcaacccagttttctatttatgaaaatgagctctaccatctagttctctctcaaccatagcctccaactcaatgttatgcagagagaaacacaaacatgcttgcaaatagcctgttaaaagttattcctaatattaacctacacacttcaaggggctaaaattagtgtcactaaaaatagcctgaccacataaatggcatgggaaacacaattgcatggctctgtaattgaagtagcatggttatattgagatatgaccaacttagtgtatctctagcttttagaaccatctgaagtacagaaataaaaatcctacagctctacatcttcaaaagaaaattccagatgtactgcattctagcatccttatattgttaaagaaaaaaaaagagttttcctctctctatctcattttaactaacatcactcaggcaattaccagtgcactatcatctctacaacttctactgcgcaaacaactcaggctagaagacaggttcatgacgcaattcgacggatcagtataaccaaagtgagattatctcaacataatgcgtaatccagtctccacgcacatcagcccaaggccacaaatcaacagccacccaaatcaaccaacccatgccctaaaatcgagacccctcttgctcccccaactcaagcacctgaactgctagatcgccgccgaaacgccgattcgcccccgccctacacgtgctggaaacgagagagtagggtatgagaaagggggggaggggaggggatggaaattacgcagtagtcgcgagatcggacgacggggaagagctcgagcatccgccggaactccctctcgtccatggcgccgcgcgccgccgctactccggcgatgagctccgcctccgcccgcgctcgtagggttcgatccgattcgagcgagctcctcctctcccgattcgttgctctctcgctctcgaagcctcgaactcgctggagacgagacgagacgacgacggcgagtccaacccagacggagccgacgtctacgcggcgcagtcgcttgctggattatcgggtccaactctgtttcagattccggcccaaaataacctctcaggtcttgggcctcttctgggctaggcccagaaagggacacaataaaatgggcacgaaaccaagcttaagtccagatgaatttttttcatttttaattttaatttttttaatatttacataaatattattccatccaaaaattttacacaaatggcccctgccgcccaagtggagggcggcaaggtgtgcgcattttacacttaggtcccttgccgcccttgtaccctctacaagggctgcaagggggtaaatacaattttcgccctgccaaaaatgcatttttctagtttttttttcaacttgtctgtccctcacgtcaccctgccgagggcagtagggtctatttctgtaaatattttcgctggtgcaatatttctataaatattaaaaaataaaaatttaaaaatgaaaaaaaaaattcaagtaccgatattgcgggagcaggaaccatcgacgtgctcaatgcccacttggtttattccatgagtttctgagacaatatttatttactactccctctgtttctaaatatttgacagcgttgactttttagcacatgtttgaccgttcatcttattaaaaaaacttttgtaaaatatgtaaaactatatgtatacataaaagtatatttaacagtaaatcaaatgatatgaaaagaattaataattatttaaaatttttgaataagacaaacggttaaacatgtttaaaaaagtcaacggtgtcaaatatttagaaacgaagggagtaagttatttgtgtcgaagcacaccatacacatttggcaactggcataaaggctagttcccctcctccatggaagagcagaggcagtgaagtgggccaagaagaagctgcataagagggagagagagttcgcaggaatctggaggctaaggagagagagttggtgaggaaattcttgcataagagggaggttgataacgaactaccctgagttcttgcacgagtttagggttgaggactgttgaatcattcgtcgagaagtaggaacaggagaagtagataagtcaggtggtggcgctggagacctcgggcggcggccggattcggcgttgcaggtctagtgtcagtgctcatgggagctggcggcggtgcgtcgtcttccttgttgccagtcagcaccctctcccttcttgaactcctccccttctttgtggggagtttcggttgggttgaggcggctgctggtcagcaggggaagctcaggcggccgaagtgacactgtccagtccggattctcctttggtcgaacttggcgaggaggccggcgggtggcgggacggaggtggcctgggccagctctcaggggaggagcggtgggatgcagcgagctggcggcagggttctgcggcaagttcagaagtcaaccagcagagaggcgctggtgcggtcttggtggaagccacgcgctgccaatgcttgtgtggtggttactgagttggtgggcgacaaactacttgagaggttctaggggttccaggcgaaagcctcactcggtgatcaccgggccggcaacggctacaccttcgagtgtcgtaaccctcttgggggcgctgtcgtgggtacctctccccctttcttggcgagttctctttgggtggaaaccacatctttcttagatgggcgatagcggcgtccttgatgtcgtgacctccatgggggcatcgtttttggagtcttgcctttgtggtgttgttgtaggccgggcggcgatcagccatgcttaggggggtcattttggtgctcagttccattttcagtggtttgtgcttgtgtggttagcgtgtggttcttggaggtgccttgtgcacgtccgtacttgacaacttctgtcgtgtttttctttgtaactttactcctccttaatatactcggatggcctccttcggcctttcccggtgaaaaaaagataagtcaggtgagatcttgttcatcctttttatcaattcattacccctgaggccctgaattaacaatcagtgttgtccatttgtcattgtaatttggtttcttgaaacctttgaagtctgaactcccttttgcatttgcaggagttccttgctggtatccgcatgactttggacttatttcaaactgtgggaactgaaaacaaatatagactccaggcctctcggaagtgatgatgagagctgctctcctacacaccatgaaaattatccacctcaatgtctcaatctcattgttcgtgctgtatgaatctagtaatgagctggcttttcagcatattctgtggtccaattctagtcacatttgagaaaatcaccaggcacgctcattggtgctattgcgcactaccatttgttgtgggatacagacaattcgtatgcggttggttgtattgcaattgctcgcctattcatttttttttaacaatataaatagatctcctgttctgcttattttgaattgctatgggttgtattgtcgctggtagtggcttgtgtctgacgatagcctgattttctggtaaggccactcgagcaatcttctttcccgatcagatcaggcagtggacggctcagatcgatctgtaccgtatgaactatgcataattggcgaatacttcacattctttcttgatcagatcaggcggtggacgtctcagatcgatctgtagcatatgaactagtatgcgtaattggcgaatacatttcgttggcggaggaggtcaagtcgtggcgaacgaccactctctgcaacaaactctattttccggtttcatgaaaatggagcagtgggcttcccctgctatttctggattatttttttaataatggaatagataacatcccggtctttactcaacagagttacagccaattgttacaatctaatactcgaacaaagaggaaaaaaatatttttgaaacagaattatagatgaaatcaagatcaacaccaggctccaaagacaactctctaaacgatcaaatagagtccaagagagcataaacatatccattcaaggcaaatctaaaatgcagtcatgcacaataaccaaaatacataacggggcatgcttttcaacagctagctctaattaatttatgcccgggcatgattttcaacagctcaaattaatttatactccctccattctaaattgatctacatatttcataggtacactaagaccaagaaaaattaataattctctcatgttatatttactctagcaacaaactcaatgcatgcaccatccccaatatttcctagccaatagcaaatcaagatattgcatatgggttataaatacttgtgtgtatggatgcatgcatcaatgtccatttactccaatacacaaataacgaatagactctactaaatgaacacaaatatgtagatcatttaggaataaacttaaaaactatatgtaaatcaatttggaatggagggagtaataatttatgctcgggcatgattctcaacagctctaattattttatgcccatttagtttcactccaaaggggcatgcatggctattccaagtccataggattatcgctgtcttcagtttcgtctttagttcccaaaccaaatccaatatccagttgcaatggctcatgcaagtccataggattatcgctcctgctgattgtttcacccagccgcttgtgaggatattgcgcatgaaatttcaaaggtctcttcaggtttccctttacacctgcacccagtaaaacagcaaaacaaagggcccatgagttagtgcatatagcctacacacaaatgtaggtacatttgtatgagagtgacaaaaagaaaacctacaagagcataaaccaatttagttcaagaatgtttaaaaaatgcaagagcacctaaagtggtcttctctctccccactttgatgggggcagaaatcttgtttctgttttcatttctgacaatttcttttaataaaggctcactttgtttaattatgtgcatgttcttgatatagcgtgcactgacaagaaaattttgatatgaaggcaatctagaatccaaaatgcagttgcatttggctgggtttgtgttccacatagcttgcatttcatgtactctggagtacatcttatctggaactgtactctataacttgtctagaatctcaccaaaggcggcttccataattagaggggtaaagagtctagcgaggttcaaaataattacagcctaaactaacaagtccaactagcactatagcagcagccacacaggtttaaaatatatgagcaatcacaactttgaatcaggtttactgtcatatgcaacacaaagttaccgaaaagaaaagcaataagcagaaagaacaggccaagaattaattaatcacctgcagctgtagtgaaatattgggagatggtagactgcgtgtaggagtaatcaaagtagttggtgatccttttggtgtaatacatagacactgtttgaagcattttgttggccatgtcaaccgccaacaccaccgccttctcatcagaggtgtcaaccttgcccatgatgtaggcaacattagcatctgtttacgtgcagctttgccatggccggttgaccctccagcttaggcaggagttggacattgcagcaagtggtgtcgaccgtgatgtcactagaatctaccatgaagcccttttgccagcccttgttgtcgcccagatgagccaccggtttgctccatgtggacagatcccaggaccagcaaccagtgtccgaatcaaagcaagcacgcagtctgacaatggtgagaaggccattaacgatggcaatgtcccggcaaagcgatgaggtattgaagctcattggagagttgatgagctctggcggcagtggcaggtgacttccaggacagccatgggcgagcacgttgcagatgtggattaattccccgcttgagatcaatgaaggccacctctccctgcccctcatccagagtaattaccttgttcgtcaaatggaccaggcacagatgtaggataccagcggcggtggggcggtaaagatggtggccgttgccgagatcggcggcggcggtggtggagttccggcggtcggcgatgtaggcgcggacgtcgaggaggatccatggtagaggctggtgtgcatccagagggtcgccgccatggcagggcgggcgcagagtgaggtgctcggttctactccacctgtaggggaagacggtagccatggctcaggaggcctctcctcccgccggcgatcgtcgtccgcccgcccgggctagcttaagtagagcagagcagaggagtcggagtcggagaggacatctaaatcgatctcagcaatcctatcaagacaagttggaattgacgaaagatggtttggatagaaacggattgccggcctgatcaaacacacagcatagtttacagtcttaactaagcaaagtattttcagagttcagacaaatgcattttcagagtagagaagagtgtattcaggggctcttttttcaacttcaaactttattttttttcgtttttcgttagcatgttttttaaactattagatggggtgtttttttaaaaaaaaattatatataaattgtttaaaaaattaaataaatcgaacttttaagtttataatagttaatacttaattaatcatatgctagtgagttctcttgtttcacacgaactgaaacatcttctccaataggatgaaacgaacgggccaatccactttttttttccaaattacaataacaatatcagcacgcatacaaaacactagagtcgaacgcgcggcaccagtggtgcaagaggggaatttgttgttatttagttatacaaagttaaggaagaagcattatggtagaagagtaatcttgatggaaaattaattaacaatttataatatatatgaccaaacatctttaaagttataggaatttgacatgatgttgtgtgctgtatgaaaaactaatattaagctagtatcaaagatcatgtgctatgaaaaataaataatagtttgaccataattgtatgtggtgctctgaaacaacatgataaggaaaagccatgtgtggtatttaggaagatgaaagagcaagatgtgaagccaggtgattttcagggagatatggttcaaattttaaatctcgggaatcagatggttgttgatggaatgcactgacaaaattctcaaccacccagacctatcacagctactttcactaatcagcacacccctgtgtcccaaacctaacgaagaatgaatcaatagatagttccaattccaccagcaagtatccaagaaaaagatgtatatgtatcccagtttgtaggagatagatctgggatcagagaacctgaaatgcattgccctatcgcttgcatttcagattttctgatggtcagcaccaatgcctgtcgcttgctaaccatcagagattgctaacaaaagagctctatatctatctcagtttggttgcactgcacatttgcattttaatgtatattcccaaaggcttatcagattagccatgaacattgtaccatcatatgataatgctgcatgggacagcatcacctttaaattccttgtacagcatttcattccaaagcttgaatgctttgtttatatagcacctatcttacagagctgaggtactataaaccattttgcaaacaattataaatgaattccaagaaaggaagcaattaaatgaagcaactgtgactttttttgggacaggttggagctgccagatttttactgtgattaaaatgcagcaccaaaggatgatttataacagatgctatattgttgtagaaaataatcaggaaagtgaagctatgttattctagaagataagaaaggaaaattaaggcaaaatagcaccattcaacaggactgactaagatcaaagatctataaagcttatgttgctagacatgaatctaactgggaaaaaacatgtctcccagattagaaacaaacatgtatcccagcttaatacatttctatttttccataacaacagtaatgtaggtcatcccagattagcaacaacagttggctgagagctatctcatgcatatttttatgccatatctttaccctgaaaataaggagcatagcaaagcagtagacatccagagtaataataattaagagttataggattccaaccataagtgcttggtcatagtctggattgcagtttcatgtaaagcaaaaggattctacgaagcaaacgccatatatatgacagcagctatttacattagtggccataatgcagaggttctaaacaaatggcgttgcttctaagggtgggtgtgcatactggtgacatcctggacatataaccaaaagggacagtaatgtgctgcatgttgtttccttcttcatccgctagataaagagcaaagaaaagtatggattagcaaatatgtattgagctatgtgtcctatgatatatagaattgagatgattgtttatgtactgaccttttcttatgtttctgctgactgtcatctttaaatagtttcttagcagctgaggctgaggctgaggctgcaggcctgtttttgttcaggatacagttagattatatttttgctagaatagaaagttgttgtaactgaggaatgatggaaaaatatacctttttgggggaatgtttttggtaggcggtgatggggatgctgatggagtatcttctgctgctattgctagtgcctttgccttgtaagatagtttatgttgtcagtgtttatagtttttgctgaaagcagggataagtattaattaccttgtcctgagtagcagaagatagctcaacagacgatgcaatctgcggaggttctcccttaatntttgtctcagttggtgcctgaccattgaaagaaaatgcaaagttatattacttgtgatgcagtgaataaaataagtattgtgtaagtagcgatgttagaatagaaaccttaagatcatgtgagaatgagatctgtttatcttgagctggcttgggagagactgataggacatagcttttcttgcttggtgctggtgcattagctttgctagttggtgtctgatctgaagcagaactgatagtataccttgttggtgtcgatggactatccattggtaacatactttctgtcgtttgtgcttctatctttgatcctgtactgccttcacttgttgctggtgctagttggagagagctgcttgagtctgctggcataatagctaatgtctgttgtgaactgcttggtgagataggcagtaggccctgcacttcagcattggatgagataatgttgttaacctgtaaggtttcttgatttttcataatagtatcttgtgtgaagctgatgttccagataaaggtttggttgaaaagagctacaatctcatctggaatatattcactgtcaggtggattttggtcaatgagagtctcaaccggtttgcgtacgaggcgttgtgctattctcccaaagaggataaatgtagcttgagcagtatcatcagcagcgatcaacacaaccttgtatctacatgcagaatagaaatagttatagcagttttgataactgtgaaataagcatggaggaaattgtgccagcatattcttaccttggcactggtatgcctacattggagcagctggtgcatttataggtggaaccatatggttttgaggtcttgtagcatatgtcacatgaataataccaccaggagctgttgcttgatatgcctttaatagtcactctgactataaaacgtgctcgctgcaaagaaatatgattttatcatttttgtcaaataagaaaggacaatattgcagtaacaaagcctgaggtggcactgaccgcatgtttgtgtgggttgagagcaaggatttgtgctatggttttttcttctggaatatcctggttaaaccctgtggtagcagttcaacccacttgataggttgaaagtttgcgctaaagctacagaaagaagatatcttaaataataatgtatcgcagggaaaatgtatatgtaaatggatgattgtgtaagcattaaaacaataatataagcttgtggtgtcacctttcttttaactcaagcacttcaggcatatcaaggttaatctaccatttgcatggtgaacttccatttaaagttagtcctgtatataattgtattaataaatatgtactgcagatttacagaaggcatgaaaagattttggtacaaatttatagagatatacctatccctttgtagttcttgacaactgttccaacaaaaacaataacctgaggtttcttttgaccagcattgtataattcttctgcattgaatgcagctgcagtatttccccatagtgtgataggcagtgtagaattgctagttttataaaatgattataaatttttggtgatcaatattagtaacttgttacaatagttagtgtggataatgtaaggtaaaggcagtttataacaaaagaaaatttcagtctatactgtagcttaccttgcatcccaaatctgcattgttcttttcaaagtttctgtgtttcttgattttgggcgtagagtgtctgttgcaccaatttcagttatgacacccataatatctggttaaagagaagatatatgtaaacaataaaccactaatgtataagaagtaaacataggaagacaaaaaagggataaggaggttataccaacatagaaagcatttttgtccacaagagacgggacgtcttgaaaaggtgtcaatgaaaaagttatggcagggaaatcatcagaagcatcaatgcattcttctaaggttgtccatttagtgaatgagatcatcaaagggttcgtaactggcctatatgttcagtttgcatatctgacagagaaggagtcaaagtagtaaaccttcccttcctgtagaagagtcctaagcttaatcatggcaggtggatagatttgaacatggatgctattgccctgcatattgtgtatataaagcaccttgttagtaccatatttgtatgtaagtattaataaagaagaaatgagtgttaattagactataaccttttcatccagcaagacaagatcagtgtggaagatttttgtttcatcattcagatcatggtagtcccattgcctagatactcttgccttgaactgtttattagtgtccccatacataaggtctgaaataagcacgtataccattggaagcctgtaattaaatattgaagatatttagttttacgtatatataaagcatcaatgtaatgaactaagcagtgagaaaatagcacatggaaatctagtagtctgttggtgcaccagtgctacagcatatactacatgtgagcacaatatatatactccaagatttatactacattgcatatactacatgtgagcacaaaagccattgcaattagctgatgagggaaagcatgctacacatggagtggtgaagcctgcaataggaaagaacgtccactgtgacaccaagaatgtaggtaaacatagagataaaatatgcagagcggcagcgagggcacaccgcttccattgtagcagaaagtatctcggtataaacaacatttcttgtttggtttccacttgacccgtcatcgttttcaatcagtattttgaggcctgatcggtttgttgctcttgaaatagcaacatagagttgcccatgcgtaaagacaggtttcctaaggtatatgccaacctgctcaagtgtttgtccttggctgttgttgatagtcattgcataacaaactcgaactgggaattgtctcctttgtaatgcaaaaggccatttcattttcgatgtgcttagtgtaattcttagtatataaactgtttcaccgatgtttgatccagttagtatagtacattgtaaaattgtttcgcctaaagcaataagtaatagtcttgttccattacaaaggcctattgattggttcaaatttcgtagaagcataacaacactaccttcctttaaaacaagtttgtgtgtaggaaagttagttgctacacctcctagagtctgtgtaggatcaaatgcacaagccacagtatgcatgcatgtttggctacttttgctatgagacgtttgagaaacactaaaaaccaaaattttgggacccagtaacctcttttcatcatattgcctcatgttaaaa

SEQ ID NO: 52829 - DNA, 1222 bp, Oryza sativa
taaaatatcagcagccgagctccaatattctagaatcattgaatactaatagcacaatacaaaaatcatatcatgcagtaggcatgtttaatgtgaagtaatcaatatcgcactaaagcaaaaaaaaaatgtagtcacagatacccctgaatatagatataagaggtggcttaaaataattgcgtgcaataataatcatggatttgacttaacatcttgcagaatatcataaaaaaagaactaaacttgcaaaaaaggcaaaaaaagacttaatagtttaaaggcacactacccaatttgcagaactatcaagccgcttcaacagtttaacaactgcagcactaatatatcacttacataacagcaaaactgccctgctgaaagctcagaatgagatatgtcactccgaagcaacaacagaaaaagaatgttaaaaggagtttatatataaaaacaaatgcctaattaaagtgcaaaattagtccatttggaagccttcacagcaaactgaatttctgtcaactcgctgaataaatatcttgcactatataaaatagatatattttgtttcaaaagggaaaatatgtcttgcaaggaaccctggcactctcccactctcctagccatcatataaactccatcatacatgagtatattttccatgttccaaatcactgggtgtttatttagatctcaatttaatttgtgaaaagcgagaacaggcaagaagcaaaacttttgctttgaggtcgcagtgcgcggattgattacttgtattttttttaccagagataaacaatatttaataatagaggttatatctttaaaacttcatatggcaagcttgtcttaaagataattactaacttttcccaaaaaaaaaatcagaggtaatgtgcaaaagttgtgcagccatgtaggattaaaacgccaaatgcatattttacaaactatcgaatgatagttttaattttactctagataaagggaggtagagttagaatctagaagcatgcagagctagaagcaggacaaaacgaggcatcaatagcaaacatatttagatggaaagaggaagttttacaataatagctccaaagcaagaaaagatgacatctggaagaacaaagcaaaaacctagctgactttgatagaaaacatgaggcagaggaaagcaacattcttatgggcagcaagggacaaaatattaggaaagagagta

SEQ ID NO: 52830 - DNA, 771 bp, Oryza sativa
  unsure (1)..(771): unsure at all n locations
nnnnnnnnnnnnnnnnnnnnnnnnnnnnnnnnnnnnnnnnnnnnnnnnnnnnnnnnnnnnnnnnctgatgagctatatatattttttgacatgtaggatttagcacggtgttcgagacgtgctgcgggtcaggcggcggcaagttcaactacaacaacaacgcgaggtgtgggatgtcaggcgcatcagcgtgctccaacccggcgtcgcatcttagctgggacggcatccacctcaccgaggcagcttacaagcagatcactgacggctggctcaacggcccgtactgtagcccggccatcctccacagctaaggcaaaatgactggaaagaacgagccattagttaatttattactttattattaaggctggtgtttattaattaagcgggaattaattaaaggggaattgtttgggttcttgatttttatttgggtggcatatatggtgggtggtgtgacggtgaaatggtttacttgcgttgccaaaaaagcaaagaaagcgatggcatctgtagaataaatgttggttactgttgtaatttgataattgtttctcttccagaatcaaatgaatcatcaatggtattatactcagttattttttttcttttgctttttagaaagagacttttttgccatggcagcttatgtttggatcttttgcctgccaagggcatgtggtctgtgctttacgaaaagcaactgcagaaaattcactctgatggtcatcctgtttgagacggctttgtcattattagtcagagact

SEQ ID NO: 52831 - DNA, 1455 bp, Oryza sativa
  unsure (1)..(1455): unsure at all n locations
cggcaccatcgtggacgggatcgggaagggggtggagcagctgatcgggctgggcgccatgtacgtcgtcgtccccggcgtgctccccgtcggctgcttccccatctacctcacgctgtacggcacctccaacgccggcgactacgaccagtacggctgcctcacccgcttcaacaccctctcctcccgccataactccctcctacaggccaaggtctcctccctccagagcaagtacccctgggctcgcatcatgtacgccgacttctactcccacgtctacgacatggtcaaatccccctccaactacggtaagaaaaaaaaaatcctcaacacaaacactacaaaacggtaatatcgttccaacggaatagcccatatcagcatgacacctacgtaccaattgaaggagactacagaacaatatacttttgtaatggaatagctgacatcaacacgacattagcatggtatcgtaggtacggatctagtacctagatatcgtgttaacgtcatcatgatgtcagctaatccattagaacggtatatcgttttgtagtatttctggtacgaattatgacgttagcgtgatatcgtgcttggtacctatctggtaccacgggtaccaggtctgctacctatgatatcgtgctgaatccatgctcgcatgagctattctgctggaacggtaaagcgatagtagcggattttcttggatggtttgaagtttatgaatgattaattcgacggttttttgtgatgaatttgcgcagggtttagcacgaatttgagggcgtgctgcggggcgggaggagggaagtacaactaccagaacggcgcgaggtgcggcatgtcgggagcctacgcgtgctccaacccgtcgtcgtcgttgagctgggacggcatccatctcacggaggcggcgtacaagcagatcgccgacgggtgggtcaacgggccctactgccacccgccgatcatgccctagatcatcgccggcggcggcgacggcggccggaggatggccggctagctgctgctgatttgatttgtttagcagaagaagagaagaaaaatggatagcaagaggaagaagaagacatcttgcgatcgactgggaaatgaataagatggtgattagttgattttcgttgtgggtggttaatttgtttttgttttaggtaatgcacatttgtgtagtatgtatgagattgggaggcaatttaattatgtgttgcaattaattaattaaatcttagtaatttgttgcatggtttggttggagatggtcacatacgcacatgctggatccggatgaaatcataaatgcgagcaagatcttatctaagctcatcaacttggtttgctgccatctcccaaacacgaaagaaaaaaactttnnnnnnnnnnnnnnnnnnnnnnnnnnnnnnnnnnnnnnnnnnnnnnnnnnnnnnn

SEQ ID NO: 52832 - DNA, 2274 bp, Oryza sativa
  unsure (1)..(2274): unsure at all n locations
nnnnnnnnnnnnnnnnnnnnnnnnnnnnnnnnnnnnnnnnnnnnnnnnnnnnnnnnnnnnnntttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccgactgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggcctgtcaggcgcatccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcaaaatggcgctccatacgccgtacttggcgcacgtaagcgtccatctgcgggtcagagcaccggtactccttacatacctggttaacgaccagctgggagtcgcctaacaccaggaggcggcggattcccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccttgaagagacagggagccgtcgaactgcatcacccagtgggcggtgtgaggcagctgcgaggggcccgagctggcctcggggactgagacgggctcgggtgctggggtccactctgccacaaaatcggcgagggcctggctcttgatagcgtggcgtggttcaaagtgcaaatcaaactcagaaagttcgattgccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcctggagggcctcactaacaaagtagacgggccgctgcacctttcggtggggccgatcctcttcgctaggggccacatccctggggcgctctttgtccaagcggccttgcggggtgcactcgtcttctgtgccgacgacctcggggtcggaggacggcaggggcggccttcccacagtggcctcggggccgtcctgggggtcgggggctcctggcgtcgttggacaagcgggcaaagggccaactccggccgtcaggggccttaggccaccgttcggctcgggggcctcttctccctgctgtctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggcctctcctccctgctctctcccgggccaaaccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagag

SEQ ID NO: 52833 - DNA, 1347 bp, Oryza sativa
  unsure (1)..(1347): unsure at all n locations
ggccgacgtagccggtgccatcgggctcccatcctgcttctccacctagctgtcgtggcggtcctcgtcctcgccatctttgcttccttcgtgccagacgctctcactgttgtcgccctcgagctccttcccaagccgtcgatcaacctcgattccagcttgatttgcatcaatctcgaccggcgacccatcctcacttccaccgtcacggcgcccttcgctcagcttcttccaacgtcgtcggatcccgcaccaacccatcggcttcattgctaggaaccgcagacacatgggggagtggcatcccctctaccatcgtggccctcttccgcgatcatttgcagtcacgccaagctgccgctgtcggaggagtaggcgagggggacttcttcctctgctcgacaccggcttcgcttggtttcccaccagctttccagcctctctgtcgtcggcgctctctcccttgcccactgtctcctttgctatgtgactgcctcgccttgtcacccaccgcctgacctctcccccgacgaaagcaatttggacccaatcacccaagggcaaagctatagttttgtgaaaattctctctccgaaatagcaggaaatcataaaataatatatatggtgtctactagaaaattgccccggtttttaagcgtcgttggacaaattcacattcttagcaatgatcaaattttttgagtgtcctttagcaattttgctaaccaattaagagaaaattttggctatgtacacggaggctaggatgtaaagcatttccatataaaaaattaagcaaagaataaccatacaatatcggtcaaccatacaaattggttgtaggaggggcaaaccacactggctgtgttcttacccccaagtttcccaacccatctccctcgttttctatgtgtacacttttcaaactgttaaacggcgcgttttttgaaaaaaaaattaaacgaaagttgctttaaaaatcatattgatccattttttaaaaaaatagttaatacttaattaatcacgtgctaatggatagctaacgccggtaacaggctgcagcgaacacacgctacgctgggagcgaaactatgaattgattaagcgagactcgctagataagccctggggaggtacttttgatagagaaggagagtagtgcttaggttagaaatgctctttctcatgattttttttattttttttgaactttttaaaattttaattttacaaatgaaccatttcaaaacttatttctagaatctgaatcatttggccacgccagnnnnnnnnnnnnnnnnnnnnnnnnnnnnnnnnnnnnnnnnnnnnnnnnnnnnnnnnn

SEQ ID NO: 52834 - DNA, 831 bp, Oryza sativa
ataaaaaagatggccaaccttagaccacacgcatcccatccccatcccttttcttgttatcatcaaccagaaaggttacaaaccaacaagtaacccagacacaagagcatcttggcagatcagttgagattttagccacaaacgagcgaacaactaaccacttaacccgaaccaaccccaacaactgtcatcatcgaccaaatcccccaattagcgtccatcccgattgcttctccaaactctatttcttaattctatcgagtatcaaccaccccgttttatattataagtcgtttgatttttttccctagccaactttttttaagttagactaaacttatagaaaaaatatattaacatttttaatataaaaacagacagattattaaaatatatttaatattaaatttaacgaaactaattttatgctataaaaattgttatttttttcaataaactgggagaaagaagtttaaaatacactcgcttgcaagcttgccccaaccgagtcagcgcctccttaccgtgggccccacctgtcagcgacccgtatacgaggggttagcgaagtttgacgcgataaaccgacagcgacgacgccgcgcggaagcaagacggattggttttatgccgtaatcaaaccggattagtttctcgccggagagagcgagcgagagcgagagagagagagagagagagagagagagaggagaagaggagaggagagcggccgcgtggggggaatctgctcgtcgtcctcatcggcggcggcggcgttgaggcggttgcggtggttgggtggtggtgggggatggggaatcaggtgggagg

SEQ ID NO: 52835 - DNA, 6929 bp, Oryza sativa
cttctgctgcctgcagagtgttttctccagatgaggacgcccacctcgtgccggccgacgcagtatccttagcccaaattcttgtagatttttttgttttgtttagcttagatgttcttcagtgctattattcattgctgatgttaggaatcctgcgtgcgtgccatgtattatgtgtcatcttgtttggttattccttgacttgtaaggtgcccttactgcaaaatggcgagttacgcggttgagtaccgcggtgtcaagacgaaggaggaaaagggcactgagcagattgtgagtgtccgcaagacatgatttcgttcagtgttgtcttctatgttttgtatttttgccaatggttggagctggaacttgtggtgtggataggaggagcagagggtgatcgaggcgcagatccggatgcggcagcaggagctccaggacgatgctgagcggatgaagaagaagcaggctgctgctttgaccgatgtggtaacaactgcacaagtagaacattgtgatactggtggcgcatccaccacaggtatatgcactggaatgtgctaactttgtttctcagttattcttttgtcatgcaatctctaaccctgtctattatgttgacagtcaaaagcagtgggcaaggcagtgatatgctctcatctcaagtgcagcatgcggagttactgctgaagacttctgaacgcttaaagcagatgcggttcgtactgcttactgagttgtgcttgatattctgtaaaagtagctgcttattgttgcatcagtgcaatttagatcaaagtcatgacagtatctcaatgactgactaccgtttaagatctgaaatgtctatatctggtccctccaatcctcaaatagtttaagttttcgtccctcaactccaatattagccagaactcatcagtcaactatcaaaacgtctaaatatgttcttgggcatgttttccaagtggttttgagtgccgcgccatccttttttgccatgtcttttaccacatcaggcaaacccacatattagtttttttcctctttctttttaatagaaaacaaatggcgaggaaggggatgaaaataataaacctaaatggataatctgttatctaacatatccaattactttcttatttttgtgacttgtttcccatgtattcagcccaataggatgccattcaggacaaaaccactgatgtacttagccagggacattatttgtatggtgttgatagttcagggacgaattctgtccgttattggaattggagacaatattaaataacgtgcagagttgacaaaacaaatataagactttttcctgagatgtttttttattgttttgtcaatccgtcgactagataagtacaggcctttcaaatcttggttttggtgctctgacttttgcttcttcttcttttttttttttggggggggggggggtcaattttattgatctaatgtttgttgcagcaccacagcatgtgtagtaaatgatagttatttttgtttttgacttatctagaaatcattctattatgtaagaagtataacgggcaaacatgtataatctgaaagcttatggcctctgcaaagttcagaacgttaatttgtttgtgggtgattttgatattgaaatgagtatttgttctgaaaatttcttttccacagtacacctgtttgatgacattctgctatccacttctccttccttaattaatgtgttccttttatggtgctagtatatgccacaaatgctgatttgctgggaataattactgatgaattccttaaagcgcaggaataataattttgacatggatcctgacgaagttatgcttgttgaagcactttggctttctctgcaggtacataaaaatgatgttgctgaacttacatgtagaaataaataatatctttaacttattttttaaagaaataacctatttctttttagtggggcacatcttttactcatttaccatcttcattggtataatatgtctgtttcatctcatttgtatatatttcattatcatatccttttgagtttgtgcaaatttagtgtttgcttcttgaattaaacctgaacttggttcagtgcttgatacgtgaacctgcacaaacaattatgcatccctgcactcgtttttgtaacaattatgcacacacatttgttgtgtttgtcgatatatatctttcagtagaaagcgtgcattctttcaagaaataaataaaatttaattttggtaaacttcatagtaaatgcaggattactcaccatgcttacatgtttcagtctgaactttgtttctttaaacaggatcaggaagcctcgggaaatccaacctgtggtaacacagtctcatcagtacatcctccgagaagctttgaaggttccatgacaattccagctgaagcagcttcttccagtagtgcatttgcttgtgcagtcgcagctttagccgagcaacagcagatgtatggagaagcttctagcaccgctacttgccacacgtcaagatgtgacattctcagcaggtcagacagatcttttacagaggatctgagcataaacgggagtggttcctcaggcgctaggtctgaggaaccatcgagcaacaaaatgcaccaaacaagggagggtatggagtattctaatgagcggtggtcagagatggccgaggccagtagcagctttaccggctctgatcttacaacagaggctggagctgccaattcaggtggatccgacactggtgctggcagtattcctgatagtttcgaagaacagatgatgctggccatggctctttcgttggctgatgctcgggccaaggctagttctccagggctaacttggcggtagcatttggcagtgctttattctttagctgggtcgtgtttgtttgttcttgtagttccttttgtcacataaaaacataggattagagggggaacagataagaaaaaaaatctagcctggatgttgtgaatatagtgggataaaaatgcacatttgcagtcagtctttgcccttttctcatgatctttttttttctttcttcagaaagatagattctgtcaagcagaccttctgtctgcatacattgtgccttaatgacttttcagaattggtgtaaatacaaaaaagaaaaaaaaaacattcatcttcttgttctggtgtgatcctcctgaacgctacgcattgtttatatacctgtgcctagattgacataatcccagacaaatttgttcatcattatttctgttgaggcaagcaagaagtaaaagctctcatgccatgcttattactaccatctctgtatcctttcctccatgcccagctgtgactgatgctgatgaaggtgcttcatcaccatggctgcttcctcctgggtcaacagtggcagaatccttacggccatcaccttgcttcctgtggccgccggtgatgacggcgccgccgccgccgccgccgctgccgcagctggtgtcgtggtggaagaagacgccgtaggcggcgagcgaggcggtggacgcgaagagggtcatgaggaagaggccccagtagttctccgggccgaggcggtacaggtcgccagcgccgccgtccatggcggccgccgccgccgccgccgtgcagttgtacgccgacagcatcgccgtctccagcctctggatggtgccgttctcgaacacctcgaggattgcctgcgaaatgtcggccagcagcggcgaccccttggggaacacctgagacgacacaccctataaatttgtaggttaatcaactcttgaatcttgatccagagttaagccactgtaattaagcttaactaactaattaattattcattggtgtcccttggcttcgtgtactctcgaaatacagaattagcgctctaatgtttttcacgggtgaccctagatgcttgtttggtagaggttcaactttttaatttagctctagtaattgagtttggagtgaaattgtgggagcaggcatatagtttattttgtgagagcgtttcttcgcttctaatttagatgaaactaaaactgtttggctagactccagttctataagaggtggagctaaagctaaatctgtaccaaataaaccctaacttgcgatggctccacgtggtgaaacaaaaccagctgtgaacacaagacaagattaagatgctaaatctacattttgatttttcgcttttggcaacccctcttcctagcttctaactcgctcattttttttgcactcttatcgaactaataatggcaaacaattttttaaaacaaatcgataggaaaattactttaaaaatatatttatctatttatcaagttttctaaattaatatttaaataatcatgcgcttatatatcatctatttcttcgtgcataagatatataaacgtaacctaaatgacacagccgaatatgttttaagtatcggccatacactctactcattaattaatttgcaatattaagcgatgtggcgatggatgcttacgaagccaaggccagcgacgtggtagacgggtccggtggtcatcagctcgttgcagtacttggcgaggaggagcttggcgtgcgacacgcggaggaaggcggccttaacctcgccggagacgagcgcgcggcggtgctcctcgtcgccggcgagcctccggacgcggtgccccgggaacatgagcacctcctcgaggtacctgccgacgacggagccctcggtgcacccgaccaccgcgccggcggcggaccttgttagaagtagaaatacgtcggtcagagataaaagtcaaatataaactatagagataaagtaaaattctaaagataaaatagagtcttagagataaaattctagagataagatggagtaatagagataaatctactcataatcttacctgtattgtactccctctatccgctatgtactcctacatatactctatgtactcctatacatatacccttgagagggtcgatgtaacaaatcagaaaacatcaaaaatacaacaattagatttttctacgtacctgagcgactccgccgtcaccgccgcctccctccccagccgctgcgccgtcatcagcgagctcaggctcgccgtgtagttggtcgccagcacgacggcgacgagcagccacaccgccatggacgccttggagaggctgctcctcagccgcctctccttctcccccggcgagaggagggcggcgagggagagccagagcacgatggtcacctgcttccagacgccgccgcggtagtcgccgttgtgcctgcgctccatgagccagatggcaacgccgttgtacagcctgacggcggcgatcaggagccacatcgccggcgagaatggccggaggaagatccacgaacggtcccacgtgtccgcgctaaatggcaccaccatcaccagtcctgactcggtgtacggctgcgagaactccacgaatttgtaccttcctgatgagatgctcgtgtcgccgacaaggatgtcatagctctgtataaaaaaaacacttcttttaatggtttatttttattgggttattaccaatgttttaaatagcagctatagcggactaaatggagctatagcggctaaaaattgtacataagagcaaatagataaacagctatagcgagagatagcggcagtttagcgggagatttaaaaccctggttattactgattagctacagccgaatttaaaatttgaaaaggtttttcaatgtagtattttacatatgtggcttttaaaaccactaaaatacgcacatatataaaagttttatccataaattattttgtttatttttctgctacttatccgtcgtagctcaactgatcttaggacctttgaaaagcttgataagtcgattcaaggagaagagtaaagagagaggaggagccaaggaaaagtgagggggaagtgtgaaatgtgaggacttttaagtatacgtctgatataaccaaataccaccgtctataaaaatattcctattttcacatgagggtcttctaaggaaatacctacgaagaggttgtcttaggatcgatgattgaattttgagagaatcccttatatgccactagaaattggccagttcccttatataccattcaaaattggcttctctcttatatgccactggttcaagtttttccacccttttatgccacttccaacactatagtgttagttgactgttagtcaaatgttagtttttttcgtaaatgaccaatatgccctctcaactaaaaaaatgtgtaaacttacaaaaacataactaatttattttaaatcattttagagtgaacaaaattttgttagaaccagtgaaaatgctctttgtattaaaaatattgttggaaaactgcatgtttcatgcttatattgaaaaattatttgtgatgatgatggctaaaattgcatgtgatgaaaaaaaattaattttcatatgttgtatccaattgtactaaaatacttattattagttgtatactaactcttgggtaaatgcgtctttttactatgaagttaacggtcaactggcggtggagtgacggcaatggcataaaagggatgacaaacttgaaccggtggcatagaagggagaaaccaatttgaagtggcatataagggaaccggttaatttggagtggtatataagggattctctctgtaattttacacatggctcaattttcaaaaataaagtggccccggaaattttctttttaaaggagtgagagctagatggatagatcaccttcatgtagtcatgctgcatgagcgagtcgtacgtcccgttgaaggagaccaacttgtagtggaagttgtacggcaggtgttcgacggcggccttgaacacctcgatggagaagccctc

SEQ ID NO: 52836 - DNA, 7468 bp, Oryza sativa
  unsure (1)..(7468): unsure at all n locations
cttcctcaacctcgcgatgaggcggtctctggtgttcttggagttggtgtccatggagatatgattcctcacgccgatgactccctgcatggtggacacggcggcggcgtcgagggagtcgatggcgccggcgatggcgtcggtgacgatccagacataccccgtcgccatcatccccatcctgctcgcctccgcgaacagcgccacggcgaccttcgccgaggtgtgcacgacgaacacccggcactgcccgcccatgaggtcgccgagcgaccgccgcagggcgtcgccggacggcgacgcggggacggggacgcggcggtcgacctcggagcccacagcgcggagcgcgtcggcgaggtgcgggaacacgccggcgccgccgccgtagtcggcgtcctcgtagagcacggccacgcgccgccattgccatgacccgacgaccgcggcgacggcgcgcatctgcgcgtgctggccgcgcgccacccgcacgaggaacggccaccgccgggacgtcgacggcgccgccgccgcggcgaacgacagcacgggcaccatcgcctgcctcccgatctccgcgacgaacgccgcctcctgccacgagtggagccccaccagcgcgcgagctcccctctcgttgatcagcgacagcgccgccgaggcggctcgcaccgggtcgccattggacgccatcgtgcacagcaccaccgccaccgccggcgagccgacgtccacgccgctcaccgtgaagtcctccatggccatttccatggcgagcttctcctccttccccgcacggctcgtgtcgtcgaccatggcgccaatgcagccgccgccgccgctcgccgcgccggacaccgccgcgggtagcaacagcaacaaaataatagtgacgtagccagccattgtatccgcggttcgcggttcactgctagcttcccagtgtacaacttgtgtctgaaaatacattacacttgtgctgtatttatagcgaacacataacattcatctatatattttttttcaaatgtcattcgaataatcgttaaacgaattgaaaaagattatgattattcgatgttataacaaggttacgaagggatatccacttaaagtatagtgttatcatagacgtagtataatgctatgtgtaatgatgctacacttttgaagtcaatagctaaaattctcttattatgtgaagatatgtaaaattacttagtataatctacgtggtctttatagcattttagatggtttctttttgcacggcctagagatatatcccatcactttgtcttttcatttagtggaataaaccaaacggcatatttacaaatgaaaagtattttgtaaataaaagttacgtgttcttatctatttaaaagcaaagactggaaaataaactttgatgaaaaaaatctaaaatcaactctaaatttgaaagttgaaaatttaaatttcgccagacaagtatgtataagtagaaaaatctattgacggtctgcctacttaagccaaaggccagggcgggaatgcaaaccatttccttttatcataaaaaagtatgaaaaaacatttcaaattactttccttaagcgtagctgttggttgaatgctctgaattgcttggaaattgggaggtttccaatccaagcccatttgcaaggaaatggctaagattttgcgcgtgcggtcgtaccatcaggttggcaatggaatcttcagcgagaagacttaccggcacctgaaaatgctaaatccatatattcagaaaattcagggtagagttgtccggactagcaaaatattcgtacggtgtaatagacagttattttttaaaaaaacaataactcattatatatgcatttttaagtccctaaaaactattccgttgtctaatatatatatcgtaatctttcattcatatatatatatatatatatatatatatatatatatatctcgcgtaattgtgctatttttgctgtaacttcttaggtacagttagccatagataatgctattattatcttgcaagatattatcatttttctatgatgggatctgtgtggcctatgggaatcgaaaatatggaaaatcttatctcagggactcacggtttatgtgggttctgcatgatagttggatgatgatgataaattcatctcatcactgctattatattttaaagtagtatagatagaatatatcctatgtcctttctttgcttatgcttatacttatcggtcaaaatttgaatttttaattttagggttttttcatcgaagtttatttttcaacctttgctttgatatcactaaaaacacgtatataaaagttttacttataaattatttttcatttataaatatgccgtttggcttattccccaaaaagcgaaacgatgggacctaatgtacttatgtttgcgtgattttaattttactttgatagaatctagaataatgagatcacggagttctgtttactattttttactttctctgtttcacaatgtaagtcattctagcattcatattgatgtcatcaatataaatgctagaatgacttacattgtgaaacggagggagtaggtactagtattactttgcatagggttctcatgattaaaactagaagttcgttccaaatatattctttttgggagtgtttattttttttggatggagagtgtatatcgaatatttagggggtgtttgggactaagggctggtttgatttgaggcctaaatttggcttaccaatatttgataattttaatagtgtttagtgtctatttggtttgaagctaaattttagcatgcctaagaaaataggccatttcaatagttaacttagactattttggcttcaatccaagcacaactttgccttttcaaaatttgtcatgtcaaaacttaccaaaatttggcattgccaaaaatttataagactaatttaggtcacaaaacaaactggccctaaagttccctcacacccaaacacccccttaggatggggcattttgccgtgacactgtctgggtcttcaaggtccagacggtgcactttatttgccgtgacctatcagttcgtcaacactaacagagaatcacagccggtcacgtactcacagtcacttatctttgatttggacgatttaattaacagtggcatgctgcccattgtcaattgctaatttacccacacgtcgcgctgccgtatagagcaagttcagatgagacagggagtcagagagatcagccgaaatccatgatttcatttttgaatttagcacaaagacttgtggattctttcttcagaaactagaccgaacaggacatgtttttttccctcgagtagatgctaagatgcccctcgcttcttccatatcattaaaatagttaaattttttcttaaaaagataataacacagataaatataagttatatcactcacatacatataagaccaaatttaatgaatagaagttataaaaacaaattaaaatctaacaagtacgtgtactattgatggccatatttgttttttcccatcaacttgcataaactggatttatatatttatgtagtaatatatcatatattaatatattttgtttatttaaaaaattgcataattacttggaaatcccttccagtggaaaaggactttcccaaactgacacacacaaccatgagaacacatatgtagaagatggatatttcaaccctgtcacttgctaggaaaaacctcagctatgtccgagtttagatccaaagtttttttcaaacttttaactttttcatcatatcaaaactttcctacatacataaactttcaacttttccatcacattgtttcaatttcaaccaaacttctaattttggtgtgaactaaacacaccctatatactcatacaacttgtggttttgccacatcaccttcatgaaaacaactttccacaataattacagtgaaggcgcaagtacgatatgccagtccactttatgggtggagtgtattcctgtttttagagaaaatatgtggtgaaaactacatacgtaatgaaaatttgaaactatagttggatcgaaaaaggacgtctatgatttgtccacgtcaatatgagtaaaaattttactcccactaaaacttttactcatgagtaaatttacgagtaaaattttttattcatggtgacgtgaatgaatctcagatgtctagattttcactggatatgtgtttgcactacgtattttcccccgtttatgtaccgcgagctgaatcaaagtttcaacgacagcatagtaccataggagaatatacacatataacaaggacacggcaatcatctttactttgctattcaatggaccctacattttatatgtgacagattaatcgagatccattaattgagccaacaaattttgttatgccgactcatgctgtcaacattattgactaatttatggattcatttatgcaatatcttttcaaaagaagttctcctttttatgtcaaggataggatctatatgctctttaatttgctgcaatatcttttaaaaataatataattgctacaggaaaaatcaaagaatgtggtttttctaggggatattgtaaaaacgtgaatttgttcgagtactcagaaagtatgataatttactgcaaaacacatgagtattaaaatacaacattcacttagttgaggagagagaaaccatataaaatattcattttaccctcatattctttctctcaagaggttttagtcacctccacccacctgatctgcttcgacatggccgacgtagccggtgccatcgggctcccatcctgcttctccacctagctgtcgtggcggtcctcgtcctcgccatctttgcttccttcgtgccagacgctctcactgttgtcgccctcgagctccttcccaagccgtcgatcaacctcgattccagcttgatttgcatcaatctcgaccggcgacccatcctcacttccaccgtcacggcgcccttcgctcagcttcttccaacgtcgtcggatcccgcaccaacccatcggcttcattgctaggaaccgcagacacatgggggagtggcatcccctctaccatcgtggccctcttccgcgatcatttgcagtcacgccaagctgccgctgtcgaaggagtaggcgagggggacttcttcctctgctcgacaccggcttcgcttggtttcccaccagctttccagcctctctgtcgtcggcgctctctcccttgcccactgtctcctttgctatgtgactgcctcgccttgtcacccaccgcctgacctctcccccgacgaaagcaatttggacccaatcacccaagggcaaagctatagttttgtgaaaattctctctccgaaatagcaggaaatcataaaataatatatatggtgtctactagaaaattgccccggtttttaagcgtcgttggacaaattcacattcttagcaatgatcaaattttttgagtgtcctttagcaattttgctaaccaattaagagaaaattttggctatgtacacggaggctaggatgtaaagcatttccatataaaaaattaagcaaagaataaccatacaatatcggtcaaccatacaaattggttgtaggaggggcaaaccacactggctgtgttcttacccccaagtttcccaacccatctccctcgttttctatgtgtacacttttcaaactgttaaacggcgcgttttttgaaaaaaaaattaaacgaaagttgctttaaaaatcatattgatccattttttaaaaaaatagttaatacttaattaatcacgtgctaatggatagctaacgccggtaacaggctgcagcgaacacacgctacgctgggagcgaaactatgaattgattaagcgagactcgctagataagccctggggaggtacttttgatagagaaggagagtagtgcttaggttagaaatgctctttctcatgattttttttattttttttgaactttttaaaattttaattttacaaatgaaccatttcaaaacttatttctagaatctgaatcatttggccacgccagcccgcctggcatggtaaaacatcactgacacaccatccgcaacggtgcaacgtgcgtgacagttttagcgtgaccaaaaggtttagattgtggaaataaattttgaagggtttatttttaaaattaaaaaataaaaaaggtttaaaaaataattaagttcctttctcagcataatccctcctatttctttcaaaaatgtttctctctatattcatttccagtgttcataggcgactatgtgtgtgtcagagatcgaattgtggatattgattccggaataactaaaagtcctgcagtcttgatagtgaggtatgaactcatattctaagtcttgggcaacttgtaagttactgcgtcaatcgttttgactgtgactagggaaacaggtaaatataccatggtctctactggttagtattaggccgtgtttagttacttttcaaaaaaaaaattaacatatacgaacctatatgaagtattaaacgtagattaataacaaaacaaattacagatttcgccagtaaactgcgaggcaaatctattaagcctaattaatccatcattagcaaatatttactgtagcactacattgtcaaatcatggcacaattaggctcaaaagattcgtcttgcaatttacatgtaaactatgcaattggttttttcatccacatttaatgttccatgcatgtgtccaaacatttgatatgacagaaaagttggaagtttgaaggtaacatagccttagagcaagtataatagtaggctataagctgactaaatgctgaagtgtaggagagaagagaggagagagaggagaagcgggctgtaaacttaaagccggcttggacgcaagaaccaagccatattcgtggacactagaatctactccctccttccaaaaatattagacttatttcatattttggtttctccaaatatgttagtcatatattgtaatttttacgtatttaagacttactacctccttgcacaaatatatgacgttggttagttcaattttgagctaaccaacgtcaaacaaaaaaatatagagggagtaaatggaaagataaattgaattattaatcagaacctgatgagcctggtaaacatacattgtttgatctttgttacatgcaggataaattattttttttcttagtggcaaaagtaatactcctttcgtcccaaactataacaatcttaaattgaatgtatatttatacaatgaatctggacaaaaccctatttagatttgttgtatttggatatgtctcatccagttttaggttatgatattgtaggannnnnnnnnnnnnnnnnnnnnnnnnnnnnnnnnnnnnnnnnnnnnnnnnnnnnnnn

SEQ ID NO: 52837 - DNA, 2168 bp, Oryza sativa
  unsure (1)..(2168): unsure at all n locations
nnnnnnnnnnnnnnnnnnnnnnnnnnnnnnnnnnnnnnnnnnnnnnnnnnnnnnnataaattgaattattaatcagaacctgatgagcctggtaaacatacattgtttgatctttgttacatgcaggataaattattttttttcttagtggcaaaagtaatactcctttcgtcccaaactataacaatcttaaattgaatgtatatttatacaatgaatctggacaaaaccctatttagatttgttgtatttggatatgtctcatccagttttaggttatgatattgtaggaaagatggagtattttaggttgcaagttactccctatgtccaaatgaatcacctaggatagagatgtgatctattctaagataatgaatctgaacaaaggagggagtatgttgtaaaatctaatcttttttggatgcaggggccatgatgcttcactccttcctaagcaagggcattattactccatctgcttcatattataatcgttttgagtttgtagaaaaaaaacagtaatattttcaccccaagacaaatatattattaaaatatatattcaattatagattagtgaaactaatttgatgttgtaaatattactgtatttatttacaaacttgaacaaacttgtagtagtagtttaagtaatttaactaaagttaaaatgacttataatataaaacggggagtagctattaagagtactttaactgcactgacataatttggacggaatttacagatgtcactgaggacgatagaagaacaggaaggctacctcgatttgagataaaatcatcaccattcaccaacactaataaaatggaagaaaaaagctctactgttatactttctctacagcatgatcgacctaacaatgagaacaatcaccgcggctgacggtcacacgggcagctccggctccggcccggcggcgcacacggcggcgcggcacagcgggcacgtcgcgtgcgcgcgcagccactcgtcgacgcagccggcgtggaacaggtgcccgcacgacggcagccgccgcacggcctcgccgacgcgcgccaggccgaggcatatcgagcactgcgcccatccccccgccgccgccgccgtctgctcccgcttgtacccgaaggccgccgggagcgccatgatcgccgccgcgtccatcccggccgccgccggcgccacgtcaccaccgccggcgccaccaccaccaccatggccttcctccccgccgagcgacaggcgcaggaaggggaagcggcgcgcgcgggtgaccgtgacattgagcgcggcgagggcgacggcgcagacgtcgagcaccatggcgccggccgccgcggccacgccgaagagctggtacgtgacgaagaacagggacacggtgaccaggaacagcggcacgaccaccctgctgccgccgccgtcgacgccgtgtcgcgccgccaccgtggctgtcgccgccgggttgtccgtgaactcggcggcggaggcgagcatgttgtcgcgtcgggagcgagagagcgcgacgtgcacggtggaacggagacagctgcagatgcacgagcgttacgcctagggattttggccacggatcgaccgtgcgatcgagaaacggacggtcgagattggaaggaagacgcaaaaaaggaaaaggaaaaggaaaaggaaaaggaggaggttaatgcagcagagtttgatttgctgtaatgcagaggtagaatttgtctgatgcaacagcctgggttttatatatatattatccagtaattctagcaggttccaaaatacacagacacctttaatccaaaataataataataattattattgcctcctagttaggatcaccctaatcctatcttcttatataattggtacctattaaagagcatttactcctataaagtaagatatacaagaagccatatcattaaaaaaaattgaagatgtttttgtcggtacttttggtacgtcatccgtgtacgagtcgtttttaagttcgttcgcttttaaaaatacagatccgcatttgtgtcaggttttaagtttgttctttttggaaacataaaaagaatcgtataagaaatccctttaagaaaactcgcatgctaatttaagatgatcggactcctacttggagctcattattttctagaaaa

SEQ ID NO: 52838 - DNA, 1494 bp, Oryza sativa
cctttcttcctcgtctacggcgcgaaagcggttctcccatccgagctcacccagaagtcccctcgggccaccatgtactgcgaggctgatcaagatcagcttcgcagagatgacctcgattacttggaagagtgaaggcgacgtgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctctgttcggctggccacgggcgacggcacagagctgcctaacccgtggaacatcgaacaccttcgtcgcttctacccctaaaggggaatcgggtgtcaggtttcgggctcgggccaaccccgcacccccctcgggtgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcccgccctcgggggctcgggtcggctaaaatcgccaaacggggcccagaacagagccgtgccccggggcgtggtgaactccgggggggaatcggcaaaaacccacaatcgggtcacccataaccctcggtcatcacgctcccggcctggccagtctcgacatgtggatctccccaggcactagccccgacccgagccatttgaggactaggacctgggcatgagcccttgttcaagccaagacacaaaaggaccgcggcacagaccatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctaggggctcactccgatgcacccgggtcgccagcctcgtcgccactgtcgcccactccgccgtcatcgtcctcctcgtcggagttgagggcgaacgcgagccgaggggccaaatcctcgaagctatggacgatatggtcggcggcgtcccggacctgcgcgcgcgcgccatcctcggtcccgggagggaactcgtccagcgccgtccatggggagaagtcgggatccctagcttggtaactcgccagtacgagctccaccgctcctcgggcgaggtccctcgaggatgacttaatcgtcctctcaagctcctcggggagccgttggagagtcccggctatctccgagaggcgctgggcgaggcccccctggttggcggcgtacttcgcagtccgcccgccccagaggcccacctgccggccggcgcggtctatacgggagacggcgtcccgaagcatgccgggcc

SEQ ID NO: 52839 - DNA, 8572 bp, Oryza sativa
  unsure (1)..(8572): unsure at all n locations
ggcttcccgaagccgatccgcggcttctcgccggtcagattcccgcctccgggcctctgtggtcgccgggtcctcggcctcagactggccggacttggaatggcgggagggacgcgacgggatctcgctgaaacagaagaaagaccagaagacaaacaagatggatgagtgaaaattcgcgttgaaggaatgaatacggccacgatgggcgtgggacgaacctgcgagggggtcggttaaacgaccaccttggaggggaaataaggtttccccgggatggttctgtcccccccatcttgcggggccgtttcttcttccgctctccctcgggctgcgacgtcggcgtggccccctccgggcgcctgctgctggcacgcgccgccccgccccctcggggaggagatgggggaggggttccttcctgcttcctctttccccgggcgtcggcagggcggccgctccccgggcccccgacgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgcagcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgagaatggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcgaaggacgcagggaatgtagcggttcaacaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacagaccgccccgggtagcgtggcgccgggcgtccctcgcccagcgagactatctcccggccggtggcagattccggcatgaagcggcgcggcagtccggcctgtctctcgctcacgatgcgggaaggcggcagcacgctaccgtcaagcggagcggagccccgtgccatgacgccggaaaaactatttatttgaggtcgcaaaccacatttattgcggtttggacgagcgcatcacgccgcatgtaacgcagtgcagcgcactcgtttatccggtctgtgaccagtcacagaccggtcagatcgtgggttaggtggcgacaggcggtctgacgcacgcctcgccccatcccgttaggacgagagcctccaagcactcgtccctagccggagccggcgtgttagctcctggagatggcacgttagttccggtcaaatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggtggaagtggaggtaggtatgggccgtcccatcagaaggtcattcggacggcaaccatacagatctccgtccattaatgaagagaagtcaagttggagggaagagaggagaagtccccacaaaaaagagagagatggtgcatgtggtatccccttgaggtataaaaggaggaccttgcccacttagaaaagggggggatgatttttaggagaaaacgatcccagaacgatcggaggctggctggcactttgtagcttcttcatacacagatccaccaaaacataggagtagggtattacgcttctcagcggcccgaacctgtatacatcgcccgtgtcttgtgctttttccattctcgcgaaccttccacacacagactaggagcttagaacctcacccagggcccccggccgaaccggcaaaggggggcctgcgcggtctcccggtgaggagccccaagctccgtcagctctcatttatgaaattagttttttattagtctatgtttagtactctaaattagcgtccaaacatccgatgtgacatgggcaaaaaagtttttagccccactaaacaccccatagtttccaatcgtttttatcaccagctgaaagcgaaagggaactactgcacacgtggactagtagcttggggaacagatcaggtcagggaggaggtggccttgtctgtacttcctcgatcgtcagagattgatactgcctgtccttgatcagagtttgatattaaattcgtcacatgtgcaatgatcctggcacagcgtaaagcatggcctgattacaattatcacatgtaccccgtagtttggtgagatttgtccatatgcatgaatctgctggaggctttagatcagatcttcaaaatcgtgcagaatctggctggctagcctgagaagcaactgcaaaagaaaaggagctattgcatttggtctatatttctttcctttggttttcaaactctagaaaggacacggagtttctcctatagattaaaaagaagagaattgattagtttacgagaaaaattgacccaaaagcattgcaattatataattatatagttaaaaaaatagacgtgaggatcgccaaaaataacaactaaagataaaacgccatcatgaaccgcatgaataaccatgatatttattatctatccctttgcatatagtttgatctctttattctcttggagaaaaataatgcaaaatttagtgaaatatttattatgcattaaaaccgacaatacctaggaagagctatataggcatcgatgtattatgcatgttatcattttcggccacacgcatattcttctactacatgatggacggtcacgctcacgttttagtaggaccattaactactcagttctccttcaatctaaaaatataaacaatcctacttctcaagactaaggttgaaggaaaaaaaaactttggtactcctcgttaaacgagggttgtttaggaacaagatgtacaaaatttaaacgagagatgattgatgatgcaataagtattaatatgcggatgaattttaaatgttttgaaatgcttaccactggacccatggcaaatagttaaatgcccgagtaccgctatacggtttatttaggtaatggaatgaaacattccggcctttgctcaagagctatagtcaattattacaaggttcacacagtgagtaccgctatatatgtatgacctatttttacaactcatgtacaactagagacgacgtataatcatagatcaattaaagccgagcatgttcataagcactatagccgtttataaccattgatccaaattcagttttacgagagttatacatggtcgtatgcatagcaattttctaaatgcccccatgaattctagatagagggagtactgtttcgtctcatgtacgctccttgcacctaaatagtagtactctgatcttagtggggaatattagcatatacggtgttgatcagtaaccttgttttgggaagccaggaaactcggaaaatatactagaaaagcaaaaaaaaggaatgaacaatattgctaattacgtacgattatatacacccatgtggttccttttcaacgcatcgaaatgacggtacagtatgtacacaggtgatcgattaacaataaagcatctttgcaaattgcagctagctagctaagctaggaaggattaagatagcatgagcgctttactactactggagtgtgggctgcgtttagtgcgtcccaccaccatgtatgacgccaccatgctgatatcctcatagccagcgaggaatcaaccatgaacgacacaggtcattaatcaggtagctactgcatgcacagtggagtacataggaaaaaaaaaagctttgtatggtgcagtactgcagtattcagaagtggattccaaactctcgaggaaaaatccgcttattatttatatgttatctaaataattataaaaaattttaacaagaaagattaatatgtgataaatcatttcacaaatatgcaggttaaaatgggaaactgttttaaaatttaacttctacaagttgcaacggaaaaacagattaagctgtaaatatatgcttcctccgtttcacaatgtaagtcattctagcattttccacattcatattgacgttaataaatctagatagatatatatgtctagattcattaacatcaatataaatatgagaaatgttagaatgacttacattgtgaaacagaggaagtattaattagctagccgtagtttaattttggttgttcgacatagtgttaaacttgcgatttcatatgaccgagctatatttttataattttctctttagaaaagtactatctctaaaaaaagaattcccaattaaccgtgcgccgtgagctagcggctctcgtcgtccctggcctccatccatccatcgctttccctcacgtcgcagctcgacaccgaccggtggatcgatcgtacgtgcgatcatctcgacctcgcgtcgtctcttctcggcggctcgacgccaatccacgacgcgcgcgccgcttgtcgcgcgcgcgcgcgagagctcgtttcgatctcctgtgtggctctacgctcatccacgcgacgcgatgcgccgctttcaattcgatcgacctcgtcgntgtcgcaattgggcatcgatctgtacctgtacgcatcgcatgtactgcgtgagagcgacgtcgttctagccatggtatagctacttttctttcttcgttgtggttttaacttataagctacacgtaaaatgagaaatatattattagcataaaattagttaagtattaattattaaaaatttaaaataaattttatttgaaatttgaaaatcatatcctgtatataaagttttttatacgaaacacaaccacttatccgtttgaaaaacatattaacgaagcttatttaggccgggcgctagctacaatggtgagctttaatttgtcagcctcttgctgcatatatgttctttttagagaaggatattttctatccggcctctatattcaatcggatatatctatgcagtctttttaaattaaaaacttagcctataaaacagagaatttactcatcaaataatccaatctgaaattcgtttctatagatatttgaactcacgacttagagtgttactcgagttactgtaactaatatgctacatgaggaactaggcactgcgatcgcgatcacacgtttatgcgatcgatcgaccgggcacgaactgacagctccagcatgttgaatgcatgtatttacctttacttttgccaaagggtaaaggttaagtttagagactatatagcttaattagggggcattgcgctgcctggggtgccactagcacgtactagtgtgtcaattagtcaaattgcttcatctgtcgtgtgtactagtgtgtcaaattctagcatcaaattgcttgggcaggggaatatttggctctatatgggtagaagtaggccttgaaatgtcatgctatagttaagtacacatcaatcatctatgttgattcttatgtttgccggctgtatctgctttctaatttgtcgatcaacaatacacctaaatttaattaaggaaaaagtacgaattacacccctaaactatcgaggtcgtccgaattacacccccgaactcaaaaacgggacattctacacccccaactattaaaaccggacgaattaccccccctcgatcttatccgcggtggttttgatctacgtggcatacacgtggctgtccagtcagcattttatttttttaaaatggtgggacccacatgtcatacactctttctctcttcctccatctcccttcctctctctttgtcggtcagcagcgggcagcgccgcgcacgccggcacgctatggcggagaggcgagcgccggcggaagcgtcgacgagaggatgcgatgggcagcggcgcgcgggggcaggcctgcggtcggcgcgaacgacggcgcgcggggagatggaggggatgggggagaggcgggcgcaggcgtccatctcggagaggcgggacgtcgtggcaccgaccgacagcatcttgaggacaacatcgtgaggccgcggcggcggtggtccaggcggagcacgagcgcaagctctctgctgctggggacggcagtcgcgacggcgaggaaggggaaccaacgaacgaatgcttcttccaagagattccccgcggaagacgcctgggccgcacggaagcggagctcgctagggcggcggtcggctgatgcaaagctcgcggtggcaaggtggagacggactgagcgggcggcgacttangcgaaggccgtcgtgcgactacctcctcgcggacctcgcccgcggcggcggccggcgctacgacggcccacttatccgccatggccgccggtgcccacctctcccccatcccctccacctccccgcgcgccgccgtgcacgccaaccactggcccgccatccgaagcttcctctccgccgcgccccctccacgccgaccgccggcccaccatccgaagcttcctctccgccgcgccccctccgagccgctcccgcagccgcctggagctccctcccatccgcgccctccgccgctcgccgccgaccggttcccctccgccgctgtccgcctgctctgcctccgccgctcgctaccgactggttcccctccgccacttgccgcccggggagctctgccgccggccgcccgctctacctccgcctctgccacccgccgctcgaggagctccacctcggccgcccgccgcccgaggagctccgcctccgccgccggtcgccccctccaccttcgtctcagccggcgttagtgagatggtgaggagagggagaagagagagagagggagacattgagtagagagagagagggggtgtggggatctgacagtgggtcccactaattttttttgtagagagggaggatgaggtggaggctgacatgtgggggcagtgccacgtgtgcggccacgtaggattaaaaccgctctggattgagccgggggggtaatttgtccgggggtgtaattcggtcgacctcgatagttcaggggtgtaattcgtattttttcctttaattaattatatgcaacgcctaaatttgcataccactagtttggtttcatttacatgttcttactatgtattcgtccatgaaagactaatagttttaactagctaaaagacaattagaaaactactgtagcctttattaatgcgaagagaaaatagggagagatgatgaagtactactgcttctatggctaaaatgagacaaaataatgtagtaagtagtccagagaatttcacgctaaaatctagtctttgtggtataaatttttagattaaaacaaaagtttaatttgttagggatggaggaggtattgtatatgtgtttttatttacgcttgttcatcatgaaatgagttaaagatggtgttctccaaccttataattagaatatctccccaattaatagaaattttatagttcttaataaagtatctcgagatatctaaattttacactaaaattttttgtgataggtatcaaattttaaacaaaatatggtaccttcaaattccgttctcaatgatgctagaattactcctctcccctcccaaattaaccactacaggataacaggaattaaaatgatccacatgaacatgacttgaaactaagaggataataaggagaccccacaaatcaaacaaggtatagtattcatgaaaacgagtgttattatttttatagttcaccgaacgatggtattggtgcgtgtcatatccttgtgtagttttgtgcgtgcgtgtaacgtacttttgactagttgcgcctctccctctccctccttttaatctctttccacgactttatcatattatatatataactccatataataagttatatagtagtagtatagcaggataaacaggagaagaagataacagagaggatgggggacgcatctgctgcgttgtgatggatcggcttatccacaacaccggcccggggcccccccaccctccctaccgccgatgatggggatgtccatgtgatccatccatccatccacccccatgcacttg

SEQ ID NO: 52840 - DNA, 19746 bp, Oryza sativa
  unsure (1)..(19746): unsure at all n locations
nnnnnnnnnnnnnnnnnnnnnnnnnnnnnnnnnnnnnnnnnnnnnnnnnnnnnnnnnnnnnnnnnnnnnnnnnnattttgtcacgcgtggcgaaataacaccgctagctaatactctaacccctcgtgatgtggcgcaccgtacgtgttagcaacaactacgggtgacattgtgacgttgttttagcacgtcaggcgggataccatggtctaaaggttcagatttaaaagtaaattttaaaacagcttatttttaaaataaaaaaataaaatggttcaataataataataataataataataataataataataataataataataataataataataataataataataataataataataataataataataataataattcggatgaagtagtgagcaatcagcagctgcagtacgtcgtagctaattggtgtgatgagtgatgagtgatcactctcgtcgatcggaagctccagctccaatcattcacgttttgatgatgcaagatgagtggccgggcggtcgctgtcggggaaatttaagaaacgggagccgtcggcgaactcgatcgatcgatcgaggtgccgtgtgcgttgcagctggcggcgctgctgccaaccaagctggcaggagagcgatctctgctgcgtgggtgatcgacggcgacacgcactgccctgtcttcctccctcgccgtcgtccggtcccggcctcttcgtggtcgtcgccgtccgacacagctaagattgcttgtgacctccgacttccttctcgccggactttcatcttcgcttcacttactccctccattccatctcaagtgtaattataagtttccgtgcctaactttaatcgttcgctttaaattttttttataattagtatttttattgttatgagatgataaaacatgagtatgtctaactttaatcatccgtcttatttaatttttttgtaattattatttttattgttacgagattatgtgatagtttatatgtgacttatgtttttaattaaaaaattaaataagacgaagatcaaagtactatgttttcaaataattgattttttttctaaaatataagacacaactatttaactttagatatgttgttttatatatttgacaggaaactgaggagaaatttatccctttttttcagcagtttggatacgagtaaagattcacgggtggcgggagaaaaaaatctcacgtgcaggggctcgatcccatgtacgaccttacatccactgagctactacatgtgttgtgtggttttatgagtcttacacctaaaatatattgtaattactttctaattacactataattatattaattaaggttgtactgtagtcacattcgataaattttaattttgagatgatttttttcaaaagttatataactaatccctactactgtatctgtcttataatataagaaattttgggtggatatgacacattctaatacaatgaatcaggataaattaggatgtgttatatctacccaaaatccttatattataggacaaagggagtatttgacttttgacctacaattacactttaatgacgtggtttaagtgtttgtaaattatttgtaagaggacgaatggttaaagtgtgaaagtgaatgtctcctgtcagttatttaaaaacaaattgaaggtagtaccaatctgcctcgtcgtcttgcacgcggccaaagctcatcgtcttttcagacatttacagtcgacagctccactctccatgtcaatgatttagtccagaacccaaatcaaaactgctgataagttaatcatcatcttcttttctttttgtgcactcaaacaaagttgttctagctttgctctgaattttgggcaacaatcactcaatcagtagcagtagacctgattaaggataagatgagatcaacgacgtgagtgcttgggcaaagagagggcagctttaatttgtgatcacaagtgcgagttcgttatgaatgtctgtgtctgtgtccatgtgtggtggtggtgcattttcagagaaggggattctttatagttcgctaataacaatatatacagggatgcctgtggctgatggctactgtcaccaccaacatcttgttattgttcagactaaagtgttggttgctagctcaggtttagctagctccaaatacaagtcttcactcataataatggtgttgctggtccatgcttgatcaaccatgcaagtgtggtgttctttgagttgggtgttgtcccatcaaaatcctctgtatatatatacttccatttgattcgtttgtgcggtttaagcacagtgtttagctttgctttgcttagttgatgcccatgtctgaatcacactgagaatatgccctctttgcttaatggacatgtatatgcctgttgctggtgatgttggttaaggcaattcatttctttttttttctaaccatgattgattattctgctctaataagatgagagatgcatgtgtggtgttggcttccactgtttagtgatctcagttgctaaccacctatcacaattggccagctgttcactctagctcttggacaacaatgtcattgttgcagttacaacggtgaaggagatatcctccaattggcaagataaagatcagagatggaaccaataaccaacctgcagacaaaattaactgcaagttcttccaattcttcttcttctttttttatccaagcaaacacagattgtaccaatttcattgaatacttccaattctctatcaaccaccatcatggcagaagactgctagtcttgaaaggcagttagctagttgtagatgcaatctattgcagggagattgacagattattggagcccaagtttcgtcgaaccggagacgcaaggaataaagggcaaagacaccggtcaaccatgcatgaacgtaaccatgagcacacacgcaacttgtgcctacatgcatttttcatgccagaatatattaacactattttttatcctatttttaatgatactatagtgggaccaagatggtccaactgatttgatatattaaaaataaataaatagacagttgtatacagcattgcatctgaaattcaaacttaatatgacctattctcactttaattttgcatatagaaattgttaatacattaaaaaaatagaagatatatttcttccatcataaatccatattaattatatctctcactttaatttacagatagaaattgttagcatattaaaagatataaaaagcaataactgatacagggttgcatcagaaatttcatattatttctatctcttgcttttatttgcagatagaaatatatatgtagatggctagctaaaggatttatttcattatcttatactccctccattttataatgtaagacttcctagcattacccatattcatatagatattaatgaatctagacacatgtatatacctagattcattaacatttatatgaatatggataatactagaaagtcttacattatgaaacggaggaagtagaaaaaaagaaagctaagatgcaaggagaatgccggtccatcacgtttgccatctaggcagcacactctaccagaagcctgaatgcaaagtatgcaggcaacctacccatgcagagacaaatcaaacaccaaaaaggtggcaagagatttcaaagggagagacaaatccttcttggcacgggactgatcatggttagtggcggcagcagcatcagcagccagtgattggtactccggatggagtactaattaattagctggctaacaccaatatattgcttctttctcaatcatttttcttcggtttaagtctctctttttctctctctctctggtgctgattgcaaagccactcacacgcaccacccataatgtaatgcccacccgaaagtccccacaaaatcacatggaagtcgcctcttcccaatcacaaagcatgaacaaaaaaaggagattgttccacagctcacaaaatcagctaaccccccttattcctgcctccctccctccagtaaccaaccacctgtaccgggcgcgaaaggacgaatggtctctcgcgctcggttagttcgttcgatggtgtacaatggactgtccagatcatcttaagacggcatttgtattgtcctaagtcgaacaaatggtatactcccttggtctatcttgaccacaactccataccatatgcatacatgccttgaaactgtggttcgctatcctgatatcagataaaaatcgctcacgagcagtatcttcggattttgtagaaaccattgataaaccaaaagaaaaccgatgaaatccgaacaaatctggaaaaaaattaataatccatttttattttaattttttaacttcacacaaaaacccgagcggtttatgttttagacatggtccgaaaaaaccagatttcacgaaatcagaaccggttttctcccgggataataaacccctgctgggaacaaatatccatatcgtcgcaaaccgaccgacgtatcggacgatctcgaccgtccgataccgatcgggcggtgcatggtagaggacccggatccgggaggaacagtgcttgccgaataccgacggcacgaaaaggtaaagtgcacacatgatagtgcattacattgctactactacatgatatgcattacattacacctgtccccagatgcgccaggcagacgggcctcacgcctcctcacgggctcacgcggtcacgcctataaaacgcgccacccctgccctttccacgcatcatcacatcatccactgctctgcttctcctcttcttttcttggcttgtgctctgttttaatttctttgcaatgatggggaggcagagctcgtcggcggcgaggagggtggtggtggtggtgtgcgcggcgatggtggtggcggcggcggcggcgcagaagtacaatgcggtgtacaacttcggggactcgatcacggacaccggcaacctgtgcaccaatggcagcccgtcgcagatcaccttcacccagcctccctacggcgagacctacttcggctcccctacctgccgctgttgcgacggccgcgtcgtcgtcgacttcctcggtaactttgattctttctttgattccttcgtcttcttggtttgcttgctccggcgagctgacggcggcggctggtggttgttgcagcgagtaagttcgggctgccgttcctgccgccgtcgaagtcgacgagcgccgacttcaagaagggagcgaacatggcgatcaccggagccaccgccatggacgccaacttcttccgctccctcggcctctccgacaagatctggaacaacggccccatcagctttcaaatccagtggttccagcaaatctcctcctccgtctgcggccagagtaataatcactcactcactgttcttcccaccacacaatttcaaaatctctgacaagaattcaattcgattcgattcgattaaatttcagattgcaagagctacctggcgaactcgctgttcgtgttcggggagttcggcggcaacgactacaatgcgatgctgttcggagggtacagcgcggaccaggcgagcacgtacacgtcgcagatcgtggacaccatctccaacggcgtcgagaagctcatcgccatgggcgccgtcgacgtcgtcgtccccggcgtgctccccatcggctgcttccccatctacctcaccatctacggcacctcctccagctccgactacgacagcctcggctgcctcaagaagttcaacgacctctccaccaaccacaacaatcagctcaagaccaagatctccgcgctccaatccaagtacaagtccgcccgcatcatgtacgccgacttctactccggcgtctacgacatggtccgcaaccccggcaactacggtacgcacaccactccgcttacactgttacacaaaaataactaattctacggccctgtctagttccaaagtttttttctaaacttccaactttccatcacatcaaacatttcatacacacataatttttctatcacatcgtatcaattttaaccaaaacttctaaacttcagtgtgaactaaacacagtctacgtatatattgcccgtacgttgcaacgtgatttggattttttttaaaaaaatttgtgcacgagggagacagggggccatgtgagccgtagcaagattcctcagttttgtgccagtgaatgagcagtttgcttaagtagggtagtagtgtccgacatgggcaatccgagctcgtgattgccattttatatggggggaacagtagtcgtcttgctccaacgactagctagacacccaaattatgccagattaatggcagatacgcccggttaggtgtgtggacttatgtttgtacctacgaatccaactgcacgcacgttcctccgttccctcaccggaactcaccccatgttcccccaactaaacacacatgtgagacagtgtcaaacgactacccccgagcagtggcgttttggcagtgtgcatcctactcctttcgttctgaaatataagagattttaaacggacgtctaaattcgtagcactaaaaagagtcacatccattcaaaatcgtttatgttttatgacggatggagtagatgatacagagaccaaagatgattaaactgatgagctatatatattttttgacatgtaggatttagcacggtgttcgagacgtgctgcgggtcaggcggcggcaagttcaactacaacaacaacgcgaggtgtgggatgtcaggcgcatcagcgtgctccaacccggcgtcgcatcttagctgggacggcatccacctcaccgaggcagcttacaagcagatcactgacggctggctcaacggcccgtactgtagcccggccatcctccacagctaaggcaaaatgactggaaagaacgagccattagttaatttattactttattattaaggctggtgtttattaattaagcgggaattaattaaaggggaattgtttgggttcttgatttttatttgggtggcatatatggtgggtggtgtgacggtgaaatggtttacttgcgttgccaaaaaagcaaagaaagcgatggcatctgtagaataaatgttggttactgttgtaatttgataattgtttctcttccagaatcaaatgaatcatcaatggtattatactcagttattttttttcttttgctttttagaaagagacttttttgccatggcagcttatgtttggatcttttgcctggccaggggcatgtggtctgtgctttaggaaaagcaactgcagaaaattcactctgatggtcatcctgtctgagacggtcttgtcattattagtcagagactctgaaagtgaaagtgacagtgttttcttctcattgcaaacttttagctaactaaccactaggttgatgaacaaattggacactcctactggggaaggaaaacctgagcaaatttatccaaggatagatagatatgcagcatatgctccaagtacaataatgcaaaaggaaagcaagctactcttgcatagtgatgcactcgctctcctactgctgaatctagctagttgcatcaaatcgacttgaatacatgagatggagtaatatgcagggcatgtgggtgacgcaagtgggatggcctgaattattcgtagctgttggaattaaatccaacggcgacccatccttggaaggaggagacgaatcttcgtatttgattgcctaacacatctattgattatgatagtgatgcacatttgcaaactaggacagggcacacaagcaagtacaagcatgaagcatcaatcagagcggctgatttatacttacataaacgcagtaaacaaaaaaaagaaataaaaacatggcatgcgtaggattgaaacacagaaccaagcctaccatagaggttgaaggatgttacgtatagcgaaggttaaaaaaatatattcaaaagtacgaagcatagaaactgtgtgttaatttgtgatgcattctactactatacaacaaaactgcttcacaagggcacatgatgagcattcctggcaagaatatactaccaagttctgaagtcataagcaaatgagaatgtgacaagaatgtggaacaagagctctgtgatcccgtgtatctgacgcctgaaatcggcggtgttggctgcctggacggcgcgccccaggcaatgattgtgcctggtgaagtcagtgaatgctcgggcaatccattcgaggcgtcagtggtcaaccattctgtcatcatgttgcctggactgtagtccgtgtagggacgataatttatcggtcgtcagattcagacaccgcagatggaccacctgtacattccttccttcgatgaagctccagcatctttacctccgggtggcatagccctggatgatgatagatttgggaacatgttagcatgcgtcagctagactgaaagatcttaggcattagtgtccttgagaaaaacaatgctttgcaagtttcagaaccagcttctgcacaagcacatccctcacttttattcatcttcctaacaagagtttggttttttagtactatgcaatacttgtgcaggttaatgttaactttattgattctcagcttcacagacctatatgggctacggcctttgtgatgttgaagttgatcaaaaggaaagtgtgatgtgataatactttaagggccacgcaaatatatagataaggaaaaaagataattcaccaagcacttccacttcaaatgacatcaatataagagtcaagaaagtaaataacctgaacattttggaatatcccaaacagcaattgaagactctgtgcactcaggtgaacaaagtgcatgtgtgttctcatggttgacgttcatagcaagcatccaggatccaatagtaacatcctcattgctgaacatacggaaactggagaaacatatgtgagaatccattaaacaaacatataacgtgactcgatcgtggatgaagtttaacagtgatgcaaaatgaaaaacatgaatgcaacaacagtcttatgtacgaaacttctactgctgaagcccatgacataaccatgtagtatgtttactttaggctccagggcttctgagtttaatatatcgtgagcaattaatcaataaccacacactatttcccttcgctcttaatttgttgagccagaaaagggaaagttttgctgaaaagaaacaccacttcttttacatgagagggctaaaactaccaagaatagctcagaattgtgggaacaaggctaatatgaaagccagtaagacagcagtaacagtcaatacaacttctttacagaagtatatggatttgcagtgcagtagtgttgctcatgttagtcatacagtgagcggtggcctcaccatcactggccatcaaagcagggaaaccatagacccaaaccaacattgaatactatttcataggctaactggtttgagaaggcaagttgaagaatgctgcttcacaataagataggatgagtactgttaattacctgttgttcctcaaggcaaccaagcttgccaccacatcggctgataaagcgtaaataggcccatatgcatgaaggaagtattctgatccgagcaaaaaggattgtggctcatacctgcatttggaaaaagagcagaaacaatatgataagcagtcattgatgaatggtacatggaatatttttgctgtgtggaacaatagaaagtctgaagtccaaacagcatgtggtatactcagcatatatgccctcacaccatttgccacagcaacatgccttggttatagaattctgtctatactaccctaaaagctaagctaacaactgtcttaaaactataatagcaaagaggaaactgaaaatcacgttggagggaatagactcacaaactgaacactttgtgcttgcaccaacttgtaggatcacaagagtgcttgcacagctaagctagcaatattttaagcacagattcaaaaatgacagctgcactggtgaattggagggtggagcgtgtgacaaaatacaaaactgatgaaggatatatatgattttctttgatcctcgaataatactgataagatgttgaacctgacaaaagtcgttaggattcaggaatcctttatacttacatagttcatccccactaagtgtagttaatgctatttctctcctctcattaagccacatcaccccaattatttctagcctttggatgatagatctataatccaaattgtctcttctttcttctctcttaaaaacatgcaatctcaattatttttaggctcaaaattgtatcaaattgttttagttttgataatcaaattacatcttatttgtacatattatgcaacttaattttccgcagcaacgcgacggagtattcatctagtttgggatacatgcgcattaacatctgaaaaacaatcaagtaaacacgttccttgctaatcctttccttcgccttccaaccctacagatcaagtgcttgctttacacaccatatctagtgtggtctgtgcttaactttatgagaaaccatccggatattgaggtaccagcagttctggttttgtacaatataacatactccctccgtttcacaatgtaagtcattctagcatattccgcattcatattgatgttaatgaatatagacatctatatctatctagattcattaacatcaatatgaatataggaaatgctagaatgacttacattgtgaaacggaggaagtaaacacgtaattacgaatctgaaactgagttattttcagttcatatttatacagtgatgaaatattttttgacaccataaaattattaacttttttgtggaggtgtgagggtcgcatctggacgaaaaaatttctttattatctaatttacatttgcttagcatgagccacgatgctgtatgcatttcttcatagagttaaactttctcaataaaaaaaacaatatggcataaaaggggttcattatgtcatacaagactaaataacagaactgaccatttcagctttgggtcagtaaaaacaggccccttcttcatgcatccaatgtatgtttgtgtatgtgaacgctccttagccaaaagcaatgaaagtctatctgcagaatagatatcagtaatgaaagtgccagccattaaaaaaaatatgatatccaagtcaaaatctgtaagaggatatgtagggcattggtatgcacctggtctcaagtagatatcatcatcagctttaacatagaagtcagagtcatacaatgcatacgcagccttaaagtaagctaacctacaacataagaataaatcagcatctttctgaagaaataacaaaagcatatgataatagttctgctatttacgttttgtacggaagcttgctatactcctcctccagatctaaaagcacgaaatcatcgtattcttgaacctctctttctaaagctgccatcttagacttgtcattactttttccaatcacaaatctgaatgccagaccagttgcttcctccaatctgtaatacagtgaacacaaaaatacaactattgtaatggcagttagccaaaatcaccattaacggaaactgaaatacagaaacagagatggtgatgatcatctctttattaagaatggttggacttttggacaacaaaagtccacttaggctgaaaccgaagcaaaacagttaatggctgctcatctactaggcagcatggagctggtttcagctggcaggccgctttagtcaaagtttattgaacctacgaattaaatatattccggaacctccatgtgcattttcatgtacattgtagacttatagttggatctcacgacataagtactagagaaaaaaaaaactaacaaatccacatgatcaatcccttcttcaagaatagcagcataattcttcctcgaaaacaatgagaacagatggaatgaattaagagcaggtacaatagcaggctataagctagctgtaaacatattttaaagagataaaggaagagagagaagagcagcgggctacagatttgtagccagctacagcacggactccaggacataatgtgtgtatggtaggtgggacattgatagtatagtaagcaactattgtatgaattggctattagattggctatagatgaattagagctagcaatgggccataccaataagcagatctcactaaagcaaatacaaccttatagtgatgagtgatctctatctcatgtttatttgacaacgaaccgtaaaattacatctaagatcatagaaatgaacaaattagattacctacgtactaaaatctaatcagtaactatttccgctccactcccgtaattaggtaaccagcaacatcaacagttgaacacctaaaactaaagccagatctcgagcaacacaagcagacacgaactagcaaactgtgataccagcgactaaccgaaggagaccctgccgatccgcggggagccacgtccgccgcagcgcgcgtcgccgcccgacggagccgaacccggtgaagatcccgacgaaggccatcaccttgtgcctcccgcgcgacccggtggcgtgcgacgccgggagatccacggcggcgcccgccgccgccacggccccggcggacgcatccccgggccggcggtcccacgcgacggagacggagagcgggcgggaggagtccgggcagcgggcgcgcggcgcgctccccggcgaccaggagaaggagagcgcggcggctaggaagcccgcgagggccgaaaaggaggcaggcggcggaaaaggccggggtggaaaggatgcggcggagcgtggcgcggcgggaggtggtcgccgaggagaagaccttctgcgagctcggcatggcttcggcgaacttgccgccgcgccgccgcgtgggttgacggcgaggcgcgccggatcgaacccgggggagacgaggagggggaaggggtggtggtggacgctgggtgcggccgcgtttgctgcttctcctcctttttgttttgagttggtagagagagagagaggggctgtgttgagcccaactggtagcccactaagattcagcccaagatgatttcaccggcaaattttggagggctgtaattcgaaatgggcctagaatttcgttcgaattttatttgaaactggaattgtacgtgatccttctgttgcgtattataaaacgttttcgttttgttctcaatcaagtttaatcaatgtagcaacaagttcaaaaaaaaatgtagcaactcttgtagtacaaaacagatatatctctactattataaaaattaaagttgtttttgcggtattttggtacgtcgttcgtatttgagctgattttaaattcgttcgcttttgaaaatacaaattcgtattttagtcggattttaagttcgtttccttttgaaaatacaaaagaagtcatataagaaatcccttttaaaaaacttgcatgctaacttgagatgaatgttgaactcctaattgcagctcatgattttctagaaaaaaaatatctaagcgaattcccacagtggatttcaccctagccaaaccgtataacaataataaaaaaattataatagcattcacccgttacaacacacgggcatcttttcaagttataaatatatatattattcggtcgtagatttaatgaaagtaatctggtgttctatatgttaatatatttttttttgaaaatctttggtttaataacttgaataaatttggcttgggataggaacgaagggagtatataattattttttctagttgcacacatacaactattatcttctttttttccgtttacatcaaatgcgtactcaagtgcttctcctaatacacgttcagggaaccggagatgaacaacaaatcccaacaaactgaattttattcaaatccacagcgattacaatggtaaaaccaagttacaacacaataattactgtattcgagccagagaaaattgtccgacaaatcaattgcagcacggttacatctctgctagctcttctgccgccgtcagctaagttagcttaactgcggcgcttggtcttgcggtggtggtggtggtggtcgtcgtcttcgtcgtcgccggcggcggcggcggctttggcgagctcgcactggtcgatccactcgctgtagacgtcgatgggctcggtgagcgcgtgggcggtggtggagtagcgcgcctggcagacgaaacaggaggcctcggcgatcatgtgcttgatgtcgatgctgcactccaccgcgccgccggggtcgcagaacgggcagctgaacgccgtctccagcttcggcgccgccttcttcgccgtcgccagcatcttcgacacccgagacttcctcttccccatctccgactccgacgccgacgatgcccttgctttcttgcttctgctcccggcggcgaatcgatcggcgaatgccaaacgattgatcgagaaagaagaatgcatttgggtttttccccccnaaaaaaagggggggccccgcgggggcgccgcgcgtgcttatatcgggagctcttcccagttcgcgtcggactcggactcggactcggactccttcacgaacacggcccgcattaagcaaattaagtgtccaattagtacggactaattaaaatcatttcttccatatcgattttgcaaatttgcagttcgttctgcggctacacttgacttggatcaagagatgatgattaattgattgattattaattaagcctagtgttttcttggtttggttcatgcatccatccatggcggcggcaggtggtgcagttgatcgatggttctagtggtgcaggatgggagggtggcagtagggtcccctgagccagccgccggcgacgagccggttcgccgcctccgtcgtgtggacgccgtcccagcacacgtgcctcgacgggtcacggcacgccgccgcgcccttcatcccgcaccgcgcctcgaactcgtagttgtactccccgccgccggcgccgcagcacgccgtcatcccgctcctgaaccctgcgccgccgccgccgccgccattgccacccccatcacatcagatcacaaccaccaactcaaaccaaacatgcctctccaagatcgattaatcggtaccgaagcgcgccggcgtgtgcagcatctgggcgaccatggtgtagtagtcggcgtacatgatcctcaccggcgccggcgccgccgccgccgccgacctgtacctggcctggagtccggcgagcctcgcctgcagcagcgcgttgtggtggatggccagatcgttgagcggccggaggcatccgtgctcgtcgtagtccgactcgttgctgctccggagcatggtcaggtagagcgggaagcaccccaccggcatcacccccggcaccacgatctccgccgcgcccatcgcaatcagcttctgcaaacgattgcaatcgcgcgcgaaagatcagatcgaccaagaaagtgaacaacattttctggatgattcattggttggttggttgattgcctcgacgccggtgatgatggtgtcgacgatcttgggcgtgtaattcctggcctgatcgacggtgaagccgaagaacagcatggcgttgtagtcgttgccgccgagcgagccgaacaggaagagtgacttggacaagtaggctctgcaacctgatgaacacttagagtaattagctcgtgagcgattgattagctgaagaaaaaatgggagtaattcgatcgatttgaattttgattcagatttagaatttgatttttaccctgtggttgtgtggcgcagatggaggggagaagatggtggaaccactggagctggacgttcatggcgccgttgttccagatcgggtagccgaggccgatggacttgaggaagtcgaagtcgagggcggtggcgccgacgatggccatgttggcgcctcgccggaagtcgccgccgccggcgctccgcttcgacggcggcagcagcggcaaccccagctcctgcgctgcattggcaatgcaggcgaatcttggcatcaatcagcaatggcggcggtggcgacggcggcggatgcgtgtgcttaccgaggaagtcgacgacgaggcggccgtcggagcagcggcaggtggggtggccgaagtaggtcatcccgtacggcggctgcgcgaacgtcagcagcagcgtcgccgccgccgacttgttcacgcagatgttccccgtgtccgccagcgagtccccgaacacgaacatggcgttgtacttgcacctcatcccaccatcgccgccgccgccgccgacgccaccggccaacgccggctgcacggcgcaccagcagaggcagcaaaccaccagcacgctgccgacgacgtcgacggcggcggcggcaagcgcgcctcctcgccgcgccatcactcgcaacgccacagctcagtgacgacgcgagacagtggcatacttacattatatacacttggtcttggttggtttaatgagcagtgacgtcacctcgccgccattgttgctgtgcttttgtacacacgtacacgtctgatatctcgtcgtcatcgttgggctaaggctaagctgcgcaacgtttgcatgttgcaaccgatagaccgggctgggccggcacgacaaggcccatgggccttactgggctatctcggccggaaagtgttctgccgtaaagtaagttcactttgactcccttaactagaggcttaatctaattcgtatccctaaaccacaataccgggatatctcgactccctaattactaaaagagaaagactacacaacggtataccgttgaatggtataccgcttatcccccatgacgcggccccgcgtgccggcttctcccgagtatgtcgcgtgctgctaggattatcatcacgcatgtttgctatgtgtatcagtgtatagtcttgttcctgacagctagctaatacccagcatgcctgtcctgcctttgatactagcctagctattaaataaaaccgaaagtactactagcttgctgtgcatgtcaaatccctgtaatagctactagtagtcccgtaccctagccatgtagggtacttattatggcagagcctagtagcctagctatgtgtttaagatgggttgcatctatttgcatgtgtcctataccatgcatggattagaccagacaaataattacctaaattatatatggatacaatgtattctaattagatatgtcatgttgggctcttggttataccacatcttagaaactctagtatgtgatatatagatgctagattatcatatctgatatccaagtactgggtcgaatacctaggtaccaagtatgaaacctataaatacaagatctgatgccgagttatcgggtctgatacctataagtaccggatccgataactaggtatcgcgtctgatacctatgagtaccagatcggatactcgggaatcgggtatctgatctgatacctatgagtatttgttctaatacctatgcgtaacgggtcgaatacccaggtaccgagtatgatacttatgaataccaagtctgatacctaagtatcgggtttgatacctatgagtaccggattcgatacctaggtcaggtttgatacctatgagtaccagatccggtatctcgtatgatacctatgagtatcggatcggatacctgggtatcgggtatctgatctgatacctatgagtatcaattctgatacctgtacgtactaggtcggatacctaggtaccgagtatgatacctatgaataccaagtctaatacctaagtattgggtttgatacctataagtaccggattcgatacctaggtcgggtttgatacctatgagtaccggatccaatacctatataccaggttaatacatattagtagcggatctgataccaaatatagggtgtgatggtaggagacttcagacgtgataccactaattctgatatttatgggttatatacttctattcaaccatcaaataaaaagatggaccatgcatagctaggccagaaagtacagccaaacttgctcatgtgccgctgagtgcttaattctaacttgctgacatgctttgtttaggctcatgctactagctctagtgcttaattctaactttgctagttgaagcaggtgtgagacccatatggacctaaagaggtgtagaagtagtgttgtattagagtatttcatagctattttgtactgtaggagaaaagagacctctcgtcagtcgtcactagtcagcagcctccatgtgaaaggacagcacacgacatgctttcagagagaaagaatcgatgagtgattggtaagtataaattataaactataccgttgagacggtacaccatcccatagtttttctcttattaaaaccggtacaatttaactcggtggttttcaagagcggtttcgttgatgtggcgtctacatgacggtattaatctggcatgtggcattgactttatgccatgtcaatgccacagaccaggtcaacagtgccacgtggacgtcacgttaatgaaagcatcctccaaaattatcgagggagttaaattacaccgatattaatagttatgagtcgagatatctagtattgtggtttaagcactggtttaagagtttaagagagtcaaagtaaacttattccttctgccgttgttgtcacgtacagccgtacaggagagaggaaattcggatggttattggtggctcatctgggtacacactacacagtattcaatggcgattcagagtactacacggcattgcatcattcaatcatatgcaacctggtagatcgatcagggagaaggcaccgcatttggaatctatatctttactcttcataaagaaactgattttaagccaaactttactctttagcatgtaacagtagtagtaagtacaggcttaaagatgcttaattttgttcttgcagaagagtttgttagccttggacagtaaggtggagaagccaaaataaaaaaaaaaaacagacagaaccaaaagggatcctgcattattttggtttggtatctaaaactggggtgcatgcatcatattcagacttaaagtttggccaaacttctttaataaagaaactgttttttttttccctgtaaataaactccaaagcaacatgcacagtcactcactctgtgtagcatagtttctgtaccagaaaaggaggtgaagcattcattcactagttccatacaagcatgtggtcatgcgatccaggattcctaacttgtattaaagtttttttctttctttttttgagatggcagcaaaccaagttgatgagcttagataagatcttgctcgcatttatgatttcatccggatccagcatgtgcgtatgtgaccatctccaaccaaaccatgcaacaaattactaagatttaattaattaattgcaacacataattaaattgcctcccaatctcatacatactacacaaatgtgcattacctaaaacaaaaacaaattaaccacccacaacgaaaatcaactaatcaccatcttattcatttcccagtcgatcgcaagatgtcttcttcttcctcttgctatccatttttcttctcttcttctgctaaacaaatcaaatcagcagcag

SEQ ID NO: 52841 - DNA, 1090 bp, Oryza sativa
tacccggacacgaacatgggggacgcaaccgcgaacgccacaacaacacgcgccgccattgttgcataggtttagattcagctcgagctcgatgaccaacttgatggatggatgaggcaatgcaagatgctgcagggactccgtgagcttatatacacctcgctaatggtaggttagcacgtagctgttcgccattagcccacctcgagcttaaacttaactactagtctactactgctagtctgctacgaccaccttcaacttactcacctggttgttgtgcatgaattgcatgcatggatgaacagcttttgatttcttttctcgttcatctctctttccctcctgtttcctactctcgtgtttgatcatatcagtatcgaatctttgcctttcttttggtttctacacacttttgatgcaacatcttaatttgtttttgatgtatgtgctttaatttcctttttgcataagatgttttctgagttctgacaatttgctgcctgatcaattgctaacagtttgattagtccctgtgtaatttagtagtactgctttagtggacgcggcaatgtggcttatattttcgtcgtcttttcattatatgcgtaataaaaactgaatgattgaatgtgtgtacaatacatctgagttggaccagcatcgctggtgctactctaggacagtatgtttcataattgaaagtttgaaaagaggcacctaatcatgtattccactgacttattttaacacttggaatagccttttggattgattatttggcaagtacaaatatactaatgcctgcagaacaattttcattttttgtcgaacttggaagtgagtgattagtaaattaagtaggagtactaatgcaacctgaggctgtcgactctgatgaagtatccatgcattctggatgtcactacatgtctacatgatgtctgcttttgcttctcagtagagaaattcatgccattactgtttgagaactgaaaaagatttaatttgggatctgaagaaacacttctccttatttactactaccagcattagtgttcctggacattgaaatgtgtacctgcaggag

SEQ ID NO: 52842 - DNA, 4239 bp, Oryza sativa
  unsure (1)..(4239): unsure at all n locations
cnnnnnnnnnnnnnnnnnnnnnnnnnnnnnnnnnnnnnnnnnnnnnnnnnnnnnnnnnnnnnnnnnnnttctggatgtcactacatgtctacatgatgtctgcttttgcttctcagtagagaaattcatgccattactgtttgagaactgaaaaagatttaatttgggatctgaagaaacacttctccttatttactactaccagcattagtcttcctgaacattgaattgtgtacttgcaggagtggttgctattcataactgtcaatctgtcatgcatggtgttattgacttgcctgtaactgctgaaaaagctttttagtatttatcaagaactttgttaggtaatccaactctatcatccaaaacagcaccctcgctctcatctacatgctgcatgattccacaaacgcattatgattgtcagatagtcattattcatatcagtagccaaaaagttatttgcctgtgatgaaacagaaagctagtctagctaagatagttgcttcatttcagcatcatccagctaaacagcactgatcatcacctcccttgatcctttgtgtcaattagacgtcaccctacctttcttcctcctcttttccaggattgggaaactgctagcaggtcaagcagcattgtcagcaacagcatgagtctgcatctactatcccaaaattatgcgcatgatttatatagttaaaaagaaataaaaaaatatagttatatatgtataccaactctataaagatataggggatgctttaactttatagggaagaatttgaagtggtggttatatttgtagtacttgaatctccattgatgcctacacttcaacataaaaaagtagggcacaacaactccaattagttcagtattgggcaaggcagtgacatgcactggctattatttggggataggttggatgccttgtcaattctttgagctaacttggcactggatgagtggatgggccatgcagtcagttattagccaaagtgtgagaaaactatgtttcttttttcttaaaaaaagtgtaactgattaactgaagcatcagttagtcagactgtttgatctaatatcaaccatcatctgctgtcagtttgtcacagttttgtcactcataatgtgtcaacctcagagaatggattaagctgtgacatatgttgtttgttcagagttcaggctaatccagagagagaaataatatgccattgtgttaccatcattcagatcaacatcttgcaacaatatatcatgcatttgctgatttgctttgcatggatggatgcagataactccatcatgcatgtgacatgagcaaagctcaacaactactaattaatttacaagattatccacatgagacctctgtctacaagaccaatgtcaaagcacatcttttgacaacttcgattccttattcctctagctgtcacacattcccaggaggaaagctcaattagcatctaatcagtggatcactgtatttgtttaatctgtcagctgtaattatctgcctgctaactcagtactactccttctggtttcctaataccaaatcattaacttttaaatacacgtttaatcaacattctcatttaaaaatcttatacaaatatataaaaaatatatgtcacatttaaaatacgtttaattataaaaacaaatcacaacaaataaatggtaattacatattttttaataaaacaaatttttggataataaaaataaattacatcgtcggtttttattataagacatacaaacattaagtttttttaacaaataaccaatcttaaagttaatatcatcgtatattaaaaaacaaaaaatatcatcgacgaatcggatgagagaagctggcgagtgtggtgtagtactagggtactcgcagaaacgtctcgtttcgctaacggacaagcgctccagtaccacgaactgctgcagcgactcgcagcgtggacttgatgcagagcaatttgtgcaaaatggccgtcgttttctgcggcatctgatactgtgttttgcaagcgaaccttccaatgtaactaactcactctctctctctcctgctaacaactcaatttcccttttctaacgccctggtttagggtcgagttgaagcaaccaaagagctttggtactctgcctgcaatttgtggttgatgctgaaaatgagatgtctgaaactctgaatattcaggtataaatatgtttgctagctgcaatttgttcgattaagagaatttaattttaccgatctcgtgaagtagtgtttctactaccaatagatactactgtaaaacggtatacctttttggtggtttctagttgcatcgatctaatatgttttgttttccttaaaacctttagctgatgagctttcctctgtccttccatgaatcattgcttaatccaccgggtgacatgttcacatcatgagctggagaattgaattccaatggatgatgcatggatgcaaccgacgatccatcgatcgagacggtactaaatggagaatattagtgcaatacgtggttagctgcaacgacgtgcatgcataatgcattgcatcctgggagggtacagctttgtgtacattgatcataagataatccaaatgtaatccaagtgtccaatagcctcacagtttcgatcgaaattgacaggttgaaaaatagcaagagcaactcatcactcgcatgatgaacgtgtagtgctatcgatcaacagtcggcacaaattggggcggttaatgtgtcaagttcagagatgaatctggcagcaacatgttacctacctggaagcgacgtccgttgattaattaattggtttatttagctttaaggttgatcctatcttacaggacaaaaatggacggttaaccgtttgagaaaatctataaaaagcaatcgattataccagaggttcagtttatggatgcatctgagaaaatctggacggttaacagttcattttccgatcagacggcataagttcttctgcctcagatggtcgaatcagaccagaggtataaaacaaatacactagaaaacaatgttattttcgaatagctctaataatctgaaaagaactcaaatctgatgggtgcaatcaaaccctgaagaatcgaaccggacattcacgaagaagaaaaatcaatgcgagatcgcccgagaccgatcattctggtgaaagtacattgcatttacatcacatggatggatggatggatatccatcctgcagagagcctgaaacctgtagctgaaggaggtcgatctacagactacagctgaggctgcaggaccatggttagctgggtgtccggcacacagtggtttcatcacttagaaagttcacagggatgcctgaattgctgactcgataggcatcataacagctgagattaattgtagccatcatcatcatcatcatgccaggacaacccaactaactgttttacatatgtgttcttttaactctttttctttcagcatgttcagatcagtacttcagaccattgtcaacgggagaaacagggaactaatctacatcaacattgtttacacatgtgattgaatgctttgcagagagcagatgctagttgctatctcatttttagaatgtaagctggttcggttttgttataagtcaaactttttaatttaaatttaattaagtctatagaacagacgtaataatattttaacactatatttaataggaaaaattgtaaccataccattataattttgtaaaatttgagatatgacatcctgacccacatgtcattgactcatgtgggttctacatgccattgagataccgatgccatatcttaaactttgaaaaattataatggtatggttccaaattacctatttaataagtgtctgaaggaaacgatggacttaataaaactatttaagtcatgtagatgtcattacatttttcgataaattcagtatgaaaaaaacagaatatcatcttaccttctaaaccggagagaacagtagcagcaaaaacaagatgggccaagctaatgaagtaaagttatacaacgaccaaaggaaaaggattaaaaaaaagacaataattgcttactcctacatggatcatggatgcatgtaggtgactgcatttctgttggaggtttgctgctgctgattgatgacgaagtttgattcaacttcttctccttcttcattcgggagtcaacatatatatc

SEQ ID NO: 52843 - DNA, 3274 bp, Oryza sativa
aataagtgtctgaaggaaacgatggacttaataaaactatttaagtcatgtagatgtcattacatttttcgataaattcagtatgaaaaaaacagaatatcatcttaccttctaaaccggagagaacagtagcagcaaaaacaagatgggccaagctaatgaagtaaagttatacaacgaccaaaggaaaaggattaaaaaaaagacaataattgcttactcctacatggatcatggatgcatgtaggtgactgcatttctgttggaggtttgctgctgctgattgatgacgaagtttgattcaacttcttctccttcttcattcggcagtcaacatatatatcagtcatcagtgcagacggtcggtggatgcaggtagctgtgctgacagtgtgtatagtatgtaggtgagttggatgttttcagggtcactgcaggtggtgctcgttaaggcttaaatcaataattatcgatcgcgtacacgtaaccatcagcttttgcatggcttaacatgcatgatgcattattacgggtataaatgtgtaatcagtacatgtaattagtcaacacggctagtatttagatctttgtttagatcatggaccatctatgattcagctagctaacctttggtgctctggagcagtgtgcgttgctttcagtaaaggtaggcaggatgttgattagtgaaatgtatgtatctgtctatatatactacgcatataaaatactgcatgagtttgtcggatttgtcattgtagtgcgtacgtttgattaatttgatgttaaaatcaaccatatcagattataatgccgtaatttagaagtatgcaggttatttagttgtacgcttgatttgaagaaaaacgtcgaacggagttttatcatttagtaaaaaataatttattacttactaaaaatatttcaaacagatgcaacattaaaaatactaattgcaacactaaagtaaccactgcatgcaacatcgaagaaaaccgacactacttaaaaacaaagtgtttttcctgacggctactttgcgttctctatgacggccggcgctaccgctagcaactaaaggccaatgaaaatgaaccatctttacaggcggaacttcaccacagttaggttacgctgattgttagggaaaatgatttttgatcacaaaataaaaaatcacaaatccgatgcctggccgccaggaaaatatgattttcgagcgaaaaagttccgcaaatccattgttgtgcccggctccgccgctggatgcgccggttgcaccccgagtcatcgctggatccaccaccccaagccgccggatccacagtccgagccccaagctgctgcctgttcgccatatgtgggataggggagggggtggaaaagccacgccgaagcccagacatcgcgttgtcaagcaccgctaccgccatattcgtcccctccaccgagcaccgctgctggagagaggtgaggtaggctggtgtgactggatctcagagagagagaggggggtgaggaagacattggatttagagagggttggagaagaggccgcagcagcggcggtgggtttggtggtggcgggggaaagggaggagcgagggagaggagggttggtggtggccgctgcaacgacagtggtaggacgtggtggaggagagggagctgggtcagggcggtgacggatctgccgccgaacagggtcaccgctggttgtggatgctgccacccatggggaaggaggaggagacaggcgcgctcaagctcatagtggtgccgatgaggaagaagaaaaggtaacggaggagggaggatgaagtaaaggagaggggacttaagtatcggaaattttttttaaaaaaaaaatcaatatagctatttaaaacaactgttttataatttattttacataataaaaaaatagtttagcagtttgaaaaatatatactcaaggaaaacgaagaatgaagtattgacggtaccaaccgccacaaccaagataggggtcaaatggttgcacgcccagctcagccaacccattccaaaagcagaatcgtcttgttaggcccagaccgctccactgtcgacgtaggcctcgtcggccgtttgctgttgtactcggcacaggtccaggttcacatcaacaatcgggtatacgcatctgtactggtgccattgtgtttggcaatttttttgtctaatcgtatctcgcgttccagtattaattatcagccatccgtcctcgtgtcgcaaaaacatgatagacatgcagtttaaagtgtacgattatgtttacagcttatttgaaaaaaaaatgattatgtttacactacagtgacgtccaggataatggtcaaaggcagcatttgtccagatcagcccagcccattccatggtatcttacctcaattacaaaataagttcattttaactaatctcacatatacaaatacaaaatctcaaaaactagaatattcatattttatcaaatcccaatataatttctctctgtccaaaaatatataagattttggtcggatgtgtcccaatctaagctagactcttctgttcagactcgtagtataggatgtgtcacatccgactaattttttttattccccttaaaaaaatcttttgtattctaggatgggtggaattttgctcactttatctactcccaataaatcattccctactttcataaattcctatgcaatagttactccgaaaatacactagtgtataactttgagataagcgaaggaagctactccaagtcataagtacaaatgaacttagtatagaacgaatgatacatactgaaataaagaaccgcaccaagcgatgaatttttttaatttttaattttatttattaaaatatttacagaaataatttttgatttgaaaattttacaaaactagtcgtccatcgccctctgggagagcgattttactaacgtggcagaaagccgatggccctcctgtaacggttggccaccgagggatgggaaatttatagcggcccccttatagccctctggaagggcgactttttactgtgcagggtctgcctgcatagtagaaaatcgtcccacccaaagagctaaagggggccacctgcaaaatgtcacctcctcccgtacagtacaaaatagccctcctagagggcagtaagggagctgcctgcaaaaatgccaggcagccctcttagctcttttgcaagcggccctctagagcaaaaatcgccctctgggagggcgacaaggggg

SEQ ID NO: 52844 - DNA, 12368 bp, Oryza sativa
  unsure (1)..(12368): unsure at all n locations
gatccccccgagccactgcacctgtacccgacgcgcgacgcggcacaatgcccgcctcacctgcacgtacgccatgcctcccacccctccgccgctccgcgcgcccatgtgtccaagattccggaaccgacgacgtacgtcgacgtacgtgagccccccccccccccgccatggattcgctgcctatatatacgcacgcgatcgagctgatcgatcagtgtagcgatctacgagatgaggccgtcgatcgtgctgttcggggactcgatcacggaggaggcgttcggggagggagggtggggcgcgcacctggccaaccactactcgcgctccgccgacgtcgtgctgcgcgggtacagcggctacaacacgcggtgggcggccatggtcgccgcgcgcgccgtcgtcgccggcgcggcgggggcggcagcgccatcagccgccggcaccgtctggttcggagccaacgacgccttccttcccgggcgcgccagggcgctccatgacgtgccgctcccggagtacatggacaacactcgcgccatgtgagccctgctcggcgacagctggcccttcgtcgtcgtcattctcaataacccggccgccgttcacgaaggcggccgtgtccggtatacacaatcgctctcatcttgcatcaatttatttggttttctcgatcgtcgaacacaatgcaagaatggatcaccaatggcgcgccgccgcgcgcgtgcaggtaccagtacgtcggcgattgcgccggcttgccggagaggacgaacaagtcggccggcgcgtacgcgcgcgcctgcgtcgaggtgacggcggagtgcggactgagggtcatcgacatctggtccaagatgcagcgattccccggctgggagagctcattcttgaggtaatcaaatcaaagcaaatcaagcaaacacctcatcaccttgttcttgtgatgagctgctgagagcaagtttagtactgtagctaactactagcctcaaatcacgttaacaactaatttatataataattatctataaacatatactacattattaatatatgatcccacctatcatatatacattatgttttggagtccgtgtttcaaatagctacaaatctgtagtttgccttttattttctcttctattttctcttctcaatatgtgtttataattggtttatagtttactgttatacccgctctgatgaaatttggcgcgaaatttgaagggacgggctgcacctgacgccgcgcgggaacagggtggtgttcgaggaggtggtgttcgcgctcaaggacgccagccttggcctcgaagcgctccctgccgacctgccgctcttctgcgacatggatccaaacaaccccgtcaagtccttcgacgaatgactcatcatcgcaaaaaattcgcattactgatttgagaaagagaatttgaattccttttcgttgcgttttttttaatttacggtgctatttgctggagaaatgtttgaggttataaatgtctcggttattattgttttgattctttagaaagattggatgaataatacatgtatcgaccgtattgtcatgtaatgttttctttggacaatgaaattcaatacacgatcgagctgagctttttttaagataagagctcctgcttacgggccattacaacaagttcagaaacaatgatagcaacacacggctaatggtgaaggtacattgtttaatttggtggacttgcttgtaaaccgttgcaacttttgtcattctgaccatttcatggatacaaggattgttaggagaaatgaacagcccataatatgtttttttttaaataagggaggccagaggacttcgccgggcaaaaacaaaccaaataaaaaaatattggtacacgctgtgaattggattaacgtccaaaatagcctaatcaaatcgtttctcaattcatacttactccctctatctcaaaatatgttaaccaagaatgtgactagtgtcagacgtaacgtagaggcggagaggtctttaagcctccactgtttgaaccatggaagcactccaaaaaatatatatatattgccacacctccattgaaaggcggggcttggaccttggagctctattttagtttcgagataattttgttcttgtctccactttgatgtctaatattgattttgcccttgttttttagggttttcgtttttacccctacttttttgaaacgaaacaactatttgccccagttccattaattcttactaatggtgttaaatgtagggttaaaaagacaattatacccttagatattttccggtacttttgacaatcaaaacacaaattgataccatactatagcagtaatttaatttgtcaaaattttgtgaaagtttgccaaaattccttatctcaaaatagggcaattgtgcaagtggtgtacagaagtatcagaatcgctctctctctctctctctctctctctctctctctcctgtcctacccaattcccaatcttgctctcaagccgtagcactcagcatcgcagcggccgggacaacggcgacgaggcagcgcaacgcaacggcggaggaggcgatgaggcgtagatcccccccaggtggaggtggtgaacgattgaccgtcgacgatagaccggcgatgcgccgaggcgcggccgagcggagccacaaggcagcagagacgacatcagggccactgtctagtgtcgaaggctccaagtccaagggggaaattaatttcaagacttcaaggtacataaaatttgaaatcaatatcaagtccagttgtgtggtaatagttaaagttcagtgctcagttaaaatttgaaatcaatttcaagtccagttgtgtggtacggagtaatagttaaagttcagtgctcagttaaaatttgaaatcaattttatgcttgatttaatgctttctgttgctactttgctgctcacatctcaccaactgagtcctataacaaacctcactcatcaaatccaatgatccagaatcatctaatccaacgctttagatcgtcccacgttacccctccccctccgcacgcacccctcctctctcagatcaatttcaatcgcgccgccctcctctctcggtcactctcctccccctcaaccgccgccgcatccgccaccgctgcctccacgtccccgatccacgctgcgccgtcttctacgccggtcgagatctccgccgtcgtcgccacgcacagccacctgagctgccccctccgaaatcgccataccctgcacctgagtcaccgaggtccgcgccgccaaaactccgtcgcgccaaccctccatccgctatccccgtcgccatcggccacctcctctacggctgtccctaccacgaagactgcctcctcctcgcttgcatcgtacatttgaaggtttccgcctcctgattctatccccgatcccccaaatctctaaccccaactctttgcagttcaacggagaaggccggtgtcttcttggtccttccgttctgatctccattcctttactccaattcccattctctgattttttttctttgttatttgcgtgtgagggtgggcccaccagtgattcaagggtattcagacgtatacccaagatttttgaaaaaaaataagtatatatactccatacctcgtatatgtattaaaaaattaaagagaaggctaaaacttctcattttgggtcctgttttaccatttcttctctattggatctaaatttcccacttccttccctcccctttcctctcagcccacactcagcttgggccgcaactagttcatttcccctccccgcttaggcacagcaaacccaaatcgggcaaaccactgaggacgtgcgcggtgcggcggcggcgtctgggcggcggcgactgcaccggctgcggcggcggctgccggctgcgtcggcggcaggcggcaccgaggcgagtaggtagcgcgtcgggtaggggtgggcagaaaaagaccgaaccgaaaagaccgagaccgagaaattcggtcattaattcggtcctaggtagtgaaagaccgaattttgttcggtcaattcggttagtctcctcggttaaccgaatggaccgaaaagaccgaattatcaaaaaaaacgtctaaatgcaacatacaatccactatgtttaataggattaaactctaattttcacatccctacttcttctaggcatgcaacctaacaagagtctttactcataagtgcttacaaattttttttttgatttttgtgttgaaaattttcattatttctttgcatatatgaaaatgttcttgaatttcggtcaagactgagaccgagacggaatttgtcggtcctaacattttttttcgctgaaattcggtttttacttttcaaagaccgaagacggagactggaattttcggttagaccgaatgaccacccctagcgtcgggcgtgcggcggtgactgcagtccagtctgcagcgtgctcgtcggcggcttcggcgtgcgtgacggcgtcggcggcaggaggcgccgaggcgtgcaggcggcgcgtcggcgcgtcgccggcgtgcaggccgccagtccgctaggccaccacacaggtacgcgatgcggcggccgaacgaccacggctcgccggcctggcatggattgcgtgaggggcttgattcattgcattgatttgttctaggtagttcaatagtagttatgttttctggcggtgacggcttgattcattgatttgttctttagtagttcaatagttcactagcactgaaggattcaacttccttagttcctgtcttctttatttttcagtgtcaactgttaagtgtatatttattgacagattgatagtataaagctgtaaatattaggaatttagataacttagaaccataatatttaattttcggagtgtaaaatttatatatatgatgatagtatgaggctatatatgagctgctgttaggaatttagagaatttagagggggtgttttcttcgatggactatataaaaacaagaagcaagatgagcaacaatctacattcattggaagagaattctttttacaaggtaaaggatgaggacatcatcactcatttttaaaataccaagcatcgaaaagttctcctctaaactgtaagagttttttttatcattttaccattctccatcctttacatgttttatatgttgccactttcatatgtcgaataattagtacttatatatgttaaagaatttggacttatgatcaattctaccaatttataaagttatggccaattttgtgttctatatgctataatattatacaattagtaatgtgtgatattataccaattaattattggacttctggaggtaaaaagaattttgttttacccctacctattttgaatacccaacctctaaatcttaggcccaccccttagatatatgataagttcatttttgatgttcttattaaattctcaaaagtcttagcattgatctgaactctgatgaacatgttttctatatttggctttgttcaaaagattgctacctttcagaaggcatcttgttatcaggtagtgattcacctaagcatgttgctcatggtagctaagcatgttaccatcataattgtaattcagtacgctcaactgattctatgataaataatgaatccatttcagaaatatataataataatatatatctttgcttggatatttggttttcaagatatttcaacatttgtattgccaacatatatatccttttcttttaattgtttgatttacacgcattacgatattgtgtcgttgcattagcacgtgcatgttactagtattattctagtttaagaaacacaaataatgagattgcaagtcagccaaagaggctagagcagaagttagtcatttggatataattagtgacccagggattcgaaaaccaattgaagattatccacgtgagcatcgcattatctattggagaattgttttgtagggacaaaattgcttgcctatttttaattttatgtatgtgtaaatgtgtagccaatttatacatgaaacatgttaatttttttctagattcacccttgttttcagccgccatggacgcggcggaaggtggaggtggcggccgaggctggggtgacgccgtggttgcgctgccgtcgacatccgcagcagcaatggagggctgagagagggcgctcaccccgatgatagcgtacaaaggggaggaagaccttcgacttccagagcggccagggtttggttcaactggaagggaagtggttgtcaccaccaaccacttccatgttggcgtcgagaacgccacaatctatcagtataatgtaagtttcttcctcacagtcgcataatattctactcatctttagttcattttagaagcattcgcttatttcatactactactaaataaatcttgattttatattgaacattcaaagattcgttttttaataatactagttgggtgcccatgcgttgcaacgggcaaaaaaaaaaactatacattaattttaaattacaccaattgaaatgatgggaaataatcattgagaaattttaatatagcacaaacaagaaatatgccataattttatagtcttcatatattagtaacacaaagagcaaaaatggttgaataaaacgctcgtaaggaagcacaaccatgtatgtaaatatttcaaatcatagttgtggttcaaattttattgtattggccgtaatcgtgaaactaaatagacaaaaccatccatagatatcacaaataatttttttttccaaagtcttcttaatagattgtgattttagtaccgacgaagttgactacaaatcttagtacattccacaatgtgataaattaatttttgagcatttttttccactgacttcatgattaggtttctatgaaccccgagccaaaatcaagagctaaaaaaggagaggtactttcagagatggtagagttgcatgaggagatgacttatgactgcaaagtgcttgcctaattgatccaggctgcttatgggcctctgccttctgtcccaatgcccatgacactacaccctccttttgagcagctcatcctcaagctgcaacacgatctttgttggctgagacaactccctaaacaaggcctaacatgactcaagccatgcagccgctgcacattgcttcaatccatccgcctctgaaaatcgtgccgatgcatgacgaaacaaagccatctcacctggaaatcgcgcccaaggttgtgtcagccgttgcgccgcaatcaccgcagtcgttggtgctagaggttgtgagccctaagaaacggccctgctcgtggcatcaccctgcatcgcggtcgccgacgacgacgtcgttgccaagtccaacgtcgaggttgagggcttcctggacctggccgttggtgacacgaatccacctgcctggacaacttgaagtgacgtggacacggtagtggttgctgatgccgtgtgacgatgaccttcgtcagatttgttgtgtctcctgcttcttccagaggtcagccgccatcttcgcccgaggcgatggtgccacagccggccttgtcatcattatactcagcaccatcttctgctgcactgccacctcttgctccatcgcgaaggctgccagcgggaacggctgagttgaaggtgcagtggtcagagatgttaacatcgtgtccacaacctgagtagaacttgttgccggtgccatgaagtcactagtcaagccatcgccaaacgacgtcattgctgtcctccttgccgaagaagaatgttgtccatctttgcctccaagacatccagcatctctaacttcttaaggatggccgtcagcttgtcatcgatcgacataaccacaggcgtaggagattctaggggtggggaggggggaggggtggggggaggttcttgtcaggttttgaaaattcgaggggagagatgtctggttttgagtttagaggtgttatttgtactcacctaatagttcgggtaattcgtacttttctcataatttaataatgtacatcttttgtgataaaaatgctactatatactctctccgtttctaaatatttgacgccgttaatttttttaaatatgtctgaccattcatcttattcaaagaaaacaaagaaaacaccacattaatatacatattgcggagagatacactattatcgtctgttacaaacttggtcattcttgtccttttaggccttcattactaaatacagagatgatcaaaccatttgtgtataatacgaagcatagctaatcttcttcctttttgaaaggggaagcatagctaatctgattgttcaaataatggcgaccacttggcagtggccgaaatctcaagaccgtccatacaactagaacagcctccacttgcagtagaactcccctcgttctgtggtacaaacgacatactcccaaacaacacatcctcagtgacatgctcaaggagatcattaacaccaccaccatgactaaagctcttatcatttgaagggctgttatacgtgaagaagcgaagcaacagaattccatcaccgtccacgcataatgtgaccgggggcaacttgccaacgctcaacttgccgtcaaatatcatgaattgtccccactgtacgcagtaacctgcaacaactgtaagtgaatcaaaacagttctctccgagatcgagtacctcaagctccaatgtgcccagtactgccttatcaagggcaaccatctccagagcaacagtgccacaatgaccagtgtcgatgtgccaacggtatctatgaagttctgaatagaacgatggggcatacatagaatgcccgtctatcaacactttatcgtctttcctttcttgacccttaatgacaaggtagtattcgatcaacataggcccaactgcatatatgcctctaggtggccaaattagaggccgtatcttattagagccctgtgcagtaatttgtgaaagaaacatcaaagttattagacatacgtgcatcaaatgttacaagaataaaatgaagtattaattctagtgcctaatcatctggtacataaaacacttgtcccagagataatatattggtgttttaaccactaatccctccatttatgaatataactgttggtgtctattactattttgactctgaccgcaaattactcttaaatgattagagtttgatgaatgagagcttcacgtttgtatatatttaagatgccatacactacgaaaatatggtgtacttttttttttctttttgcgacaagtggacaaagttaaaaaatgaataattcccaatgtcagttatttcaaaaaggagatagatttatgtcaaagtttaaagagcacaactacagaaaaggaggggacccttttaagacaaaaggtataaacaaaacaaacttagtcatgaaatctctcaccggccgaagcttatatggtttgtccctcgagtattgaaagacatgattacgttgttggttgtttcgtacatctctaaatgcaaatataccgtagatctccattggttcatcatggggggacgatacattcaaatcatacacctggattgcacgccgacaaggttcattcctgtggttgtatccatttacccaacgatttttccactttggcagctggggcactgcaacaggatttcaataaactagtattacagacacaaacaccgtgagtcattaacttgtatcctgcattctaaacattatacaaaatctgtaatcaatatttgtaaactatacttccacatgttatatgtaaagatatagttcaaacgtaaaaattaagttgttcactagaaataataataactaaatggacaaaggccatgtttggtgagattgagagatcctgggtagctaggtaagaatatggataaacaggggctgcctagcttttggtagctactactaagtcttagaatctccagcaagcatctggattatttgagagaactggatatgaagctctcctaaataggatctaaaaattgaaggaaaaaaaactatatatgatcatttgtgatttatacaataccttgcttatataagattaataaatactccaattatttactagaagatgtagcatgttaagacttacatagatgctccgtcgacaggatatctggatccaaatgacatggcccttcaacatgtagagacccctcaaaaataggacaaaagaaatcattttgtcgttgctttgcaattgatactgtgaacttcatttgctccataacctgattctcccatctctcctccctctcagcagcgtagtaaggatttccatcctcgtagcggaattcataccagtatccgtcgaaagaatcgcattcatctggatcaaccgagaattcactttcggactggtaattatcttctcgagggcaggcccagcctggaagtgtcccttgccattcagattcttcattcagaatagagtccatgtccttgccccagagccaagtgttgagcacctcacgctccaattcctccctcatcatccccaaatcccggtccaaatcgtcagcctctttctcctcctcctcctgctgcgaattcccgtcaattttactaaaacctactcccgacattgattcttggggggatttcagccacaaatcaacaagaatcgcgaagcgggacgggaccaaaaataatttgaatgcctaacctttcctccgtagcttgttggccccggctgctctacggattgggattgcgattggaaagaagcatagcagcatcgagtgtgtgtatgtacagtacaggagcaaatcgcttccaacacggactctgactctgagatgcattgcgaggcggctagggttttccttcctttcacggacgggaaagcagaggcttttagtgggcccagcccagcccagcccagcccaagcccgtacaagctgagctctttctcattgggctacatctcagaaaggcctgtttctgagactcggctcggctcggagccgacgtgcctccaccaccactcgtcgcacgagcttggcgaaggtggagggagtggctcgtgggcttcctccgcggccgacacggcttggcgggtgggcgggcagagccgcgtcgggtagcctcctggtggggcggagccacccccagctgcaacggccccagcctcacaaaggtgacatagggtgaatctcagccctagaaagtaaatccaatggctaagattcgtccacataatcacgagttaaaattttactcccaatacctgaaaatttactcctagtaaaatttttactcctaaataaatctgcgagtaaaattttaactcatgatgacgtggatggatctcagcagttggatttgttttggagggccgagattcacgctatgtcacattgtgacatgcctaccttatgtcacccaatcccaatccgagggagagagagcagtggaactgaggaagagataaggtggagactaaggataacatgtggggcccactttcattttttgctacatcagtgtctagtcagcacgagtggatcgggtcaaattgttacgtcaacaaaatcagatgtatatactgctataggatccaaattggatggttttgtatagtttaggggtgaagatttctggtattgaggataatggatgtcaaacaaactcagtgtaaagttgagtgacggcaggtgaacttatacctttacttgggcatcgggttgcaggaacggaagaggaggaggaccaacaacgcttcctcctcaagctcatgccttccacaaggaccatcatcagcgtcatcggtcggtgttcgcgtccgagctacatagcggcaggcaggaggcggaggctgacacccatgacgacgggttcgctggaccaccacaaatttctaaggctctctgatcaagagcccgaggagtaggttctatgtgagttttatttttttatgtcacgccatccaaaactatactcaacactgagacctaatgtgatatgattttataaggttatggatgtgttatatccgatattttgatttatgggtgattttgaaattcgacgacatggaacataaaagtgaacattttctttatcccatgtaaatagttaatatgggcagattgtcgtgaaggccgcctacattaactgggtgccaatgcaaacatcgtaaaaatggcacaacacgtgtggtcaaataatttactcgggcagtacttctctatgtctgctcaggtaataannnnnnnnnnnnnnnnnnnnnnnnnnnnnnnnnnnnnnnnnnnnnnnnnnnnnnn

SEQ ID NO: 52845 - DNA, 10395 bp, Oryza sativa
  unsure (1)..(10395): unsure at all n locations
nnnnnnnnnnnnnnnnnnnnnnnnnnnnnnnnnnnnnnttttgtatagtttaggggtgaagatttctggtattgaggataatggatgtcaaacaaactcagtgtaaagttgagtgacggcaggtgaacttatacctttacttgggcatcgggttgcaggaacggaagaggaggaggaccaacaacgcttcctcctcaagctcatgccttccacaaggaccatcatcagcgtcatcggtcggtgttcgcgtccgagctacatagcggcaggcaggaggcggaggctgacacccatgacgacgggttcgctggaccaccacaaatttctaaggctctctgatcaagagcccgaggagtaggttctatgtgagttttatttttttatgtcacgccatccaaaactatactcaacactgagacctaatgtgatatgattttataaggttatggatgtgttatatccgatattttgatttatgggtgattttgaaattcgacgacatggaacataaaagtgaacattttctttatcccatgtaaatagttaatatgggcagattgtcgtgaaggccgcctacattaactgggtgccaatgcaaacatcgtaaaaatggcacaacacgtgtggtcaaataatttactcgggcagtacttctctatgtctgctcaggtaataaagtatttttcctttataaaataatctccataaacttaaaaatcttgtagaaatttgaatttagatccgattgacacggtgagcacttctacgtgatccttgcggtattccctagctttaaaacggcatgctaacaacttgtcatggctacctcttttttcatttggttcttcacgggcaccggaatttccgtatgccattagctgcagttggagcaaaaaacacccatgcaaatagcacatggccttagacgccatccaacgtctagagatggtgcaaaagcaaaggcaacttacctccaccgagctgagcctaagaaccgccctaaaacacaggctgctagggctggcagtaatcgaaagagcaaggaaaagacatgcctcaagaatcaccaacatcaaagaagagggcaccaataccaggttttttcacttaaaggttaacgcgaggagatgaaagaaccacatccattgttttcacacaaggcggatgggcggtgacgcacgaggaaaaagagcgaaatgatatttgatcacttctaggggataattggaagacctagtccaagacaacggagttgaattgggaagcccaagagattcagccctcgatggaccttgctgtccaatctgaaccattcactgaagaggggatttggaaagccataaatgcaatgcagtagacaaagctcctggacccgacggcttcacggtcaatttcttcaaaacctgctggggcatagtaaagcttcactccatccatgatcagagatgcaatgatctaaaccttctcaactcggctaatactgttctattaccaaaaaaggaaggcgtggagagtagcaccgacaataggccaataagcctcatacacagcattgtgaaaattctcttcaaggtgctagccctgcgacttcacctggtcatgcaatccctaatctcggtcaaccaaagcgctttcaaccgtggcaggagcatccacgataacttccattatgtacagaacatggtgagaagatgccatcgcaacaagagcccaactctattcttcaagctagacatttccaaggcattcgactctgtgtgttaggcttatctgttggctcttctacaacagtggggcttcccgcagaaatggagggattgggtcgcagccctcctctcaacctcttgctccaagatactcctcaatggggtcccaggaagtaaaacatgtcatgggtgtggactacggcaaggagacccattatccccgcttttctttattctagcaatcagcccactacatgccttctgcccgaagccacatacctcaatttgctcagcaagcttagggctagggtcggtcaccatgcctctgaatctcaatgtacaccaacgacgcaacggtcttcatcaacccaaagaaggacgatgtagatgcattcgctggcctctgtgaatgcttcggacaagcaacagggctatgcaccaacatacaaaaatctcaggtgaagccaattaggtgtgccagcatagacctcgacgacttgttggaaagcacgccgacgaccagagcaagcttcccaatgaaatacctagggctctccctagccatgacaaggctacacaaggcagacctccagccactttttgacaaatccgcaagacacctagtaggctagcgaggaagaaacatagggatagggggggaggggaataacactagtcaagtcaatcctcacgtcagcaacctgtctactctggacaactctaaaagttacgaaggaatcccttgaggtgcttgacaaacagaggaaacggttcctttgtgcaggggccgataacatcacaggcgaaaaatgcagggccaactgggcaagaacttgtatgccaacagcttatgaagggctaggggtgttcaacctagaaaagtttgcacgagcgctgagggtaagatggctatggcatgagtggaaggccccaaatcaaggagaaagccaaaacttgggtctcagcaggagcaaaacaccttgcgcttttaattccttaggctttgccattttttacagttctttatttcttgtaaatgtaacatttactcctgtgctggttcgttaaaaaaaggtatttaaggataattcggttataatataaccacggtcatctttgcaaactttattactaccacaaccataccgatagtccacatcgtaggctcgcagctcgatgagaactgaacttggctcaattacaacttatacaatagctcaccacaccatacagctcgatcgattagcttagatggtgtttgggtgggaggggctaaacaaaagcataagtctctagaggagagacttatgtttttgtgagagggactaaaataagtccctcccctcccaaacaccaccttaattagctgcgcacaacaacacagtgaattaattagtagttactaattgattgattccacgtagggagttggacagcctcatgcaaaattcccacaggatcaatcaatggtgctgaggatcgggccccccggggctcgacctcttcgactcggagtacggcatcgccgccgccaccgccgtctgcgagctgatcgtagtggcagtgttgctcccggcgacgacgagcattctccgcccggtgatcacggccagctggagctgcacatgatcatgatcaggctcgccgcgcgagacggcggcggacatgacgacgagcagcagcatcagcacgacggcggcgcgcaccagcggcgacctcaatgtgctggatgaggagtaggccatggaaaaagctagaggtcttcttcttcgtctaatctcctagcttagcttagcttgagagtgagctagctgtgttctcaggcgcaggttgcaatggcatgcatggtgctgaatttatagctaagctaagctgatcgagattcgaggggcagtttccggccgttaccgtgagcactatcgagctagcgacaggtgtagagagtgatgggtggtggtgatataccggaagtggatttttgtccctagaggagacattccctcgttttgtgcataatgtttaaatagttattaaaaaaatttaaaaaaattgtcaagatatagattaatatatgatatatcttttcgcaaacatgtaagttaaaattcgacttatacgattcgaaacaaaaataataaatttgactgtgaattacgctttctattcatagtcaaattttttgtttttgtttctgcttgtataagttgaatttgaatatgcatgtttgtgaaattttttcaattttttttatgactctttaagtgacaagtaaaaacgaggggatatccccttaaggatgaatagagttttccgtgatatacctctgtggcgcactgatctctgccattcatgtcgacgatgcatgcatatgacctcacacacaaaaacggctcaacttttcatttttaattctgccttaacaaggcagtgcaaaactgtgatccaatacaaaatccaatgctatgcatgctgagatatgatcgattaatgccattatcatttctgttgcatagtgatcacaataacttaagacatggatgcatgcatggtcccttcttgatatatagtaagatttttagggggaaattttatgagcatgttgcacgttttagtgggcactggcggttgtttagttttgtttggacaaaaaaggaaaaaaaaaacacaccaggccgttagccaaagcaactgccatttatcgttatgaaatggccactatatatatctatatatgttcattaattcataagctagccaagtcagctcacacgaatcagcaagcaccgtgatcttcagccggatctcatttgcttctggttgccacaagcatcgatcatcaacttttaaatacatactccctccgtctctaaatatttaacgccgttgactttttcaaacatatttaaccgttcatcttattcaaaaacttttgtaaaagatgtaaaactatatgtatacataaaagtatatttaacaataaatcaaatgatatgaaaagaattaataattacttaaattttttgaataagacgaacggttaaacatgtttgaaaaagtcaacggagtcaaatatttaaggacggagggggtaatggagtatattgatatatatacttgatctttattactctcttcatgcccatttgtcaacgtataaattatacaagttcctccacgtacaaatccactttcaaggagtacctgcagtacacaaaaaaggccttgttaaaagccaaataaaggcataactaaccaacctatgtggccatatataggtgaacatgcatgtaggtgatagatcagagagtacaatatgcagtacacacacattcagttacctagttggcctcttcttccttaatttttccctttaaattttcagagacccatatatgcatctccgtgtcattttccactggtcacaaacggaagcaatgggcgtacgcgaggccgccattaatcgcgtgtgtgttctagctatatttcttcttttgctcaaccaccgggctgctccaatggcggccggcccaggaggaccccatggctctgtggccacgaacttcacctgccattggaggctttaagctcgtcgacgacgacgaccctgagggcgacgagcagccacggtttgctgcatgcggcgcaaggaagaatgatgaatgcacacaatgggaaagtactctgttttctatttatctctcaaggggacatcctttttgttttttccatgccgcctaagaagtcagaaaaaaaattctgaattttgttggcaaggtatatcgatatgtttatatcacactataaatatgcaagtttaaattcaaaagtagaaaaaaagttataaatcattattcgtagttaaatttattgtctctgtttctacctgtgtaagtcagatttaaatttgcatgtttatatagtaatataatgcatacttgatacttccttcgtttcaaaatgtaactatttctaactacgaatttgaacatggctccatccaaatagctatatgttgggatgggagggagtattcatctattataattctataggaggacgacatgcgcaaatggaggacgtctcctggagggggaaaaaccatccacataattctttggtcccaactcacaatgggagatgatagtaagaatgtgtagtacaccgagctagttacatgcatgcatccgggagacatgatggtataaagaaacccggcagccaaatgtgtttaatttcacactgaaactcagcagccaaatgtgtttaattccacaccgatataagattgggccagtagcatgtgtcggcaaacattttaattgcatttacaaactcgcagcttgagctgtataataatcccaggagggaatgtgcctaacaactaatgacagtatttatcacccccagctcacaaaagttgccaaaatgatcctgtgagtcatctgaaggccgtcaggttttatttctgacttctgagtcggaaccgattctgtacttctgtatgcgtaatgctgcactatctatccaactttgtaaattacagccactttctgatggatgttgttaccatgttatcaatagcaacccagggaagtggaaactggaaaaagaattgacattcatacagctaggaacagcaggagggtaagatagtgagtgctactctgggaggaaaggcagcctgctgacaccgttctgtttatagtccatgtcatctgaattgtctgaatctgtgagctcagttgcagcttcttgcttgacagacttgccgccttcttccacgcctacgaattgcggaagaattctgaggcatgcgtttggctcctggcctatagattcccacttgagcttgaaactttcgactagatccacctgggaagcgatgatgcttggtggtctgggcagtagctgcacgctttcaccttttgggatcactacttgctcgattgccaatctagcttcctggcaacaggagatgattgtttatgttattcatgaaggtgttgatcagaataggtcaaaactgctatagcaatggcaggagagataatgtaaaggaaaatggtaatcatacctccaaagcatcagtttcctccgaagatctcacttcagtatcttcaaaatccatcaacccatccgtgtgatcatcaacaagggcacgaagtgcccttctgatttgcaccagggagtttgtctatacaaatagttagccaatatcaacattctgtcacatcaacaattaacagtgccatgaaaattaacaatgctctatacaaaccttggtgaaaaaaacaggtatatcttgagacttcacaacagcctgaatctgggtattcttcttgagcttcgattgcaatgcaatcactgcatcagcttcactgatgttataagtcaaggttacaatgtcctccagctccagctgtttaatggcttgcaaggcagtcgactccgagatctagaatagcctatccaataagttacaaactaagtataggaaacttaataaagagttgacagtgcgtgaaattcagcagtcatccgatgataagagatatccaaccaaacaaaggaaggaagttgcaaacttggaggcttcacaacgtaagccatgaaacaacttctcttccctcaccactccaacaataacagcccacagctacacttactaaacaagaactaacagggttttgtttaggtgtacaaggcttaattaatgccttggaggtttggtagctcaccattacttcaatgtgccatacctaaaagctgtaaatatattaagccatacagcacagttcataccaaataatgcaaaataaagcacaagtccaggcaaaaccttgagcaaacaaatgaaaagctgaagtacgagagagggggtgggtgtggggggtattgaagaaatgcataccccataagcatatagattgaggtctggttcagcttcagttgatctccctatatgcccttcagcaggatcaagattaaatgccgagtctaagcttcttcttgcattgctcaaagaatcagtgtccaattgagttgcaccttcagaaggaccaagatccaaccgttccttttgcacataaacttcctgtactggcccctttgaaccaactttacgaatttcaacattaggcattttgcctgcaccaaccaaatcggactaaatcatgctgatattggagttacacgttttatataagatattgtagcatcatatctaacatgataatgcagcttactaatgccataataaatgagaacctgcaagcagagcatctacagtatcttccaaactacgatggacgcgcaattcaattttggagacaatctccgcagcacatgtaaaagtcgatggacccttgcgctctaggacagttttctggacccctcttcgattagcttcttcatcaccaagggtgacgctctttcataaaaagaaagcatattgtaagagatctccatgacagaaatggcaggtacagaaattcagaaagcacatgaaagaacattagatgcttctgtgtattcccaatgaaagctgaatagatgctataacagttagtttctgaattgcccttaaccattgctttaaatatgcatagtcttcgattaaaaagcatagaagcaaccttcaacaagcaaaacatagtaactaaaaatttacaagcctacttggaacagtcacgatgaaccattaaccaatggtggaagggaagcaggactgcaacttgatttaatactcgtatacaattacatagtttgcagtaagatttcgctggctcttccattctgtataagttaaataactgtttttggaaacacacccttgttaacatcaacaagcaagctggagtatactgatgatcaatatcacaatctttccatgtgtgatactatctcactttatctctcatatgggataatttgaacgcacagataaactacatggtagagactacagacaggaacataatagcacactacctcagaattgattcagtattgcaaagatacttaggaaaataaagagcatgtttctaggtgactaagatttggcgatcagcatgttcaatttgacatattaatacataactattctagctacattgcatagaataaaatgcagcatatcattacctgcacacctcctacaagcatatctagtgatggattcatgatcagattctctattgttattccatgggcagtggcaacaagttgtatcccccgttgtgcaatggtgctagcagccatagcctctagcttcgttccaatttcatcgatgactattgcctggggcatgtggttttccacagcttctatcaatacctgattgagattgagagaaaaaaaaaacaaataagcacaaatagacattggtgtgttaaaaagagcttcaattatcaattcacatgtaattggtttggcatatatacgatcacggaccttatgctgcatatcttggttaggcacttgtaacctgcgggcattgcctattcctgggtgaggaatatctccatctccacctatctcattggatgtgtcaacaatcatcaccctcttcctataatcatcagctagcattcgagcgatttctctgcaagtcaaggcaagcaacttgttgctacactaacactgatacatttctcgatcacaattaacaaatgcacaactctcccgatttacatcggaatcaaaatcaatactcgtcagtccaaacctaccttatgacagtcgtcttccccacacccggtggaccgatgagcagcaatgacccaccatccttcaccaaatcctgcagcaaattagcacttccaggcacggcacgcccaacccggcaagtgaggcctatgatggcgcccttccggttgcgaatcgcgctgatccggtgcagcgtccggctaattccagctcgattgtccgctccgaaatccccaacctagcacaatgcgaatcaccaattcaccataagcaaatgctgctaaattcaccatgagactaagtctagcgatcgggatcaacctgggaggtggcgtggcggaggtcgtcgaaggagatggggctctgcgagaggaggaagtcgccggaggggaagcgggcgagcggcgggcggccgaggtccatgaccacctccaccagcgccgggagctccgggtgcccctccacccgccgcctcagctccccggggagcaactccagcagcctccgcatctcctcctcgggcccctccccacctccccgcgccgcgcgcggtggggcccccaaccggcggcgccgaccgacggagaggagggggcaaacggctatccggcggggagcagcggagcggaatccatagggcgcgcggcgggggaagtggagcgggaggggtgggacgggggagaccccgaggtgcatcgccggccacggccgcggcggcggcggcggcgagcactcgagtggagggaaagagcgcgagagcccagcgtttcggctttcctatcgcttaggttgacacgtggcggatttagatccgatcgatctatccacctgggggagatctaacggtcaggatcaaactatagttttgttctaattttcacaaaactatagctttgcccttgggtgattgggtccaaaatgctttcgccggcggagaagtcaggcggtgggtgacaaggcgaggcagtcacatagcaaagga

SEQ ID NO: 52846 - DNA, 1729 bp, Oryza sativa
  unsure (1)..(1729): unsure at all n locations
gatcaaactatagttttgttctgttcgtcctcaacgtggagtagtggcgcttgtgcttccacgtcgccaccaaccatggcgatggccacctacctcgcaccatgacgtcatccaacctcctcctcctccgcttaaacgcgtagcctccattgctctcctcctcctccccaccatggagtcgtcgccgccgccgccgccgcagatgcgtgtgcgcgtcatggagaccgtgcacctgcgtccgcctccggcggatgacgcggcgtcgttcgcgctgtccgggctggacacggaccgcaacgtgctcgacgtgacgttccgcacgctgcgcttcttcccgccgccgtcgctcgagctcgacccgctcgccgtcctcccgcgcgcgttcgccgccgccctgggcatgttcgtcccgctcgccgggaggattggggacggagggcgcgtcgtctggtcggccgccgacgccgtgccccttgttctcgccgcggcggacgacgtgtcggtggccgacgtcgacaccgacagcccgggctccgatttgctggagcggctcgtgccgggggacggcgacggcgacggcgtggcggggtcaccggcgctcgcgctccaggttacgcggttcgcctgcggcggcgtcgcgctggggatgcgggtggcgcacgcgctctgcgacggcgccggcgccaccaagttcctctccgccgcggcgcggttcgcgcgcggggcgcaggagccggcggcggtggcgccggtgtgggagcgggaggaccgtctcggcccgaggcgtccgccgcgcgtggtgaagccgttcgaacgcgtcctctcgctcgacgacgccgccgccgcggtgcacggaccgtacggcgcggccggcgacgcacaaggacagatcgcgagggagtgcttccacgtgagcgacgcgcgcgtggaggagctcagggcgcagctcgccggcgaggccggcatcaagctcacaacgttcgagttcctcgccgcgttcatctggcgcgccaggttacactgatcccgtcgaacacctgggacaacaaggtgattttatctcctctcgtttaactccgccatggaatcggtgatcgagcaggacgaaagccagaaggacgagccccgacgaggtcgtgaagatggtgtactccatgaacatcagcaagctcctcacgccgcctctcccggacggctactggggcaacgtgtgcgtcccagtgtacgtcgccctcaccgccggcgagctcgtcgcccagccgctcgcggacacagccgccatggtcaagaagagcaagcaggaggtggacgacgagtacgtccgatcctacatcgacttccacgagctccaccgcggcggcggcgtcacggcggggcgcggcgtgagcgcgttcaccgactggcgccgcctcggccactcggaggtggacttcgggtggggctcgccggcggccgtgctgccgctctcgtggaggctgctcgggagcacggagccgtgcttcttcgtgccgtacggcgcagccgacgagaggcggcggcgcgggttcaaggtgttcgtcgcggtgccggcgatggcgacgcactgcttcagagaggagatgcaggagctatcgttgcaacgccattgcctgcgttcgaaagagaagctgtaaatttcacacgaaaacagtccgttcaaattnnnnnnnnnnnnnnnnnnnnnnnnnnnnnnnnnnnnnnnnnnnnnnnn

SEQ ID NO: 52847 - DNA, 2580 bp, Oryza sativa
  unsure (1)..(2580): unsure at all n locations
ggcgaattcgagctcggtaccccgtgaagatggtgtactccatgaacatcagcaagctcctcacgccgcctctcccggacggctactggggcaacgtgtgcgtcccagtgtacgtcgccctcaccgccggcgagctcgtcgcccagccgctcgcggacacagccgccatggtcaagaagagcaagcaggaggtggacgacgagtacgtccgatcctacatcgacttccacgagctccaccgcggcggcggcgtcacggcggggcgcggcgtgagcgcgttcaccgactggcgccgcctcggccactcggaggtggacttcgggtggggctcgccggcggccgtgctgccgctctcgtggaggctgctcgggagcacggagccgtgcttcttcgtgccgtacggcgcagccgacgagaggcggcggcgcgggttcaaggtgttcgtcgcggtgccggcgatggcgacgcactgcttcagagaggagatgcaggagctatcgttgcaacgccattgcctgcgttcgaaagagaagctgtaaatttcacacgaaaacagtccgttcaaattcaaaatggatagtactcattcaaataaagatcttcatacacatttccgaaccgcaatgggagtgaatcctgtttggatgggccaaaaaataaaatggtcgatcaagaaatttgaaatttccaactccgaatccgataagaaatcaaacacccctgtgtactgttggcgcatatataccggcacggctcttctcgatcacctcaacccagttgagagatcacctcgagatcatcgagcgagcctgatcgattcgagatcaagatcatgacgcgcggtggcagaggaggttagttattgccttcaatttcagtttcgctacatgttcctcaccttcccttgatctcttgacagtatcatgatcttggggactaatttggtttttttctcttttttttctgttcgatagaggatgacaatgaggtggattcatgggtgaagaaagaatctgaatgggaggaagcaggagatggagaggaagacgattattcagacgaaaccgaatatgatgatgatgatgatgaatcttcagatgaagacaacgattacttctcaatggaaaatcgggatgtccgcttcgcttcggaggagaagtgggagagccaaatcatggaacagatgaaattctctgtctccactgctgatccatttgatatcaggacgatttggaaggggtctctgcacgtcgacgggccgtgccaatctctcgatccaaacctcttatctatgaacaatttcagtaagttcatcgtttcacataccaatctttttcaagaaaagaaaaaaatatttaactttatatgttcttgaactttaccatatttactggttatttctgctgcagtgcctcagttaccactgagaatgaagaagaagaataatgaggagccttgccgtcgagccatccaggtgtttggtctgactgtatcttctcctgacaatgttgttcaggagatctatggtatgtttgcattcagagatatacgaaacagccaagaacgcaatttcatctttgaatacccaagagacagaccatttacacttaagccggtgagcactttatcaactcttctttttttatgcaatcgttttaattagtttattccttaagcattcaagtttttatctcacaggtgtaactctatatcatacatatatatgcagggttctgataaggtgcaacccctgattcagcctcctcgcggcatttacgcaatagggccagtggtaatggagtatcacctaatgatcaaaggtcaagaagaacaagaagatagagtattggtagatggttactccatctactgtccatctttctacaaagaacgttcaaggttccactggcacattgacactggccactgtggtgccattgatctgaagatggctgctgtaccaaacgccgtgctggccacagtggagatcgaggtgattcgtctcggaggaactcactacgattcgcttgccattgttgtcgcattatcgataatcaagggtatgtatttggttttcgatggcaaggttagcgtaggcaagctactgcctttcacggtgtgcatcaacagagagatgcatctgaagctgttcgtgtacggctactccagtagtcagattggacatggcgattgctctccagatggtgttgttagtgattacgacaatgatgggttcttctccgcaagcgaggatgtttattacgacgttttgaatttcataccacagtttggaacctataagaaaatgtcacacaatcttgaagatatggacgtgtctgtgacggtaacctggtctagcttgtattagtacagataaagtgaggattatattttatgttcttgtcataaacaattactgtaaatatgtggaagaacaatgtcagggaagaatggcggagtcgttaacactcatctttttatttgatatatggacctgcagccgcggctgcaaagacatgaagggatggcagcatacttatgtnnnnnnnnnnnnnnnnnnnnnnnnnnnnnnnnnnnnnn

SEQ ID NO: 52848 - DNA, 7580 bp, Oryza sativa
gtctcgaaggaactcactacgattcgcttgccatggtggtcgcattatcgataatcaagggtatgtatttggttttcgatggcaaggttagcgtaggcaagctactgcctttcacggtgtgcatcaacagagagatgcatctgaagctgttcgtgtacggctactccagtagtcagattggacatggcgattgctctccagatggtgttgttagtgattacgacaatgatgggttcttctccgcaagcgaggatgtttattacgacgttttgaatttcataccacagtttggaacctataagaaaatgtcacacaatcttgaagatatggacgtgtctgtgacggtaacctggtctagcttgtattagtacagataaagtgaggattatattttatgttcttgtcataaacaattactgtaaatatgtggaagaacaatgtcagggaagaatggcggagtcgttaacactcatctttttatttgatatatggacctgcagccgcggctgcaaagacatgaagggatggcagcatacttatgtttataactgaatagattaatagatccaaagaaaagtttaatcaaaataataataataataataagccaacatggccaatatgaggctaactacccaggtaaagctcacctaattttaccattcgttgtgaagtcattaacaaaagaaggaacttttaactgttgttccaacaaaacccttcccttcaattcaaacatataggcaggcacatcacaagtcatattacaacagcacaacaatgaatcctagtcctaatcaaagccactctcatcagatgtgtgcaacctctcaaccaaatacattctacattggtcacttgtttgttccatgtcactgtaaaaaacaaaaagaagagagaaacaaagagtggggagaaaaaacaaaagtgaacttcacaagatgtatcatacaatgagcggtaaccatttcgcggcgaattttacacactgagcgaaggaacctctagttgttgtggcttcttctgttggccccctttcatgtccttgggctttgcctttggaggaccagctgcctttgccttatgcacccttgctaccggtttcttttgatcagtaggagatggtgttccggttttcttatgatcaggaggagacagtgctaccggtttcttctgatcaggagaagatgctgctaccggtttcttctgatcagggggagatggtgatgacttcttcttaggggcttttcgatcattgatgttgttgcttagactgattgagccttgcagcttcagagctgatgggtttgtgctggcattttccttctttgcctgtcctttcttcaggttttcggggtggaccagtgatcggggctcccatggccgtgccgctatccatcggtccatccagctccaaccccagccacccttgccaacttcatagttgaagtttccaagacttgtggcagaccttgctctccactgaaaatgtgcagaatgaatatgccgattactatgttgagtttatacatagagaaatgagcatagtgctagtctgaattaactagtaagtagcatggaaagaaactattcctaaggggaaaagacatgatgaaaattagcttaggagtctctgtcatatataagatcaaaatcatagatataatgtgctgcaatacgtaggattcttttaaaggaatgaacaatgaatgaagttgtaacacctgaatcaattgttagtacctgatgattgaatgcatatgccatagctcgttcacgctttactgcggcttcttccctttgttggatcctcccaagtatttcctccatagtatccgagcctccattccactcgacctgttaaaacatgccgatgccaaaaggaaatgcaatgtcaaagaacattagtattcttttactagtaaatttaatattattaatacaaaatatagttgatttgtttaatcagttaaaggattaagggtaggttatgaccaaaaaaatcccaacaataattaggtaggcagaaaaatttacaaggaatggtggtcctttaggagaaattcacctgcaaattttggagttttgcttcaagtttcatttgattttcttgcttcttcttcctattgcgcccttcagtgaccatgaaggcacgccggtttcttatctctgcctgcaacttgttccaagactgtatgtagttcaatgtggcagctgtctgcttgttaactggattggtctgcccaataatgtgcaatcttttaacccccttgagacatctgagagttttctttgcctgcatttgagtgacgaaacggcaagaaatgatgtgccaatttcttagcaaccgaaaactcatgtggtagccaaaatgaaggaaacaattcaaatcaatgttaccttgtagcatctaaaggcattttgaattcgagtagctgcccattcctctagtgctgcattgtcttcagggtcactactagaggaaggaccattattagacttttgatttgttgagtttggcccattgggtacctgaccggcaaccttcaatgccaaagcaaaatagaggaaaatagttggtcaatttgacgtttagttcatctaagtaaatgtacagatgtcctaagccataatgtaatcatttaaatacaaagggcagaagctatgccatttcaataagaggcagtttaaaggtacaagaagtacaatcagattatgtttatgcactgtagccggtaagacaatcccacggaaagaaaaactacactagtactacaagaaagaagctgagagataattaggccagattctgtctgtaaatcgatgtacaaaaaaaaaagctaccaaggagatcaattcaacagtcaaattactttgactgaccagtccatgttcaaaagtgactggttgactgctgaacatataacatggacagagcataacaaagatctctgaatttatgtgactaaattaacaaaatgcttactcaatgagaactttgttttcttttttctgggtgggggtggggatgggggtaacttaacacatcttctgcagtaacatagaagagaacaggcaacagtggcaatgccaaaacatttccaattttcaaaccataaaacataaaaaaaattatcgacacagaattcagcttctcaaagaaccttttatatgtgtaccatgcaaatttacaatgacaaattcagatgtcctgttgtcagtaggtggggacagttaattagcagtagctcaccaatacaccaaagatgcagaaggttgtactactactctaaaaggtatacctaactcacacatactactgttctgcaagtcagcatccaaggtaccccataattgattgctagtatgtacaaatcaagcttttcccatcagccaactttctcttatgatgaccgcaaccaacaaagacaatcaagtagcagcacagagaggctgtcctggcccttcttaatgatgggatggaattgcattgtatggcatccttttcaggttgcttagaaggcatgcaaggctatgtgtacatgaccattcaactttcaggagggacttggaagttgtgaaaaaaaaaatcagctttttttggagtacatagaaggcacatactccacatcacggatacaaatcatctgcggtactgcatgtgtcactgacatgtgggtcccacctgctccgggcccacatgtcagaggcaccaactgcatgtgcattacagccgaggatccccactcaccaacggtacatctctaaccctactaaattcttactaaattctcgcgtgtgcgtaatatttatggacatgaggatttgatttttggaaacagtgacagaaataagggggttaatggatggatggagtggatacctttgcgtgttttgacttgccacgtttagacttcttcttgctgatgatcgtcttgaaccagtccccagaccccatggcttcaatcagagtgagcctcacagattaatccttgtccaacccccttgcttagatcacagaaaaaaatcattaaaaaaacagggttaattttgtttttaagtataagatggtgcaacatgccgaaataaaaaattacacctgatgaaccaagtttattggctcattctgaatctctctgagtgttcattaaccaaatcaaaatttacatggagaaaagaagcaaatcctaatatttctgtcaattgacagaaacatgagaagcaagcatgagaaatgaacccttgtttttgtttctatcctgaagtcttctcgaatcaaatatgaatgattccccaaaacaattcgactaaaatcaaacaacaaaaggcaataaaccggaagccaagaatcagctcaaatcttacagaactgacagggctcaagcttcagacttccttcctataaccttagccaagaaaccaagaacacccagagagtcaaccccatggctcatccatccctctgctcatcatccatggcagatgaacaagtattatcttctccctccaaaacccagagcacaagaacaccagaggagccaagccaagaactctgaagaaacacacagataaacatgatgcagctgagcagtgactaagtacctgagcttcagaaggttgcagtgttggcaatctgaatctgatcagaagttgctctcagaaagagaacgggagacagcagctcaggaaaggaagacatccattggaagcaatggatctctctctctctctctcctcaacctttgagagaagaagaagagagagaaagagagagaggtgggagagaaggtggaaaggtgaagaggctggagttagatataagtccagatcaagtcctttgtctaattgctcccaagttgttttctttaatccttctttgcctccctcctcggccagccactgatgactttaattactggactttttaattacagtgcggttgctaatgatcttgcttagcagtgggagttactgtcccttaatctcgctggcgatcttgttgccattaaaaatggagacaaggagttacttctttgttgacttgtatggagatccacttgctcagagaatccacaatttgcagtgtgcaacattttttatagctcatcttcagcagtcagcacagtgaaatcgtggtagtactgaaatcacacacaaactgtcgagttaataacagaaacaaaattaatcttgccgtctcatttcgttgttttcgagtaacagtaccttttcacatagacttggggtggtcccgggaccacccaaaaaattcctaacccaatgtatatatatatacatatgcaaaagaacttttgaaaaaaaaaagaaaacaaagttcttttattaatatattatgatgtacatttgatcaatttatatttctaactttgttatatttagagtatttaaaatagttatataagttgaaccacctatataaaaatcctagacatgctactgctttttccgagcgattaagagtgtaccatacttaaataagtatcatgagttatactatactttctaacttaaaaattcgtatgctagaaattaggatgaaaaaatttacaaaaaaaaaactttgacaactcttaaagacagtaaaaaaaattattgtttctatactacataaaaaaatccgaaaatcttcttgtctgccccagtaagaaaacggttgcgcgttattgcactaacacgcgacggagcatgaaaacgtatgcgtgtctacggaagcgcaatattaaaattcacgaattacctctcgaacttctcgatattaaaaattaatttaatcttaataaataggcacatataaaatcaaattaaggttaatattccgtataaagaagataaataacacatttcatacaaaatatattcgtatttgttttagataatattacaatatttttttatctctataaaagaacaagtattcagcgagtttcacataaacacaaactgattgtatttctggtctctgccgttaggcacacgccctattgccctagtttactagtagttgatgattaattgtgagcccagacagcacggcgaagtcgagaggaagaagccaaggagggagggagggagagagagagagagagagagagagagagagagagagaggaattagataagacgatcgattgccatggttggtacgttgatggtggtgttctcttcttcgtctgctcgtcgtcttcatcgctcgtcctccctggccaacagcgacatgcgagctaaatcagagaaaggctttctttctcccacctgaatcgatggatgcttcgtcacttcgcgcccaagtacggctccattcccgtcttacgttgcagtactcatctccaaccacccatgtcgcaattaattaccacgcaccgtgattggttcgggtgtgtttagttcacgtcaaaattgaaattttagttgaaattggaacgatgtgacgaaaaagttggaagtttgtgtgtgtaggaaagttttgatgtgatggaaaagttggaagttcgaagaaaaagttggaaactaaactttagcctaattgatttcagatagggtacagaattcagacttttcgtatggttttttttgtacccttttggtttgcttttgaaaaatggtatcatcggttggtttgtggtacagtatagtggttttggttttcttcgctgaaaagtgaaatattgttgcaatgatctgcttatgagaaaggcattagtactcccttctgtcacaaatgcttgtgagttctgatcgtcgagagaattttgactttttaataagcaacataaaagcaaaagacatttccaaatatagggaaagtttatttgtccctcgagggaatatcctctcgttttttttcattctagacctctttttagatagcatttataattcagattttatatatatatataattttggtaccttatggtttgcttttgaaaatggcatcggttggtatatgatacagtacagtggttttggttttctttgctgaaagaaagtggaatactgtcggaaacgaccctgcttatgacaatgatattcatacactgttttgttgtgaatacttgtcaatttaatttgacggtcaagattggtaaaattataaccgtcatctttttagagatgtaaaagcaaaaggaagttccaaatgtaggatgttagtaaggtacttcaaatgacaaaaaaactaatgattcaacttttaaaactgaaaccatatgctaagaagtgctaattataactatactaccaactcttgtctgccaaaggaataggtcgtgttagatcgaagccatgcaagcataattccaattccaaatccagaaaagatagacgagatatatatctcgatgctagctacagcgacattaataattaatcaagcaagctagtggcgtcatgaatgatactcactccgtcccataatataaaggattttgagttttttcttgcctgtttgaccactcgtcttattttaaaaattttagaattattatttatttttttatgacttactttattatccaaagtactttaagcacaattttttgttttttatatttgcacaa

SEQ ID NO: 52849 - DNA, 950 bp, Oryza sativa
  unsure (1)..(950): unsure at all n locations
tcaagactgagaccgagacggaatttgtcggtcctaacattttttttcgctgaaattcggtttttacttttcaaagaccgaagacggagactggaattttcggttagaccgaatgaccacccctagcgtcgggcgtgcggcggtgactgcagtccagtctgcagcgtgctcgtcggcggctgcggcgtgcgtggcggcgtcggcggcaggaggcgccgaggcgtgcaggcggcgcgtcggcgcgtcgccggcgtgcaggccgccagtccgctaggccaccacacaggtacgcgatgcggcggccgaacgaccacggctcgccggcctggcatggattgcgtgaggggcttgattcattgcattgatttgttctaggtagttcaatagtagttatgttttctggcggtgacggcttgattcattgatttgttctttagtagttcaatagttcactagcactgaaggattcaacttccttagttcctgtcttctttatttttcagtgtcaactgttaagtgtatatttattgacagattgatagtataaagctgtaaatattaggaatttagataacttagaaccataatatttaattttcggagtgtaaaatttatatatatgatgatagtatgaggctatatatgagctgctgttaggaatttagagaatttacagtgggtgtattctccgatggacaatatatagacagcaagcgagatcagcgccaatctacattcaatgcaaaacaattcttattgcaaggtaaaggacgaggacatcatcattcaagttagttatccaagcataatcacgttgtcctctactctgtgacagtttggcgttatcgtacaacacactatccactcgatcacatgcaccacatgggccagcgtccatatgtcagagannnnnnnnnnnnnnnnnnnnnnnnnnnnnnnnnnnnnnnnnn

SEQ ID NO: 52850 - DNA, 782 bp, Oryza sativa
  unsure (1)..(782): unsure at all n locations
aaacatactatgccaatactgacctgttattctctgtctaggatcaaatgtcagcatcttttcaaccagatcaattgctaaaggatgaacatgtggaaatttttcaggaaaggactgccttgcatgtctaggaagttggcgaatgtatcttcttgcattttcatttacaaaatccagatcagcctcatttggcgttccgatgagctgcaattaagaaatttatgataggaaaatcaaacacacaataatgtgaaacagatagtatataaatcctctagtgagaaatgcgtttgtattaatagccatgactcagaattcagtatcctgcatatcagccagaaagccaggaccttctggagcaacataaattctctcctctttgcattttccttagttttaacatattcccataggataatcaacatattatatatttccaaaacagtactccagttatgctaaatatatgaccacacaacataacctgatcaattcaatataaaataaagttcaaaagataagagtgtgttctaacctccattagtagacgtaattgatggacatgatctcttccaggaaacaaagatgcagctaatagaattcgggatctcgaaggtggactagtggagaagaggtgctaattaattgcatgtatgcataaatgccttatattatatatgaaaaatctgaaaaaaaatagttgggccttgtattatgaaatatagggagtatctattatctacatagggtatnnnnnnnnnnnnnnnnnnnnnnnnnnnnnn

SEQ ID NO: 52851 - DNA, 830 bp, Oryza sativa
  unsure (1)..(830): unsure at all n locations
atatatatatatatatgaatgaaagattacgatatatatattagacaacggaatagtttttagggacttaaaaatgcatatataatgagttattgtttttttaaaaaataactgtctattacaccgtacgaatattttgctagtccggacaactctaccctgaattttctgaatatatggatttagcattttcaggtgccggtaagtcttctcgctgaagattccattgccaacctgatggtacgaccgcacgcgcaaaatcttagccatttccttgcaaatgggcttggattggaaacctcccaatttccaagcaattcagagcattcaaccaacagctacgcttaaggaaagtaatttgaaatgttttttcatacttttttatgataaaaggaaatggtttgcattcccgccctggcctttggcttaagtaggcagaccgtcaatagatttttctacttatacatacttgtctggcgaaatttaaattttcaactttcaaatttagagttgattttagatttttttcatcaaagtttattttccagtctttgcttttaaatagataagaacacgtaacttttatttacaaaatacttttcatttgtaaatatgccgtttggtttattccactaaatgaaaagacaaagtgatgggatatatctctaggccgtgcaaaaagaaaccatctaaaatgctataaagaccacgtagattatactaagtaattttacatatcttcacataataagagaattttagctattgnnnnnnnnnnnnnnnnnnnnnnnnnnnnnnnnnnnnnnnnnnnnnnnnnnnnnnnnnnnnnn

SEQ ID NO: 52852 - DNA, 1259 bp, Oryza sativa
  unsure (1)..(1259): unsure at all n locations
nnnnnnnnnnnnnnnnnnnnnnnnnnnnnnnnnnnnnnnnnnnnnnnnnnnnnnnaccttcaacttactcacctggttgttgtgcatgaattgcatgcatggatgaacagcttttgatttcttttctcgttcatataatgttggcaatagttttctttttcctccacaaattttgagtgcatgttcggttggtccaacaaatattaattaattaattaattaatcccctgcctaactagctaagccaatcatcctatggttttggaggcggtggcgatctaggttaggtagactcacaaatgaaacaaaattgtttgttggcctagctagcctcctattatgttcttgttcttgtgttagttcagcattagcaggggcttaggcttggttgcaaacaagtcactctcacagccctcgtacttctgaatttcttggagataaggctctgaagatgtgccatgtagacttggatgtcagcccactaggctggcgtggccacattttaattacgtcatgtgcacatttttcagttagaaatagacatccaaaattgaaagaaatttcagagtaatgaaaaaaaaattatcatcatctgagatgtcatgaactcgggaccacgacaagtttggagtttaggatcagttttagaatatcgtctgttttggactatttgtagattaggtgctttcaatcaactggagtatgggcgccatcctagcctccctccttcggtccttccccttctctagcgtccttgttgacgaggaggggaaggggataggtagtttttcgttgttgtgtgtgttcggaacttcacttcccaacccatttttctcattttctgcgtgcacgctttttaaattgtcaaacggttcgttttttttaaaagtttatataagaaagttgttttaaaaaatcaaaataatctatttttttaaaaaaatagctaatacttaattaatcacgtgctaatggactgctccgtttttcgtgcggggagatgggttcccaaccttcaagtaacgaacgcctaagtatgtttaggatttgttctaaacaaaattgagttttagtctattatgatgtttatggagttaggtcccaatttatttagattcttttgcctttttacttttgctattgttttcacgggttcttcaatggagatcttgaaagacattgatcaggttgcagnnnnnnnnnnnnnnnnnnnnnnnnnnnnnnnnnnnnnnnnnnnnnnnnnnnnnnnnnnnnnnnnn

SEQ ID NO: 52853 - DNA, 4358 bp, Oryza sativa
ttattattattattattattattattattattattattattattattattattgaaccatttaatttttttattttaaaaataagctcggtacccaaaatttacttttaaatctgaacctttagaccatggtatcccgcctgacgtgctaaaacaacgtcacaatgtcacccgtagttgttgctaacacgtacggtgcgccacatcacgaggggttagagtattagctagcggtgttatttcgccacgcgtgacaaaatgttcagcattgtaaataagttttgagaatattcaatttaaaatttagaaattaaatggttaaaaaaatcacatgctgctgatctgaacttttttatttttgtttatttatttatttattttttctggggtttcttgccgtgtttgattagtggttgttgcggggttaggttaggtgcgagtcgctgtattgaatcgttatatatgcttgcagctatagctaaattattctcgcggcgaaggcgacgtattacgtgagtgctctcgatcgatcgatcgatcggttgttgtggtgtgcatgcgaattggagagatcaacgcgatcgagctgctaattaagctaaccactcacatcactagcaactgaacacagggaaattaagcatcagtagtgtgggagcttcagatgctgttcttttcttccatttcaggccagtccatccatcatcatatctctgacgacgacaatgatcaaacggagatttcgattcttaaatcggggacaggtaatcgacagtcgaacagtgtctcatcttccatcgcattggtggatgataattaatatatatattcataaatttatcgatttcaggtcacaaattatgagtcaaccaactttgatcatggtgagactacctcttgatttcgccatcgatcgtatgggtttctattaaaccacatcgatatgtacaaaaggatggggccctggatatgtatatatttctatggaatttactaactcgcatctatcagcaaactaggctaggcttgcatcacataaattctgaacctgtcatgttcttgattaagtctgatgacgatgttccttattctgatgtgtcatttgtttcccctctcatttgtaggaactagctaggctgcttttggattatcactccagttgacttctttttatggaaacaatggtggttatattaaatataagaaatcatcacaaccttgatagttctagtacatgagaaataaggtaccgatacagaacaaagaggatctacatacatcttaaaatgccacaagagatacaagtacacaagcacagccataacactaatcaactctggaccgcacaaaagtctttctatcgaccaccatctttgatcatttggcaaatctctaaaacggcatcaccaaacaaatcagtgacccacctaaaaccgacactgtcgattggataatctgcaacctgatcaatgtctttcaagatctccattgaagaacccgtgaaaacaatagcaaaagtaaaaaggcaaaagaatctaaataaattgacctaactccataaacatcataatagactaaaactcaattttgtttagaacaaatcctaaacatacttaggcgttcgttacttgaaggttgggaacccatctccccgcacgaaaaacggagcagtccattagcacgtgattaattaagtattagctatttttttaaaaaaatagattattttgattttttaaaacaactttcttatataaacttttaaaaaaaacgaaccgtttgacaatttaaaaagcgtgcacgcagaaaatgagaaaaatgggttgggaagtgaagttccgaacacacacaacaacgaaaaactacctatccccttcccctcctcgtcaacaaggacgctagagaaggggaaggaccgaaggagggaggctaggatggcgcccatactccagttgattgaaagcacctaatctacaaatagtccaaaacagacgatattctaaaactgatcctaaactccaaacttgtcgtggtcccgagttcatgacatctcagatgatgataatttttttttcattactctgaaatttctttcaattttggatgtctatttctaactgaaaaatgtgcacatgacgtaattaaaatgtggccacgccagcctagtgggctgacatccaagtctacatggcacatcttcagagccttatctccaagaaattcagaagtacgagggctgtgagagtgacttgtttgcaaccaagcctaagcccctgctaatgctgaactaacacaagaacaagaacataataggaggctagctaggccaacaaacaattttgtttcatttgtgagtctacctaacctagatcgccaccgcctccaaaaccataggatgattggcttagctagttaggcaggggattaattaattaattaattaatatttgttggaccaaccgaacatgcactcaaaatttgtggaggaaaaagaaaactattgccaacattatgcaagaagagaattctctggttgtgctatcaaactcgaagaagtggctgaatattttacaacagattaaatagtggaggggcagagcatgataatggataatttaaaaacacaaatttggtagccacacttaatacaaggtgagcccgttcatgacctacaaaatattgaagtgtttttttttccttttgtttcgttatatcaacatatatactctagagcttcaattaaataaaaatcacatggcagtctcatatcagatagaacaattgacccagtcttttgggttgtatgcttacaacttttatgacagctttagttaaaccagcttgtacaacatgccctgtttgaactaggctaaagaaacaccacccattagggatggtgggctagtttagaggaatggcaaggtggttaggaagcattacctaatggttaatcacttaaggttactaaccgtttaatagtactatttaacctataatatcatataaaaaactgttcatgatctcgctttaagcatttttttaaacaattgtcgtacctgctatgtgacagtttattagggaaaagttcgaataacatccctgaactattaggtcagtatgaactaccccctcagacccgaaaatcagacatttttcaccatcaactattaatatcgaacgaattacccccctcacttaaaccggagtggttttggtcctacgtggcactccaatcagcaattcttctttcttatgggctccacctgctgtgggtgcgatgtctggttttcagacctaagggggtaattcgtactcacccaataatgcagtggtgtaatttggacttttccccaatttatcatatatttgtattgatctgttacagattttaagcataacaattcatgattttaaaccattagggatcctctgctacctctaaaggttcaagactaatcatcagggatagaccaggcctagtccacctaggcctgggtatcgaagctcatttaggtgcagaataagtctatttttcctccctcatatctttgccttaatcgaatcgcatcactcaaccgtaaaaccatgtataacacctcccgcatctctagaaaccagtgcaaataaactcctcaagtggtttggaaggtgcgttcggctgacgtggcacattgatcatgattgactagctgagtcagcaagtgggacccatatgtcatcctaagtccacccttactaaccatatccaagcggccaagcctccgctaccactcaagcaagagcgaccacgcaaccaaaacattacgcaaacacattttttttaaaaaataaattcatatatatctagagagaaaaaacatgacaagaaatcgataataatacaaaagctatgatggtgtgcaatgtccgtgtgcatgcgtgcacgcattgcaaccggcccaaatcaaggcccatcgatcagtgaatactcatgggccggcggcccaccaccgcttcatctcctcctccgacgacgggagcacccccgccgcatcgccaccgacgaggaggaggccattgccggcggcgcccccggtgagccgctgcaccacgtccctgaagctcgcctcgtccgcgctcaccctcgccgtcacgatgtgcgtcaccttcacctcctcccgcctcctctttctcgtcgccgccgccgcccccaactcgccgccgccttgatctggtcggattcccatcaacggtgacgcgaactagctagcttagctaaatactgcgacgatctacactgctactctactcatcatccgtactaattaagattttatatatagctagccggcatgattaattaccagtgattccgctaga

SEQ ID NO: 52854 - DNA, 1782 bp, Oryza sativa
  unsure (1)..(1782): unsure at all n locations
tcagccttctctgtccgggccagagccatttccaaaaatagctcctaaaaatattctaccacttggatctcactaagagcactttttatatcccagagccacggtttttcctagaactcaatttcaattattaaactatcctattgtccttcgagcttcaaatccgcttgaatgattgttgtggggggtctccaagcatctcttgatctcctaagttcaccttgggactaatcacataactcaataaaatcattagtcccttaaccttattcgtcattaatcaccaaaacccactagggggataaatgcaacttcagttgcttggattgcttgttcagttttgtgttgatgtgctttcatgtgtagcccctttgggtttttctgcgtggattcctcttcattctgcatactcgttcacctcccagtcatttcttcagacagctccccgccacctcgggttatcacatagatttccctcagattccttgaattatttagttcttggatgagcgtctggttcctgtttcttggatggttgctgatttgcagagtattcggcaagatctttgaactgctagcatccgaatacttttgaactgcattgatgtcccaaactgttttttttgtgcggggagtagggggcaaagcctgaggagggcggctgcccacacccaccagtcgtcgcacccctggtgatgcggcgcgcacggagcgacctggagctcgcccaccgcgctctgcccgcagcccggcgccctcccgcgtccactcgcccatgctctacttcaatgcccgcctccgcttcgcctgcagcccggcgccgctccgctaccgcgcgggccagccgccgccctcgcccgtcgtcggcgttgacctggtttttctggatactgtctggccggcccgacgtggagaaaagagaagagaaggaaaaaagatgtgcagctgacatgtgggccccatgtactttttataatttttttgctgactaggatgccacgtccgcaaaaccgggcaaaaatattgccgagggacctncngtgaacggtttatgagagtttagggaccctccgataagtgattnnatagatcgttcacaaaatgtgtatatatcttatatagtgtataaactataggagatatatgtaaattttgtgaacaatgttactatcactttatcggatgaaggaatgaccaaaataaaggttatagatattgatgagttatacaactttattgtgatgaccttttcagttgaaatcatttagtacttgaaaatattgtctgaagttatcattatttgaaattcaaattcaaattatagaaacaaagtcatatagcaaaatgatcaaaacaaaagttatagatattgatgagttatacaactttgttgttgatgactttttcatttgaaatcatttagtatttgaaaatgttgtttgaagttgtcataatttgaaattcaaattcaaattattgaaacaaagtcatacagcaaaatgaccaaaacaaaagttgttgatcttgataagttatacaactttgttattgacatttttttcatttgaaatcatttactaccctaaaaaatatttgaattgagaggaaggaggcattatagacttctcggcgagggaggagcaaaagggctgggccggcggcccgaaaagggaggaggggaaggggaagccggcccgtggaagaagagagaggctgctggcttcgggctaatagtgtatactttataccttataccatggtattttgctgtaatttttctta

SEQ ID NO: 52855 - DNA, 10154 bp, Oryza sativa
cccctactaccaacaataaaatatctttctactgaggtgtaagaaaatcataattaatagaatttataaatcaataatttgaactatttctaccgaatattgatactaatatctctgtcccaaaaagaatttatttttaaccattcgtacatgtaccaatagaaaactggcctcctttgattaataggaataatggagaaaaaacatatgtacaagaattctatggggattggtactattcgtccctttgaattgtaggaattgaacggagaaaaagcattgaaaaaagttcgaccatgatttcaacagaattcgataggaaaatcaacatcaaccttagagctcatttttcttttcctatgcatagtatcgaggcaaagcacccttggaagatatggtttaccctagcaaaaccattcaaattttgatttactataaacttaatactcaacacattcctatgttttcctatgcaccaatcaaataatcattcctatagtatctatgtgttctcaattctctgttttgcatatgattttctatcatatttcttttttttatttgtacattttttgaatcatgtgattcaaaggggcctaaaaagactagaatgttattcacattattttcaaactttaatagattgattgctttaaacgtaaagtctttctggaatataaagaatccaaaaataaagtactcttcataggacatattttagtgtaaatcgaaaccatcgagaaagaaagcactatgcttttccgtgcgataccatttctctattggtagatattggtgtagcccacgtggggtgtcacgtctgcattaccttttctgttacccagttccatgctaaaagagcctggatgccatgttagtcatacttatgtaacctagagattcaggaaggagtattctgctagactgctaataggaagctagctagccatatgcgattggatgtactccctcccctctagttttactccctaaatattatgcatgttgtatcactagatttatattttaaagtatttttatgtgatgctaatatcatattcgttggtaacgtaacatgaagtaaattaatagtcaaagtatatcatttgagatcgtgtaaaatatagttcttataatttgggacagagaggaagtacattctttgagatcaaataaaatattttttagaggaagtacattcttataatttggagaggaagtacattctttgaggaagtacatttttcactcgaaacaaactacactaaaatgtattcaattgtggagtcaatgaagctagtgattcggtgggcgtaactggtatgaattctcctctggctatatatgcaattaatccacattcaaacaattagtttttcaataacagaaatcaacccaagccgctctacatcatagtgaatatacatcataatgaataatgagtactagccttttcatcatctaaaaagacaggaataacatttggctggccggtcggctatcgcgaatgcaatctgatattctcgcacccagtcttgctctgtcctggtggccatccctgtccaataatgcttagccatgcatccatcaagaaaattcctttatcaattcatctagtatatattcctttttgaaagtttgcatttcaaaatgtacgacaccattaatttttcgcataacgtttgaccatttgtcttattaaatatatatataaatatcatttactctctctgtttcatattataagtcgttttttttcttagttaaacttttttaattatgtttaaccaagtttatagaaaaaattagcaacatttatgataccaaactagttttattaaatttaacactgtatatactttgataatatgtttgttttctatttaaaatattactatatttatctttaaacttgatcaagtttaaagaaaagtttgactaaggaaaaaagtcaaatcttataatataataaaaacgtagggagtattttgttgttacttattttatcatcaaacaaaatataatctcaacttatactttacatatataataatatatataaatattcatttattttgttgtgtttagcttttctgccgccggccgggaataatgtctagcctttctgtttgtattgcatcatgcattttgcatatctgcaagtcgatctggaagctagttctcctccacatatgcatgcatgctttgcttctctggcctggccaccacacctttcaagacaaatctatggatatgtactatctttttttcttattttttttaatctaagcattttgagaagtttcaaaagttatcgatctcagaatttttaaaagcttaaccaaacattgtatgagttttggaatcggaaatataccgaacacaccgcgaattgtagaataggtatggtgaaaaattaatgagagatgaagcttgtaaaacgttaggccagctataagttttgccatgccagatcagctacagtaccatctgattctatcgtaacaatagaatctacattgtaccctagagtatgtaatttaattgtgcacaacaatattagtagctatagggcctgtttgggggagcttctagctgcatcaacttctcccagaatcaaaagctctcaaaatagttcagctgttggtccagattctaaaaagctatagttatagaatttataaaagaactaaaagccagaagctaggtaaccagcttttccaaactctcagagcctggttaccaaacagctgttcttaactctgccaaacatgcccatagttagcttcattattttactgctagcttcatttattttggacggggttagtacatatgtatctgtctcgaaatcgcctctgtaaatggggtcagtttcagcacttctatcgacatgaagaagatagaaagggccatgcgagagagagtgtgtgagaaagagaagattctaccgggcacaacaaagtgtgtaaatgcataaagaaaagattctactgggcacatcatagtaaggctattctcagctcaataactaggatggtgtccatagcattaaataagctgctacctaatatgaaaaatgatgtggcaagtgagtaaatgaggaaagagaagaaaacaaggtcttgcatgagacatggtttctacacaacattgaagacatcatgtgagataaatttaatttaagcatgaaaaagtggtgtttgtattgaaaaagtagtgtctaatactagtttattgatgatgtgaagtttatgaaaactaccgtgtagtgtcttgggttggtactgcctaaaggggccggctagctatataaactgtacagatgcagagaagcttgcacaactagtgcatccctgtcactgtttggctagcttaaccttcctgacatctatcctctggattgaacggcaggagatacctaagctagctagcaatctctatcgatctgtttgtttacatgttcagttaaaggttactgagaaatgcctagagtttttccggctagcttcataagttagtgggttagctgacctagattcaaagtctaatccttttatttatttgatattagatatcctaacgtttttagttagaggttattatttgacatgcccggcagcggcagggacgatcctcttgtggttggcaggattgtgggtatgtgctggtccattgtccggatcattttaaaaaaaccccctttttttcccaaaaggtgttggttcagcatatggtgcaaggatcgtctccaatggctgcgagctcaagccgtccatggtgacccaacagcccagggtcgtggtcggtggcaatgacatgaggacgttctacacactcgtacggatcatatcttggatgcagagacccaccagaagttatttaattactttcattaattatcataaaactagactataaattatattttttacatggatgcatgttaattttgtgtggcttacgtactaatctaattacctacaggtgatggtagacccggatgctccgagcccaagcaaccctaaccttagggagtatctacactggtaggcaccgatcagatatgttagctagctaattgtatacattcgtcctagaatataaagaatttggaccggattctcaatcattcgcgttgattctctttgtctgtctgtaggctggtcaccgatattcctggtaccactggagcaacatttggtcagtaaactagtatatatatatagtactcatatcaatttcgatgtaacagcaacatatgtggcagttccatgaatttttattaccttggtcctaccccatatatatacttcaaaaattgcataatgacaaaattatactccctccgtattttaatgtatgacgccgttgactttttaaccaacatttgaccattcgtcttatttaaattttttatgcaaatacaaaaatacttatgtcatgcttaaagaacatttgatgataaatcaagtcacaataaaataaatgataattacataatttttttgaataagacaaaaagtcaaacgtttgttaaaaagtcaatgtcgtcatacattaaaatacggagggagtatctattttgtcaaaaattttcgtcagatttgaaggatagggctgtacttcttctatgccaaaatggagggtggtgatcccctcaaaacttgtagaacagccactgttgatatatatatggtgaataacgtagataattaaattgatgcagggcaagaggtgatgtgctacgagagcccaaggccaaccatggggatccaccggctggtgttcgtgctgttccagcagctggggcgtcagacggtgtacgcaccggggtggcgccagaacttcagcaccaggaacttcgccgagctctacaacctcggctcgccggtcgccaccgtctacttcaactgccagcgcgaggccggctccggcggcaggagggtctacccctagctagctacgcatgccacccggcctccatgcatgcagcagctatagctaagctgagacctgcctagctgtatatgcatgcaggctcttaagtgtgtatatataaataaataaatgtatatctactattataaaattataaaaatataaagatgctagcgttcatgcattagctagatcgatcgatgtatcaagttatcatattatctctcctctatgctaatataacaaatgaattattattgcaactgaaacttttactatatatattgatacaattaattattctagttttctcataagctagccaaacatttttttctcttttaccattaatttttaaaaatttatatattgaacatcataatatatatatttttttataatcaacatgagaaaataacttacacatttttaaattgtgagaattttcagaaatcgatggccatagaaatgttaaacttgggacaaagctatcagaatgaaaagtaatttgaaaatgagggagtagaaaaaaccaataaggtataattcacttcagtactatgcatggtacaactagtatgctagtgatcaaaatcagatacacaaccatgagaagactgtcatgtgctggacatggacttcacagtgggccggatgtgggttgtcataggaaagggggcttggcccaggagcaagtcatccagagtataagtacacactccaacaagagaaagggggcgatgaattattttgaaccaatggctgcggcctcctcctcctcctcctcctcctcctcctcctcctacctctctgtgtcttcttcctcctctctagagttctcccacccccaactctgatttctactcctggattcagattctgcttggcgtgacgccagcgttgtctcggattccattctgctacatgtatccaagtaatcgagtgattactgctgtgatttggctctagaattgtggttgttctgctgtgatttgtgttgattcgatggagaatatgttggatcgtgacaatatggtatcagagcagtcgattcatgggattccgatccgggagatgcagtggacgacacatgggggcagtgacgactgttggggccaggatttgagccatggaggtgacactgtcagaggcgcccgccaggtgttcgatgaaatgccaagccggttaggaagtgctgcaggtgctgcactccatgtccaagtgaaccacctcatctaccctgtgtctaccaatgtgatgcatcaagtcttcaacccctatggagcagtggcggtgcagatgcttgcggtcgatgcatggcgtgtggaggcaattgtttggtttcggacgacctgcgacgcagagtgggctcaggatgaactccacggccgcaatatctacgacgggggctgcgtgttggatgtgcaacatgtgccgacctcgctcgaagacagagccgacactgcgcccaccaagtgtttgatgcaagtaccaggatgtgccaccacaaaatcagataccgagagcactcctactactctggaacacgtgtttccggccaccatgagtctatctgcggccaaatcagcagtcacaacaacgtcggtttcactcaccgaggccatggaggctgaggctagcatggacaaggtggtggagaacgcaggcaaggccattcaagacctgtgcaccaggatcgatcggattttggaggcatttcacgacaccaaggtggatttatccgagaacaaggattccactagagatgtggcagagttgagcgccaacactagtccaactaccattgcattggaggtcagtgctgaggctggcccaactaaccatgttgacttagccaagcttggcatgggaacaaccatcgagtgttcaatgaagggaaagaatcagttggttgatgatgatggcaaagacatggctaacgatgagagaactgagctcattgaagtggataccaagtttacttctgtgaatttatgcttcagagatccatggttagccctcaatgcaattccttccaggatcttgattgggtgtctgagccatgaccttggtgttaacaatctctcgttggttccatctacattggaagtgccttaccattgctttgtattgggctcagtatgtagagctagctcaccaccagtaccactttggagagtggcagttccatggtacagcgatcaggtcttttcaggttctcggccctcgccatggcctgatccatggttgtattcaggcaacggaagtgtggtggtatttcagcctctccaaccatggccaccccctctacaagccaagagcaaaggttctattgttgaacggcagctagaaccgtggcatgatcctcaaataaaacaagataacagaggcgttgtggtgaatctcctacaacccagactttcacctgacagatggaatgagtcttggttcagttgtgataatgcttgggagttaacacaaagtcactgcaagctcttgctgacagaacatatggccttgatggcgcataatgaagagaatcgccttgagcagaatctgagtctgtgcgtggtgagcaaaagggcatcatctcttcaattcaacgctgacttttggaagtcagcttggtgtgtccaacttgtgttcaagcaaacatttgcaattcagaaagttatgttttctaatgaggcaataatgaagtcttgggatcatgttgctgccaaacgagacacagattatgacatctctcctatgtttgacgtctctacaatgacaaggttgctggcaagaatcaatttgcttgattccaatttcggacaggtggatatgcagacattccaagcaagtgcaaatgttgtcactgttgttggcctgaagtactctcctttggtggttagaatggcctttgctaatcacctgcacgcaccctgggaccctggaggcagtaacctggacactctcttgcatgttaggaaggacaggcagcaaccacaactacaaccactgcaaaatgcctttcctgatagtgtgagggcggacatgaaaccattgctgcagatcatggctttaatgacaaagttaattaaactatactcttggcctgcttctggaagatggggagatcaagtactaaatcaagttcatgaattgtgcaagtgcagtcaagatcagagcctattccagttcactatctccacagagatgaagatgacatggcttggggatcttgagactatcaaacctacgctttgcatgagtatcaagctacctgactgcagttttggaagaatggagttgccatgggatcctgggggcatgaattttgtgcctcatttgcaccagcttgagggcaagctgattttcaaggggagaggaatgtcatgtgctggacatggacttcacagtgggccggatgtgggttgtcataggaaagggggcttggcccaggagcaagtcatccagagtataagtacacactccaacaagagaaagggggcaatgaattattttgaaccaatggttgcggcctcctcctcctcctcctccttctctgtgtcttcttcctcctctctagagttctcccacccccaactctgatttctactcctggattcagattctgcttggcgtgacgccagcgttgtctcggattccattctgctacatgtatccaagtaatcgagtgattactgctgtgatttggctctagaattgtggttgttctgctgtgatttgtgttgattcgatggagaatatgttggatcgtgacaaagacgctcggagaacaacgagagggcggatcgatcgatgccgggaagcttggtggccggagttaatggcgtcgattcgccggagatgaaaagccatcgattcaaggcaattcaaggctagggttcgtcaggtggaaggaagtcaggaaccgatcgatgccgtggctggaggaagacgacgcttccgacaggtgggcccggagcgcgtccacgcacgcagacgtaggctggtccaaagcaaggggaggagagaaccatatgggctagaagtggagaagaatagcaggccgagctgaattggaaagaattgggccgccctggatttagaagggaaagagaggaggggacctgggctagcagtgttgggcttaaaaaaaggttggagaggaagggagtgagccactgggcccgaaattggccggggacatggaaaagggatggagtgaagttcaacatgaatagtttcctctgataacttttcagggagaggatttttagatgagaatgaatattttgtatcgttttgaattcaaattttggcatatcggtagcgcgagcagtgccatctaaaccggaaaccaaaatatgtacgtgattagcactatatttagtgaagattagcgtgattagttatattttttttcttttcctgagtaattagtttgtatctacgagcctgttcagattggtgccaaaataaaccttaccaaaatttggcaatgccaaaattttggcaattttacaacgttgccaaaattttggtagaattggtttcataatgttgccaaaactctatacacattgccaatatttgataacaaactaaacgtagccacataatcaccaatttaccaaataatggtatggttaaaaatgtcatcaatctgaacaggccctacatacagttgcattttttaaaaacttctcgtatataattttaaggctttcaattaaaaagtaaaaacacaacccaaaaattctaaactttatatcccaaatcataaactttcaacaccaatttaaagacttccaactcaaattagtaaacttttaactcagattaaaaactttcaagtcaagatttgaaaactttcaaatcaagtttaaaatgttcaactcaaaattaagaaacttccaactcaaatttgaaaacttttgatacaaattttgaaactttcaactcaaactttaaaaaacttctcgacaaatttaaaaaatttaaatttcaagtcaagatttgaaatttcgaactcctaaagttcgactttcgactgatttttaaaaactttcaccttgatgtttatttattattttttatttaaaaaattattttatactatcgttaatgctaaacgttattagctcacattattcgggacgtgtgcgaagggaggattgcgcgccagctcagctcctagcgtacccgcgctgattagtagccct

SEQ ID NO: 52856 - DNA, 3211 bp, Oryza sativa
  unsure (1)..(3211): unsure at all n locations
nnnnnnnnnnnnnnnnnnnnnnnnnnnnnnnnnnnnnnnnnnggcatgccgagcttagtagctagacgctcatattcaacacttaaaatatttgaccaataattaattatttattataaattaaatcttatttgataaaattagtatcgttatattgacatttggatttctttttatattattatggttttattgctacaaacatggtatatgagaaatttaaagttatattagttttacatttcaagtctgattgcgctttattcagtaggagtgacggagtaggtgtgttgatgaagtcacgaagtaatgaattgatgatggataatataccacatgtccagccagcagccaaaaaggaagggataagtaaaattggtcaaacctgatgtatatacgtgcatgctgtcaatttaaagttacgggaaaagggaaatgccttttgttcatgatgatcaacacggctccgtgcattcttttgttctgtttttcctttttcatggaatgcatgaaaatattgtgcctgtgtggcatctttttttttcttaaggctataattaagttgcttgttattgcacaagttttttgtgtaacacactaccattatatacgttagtactacatacccctatccacaaatataatggattaatgttgttgtatgttggcttccttgtatttatgaacggaggtagtatcttatagcacattgttagctttatgcagtgcgcgtggtctatacatatattttttaaggaaacgagaggggccctctatacctttttcatgatttataaaaagaaaagttgagagcataaagcatgagaaaatatatactagcaatcctcgcaaaaaaaaagaaaaaaatactagttagcgatcatcttgttcagtggcgaatctcggaattttctttttgagtctggatgcaagcctatgacgcataacaagtacacatgaatccatataaatatgcacaacatttttacgacacaagtaaaactaacagcgttgagttataatcttagagagcaataccaatggcctatacttgtgtatgaggacgagtagcctgaaccccactttatctctttaattcattttatgaaaacactctagcctgctccccactctttttaagtgaagctgaaagtttgaaatcatttagttcggtttcaactttagaagagatagagatttggagctctaccaaataggtactgagttatgctagcttacgggctacggacataacatggtattgctcagctgttttttcgactattctggccttcatttgggtatttaattaagtactagtattcttatccgcatgcaaagctttcaatgccttgaaatgtaatatagaagacatattgagctacatatcaattgacctattggaagatagtcaaatgctgtaacattttatgacggtaccaatactatttcccttggaattaataaagagctatcaagaaaaacacacatatatacaaaagaaaaggcttagctagtttctctatcacaacagtatatagaaactagctagaaagttactgttgaacatttttcaccctcgaccaacgctaaagtcatctcatctagctagcttcctcaacgattgaaaaattctcaataataattctatcgatcggcaagtatatatgcttgtccacaagatagatagatataccaattggatatacgagtatctaatctctaaagcagacaatgaaaattcgaaaggatgtctatgtaagaaactcgttgctgagcgctgtcactatattccactataaatctatgtatatcactaaggcatctccaatgttccatgtcaattttttctaccatccatgcccgattctctttgcgtgcagcagtggggagagagaaaagagatcgatccaagattaatttgtgcaggtcctggcattcaaaaaaaaattgtgcaggtccttattaggcctagttcgatacagcaaaatggccatgctttttttcacgcaaaacacaaagaatcattagagcacgactaaaattaagtattaactattacaaacttaaaaatagatatgtttctttttaaaaaaaaaacttatatataaagttttgcataaaagcgtgttgtttataacagtttgatcgaaaagtgtgtttacaaaaataatgaggtagtagcgaaaccgaaaagctgaatcaaactcatcctagctagttctgtgactaccagcctgaggcagttacctcaacaactttgtttggttcctttgtaacgtggctctctcccctcatctcaataagaatatcgtcggcgtttcattcttatatgtcgactcgacgttagagagatccaagattaagaacttcccccatttgtagtttttgtaaataaatttcttgaaatttgaaatttgccctaaaattttctaagaatttttctattccaccgtaatttcattgcgacacataaagtatagacaacaaagacataatgtattagtaagagagaaacaacaaagaaaactaatgaaactcaccgtggttttggccaattttttttgttctttaatgaaccatgtggttcagattcttaattggtgagatgcagatacaagaggtggatatggggaataattgcagcatggacctgccatgaagagatcaacccaatgaactagagcaaccttacaacaatctatggttggtggttggatctggcctccatcccgtaagtacagaaagaagggttgaattgagaagcctaaccctcttagctgcttgggaaatttggaaagagcagaaccagcgagtcttcaagcacaaaagctctttgcaacaagcttgatggtaaaaataaaataagaggcaaaaacttaggccttggagagaacaaaacgtttgtcaggcatagcctcctaaggccgagcttttcctttttttaaaaaaaataacacccttacactctatatagtttttcctcctatatttaatgaaatggcacactcggatgctagtttgttaaaaaaaaatattctcggtgagattgtaatgtgataccacgatcactatctcggctgcgactcagaggaattttcttgaacctggtcaaaatattttggatcaattcaaatttctttgagttttggttaaattaatttcatctacaaaatgaatattgggtaccgagctcgaattcgccctatag

SEQ ID NO: 52857 - DNA, 1116 bp, Oryza sativa
cggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttgaacagcgccggtgtgtcgtacgccatacctgcatcaaatagattgatcagaaacatataactaattagttcaacataagtaataaatgttcataagcgaattactaacacatattaaacaagagtacaaacaaacaaaagtgtcaccatacggaatatttctaattacaacaataactgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcaaccctttttcacccttaacttagatggatctggaatataaaaaacttgggcactcagcgttgtgtaagatcctgagatcccgaacccatatatctcctcactccatgtatgaaagattgcttctttcctaaaataatttgagacgtacacattgggagatatgccacaatcaccggcagca

SEQ ID NO: 52858 - DNA, 1737 bp, Oryza sativa
ctgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttaatacacataatttgttgacttgaccaccctaaactctctctgcaaggaaactgcccaatgcttcaccgcctccttcatctcatccttatgagcataccttgcaccctcaattacctcgttctccttatacttccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatattcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctctagatcaaactaaactacatcttacaattaacactattgtctatgtctcaattcatactattatattctatgctctggatctacacatatgtgctgtgtgctacagatctgctaaaatatatggaactaaaactaaaacgcaacatatatactcaaacataacatattagtacaaatgcaaaagatgtatgggagcaaacctgtgatgaagtgagtgaaccagcagggcttcgccgctccccttctgctgccctcccctctctctctttcgttttttttggatttttacttaatataatgaaatttcagagagagggctgggctttatagggggaggcaaaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgttgcccgagagcgaacggccgtctgccacgtcactttcgccgccctctgggatggtgatttttaaaaatcgccctcccagagggcggtaggcgaccacttctgtcaattttcaaaatgaaaaattatttttgtaaaacttttaataaaaaaaattaaaaataaaaaaaattcacggggagatggactgatggactatgtacag

SEQ ID NO: 52859 - DNA, 4687 bp, Oryza sativa
  unsure (1)..(4687): unsure at all n locations
nnnnnnnnnnnnnnnnnnnnnnnnnnnnnnnnnnnnnnnnnnnnnnnnnnnnnnnctatgttgacttgattgcatgtcaaacaacttactgttagtgataagaaagattatatatgtatatttagtgatttaaaataaatattaaaaataaaattacgttaaaaatactctaaacttatatccaaaactagtaagttttaaaaattaaattatgataatagttgaattatatttgattcattggacaaactataaggctgacataaacgtatccttgatttgtactttattcttttaaaaaaacatgataaacttgaacttaatatgacatagataaatagagatgattttaccggatcccataaatatattgaagccgtggcaagtggcaaatcagcgatacttttacaagctatgtagcgacgtggtttgaaatacaatacaaatgcatccgtttaaataaaaacatgtgctcttacctctataaatacatacctctacgatccctccgagtacaggactgacatgctttattaaaaaatgacacttacacgcactcatgtaagcatgcacacactcatcatatcttaaaattgacgaaatcatctatacatgctcgtataaacacacactcacacccttacgaacgtacgcttgcactttacctctatgagcattagactagtatatcatgagactcatgaaaaacacctatagatgctcttataaacacacactttatttctatgagcatagaccggtatatattgagactcacgaagttaccacgtgctcctcggtgttgacgggtcgccgtctatcattagaagaataatataaatgtgcacacatatattaagtcaatgacttaaatttgggtgggcaagttctaccaccaggaattaaaaataaccaacaaaaatcatatttatattgtttgttgtgttccagaaaaaaataaaaaaaaatgaagaaagcacttatctagtactccctcgttttaatattataagccgtttgaatttttttattaatcaaaattctataaactcggtcaaacaaactcagaaaaaattatatctacactataattcaccaactatctcttattacatactccctccttttctaaatgtttgacaccattgacttttttaaacatgtttgaccgttcgtcttattaaaaacttttgtgatatgtgtaaaactatatgtatacataaaagtatatttaacaataaatcaaatgatagaaaaagaaataataattacttaaatttttaaataagacgaacggtcaaacatttttaaaaaagtcaacggcgttaaatattttgggacggaggaggtagtactttatacttgattcgtagaaaatcgtccaatccgacgctcaagatcgtcgcggaccctctcctttttccccgcacgcgctccggacccacacctcgatgggccgcgcgtctcgccccgatcgcctcccctctctctctctctctctctctctcgcacaatcatcgccgccaccaccctctgcgccccgcacgctcccctctcccctcctctctctcgcacacccgccgccgccgctctcccctcctctctctcgcacacccgccgccggcgccgccggcggcgtcgatccgacgtcgattcccatcttcagatcgacgccaccggcgccccctcacgccggttctactcacgccgcaagaacgctatcgcctcgcctcatcgatctccgacaacaccgccgcgcgccgccgccgatctccgccgcaagaacaacgtcgctccgcctcaccgatctcctccgacgatattccgcgtcaattaatcttcagatcaataaggtacccatgccatgagtaatttgcatgttcgactgtagcgtttaatttgtcaaatttccattccctggaggtggcatgaacaatcttccattcagttcgtcaaacactgcactaggtcccatgcagtagtaaatatatcaagtttgctactctactcgatgggacttgaaaatgttgtgaaatctctttcagttgctggtagaagcctggcattatgcaattttattgatatggtgcatagattgaaggagctatttcttttgtccctgcagatgcaagcactgacacaatattcttgtattttgaacacataatttttttattgctgggtcgggagaaaaatttgacagaccataaaaatccccaaaatgaactttagtttttaagtcaattatttctagaaaactaacttcagacaactttgcaactgataggtcattgagacattgtgttctggtcaagatcaagagactttctaaactaccatgctttttttttttacaaaacaatgtaagattttcagttcttgtaattttgacggccattttgttcaacttttcagaatttcagattttaggacttttaagttttgtttatttcacagcgttttgatgctttgctacttcatggacctttgcatgaccttattcaacatgtaataagtactaccgcaatgcattttattttgacgatgactgagctagacttcttttgagttactcacatttggatctacagttctgctgatctaaataatatttgctaatgcaacagcagttccaggagaatctgacttagcagatgtaaatatgtttctaacattatatgagattttttatgcgtatctatacaagccataactgagttcctatacaccatttgtcagtgaactacccaagagttgtaagaactaggatgcacttcaagttttaaagttaatttgagcagaatttgtctcctggatatatatatatatatatatttgagtaataatctaatcctttttgaaaggtgtatttctgtgcttcttcaaatcccctgctgctatgtgttaggtgctctgataatttccattcaactcgcgtattcttttatgccactttgtcctgtgcatctaatactgtacatttcagcaggattagaaaagtataataatggtattggacaaactacagattggatatcataaattggaaattccggggaatatgctaaatgtttcctgtaaatgcatatactgattttttatatgctgctttatttcccataggggtatatactgaaatttatataacaaataacagatttatattatcaaatcaccaaatgtgtacattgtactgcatgtaacagaatctctctccctctcaagaaaagggaaattatcagcacatgcataggttgtgattaatgccacatgcactatttgctagctggaaaccgtatatttgcaaaatatccaattttgggcaatatattggtggtatggcctcctgacatcaactcttacccatattgtttgtcataagatctgctatcctgaatctatgactctaaaagctcccaatctttaatatttgagaatcccgtgcataggcagtggaggccgaggaggccgccatccacaaccgacaacgacaacgcgatgctgctgccgcctcaagatccaccgctgcctatccgtactcacgccaccgttcctcctccgccgaaaggttcagggcacccttcgccacccctaccccatccctaatatgtctcctctctcccgataagtatccctgatgtcgatcttatgtaaaagcatgatttatgctcaatatatattcaatgtaatttgtgctggaaattgggaatcatggatgacattttctgtatatctacatccaaagccaactgtgaacagttgtattttcctctgataagcactttcaaactcttgaatatgtaccatactgctgatttcagtatggtggggaattgatgtggctggaataagaaaaaacattctcacaccctgtgtttcttccaaaaggactatatgttcactattctaagggtgatttgtctacatgtgtatcggacaatcgctgattagtccctgccatatctaactatgtatattcataaattagtactatgtattgctatattcaagtctatatgcctatgcttctatgatcacatagtactgtgtgcaatataattgctctatagtcaaattgaagggaaaagcctttatatttctgtgctgaactggaaatagataaatggcacatttgtttttaataaaaattgggttgtctgaagtttagagcactgaaatgcacattgttattgtcccttgaaagggtaaatatatttggatcattcgtgcatatatgtattcgggaccaatatatattcttaagatcattgatttagactctatacatgggaaatggtagcgaccattgaataaaaatgtgttttggttccagtaactggatgggatagatttgttgtctacgtttggacgatatcttactgatttccagtaagatctaagcgtcggtcaatttttcatttcattccagcctccgacgataggtactgtgccgttaaagatacatgtttctattcaagttaaatcacacttatgcaattattcatggctatcatttgagattgtactaatggtttgtattatattaagggatccatatgcttacaaaattgttctggattattttttttctatatggttcatccatacaacttaaatggatannnnnnnnnnnnnnnnnnnnnnnnnnnnnnnnnnnnnnnnnnnnnnnnnnnnnnnnnnnnnnnnn

SEQ ID NO: 52860 - DNA, 1698 bp, Oryza sativa
ccccacaacaatcattcaagcggatttgaagctcgaaggacaataggatagttaaataattgaaattgagttctaggaaaaaccgtggctctgggatataaaaagtgctcttagtgagatccaagtggtagaatatttttaggagctatttttggaaatggctctggcccggacagagaaggctgaccggaagttctggtccctagacccggaacttccggaccttgtgagttgaaaattttcccaagtgttgtccggaagttccagaccccttccagttcaaaaatgtgagtaacggctagatgatgtcacctagccgttatatatatccagatcgcacccagctcactttttggccatttcacttcagttctttcatgccctaggtttttctagcctctcccaagatccctttgcttcctccactcaaatctagagctattcttgtgagattgagagtgtaggagtgatttggagaaggtttgaagagtaggtttgattgagtactttggatatcttgtgggttgtcacttgggcttattactcttagagatcctctcctagatggttaggtgtcgcctgtgagcttacaaagatcttgtggatctagaaaatgacctaggggtgttgagttgaaggccttggactttttctgggatctttgcacaagtgaggcaaggggttaattgagacccagctctttggagcacctcaacggagagtaggattgcaagatctgaacttcaggaaaaaatcacccttgtcctctctgtgatgattctgtgcatgttgctgtgattgtatatatgctctttcatccagtagtttatttcgtgcaatttagttcaagtccctgttaaggtcttcaggtttttctgttgcccggaagttccggacagtctgagcagaccggaagttctagtgttctacatccggaggttccggtcctgctgaatttaaagctgcaaatttgtttgtaattttaaggaaagcctattcacccccctcctctatactacatctttgcgcgttcagcaatgaaaatgagcagttacctctcaaaacatcaggacaaatccccaatactaacgcctcctaatcatgaggactgggcgggcgtggactggccggccgcctctcccgccgacgcccccacctctcgtgtgggcgcgcctcctctcctcctctcctgccacctccgtcgcgtcgaccgcctccgcttgccgttgcaaccgcactcgccgatgcccgccctcgcagccacgctcgctcgccgcttgccctcgcagccgctcccgccgacaccgccgctccgcctgcctccgcccgtgcccggagagaaaaagagaacaatagaaaaatgagggtcacttacatgtgggctccgcatatttatttttattatttgtactgactaggatgtcacgttagcgaaaccagcccactatactgtcttgggacctcttttgaacggttttgtatagtttaggggtgaagatttctggttttgtggttaagggacctccggtgaacttattccttacttagacgtggttgtttctgataatctctatggccgtgtgtgccattcgatttgttctacacgtgatcgagaagtccaagccacgtggacgtgctctgtacggacggcctgcgcatgcatccagaggaaatccgaccgtacgtcgctatccacgt

SEQ ID NO: 52861 - DNA, 4256 bp, Oryza sativa
ctgtctgtccctgctaattaagcgaaacgttgcccgctaattatctccgttgtcgttaatttttaaacatgtgttccaattatgaaaattgctatacgtaggacccaactgtttaactcacgtacaactgaatttgattaacggttgcaaataattacaacgcaaatgaacatgttttcctttgattgatctatagttgcatgtctctagttgtatatgagttatacaactaggtcgtatgtatagcagtattatttgattattcgtcttttaaaaagattttattcgtcttttagaaaagattacgtaagcatcatgtacctttttgttggttgttttatcactaaaaatattttaaatatggtttatatcttacgcattcacacaaaatttttaaacaagacaaatggtcaaacatgcgccaaaaatcgataacgtcatttatcaaacaaccgaggtagtatgtgtatttaggaatgcctccttataaattttaatactcccactgtctcattatataaaaggtcctcatcagatggctaaatgctttggctgatcagccaaagctgcctccaattcagccaaactacaatgcatattggttagcttattttgcttaaatggctgatcagtcaaagcatttggccatctgatgagaccgaaatatttttctccttccgtttatctcaatatatagtgtattttgaattctcgaggactgaaggacaggagacatcaaatctactttaatatgtccatgtccgcaccgtgtcctctacggagtttttataaatgtttgtaagtgtcaagtgattcaaattatatgtttaaacgtgatatgtataaatgaccgtaaaaaaatacatggcagtggtgacaattaagtcccacactaaaatgtacgactctgacatttccgtcaattgtaacccattgttgtttttttttcttttttttatgcaagtagtttattcccgacatgtatctctatggtactatcttaaaatgggaataatacgttatattatgggataaaaagagtacgtgtttgaaagacgatgaagactaataacaaccaaactaatacctccacgtacataaccgtggccattataattcatatcaaaatgcacgttactaccgtctaccgttgagtctgacgcaattcaatcaatcaagaataaaaatataaatcaatttgtactggaccaaacgcaaacccaagttccagcaccatcgtttcgaaacggtatatttgcaaattaaagtgatctccgaataaaatttttatatacatgtttttagatatctaaaagtaaagtttgaaaaataaatttcgatgaaaaatcttaaaatcagttttaaatttaaggataaaaatttaaattttagctgataacacgagcatgggagaaaagatgaggagatgaggtccttcgactttgtacaccacacgagctcagccagtacacgcgacggatgagccgaaccgtttcatcccggccgtccgcgtctaatccgacggcggccgcggcggcgccagacttggccaacggtcgaccacgccgccgacgcgcgtaacctacttgcgccgacgccgccgcgttatcctactcggttgcggcgcggggacgggatggcgtccacgctttcctctccttgccaccaccacctctcctactattatagccaccaactccgacgactgcggctacgcctccgcccctccaccggcgtctacggtcggccgtcaggttcttcgatcgcccgcctttccatacccattccttctgtatttcattcttgattttggggggaagatgggataaacaattggttatccagtagataacttcgttgatcgattgacgtcgatttttatttttattgctaatggagaagaagctaggtgatattaacttgtttgtttctagcaacatgagggtacaagatctctttcagttttgacacaaccaaatgagcatccaaagtaacactactgtacttagtatcgcgatgttcttcaaaatgctgtgttaatgaaaatgaaatagtgtgctgacagttgattcatgcagaacttgacagtggtagagaactttattcccatccaacgttcgggggaagccgtagccgtgtgtcgcgttcatctttcatggaaaaatcccaaagaaagcgaggaccagatcatctgctgattcttgtccatggtatcattgcaaggtgagtatatcctgtcacgataacatagcacctgtctgaaaatgcatagcaagattgcagtgctagttgttcctgtcacaattctttcttgagctttgctgataaatttccttcattgttctcccttttaatgcagccccagtgactggacctatggagaagcagtgctaaagaagaggttaggtgacaattttttcatctatggtaggtatgacatatagggatcacctgcccattcctattggctttctgacaaaattgagcttaggatcagatgtacagactacagaatacctatatttttaattagtactgcaagatgaaattcacaccacttcattactgtagctacattggtttgcactttgcaaatgagaacaattcgtttctagccataaaacttacagtgaactatatcattgcagctagttcgtcaaatatctacaccaaaactttcgatgggattgatgttgctggaagaaggttagcaaatgaagtatgtactcgctagttagtcctagcaaaaggtttcaagtattcacctttgtagaaactgttgtctgcactcatggctgcgcttaagagggctctgacgaaaatccgctatcgaagcaggtattggatgtgattcagaagatggctggattgagaaagatttccttcctagcacattctttgggtggtttgtttgcgcgatatgctatttctatcctttattcaacagcaatgaaggatgcaagtcaaagtgctgcttgtatagctcctacaactggagggtctgaaaagttggagtgcacttcaggattaggtgcaattgctgggctggaaccaattaattttattaccttagcaaccccacaccttggtgttagagggaaaaatcaggtgggtctctaaatctattaaattatctgatacatttttattcccctcaaaattagttctgctggaagcaaaaactactatattggactttgagttgcctagtaagattttagtataaaactattgttgcatagctaatcggaggccaaagaccagtaaccaagtactacttctgaatatgttgtgacttgtgatcaatgtattaattacatgcattttctgcaataatattaccagcttccatttcttcaagggctatctattctagaaaagattgctgcacctttggctcccttggttgttggccgcactggtgcccaactctttctcacggatggtgaacctagcaagccacctcttctgctagagatggcatctgatcatgaggataaaaaatttatgtaagtcataagaaaggtcttaaggctaacttattatagtagaacatatcttcttcgttcaaacattgtagtagaacatattgtttcttcaatgttcctcagatctgcactagcagctttcaagaaccgcattttgtacgctaatgtttcgtacgaccgtatccttccttactcctagttagtaccacatgatttcctctgcctgatatgcaaacgaatttttttttgctccaaaccattttctattttgctgctcttgttttcttgaacatatgccagatatggtcggatggcgaacatcttcaataagaagagaaaaagaccttacaaaggtgttcagtgatctccactagaatttgattagaaaccaaattgcagcactgtgtgaatacttcagtaatttttttcctcctccatatgcagccctcacatcgttcactggatggctacaagcacattgtgaatatggaatattgttcgcctatatcatctgatggccctcatttccctctgcaagctgccagagccaaagaagctgcacagagtagaccaaacaaagaaaacactgaagaatatcacgaaatgatggaaggtgagtaggacctttttcagtagactagtactatgtgctggatcttgatgtctcccttgtttctcactctatgaacatcaattctgtgttctggtaacagaggagatgatccatggcttgcagagggtcggttggaagaaagtagatgtcaactt

SEQ ID NO: 52862 - DNA, 1501 bp, Oryza sativa
  unsure (1)..(1501): unsure at all n locations
nnnnnnnnnnnnnnnnnnnnnnnnnnnnnnnnnnnnnnnnnnnnnnnnnnnnnnnnnnnnnttttgtccacaaaagcttttttttttctttcgcacagacgtacagttgaaaataaattagtgaaacattattattatttttattatttagttaggttgcattcttgcattattgagatacgacgcagatggagatggcattacgagttcacaacctacacggctataccaactccatgaaatgataatgtggccagttcatacaccacattttatgggatgtagcgtacatgagtttttgagtttggctggagagaacgtgcacgcaagcaccagaacatcgcattataacgtaaaaagaagcaatgaaataattggcaaaagactagaataatggatgagggagtctacaacttagaagaatctcgaagtaatgttccagtcttacgatcaactccaaactgccaccactgaatcaagagtcaatatatcctcttccattgaccacgtcttacaacatggagcattaagtaaaaccatgagaaatccatgaatcgacaagaaaatggggaatttgatgataaccgcagaatttaggccgtcatcgttcatgaactaactcttcttacaaaagggactaaaaacatttaagatggaaaaaaatcccacattaaacaacatacataagcataagaatggcatagcagctacccaggaacttgatcacaaagtacatttctactcttagaacaacaccttcagctttgaaccagggaggatttttcaggtgaggcaattatttacaactagtgatcactgtcggcgaccttttgtggcgcaggaggaaaaaactccatatgaatagaatcaatccaaggctgaaatagaacaccagctactggtaatcagggttgaacgcaaggccttcttggtagattagatccttcatttgttcctcggacaatgcatgctgctcgaagtcaaagctgaagggtgatgagcagactggctcatcacttatgtcatgcagtgatgccaggtaaggatgtgcaagggcaccttcaactggataagaagaaataggagaaaagataagggggcattcagtaatatgaaacatgcagagaaaatcaggtcaaaagttttgacacagggaacaatgcattttcaacattagaaaacaccacaaggcaatgactctttcaacattcccacctatgagttaagaatgatgctcaattcacgcattaagaataaagtgatgacacacctataccacctggattaggttagggtggatcaagaggtaaaaaggatcgacatagtttttttttttaaaaaaaatatttaggtttgcatgtgatttagtaatatagaagtcatgcacagatgctctacaaatatatttaagtatccactgcagttgttactttctatcttaaaannnnnnnnnnnnnnnnnnnnnnnnnnnnnnnnnnnnnnnnnnnnnnnnnnnnnnnnn

SEQ ID NO: 52863 - DNA, 2170 bp, Oryza sativa
aaaggactgccttgcatgtctaggaagttggcgaatgtatcttcttgcattttcatttacaaaatccagatcagcctcatttggcgttccgatgagctgcaattaagaaatttatgataggaaaatcaaacacacaataatgtgaaacagatagtatataaatcctctagtgagaaatgcgtttgtattaatagccatgactcagaattcagtatcctgcatatcagccagaaagccaggaccttctggagcaacataaattctctcctctttgcattttccttagttttaacatattcccataggataatcaacatattatatatttccaaaacagtactccagttatgctaaatatatgaccacacaacataacctgatcaattcaatataaaataaagttcaaaagataagagtgtgttctaacctccattagtagacgtaattgatggacatgatctcttccaggaaacaaaggtttacgatccatgagttccataaaaatacagcccacagaccacacatcaattgctgcagtatattcagaggaattcaacagaagttccggtgccctataccatcttgtgacaacatactcagtcataaaatcggtttctgaggtggtacgagcaagtccaaaatcacaaattttgaggtcacaatttgcattcaaaagtaggttgctgggcttcaagtctcggtgaaggacatttgctgaatgtatatacttcaagccacggagaatctgataaaggaaatactgcacaaaaaggtaaagaattacgcaagaacagttataccaaacatgtattatttctcagaacatggtagatgcatgcacaaggaaaatacaagagaacacaatcaagttatctggataaggaaagataggtgaggcagccattctagagttccactcaagaaagggagagatctatctgtagcattgatcataagagcttgcaagctgcaatacagcaagacctctccagtgtgattgggcattgaacccttctcacgttgaatgtgttatgtggggaatcctttgaatgtctcaagaacacgagttcggtgagcgtgcatggcacgccacagtgtcgttctcgccgttatctgttgcttgcattagataagagttatcccttaagatttgaggtttgtttcagttagttctgattcattagcagattgtaatcgcctatataaggccactcttttttctgtttctcctcaccatggctttgtgggaggcgagggcatcggcatcaccctcccgtcaagcactgctacaaccttcggagctgcggtgccttgccgccagctcctaacagtatgtggtctactgataaatagcaatcaactcattattcgattttatatcggttagcaaataatatggtatctccaaagaaaacgttagtttgatccaatgatcaatggtgcactgagataacctaattgtagcactttgcatatatgctttgcagggcaaaggtacgttcaggtatattagtaggtcgctaaattcgtttcttaatttcaaagattatgcatacctgcagaattcttaaaatgtgatacaaaattaccataaaagctttacattcaaccttttgtaccaaattccttatagttcttacacaaaacatttataaaccatcaatacatacttcaatacttcccactttttaggtcttgaaaactcaatttgagcagaggcctagacaagcaagagaatccaagcagaccagaaaagccatttgtatgaaataaatgctaaagtggaaataaagttgtgtttttcttttgaagaaggtacctggcagtgctcctctgacaatgcttgatttgagcgaataatttgatgcagatcagtatccatcaattcatatgcaatataaacgtcattgaatgaattcctttgtggaggaggtatgatatcccttatggcaacaatctgcatcacataagtaggaagttgagacaagttattgccttttggagcatcgatgtgcaaacacaagagcttgctggatatgtgaaatacaacagaccagctccaaatatcttataggagtagataaaataagtaaatcaactatgtccagaccaaccaaagcaagaacaaacatattgcatggaccaggaaataccatatgaaaatgacttg

SEQ ID NO: 52864 - DNA, 4203 bp, Oryza sativa
  unsure (1)..(4203): unsure at all n locations
atacaggatcgccaatttggaagtaatgttttatgtaataatgcaaaatagccattttttgtgcaagctatattttaaaagtagaattggacttgatgtacaaatcttagctcatgtttccaactttccgtacatacaattgaatttatagccagatttgaaaagtagaatttgacttgatacacaatcttagctgatggcaataaagcaggtgcattatctaaggacttctactccaaaatttgcctaatccgatcgttttctacaaacacccgtaactggtataactcccaaaagcctcccctgcataattggagcactaaaacctgaaattaaacacttctctttctgcagtaggatacaaacaaaatggatcagttttagtttgaaaaaacttccaaaaaaaggcatgagcatgcatttgtgtatgcctgtgtcaaccagtctatggttcagcaaaagcagtatctgagcaactttttgtatgaaccttttttagggaagtatcaattgatctattatgttataataaagagggtgcaaaagggtgccaccacgttcaatctagaagcctagaataacgacattaatcggggaaaaaagataaatatatgcccgtttattatagtggtgggtctagattacaacggtccaggttgaccagtaaattctatacaaaatataactctaattttaaatctagctcctctcatatttgcatgggaaaatccactagtttaattataacggaatatttatgaccatccaaatttaattcacctcttcagaagaagctgagtttttctagggctggctatgaagatatggcctattctctaattcacttcccctgtggctgtctttctaccactaaccatagaaaaaatatgttgcctctggtaagctgaaaatgatacttcaggcctacgcaggaaatacaacagtgggctactcctattagtcagtctttaaattggtaaatttcaaaggtccaagtccaacatgcacacacaaagtcaatctcaaaactttccaacaataacacaattcctagtactcctatcccctaattccctccccactggcagtcactcccactgcattcagactggatttgactgacttaggaaaaaggtgtaacaccagattggtcctcctcctcctcctactactactgctcannnnnnnnnnnnnnnnnnnnnnnnnnnnnnnnnntacgaatcatgtgatgttgctactctccaggtcaggtctgttcacatcactcgctcccccactattcaagaacacaatgaataacaacatccccaaaaggcagatggcttctttaaaggcatctccaaagttacctctatttctgaagctcgcagcactcatcatcagcagcaagaatggagggaaaagctctaccaaattaggccgagcagtgacgaactcaatcatttggtaacctaaccctcacctcctcctcctttccccatttaatgcaaccaacttaactaaccagagacaagagcattcaacgagaatctcaaaatctgcgcctaaaaatcgagggtgggtgggggggaagggaattccgtggtcgaaacaatggagcggatcgggagcactgacattctcgtggtccatgtggcggagcagcttgatctccctgagcgtgcgcttggcgtcgatcttgttgtcgaacgcgttggcgatcttcttgatcgccacctgctcccccgtctccgagttgagcgccgagctgtcatccaaacccaaaatccaaaatccaaaccaaaatcaggccgccgccgccaacggaatgggagagaggggggagcaaacgaaccagacgatgccgtaggcgcccttgccgatggggaggatggggggcttgtacttggcggtgacctcgaacacgttcccgaagatgttgtactggatgaacctcccgccatggctcagcgtcgcctggatgttctccatcatccccgcccctgcccccgcccccgccgccgcagccgcagcaggcggctgctgcccgccgccggcctccgccatctccgtgtccggcggctgcgccccggcgtccatggccggattcggatttggatcgctaccaggaggtggaggtggaggaggaagggaagggaaagtggaggcggaattcgtcgcgagatttggtcgctttcggcctcgttttgtagctctcgcctcttttttttttgtgtgtgttttttttgtgtgtgggtgtgtgtgtgctcgcgtgtgttttctcttgggctgtggaggtgggggtggtggcccaccggggtataaaatggttggcacgcggggctacgggtactaggcgtggcccatttttggggtgggtgggtgtggggggacgtgtagcaaaatggagatgctgtgccgaccctaacgactgatgacgtgtcatggtgacgacagcgtgagggaacactacctctgtacctagtacctttacacccataagagcaagtttaatagtatagcccactactaactccaatttatctatagccaacataatagtcaattcatacaatagttgcttactatattattaatatatggtctcacctgtcatacacacactgcgtcttggagtccgtgttgcagctggctacagatctaagtccgctattcttctctctcatcttttatctcattaaaatatgtttatagctggctaatagcctgctattgtacctgctctaagagcaagattagtataaccaactactagctccaaattatctatagttactttaatagccaatatatacaatagttacctataaacatatactacactattaatatatgatctcacttgtcatatacacattgcgtcttagagttcgtgctgcagctggctacaaatttaaaaggaaaaaaagaagaatgagaagaaaatggaaaataaaaagaaaaataaaagaagaaaaaaaagaaaaggacacatcatgtccatgtggcatgctacatcaacgccacgtaggatcctagaggtgatgtgtcaatttagaatctagatgatacactttgataagttacgtgactcagatatgtattttgagagtttagaggcctatataacacaaccctataagatgaaggaccgccaatgcactttactcaagttgaatggtagagctaactacttataaactcatattacaagtataagattggctataacatttgtcttcaccttttcttgcttatgtatttagtgcatgtaccttgaagcatatgactagagctttgtacttttcttgtcttccttctccatataaacttatagtttactattatccttgcttaaggtggttgcttcagcaacaccaaacacgagggcggcgaatgctatctagcgccagataatggtgtcattttcttccatatttttttttgctcgccatatcttcccgctcatgtcattctaccaacacttttttttttcgtcgaagacttcatactcctacaaatgattgagacagaaaggtgttttttcttgatccagtggagataaagaaataagcatcagtactaataacattgtttactgcttactttaaatgccaatggcacgtgttgatgtagaattacgcatagataacctgccagcggctagcatcctccaaggaaattgtaccatgagttaggcaaagtttgatgaaccagagcttagaattttactaccctccggtgaatgtgacagtgaatgctatggacaggaactctttgcgatgaatgcttcaatataaggacaagaacaaaacattatctagtcttgcaatcctgattaattaggattttttttatggatactagggacttgctggaaatttggaatatatgaggcaagtggtgtggaaatgatagggcaatagataaaataatgatgttctagcatctttatggaaacaaagttaacaggacaataattaattccgcaaacacactgatattaattataatacaaatcaggtctaacaaataaaaatgagagtttatgctaaaagagtttataagtaccatgaattatttgaagctcaaggaaacctccaatgcaggaagctattgtcatatctctggtagtagagcctcaggagaagaagaaattataacccctgtgcagagtttggatgagaagactttgataaatctagtgtatgtcttcacagctac

SEQ ID NO: 52865 - DNA, 3657 bp, Oryza sativa
  unsure (1)..(3657): unsure at all n locations
ctaatttgttacttagcaagaacaaaagtacaagactgaacttatactccaaaaaaaaaaattctccacaaaatatagatgacgaaactatcgttgaaaaaaaacttgataaagagacgcggtgatacctcaagcaaatgttgtcttcaaaaaagggatacactcaacaatgatatgatgatcaggggtacaatgggcttgaccagtatgtgcaaaaatatcaaatatctgtagcaagcatgaacgtggggcccacatgacagctccaattgctcataataaaaggagctcataatttgcatgccacaatataaatgaaaaataaaggctatatcacaggacatgctccagagcatgaaggttttatgatgcaaagtatcaattgacctcctgactaattttaagtcactgtaagcaaagtttttttgccaaagttttggactggacaaaaaacacaagatacctacttcaacccccaagataacttcagccaccttgaagggaacaactcatgagactaactttcagttgaaatcactgaggtacaaaacggctgcagaaatgcattgttgagcactcaagtaatgccatggacatgatgagcaatgggatgtaatcctcggcacgaagctggctcaatgaagctcctgacgatcgcctcccacatcttttctatgcctcaatatctcaacacccaaataatcgacgattccacgtacagcaacatgaggtttcccaactttcactctgatggttgagatttgagggaacttaagcaatgcgttacttgcgattcgatgagctactgcttccaaaaggttccgcgatgggccttcaacaacatccttggcaatcctgtaagtgcagagcatgaacatatttcagttctccaatgattggaattagtaaaagaacaataaaataaactgaataatcctacattgctgaaatggacaagcaagatttaatatcttaaaaagaacaatcaatcaagacatttctagtaaaatggtgaaataaaaacaaatcgggattaatttgttactcctacccgtagatatctgtgtagctaaccgtatcagatatgctgtcagtctccccagcaacactcaaatccatccacgcatcaacatccacaacgaacttttgacctagagttttctcttctgatttcactccatggaaaccgtggaactgcaaatctataagcacgagtttatccctgtcgattaactccctctccgccataatggtccttaaagcacggaacgaatccttagtccggcagcacacgggtatttggatcgattcatcggtggtggtggtgctcaccggaggcggaagggaagggaagcagcagcaggacgacggcgcggcgcggtgcggtgggagaaccagcgaggagacgggagcagcaggacgccacggcaggcagcgccgccgctcgccggcggcgtggcgaggagaaggatgggcgtcgactcgacggggagagaatttttttatttttaattttttttattaaaagttttaaaaaataatttttcattttgaaaattgacagaagtgatcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtacggggggccacctgcaaatgggcggcggggggcctggaattttgcaggcggccctcttgccgccctgggggagggcgattttatattgtgctttatatttttttataaatatcaataattatcaaatctttttatattgaaaactatacaagattaaaatctccaagactggtaaaatacaattttattattttttagggtctatttggaatgttaccgtacaaatattttgttagtgccaaaatataagcaagttttggcactaccaaatatttggtaaggtaaaattgcatttgatcatatttggtttgctaccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacacatccttggattgccctgtaaaaatagtaatgttattcagtttgggtagtaattttgtgcaaatcatagcggattttgtaaatggttagacatacaacgaaatcgttgtctacattggggcagacaaaatatctccttccaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgcttatccttccgccttaggtagtccgatcttgtttcactacgtgggtaagcacgtgttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctccttccccgagtttgtatcatgagggaagacttgtgttgtgtgctagtggaaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaagcagcgccgaaagttaatagtgacaactcgagctgccgtttttcatgtgtgctgttgnnnnnnnnnnnnnnnnnnnnnnnnnnnnnnnnnnnnnnnnnnnnnnnnnnnnnnnnnnnnnnnn

SEQ ID NO: 52866 - DNA, 1484 bp, Oryza sativa
caagtagtactgcagtagtaatagcaaaagtagtactgtttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagaggaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacacgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaaggtaggggcgctcgaaggcaaacgaggtcctgcgaggatggaacatcaagttacgacggggtgatgttttcgtacaaaaacagaaacaaaacttaagaaacctctgggctgaactgtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcatgcatcttctcctgcatccggtcgaaggtcaccctctgctcaacgtcagtcaagtgcaaacctctgttcaacctcacttggactgcggtgatatcggcactgatatcccatgcggcatcagcctatgcaagatggaaataaaaaattcagtaattgtcctatattatgcaagataaaggaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgcaaactgtccccgtcgagtcaacctgtgaagaaaggtaaattatatggctcgatgaggtaattatcataaaaatttagaaa

SEQ ID NO: 52867 - DNA, 1297 bp, Oryza sativa
  unsure (1)..(1297): unsure at all n locations
nnnnnnnnnnnnnnnnnnnnnnnnnnnnnnnnnnnnnnnnnnnnnnnnnnnnnnnnnnnnnnnnncctcttctgtgtacggctcccagatgacgtcgctcggctggagacggtcaaactcgaacacgaagtccgggtaacctcgtctcacctggacgtgagcgtaacgacgctgcaataaacatgatcggattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggagggcgcatcacctgttcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcagggtcgtccgccgccgcctcaacaagcctacaaagtggtagaaggcctcccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctgggtaccgagctcgaattcgcc

SEQ ID NO: 52868 - DNA, 1654 bp, Oryza sativa
  unsure (1)..(1654): unsure at all n locations
acacaaacgcaatgacctggcacggcatggtgccatggtctgatggtcattgaaaaaatgaggttatattccaacttaataatggattatagatatcncaaaatgagagagaagcaaagccattattcagaagtctacttcaaatgggtagctttgctactcaaaaaacttggttgcgtctttgaggctttcagcttggatgatggatatgttttccttcgtttggctagccaacttctttagcttattagagttcagagttctgaccaaactgaatttgactggccttctctgctcacttatgagcttgcaaaacccatggaaaatagtatttcattaggtaagggtcaattatacattcactcacccttgcgagacaagctatagattatgctactagacgttttctaatgctagattacagacgtcagatgaaagtgaggtcacctgtagttgttggatcaatttcaggttgacatagtaatctaatgtgctgcaatcttcccagctgcctcactggctcaagctgattgatttgttcttggtcatgacgaaatctcctaactcgttgactggatatcgaatccctccaaattacaataataacatttcttgaaaattcagaaggcagaaagaacaagaaaccaaaattccacaaaggcgacaacacgcatgggcggctatccagtactgatcatcgtcttttttttctcctctgatgcaacaatacgcataaactgctttgtttttccttttccagctttcttattcgattgatgtgtatacataacatggctatcagctatcgattaattaattataatgatgacatgcgcggctttagctgacgttgatcctgctgagatttctgaagatattttcttttcttttcttctttttctgcagagattcctgcagtgctgccgtggtcgacccgattaaacatcgcggttggcgccgcgaagggtttggcgttcctccacacgcagagaagccggtcatctaccgtgacttcaaggcctccaacatcctgctcgattcggtgagtgccctgtagcttttcctaggtagattgacacctctcatatgcatgcatctcagttagctaggagtttttgatgcacacatcacatatgatatactatatatatagtatcatcctaatgaccttttcatcatcatcagtgaaaaggtagagtaatgactaggaaattgtacttggcacagtttggattttgaagcattttatgacatgattatgtcagagaaacttagtatcatactgtacttatgctgttatagtgttatgcatcacttcatacttaactagtactagttaatggttattatcatattgtacttctctaccaaagaaaaggaaaggaaagcttagtgatgtgggctatggttcataggttgggccgtaagtgagttctgctcaagattgggctaaaaggaggcccaaattttagtttcaccactgaaaagcgtcactgaaaataattttatcgggtcatataatcaaatctttattatctaaaaaatataatcaaatctttacatttttttccatgaccgtgtcaatgttcttttttttgaaagaaaaagcaaatgttaagtttgggcctttaatgggttactactcaagatgggc

SEQ ID NO: 52869 - DNA, 735 bp, Oryza sativa
gtttggagttgatcgtaagactggaacattacttcgagattcttctaagttgtagactccctcatccattattctagtcttttgccaattatttcattgcttctttttacgttataatgcgatgttctggtgcttgcgtgcacgttctctccagccaaactcaaaaactcatgtacgctacatcccataaaatgtggtgtatgaactggccacattatcatttcatggagttggtatagccgtgtaggttgtgaactcgtaatgccatctccatctgcgtcgtatctcaataatgcaagaatgcaacctaactaaataataaaaataataataatgtttcactaatttattttcaactgtacgtctgtgcgaaagaaaaaaaaaagcttttgtggacaaaaatacagtaactagctagttttctatatccacactaaacacatcgaacatactccatccgtcccaaaaaaaaaaaactcaacatagaaggggatgtgacccctcctagaacaacgaatctggattatccttaggttgagtttttttttttgggacactgcttactactgagacaagtcctacactcctactagagaggcaaaacctttgctttggttatttaggaaaccatagttattatacttctgaccatgcaccacaggggactgaagatcttataggtggcaccggaatatttccgtgactcctgctgttttatgctgtcgccacatgggc

SEQ ID NO: 52870 - DNA, 1347 bp, Oryza sativa
  unsure (1)..(1347): unsure at all n locations
nnnnnnnnnnnnnnnnnnnnnnnnnnnnnnnnnnnnnnnnnnnnnnnnnnnnnnnnnnnnnnnnnnnnnnnnnncattatttcattgcttgtttttacgttataatgcgatgttctggtgcttgcgtgcacgttctctccagccaaactcaaaaactcatgtancgctacatcccataaaatgtggtgtatgaactggccacattatcatttcatggagttggtatagccgtgtaggttgtgaactcgtaatgccatctccatctgcgtcgtatctcaataatgcaagaatgcaacctaactaaataataaaaataataataatgtttcactaatttattttcaactgtacgtctgtgcgaaagaaaaaaaaaagcttttgtggacaaaaatacagtaactagctagttttctatatccacactaaacacatcgaacatactccatccgtcccaaaaaaaaaaaactcaacatagaaggggatgtgacccctcctagaacaacgaatctggattatccttaggttgagtttttttttttgggacactgcttactactgagacaagtcctacactcctactagagaggcaaaacctttgctttggttatttaggaaaccatagttattatacttctgaccatgcagcacaggggactgaagatcttataagttggcacggaaatatttccgtgactcctgctgttttatgctgtccgccacatgggcgatgacgccggcaccggcattgtgaagccactcattcttaacctgcattgcattgatgccatgaactccagtggaaatgaaaagaacacatttaatttggtcaaaatggtatgcagtacatactactaacatacatgtatgttgttatgagcaaagtaaggccatagtgctgtatggaagttgacatctactttcttccaaccgaccctctgcaagccatggatcatctcctctgttaccagaacacagaattgatgttcatagagtgagaaacaagggagacatcaagatccagcacatagtactagtctactgaaaaaggtcctactcaccttccatcatttcgtgatattcttcagtgttttctttgtttggtctactctgtgcagcttctttggctctggcagcttgcagagggaaatgagggccatcagatgatataggcgaacaatattccatattcacaatgtgcttgtagccatccagtgaacgatgtgagggctgcatatggaggaggaaaaaaattactgaagtattcacacagtgctgcaatttggtttctaatcaaattctagtggagatcactgaacacctttgtaaggtctttttctcttcttattg

SEQ ID NO: 52871 - DNA, 763 bp, Oryza sativa
caatgcgtgacaaagcaatgcgtcaagccgagttgcagacaaaaagcagctagtcagaaagaaagaaagaggtgatgctgacaagcattttaattgcacttttgttcttcattccttaatgatcacactaatacgattttgcatcgtttacatatcatgtcagcaaaagcatcgcgtctcttgacgccgccgcacccgagcagagcgtattcgatcaccacccgcgccaagagcgcttgtcgatccgatccggtgcaggacaacttcttccatcatcccggctgaggatgcttgctttgctgagctaattgcatgcaagagagcaattgaaacaggccaaggaagtcagagtgttacctagggacagtcggacagacagacaatccagatgtagtgagaatgcttgaggggagggatctcaacagatcagcttatggagccttagcacaagatatcaaagcgaaactcctcttacttcaggaggtaaaggttggctgggtccgacaaatcaggcgtcgcataagttagcgcagaatagaatttttttaccagtgcttggtttaatgtatgtaacccctcattcttagaggcggcttttttccccttattaaatccagggaacttcattttccccccttattttactgtagaaactagcaagtgcagaggattcaacccaattttgtatatgagaagaaaaacaatgcatatactctatatcatatttcccacttttatctcaaaaggtacaagttttaccctg

SEQ ID NO: 52872 - DNA, 2455 bp, Oryza sativa
  unsure (1)..(2455): unsure at all n locations
nnnnnnnnnnnnnnnnnnnnnnnnnnnnnnnnnnnnnnnnnnnnnnnnnnnnnnnnnnnnnnnnnnnnnnnnnnnataagatataaatagtattttatgtatgactaattttttcaaaaagaaatatatataatttttttaaataagatggacggtcaaacattagacacgaaaactcacaactggatttaaaatgggacgtagcaacaaggcagaggctgtactggccgagagtagccattgtttagttcatagtgggtgagtaaataaaaaaatgtaagtcgcaactgcaagttttaagatcattaagtcataaattaatatacattgttttccctcattaagactgagacaggaaaaaatcgatatataaccacatgttggccaatttggatggactctgattggccgtactagcgaactcactagttcctttgtggggaaatacgttatttgtcaatatctttttttccacgtcttgcgaattgcgatgtaggttcatgcatggcactacccaaatgaaaggagtagctgaccaggatgaaatacactcccaatggccaatgggcgttcgagtcaattgaccactcgattctatcgatttgttttgtccgagtaacaggaacagaacagcttgatctatcttatcgcccccatcatcccataaatggcttgattcctcaaaaccaaataacccacaaatgtctctaaaccagcaccagaacgtttggactttggagaggtccaaacctgaaacctgatggctttttcatgggtaaattgtacaaccaacgaccgacctgatcacctgaccaagtgaccatccttgatcaagctgtacagtatggagatgcacgggcttttttttcttcttcgcaaactctatctatgtacactcgaatactctcctctctccccaaattacaaacacaaaaccagacggctacgagtcggaccctgaacacagctcggcgcagcactcgtagcagccgaggcaggcgaacgccgcgcagacctgcgtcatcacgatggcgcactggtcgttcatcttgttgcaggccttgatgcagcacatgcagcagaggcagtcggcgaggcggctgcagcagccggcggccttgttgaggatctcgaacgtctccagcggcttcacgtcgccgaaacccgtgacgaggttctccctggtggcggcccggtcgccgaacccgagcttgaggcattggagcgggatccgtcgaggttcgtcggggcccttgtgacctttcagtttctgcttgacctgttcgagtaaacaggcaagttagttgggagttctgagctagcgtggttgtcacaagatccatttctcgtaaaccagtttataagcagggaccattggtattattataaaaacagtgggacttaccttttgtgctgcatctaccttctccaatgtttgaagtaggaccatgctcgtgtactctgaaggaatgctattttgaatgcttagtttcaccaccttcaaaaatcaaacgaaatggagttactgaaacccatatactgctaactgaatggaactcaaactactaaagaaagtaacatatttcaggggcaactgcaattcacaagagaatgtgacctataaagatttcaaactagttcagggaataaatgaaatggaaagcgaacatcaaaataatattcagcaccaacaaccacactagggctgagtttagttccaaactttttcttcaaacttccaacttttccatcacatgaaaacattcctacacacacaaacttccaacttttccatcacatcaaaacattcctacacacacaaacttctaacttttccatcacatcattccaatttcaaccaaacttataattttggcgtgaactaaacacaccctaaggctgtgttcggatatggggagttgggaactaaactccccgcacggaaaacggatcggtccattagcgcgtgattaagtatttactttttttttttcaaaaatggatcaatatgcttttttaaagcaacttttgtacagaaactttttgcaaaaaaacacatcgtttagtagtttgaaaaacatgcgcgcagaaaaagagaggggtgagctgggaactctgtgttcggcacaccaagttcccatctcctctccatcgtgtttcgtgcgcacgtttttcaaaccgctaaacggtgtgtgttttgcaaaaagtttctatacgaaagttgcttaaaaaaatcatattgacccatttttgaaaaaaaaagctaatacttaattaatcacgtgctaatggatcgctccgttttacgtgcgtaggagattggttcccataaagcccaagcgaactcaagcatttttcaatgtattgcccattaaatgcttaaatgcttcagacaagcaatgtgagaactttcaaacattaccgattatcttcactatatctcatgactccaaaa

SEQ ID NO: 52873 - DNA, 1291 bp, Oryza sativa
aaattcagtggaggtataaagcgaagaacatgtataatgcaacccttagccaaaagcctgaaacataaactcacctttctctccagttgcttgtcagaagaaagccatgccttcgctgtgagaaggccaatctgctgtgccgccaaaacctagaaatcataaataaaaaaaatgcatatattattagtatactcgagaaatctatggccccaagtatgatattgtgcaagtttctcaatggaaagaagagaaaccaaatgtacacaatagtgagcatcttactttgtcaaggggtatatcctttatatgctgcaccttaagttcaatcgagatctctctcatgtcagccaagtaacctttagctgtaaccatatctgggaacttgccttggtatttcccagatatacataaaggactttttgctgaaatgtctggaatgtattcagaatcgatctgaattggaggaaaggaacagtcagaagacaataaaactactgtttttttctagctactactagttacacctgcaaaaagcatacccacaaaccacccttccatacagcaaataattatttctatatacaggacaggctctttgtaggaagagcagtataagatggtatggcagcaatgaacacagcacacatacactaccagaaaaatgagttgggaaatcacaaatcaaatactgaaaaagagtcaatttcattatgaaacatgatcgcaatgcagccagaaccaccttgatggcattactcgtcttacatatccatctctacataaccaaatttacaatattgagtagttagtgatgaattaactcacttcaaattcatcaagatgtgctgtagcatcaatggagatgtttgcaactattgtactcgatgctttcctgaaccacctaagtacctgactctcaattgatcctgcaaaaacaattcaccaaaaaaaaaaggtttatgaagatgttacatggacttcataaaagtcatatttgtccaattaatgcatataatagaacagtattgcttagatatgaacttcaggaataaatccagatcaataacaataatgtattggtagaatgcccatgaaacttgagcagaggttgcaagatggagtgtcaacttaaacagcatgcagggatcataaagaaacagtgttacgtggaaaattgcaaaccaagagtacaactagctcttagattgcagagcaagaggatcccttcatagaaaacattattgccacctctaacaatatgaactgattgcagtttggtttttctattata

SEQ ID NO: 52874 - DNA, 1567 bp, Oryza sativa
  unsure (1)..(1567): unsure at all n locations
annnnnnnnnnnnnnnnnnnnnnnnnnnnnnnnnnnnnnnnnnnnnnnnnnnnnnnnnntcagcttggatttatgaagaaaggggatccaactgtaactctgcacccagtgaaattcaagcgcgcgcggaggtgaaggacgcgagcaaaacaaagtgctcgatatacgacgatcacagtctttcaaatattttacagcttggaagttatgcaaaaccattaccgctaactgattactgtacgctatagctatatgtatgactgcgctcaagctgtgtcaagtgtcaattatgagttgcccccggatttacgataccaactgatgatcacacatcaacacttcaaactgtaactgtctacgaaggaactgcatcctcctgctcccgtgtaaccttagccagggataattttcctatgaagttggtcgcaaggctgccgaggaagagatctccgttgaactctgtcaccgaagtgaccatgttgatcacattcccttcagagtcaccaagaaccctcacgatctcgccgttcaacgacacctgagccaccactgctcccttgagcgtcgccttggtcctctcgacgagcgccgggaacgacgcgatgaccctcctcgtcaagctccagcgagagatcaggtccagccatggagacctcacctgcagtttgagcacagaaaattgtaagtttgagcactgaaaatgttgtgtagatgcttatggcagcagaaaggttagagagcagagacctggagaagggcaatccagaagtgaccatctgaacccagccgaatgttgtctggattccccggcaggttgtccacgaagatctctgcctccagccttctcccctttcagccacactctcaagcatctgaacctgcacttgacaatatcacttcatggtcacttgacgatagagtgaacagactcttttttttatgagcaattttaccgttcttaaggagatacatgagatactattttttttctattttaatttgatatctctttatatctagatactataagataccaaattttatactaattttttttacctcatggtacatccttatgaaccgtaaaattactcgttttttattattattttagataagggtattttctatccagattctacatccaatcagatatatgcagccatttaaattaggaacttagccccacaaacaatccaatctgaaattcgttcctaagaagatttgcactcgtaaccttaaaatgttactcaggtcactgcacgtgtcatttcacagatgagaagttgagcttgttactacctcatcgtctcgcagacgacgacgaaggcctcgtcgggcggcagggcgacgccgttggcgaagccgaggccgtcgagcacgacggaggcctcgccggtgcgggggtcgtacttgagcaggcggccggtgaagcggtactcgaagaagtcgaggaaccagttgtcgaagctgaacctggtgctggcgtcgctgaagtacaccgtgccatcggaggcctcgatcgccgcgtccgcgaacctgaagacgacgaacggagaagaacagt

SEQ ID NO: 52875 - DNA, 1256 bp, Oryza sativa
ttaacacaattgcacaaaagaatgtttaatggatttctgtggacaatcatatattcattgatttccattgttgtttggattgacagtctacacaatcctttcctttgtatattgctattttaagaactatatgataccccttgcattgctgcagtacgaatgaatgaaaataagctgcagaactgtgatgaaacaataagatggagaaataatattaactgtaaacaaaatagttgtagaactactaaattattattagagtccataaagtggacattgtccgctcaaagggatgggccaaagagggggaaaagtgagatgtggagtctaactgggccaatccactgtatggccctaaagcggtccttgtagaacagaacatcgatctaatttaatggttaatactatgatccaatggctgaaataattttgatggtatgattaacaacagaggcacctttttgttgtataagtatataaaagaaacattacaaagtacgatagtttccaaagtcctgccgttattattcctcagagaaatacagctaaaacaggacagttaccgaaaaagggaacacaggtgctacagttactattagagatcgcaatagcttgcaaaccaaataaccaggagacagggacatgatatacttcattatcaacgagcacctgtcgcagtgcaattggaatacatggaagcaccgaaatgcgtaatatctcaaccatacggtggagaaatgatatgatctgtatttcagcattgcataagttacaaattggttaatcatccaagcagtaaattgcaaaagatgttgataacagttacttaccttagatcgcaggggcttcacattaggaaatgagatgaggacttgcaaaactacatcaagggtctgagaacaatacgaaaaaaaaatcacatacgaaaaatggaaattatgcacatatatgataattaaaaagcatatatatacgtggaatggagaatgacagaatgtaccttcttgaacataacgccaagtgtcggcctgcttcccatcacaagccgttcattaaatccctaaaaaaggacagcatccagacacagtaagatcaagcattaatacttgaggcacttgccatatacagaaccaaagatttggcatatgagcgaatcagaacgtttttttagaaataaaatgatatactacgttcacggaatgtgatattgccaactcctcgtgatgtgtgaggatgaacagcataccttgctgatc

SEQ ID NO: 52876 - DNA, 1368 bp, Oryza sativa
cctgcttcacctagtaaccttcactctttccattaattctttgtcagtctaccctggaaatcctcgactagtgtctactaggcactagctagtcaactgctagttcccagagggatacagcaatatctgagtgattcaccgcagatatgtcacccatcagaagttgaccatcatcagttactaagagcacccgcaatggtaaagtaaggtgctatctataaaacatgtacatctcagcaatagactcgattaatagtaaaccaccttaatagtatgtctacattggtatctatagctctctcatgcattgtctcgtttttctctatagactatctctaagttagtagatagctttgctctctctcttcatttaatacattccaagtaggaaaatatgctgacatgaatctcttatagagagcctatagataaccattgtgggtgccctaacaccatagattagtagtagataatctataggactgcatgcaatgcgatgatatctaagctcggtgtagattcagaaaccgcatgttcagatatatatgcatttcttttctagccgaaaagcgacacgggattcaggaccacatcgcggcagcttctcgctgcttctctagccttcattctagaactccacacacacccagatgtgtactacttttattttgttcatcgatccaacggtgaatgatgatgggtgcctcttttctgtccagacattcttcaagagtcagagattaatgaatgcacattaatctggactattagctcttgataacaaactctaccagcatagtatcatgcatagctcctatttaagtttatctctcatcttgtggatccctaggatccttcctcatctaacaaagaccaaatgtctcatgagagaaaagggcctcttcatcaatcatccaaatcaagtactccatccgtcccataatataagggattttgaggttttgcttataacatttgaccactcatcttattcaatttttttttcaaatataaaaaacaaaaagttgtgcttaaaatactatagataataaagtaagtcacaaataaaataaataataatttaaaaaaatttgaataagacaagtggtcaaacgttataagtaaaaactcaaaatctcttatattattggatagtgggagtaccaatgtattttagcatactagtagtctactagtagagtacatatatggatatattagtacatctgaacataagatacagtacataaatgtacacacacaagtgagtagtgatcacatatatattcaatggcacatcggcatttgccaaaggtgtagaatgttgcttggcagccactcctggccacctttttttcccaaagttgg

SEQ ID NO: 52877 - DNA, 1383 bp, Oryza sativa
ttcggttacttgcaattttgaagctgtgcattggcagggtagttatcaatttcatacacaaatgaaaacatagggaaaaggccgaaaggctaacgggcgatcgatcgctgccagcgatcgttttttttttcttttcctctttttagtaagtttatacctaaagtttacacatctaaactttatccacctaaagtttgtagagcgaatgtgtataagtcaaaagtttatatacccgattcaaattcgaattcagattcaaatattttatataaaaatatttctatacacaaagtttatacgtgcaaaatttatggtataaagtctatgcacatgaatgagagtattagattctaattgtcttttacttttttttgaaatttatgatgtaatagaaaagtttttgaactcgtcattttgacggtttgaaggatagatatatgaggaaagatgatacaaacaattaaagttctttgattaatataataaagcttttagaatgaccctttttcctaggggctgttagtgggcgggtaatcgtttccctctcctcctagcgatcatacgtccctccctctaatactcctctttcatctctctttttttaacaaacagtgcccctaattgaagtactcagttgacacttgacagtgtacctaccagtgtttaaactaatcaactccttcttaatcacttagacattttctgtcccatatctgctagcacgctcctcctcctcacaggctcacacccgtttgtactcttcgccggctttagcgtacacgccagagtccgtcctcagtatgatcttggcgtcctgcgtgacgtagcacgcccagttgtccacgtaggacagcggcccggccctgatcagcggccgcgtgtcctccacgtcatcgtcctcgtcattgtgctccgtgtcatcctcacactcctccctcgagtaggcgaacctgcttgacacaccacacgcacacacccacgagtcggtaaacttttgttcatattgatataagatgatgggctgtagtaatggtgagcagtagtagcatgtacctcattgaattttgtgagggcgtccataggatgcagatggtgcagaggaggaagaaggagatgagctcccacaccgcggggattacccacgccactcgccaccgctcgttgtgctcatcagtcgtcttaaaatggacctgaattttgattttagaatttttttcatacattattttgaagtgctaaaagtcttcttatgttaattaatttacgagcttgtactaatgtaccacatgaacagttagtgtcatgacgataaaagtcaccagtaatgtggacgaaaacaactaaggttgtgtttagttccacgcaaaattggaagtttaaaga

SEQ ID NO: 52878 - DNA, 996 bp, Oryza sativa
tggactaattcgcgagacgaatctattgagcataattaatccatgattagcccgcgtgatgctacagtaaacattatctaattataaattaattaggcttaaaaaatttgtctcacgaattaactttcatttatgtaattagatttgtaagaagactatatttaatactctaaattagtattaaatataaagttaagtccctggatcctcagttctctgaagttgctgagccatcagaaaacagctaggactgcagcgaagttatacctcaaatgtgatccagccgagcgacagggccacggcgatggtgagagaattcgcgaatttccgatacatttcaagcttcgccgtcatcctcctcgcctgcaagaatcagattaatcacagaattcattgatgattctcgaagaattattcgaattttggtagaattttgaaagtgggaagttcaaatgatgctaccttgagcttgctgatagttcttgacagcgaggtgaagatccagtagatgaacaccgtgttgagggcggcgacggggagaatgaagaagagcctcctcgccggcgagtggtcactgacgatgccgacgttgtcgccgacgtcgagcacctccgccgcggcgaggaacgcggcgccgaggcggccaccctggcgttgccgcagcccagtgcgggcctcgtcacgccgtaccccatggccacgagcagcgccagcacgcggcacgccgcggcgcgcacggcgcccgacgtcgccgcccagaacgtcgtccccgccggccggacgcccgacgcgtcgaactcggcgaggtcgaggtaccaggtggtgacctccaccatgcccagcgcgatggccgccgtcacgaagttctgcatctgcgacacctcgcgccagaacctcgcgtaccgggcgaaccatagcgcggtgagcgcggcgaacgcctactacatggcgccgtacaacggcttgagcggcgccatcctccccgggaggtagccg

SEQ ID NO: 52879 - DNA, 1979 bp, Oryza sativa
tgtgggcaaatgtttggtaccttgagcagataaacatcgctcctgggtggagaagacctaggggtttgagaagagcagtgatattgtgacaagtttccttaattcctcttgctttgtttagtggcagttttacttgtggactaagggatgaccgtgagcttgtaatgccagagctgaagttgaggttttagtgacgtgccactggggttttagcggtttgaaagccacgtgtgtgtcctctcctgattacacttacaccatcactttcttggtcatgtcaagtcaacgacgatgttaattaccgcaataagaacaaatctaatactcctccgtcccaaaatataaacattcttagcatagtgacgagtcaaatgtttttaattttaactattaacagcaaaaaaataaaaaaaaatcaatcatgtaaaattgatattagtagatttatcattagaaaaactatcataatatttaactttttttatttaaaacatcttacttttatagatattgttggttaaaatagcatctcagagaccgtgttagagtaaaaaaaaatgcttatattttaggatggagggagtagttatctacattcactctaatagcttagcatataataaatttataaatatatattttactatcaatatttgatcacctcgcatacacacgtaaatacatgatatattgaaatccgtgtgtcacagctgactatatctatagctcgtttttctcctctctacgcttatctcttcttgacatttacttgtagctaacatatagcctgttgtcttaaaaaaaacatatagcctgtatttgctacgcgttgttatatttctaccggtaccactgccctgagttcttgatttgtagcataaggtacaatatttttttcccataaacgtgatcattgaagaagaaaaaaaagggatattgcagatgtgctgactgagctaattaagaataagatattcaggcataaaccaagttagctagtgacttttgcatgcatttgacatgcataagtccactagcaaatatctgcagccaaaaatcatcctaatcctaataatcaaccaaaaaagtccaaaacaaaaggaaaaggtcaaaaggtactcatcgcaagcctgcaacaagtcgcacagcaagacagaaactcacaccagttgggcaggaaaccacatgaccgtgtgtactgcatgccccgtttggctcacaacctaaccaccagcacacgcctaattagtttaatcaataattaccttaccttgtttttgctttcagaattaagtgatcgtctcgtctaagcttcatgacctttacgcatccgatcgagtgacaagagatcaattggagtagttataaataagcgtgagtattataattaggagaagttttactggtgtttttatttcaaaaataaaaaaaaatcaacggtctaaaatagaagtattatataagggtatttaagtatcgatctaacagatgacatggtgaagggtgtcgacaaataaccatattttactgttgattaccctgttgtcattatttactgtaattttattttaaaaatggaggattttcccatataactatataaaccgatgttcaatgaccgaacgaaaatgggaaaagtttcaaaaaggaaaaaaacttttcgccttcaacggggcttaattcaaacagcccaactatttgcctctgttttttacgtgatttttcaaatgttcaatttcaaaaaaaaaaggtcaagttcaagcttgacatgaattttgaccttgtttttacatgcattttaaaatggaaactgaagttcaaaacataggggagaaagcaatagcctagcaaacaaaaccattttccccctccaattggacctaatttgaaacaacacccaattgaaaatggaatatgtctactttgactcccttaactagtgtcttaacctaatttgtatctttaaaccgtaatagcgg

SEQ ID NO: 52880 - DNA, 2254 bp, Oryza sativa
acatggggcagttgaggcgctgtgaggattaaaggaagttcagcctggggcccctcctcgcttgctccccccgccaaacggcggctgggcgagggcctcggggcaaagcagtgcaagggcccgaggggcatgacgtggcaccccgaggccccgacaccccggccgctcctgcggttcgtggaatgcggggacaggaccatgctgtagggacacgtggtaggatggaaaggtagattcccctcacttcgcatacccccgggcccatatctccgacagtttagggcttagggtttaatagttggagagtcgagatatccggtactgcgattcaagcatacgaatcagattcggcccaataatccagatgccaataggacggcccatcaatccagatgcaatacgacggcccatcagatcccgtccccgagaaggaatccccctcaccgttggatccgatccgacggctgagaccagccacacaaaccctcaatatatattcgctcgccccccgctgcgtctcgccgctcctacaccgcgccgtcgccagcagccgccgccgctgcctctcctcctcctcccctcgccgccgatccaatccggtaagcctcgccgccgcaagctccccctcgtccctcccccggatagttcgtcgcctcgtcaggcatctcgccgatttggcgccgttctgttgttctgtttggtggagccgtgcgcgagatttccggtgtttgttgacctgtttagctctgatggattcaccttgtgttagttagttttccgtcgaatggtgtggcgattaggtttggggggattggttcgtctgtgattttgtagctagattttttgaaatctagggtagtgtgagtggggaagctgctggccttagtggatacatgctgttcgtggtctcctggttcttgaaatcatgatgagttagtgctgtttgaaccttgaagcaaagttttaagttattggagttcctgtgcttagatttgtatactattagtgaagagatgcatagctgtactgctgtagtggatataggagtgttgtttttgatttgctggtgctcttccatagcatccggatgcggtgttcaattgtgtagttgtttatgtagttcaatgcactagaagcttttatttctgaatgcctagttattagttgggtatgaagtccaatgtgtgaaatgctgtcatgtttcaacttttagttaagatatgaaacttgagaaacaaatgaaaggtttagattcagtactgatgtacaacttaagtaacatctatggttgtaaattgtaccatgcattggttattgtgaattagctcttttggttgattgaaacaattctctatgtgccaacaggtcactttcagtcttttttcttgagggggagatggcggtttctttcaccaacgttagctcagaggcaggcctcaaaaagctcgatgagtaccttctcactcgcagctacatctctgggtatatgatcagtgtccactgtccaccttattttctgaattgccatttatgttcactggacttaaacccttcaattatctgtttccaggtaccaagcctccaacgatgacttggctgtgtactctgcattttcaactgcgccctcttcaagctataccaatgttgctaggtggtttactcacattgatgcactcctacgtctgaggtatgcatttttcccctttttttattctcttacattttatgttcagtgttgtgaattttctgaatgttgtatttcagtggagttactgctgatggtcaaggcgtaaaggtcgagtcgacagctgttccttcagcttcaacccctgatgttgctgatgcaaaggtcatacaaccctagccttgtcttgtttgcctgaaatctgtgaagtgttctagcatagtactgtgaattgtgatttgatgctgtttgcaaattacgtttttgtggttcaatggtgctggttaccatctctaatatatcatcatatcttctaatttcaggctcctgcagctgatgatgacgatgatgacgatgttgacctttttggtgaggagactgaagaggagaagaaggcagctgaggagcgtgctgctgctgtcaaggcttctggcaagaagaaggaatgtatgccatcctgcattatactataccatttttatgcaatgaataatacaattattcattttattttattctcatctgtagctgtaaattaagaccaaatcatcactattcattataatgcaa

SEQ ID NO: 52881 - DNA, 755 bp, Oryza sativa
  unsure (1)..(755): unsure at all n locations
cgatcctatattattctttaaatgatgatgcatgccatatatattattctgtaaatgataatgtcctgatgtttcatatctagatacctcatttgctgcacattactctctttattcagtaggcttagatacctgatttgctgcatattactctctttattcagcaagttgctcatatctagatatctcatttgcagcacatcaatttgatttcatatggtcatgtaaatttcatctgccttgagccatccttgttcagaactaatgttttgattatgttttattgcagagatcttccttgagtcaggtgatggcgatcggtgcacaaagataaaaagaaaaatccggaagtttgaattaccgttgatacttcaatctagaagtttgaattaccattgatgtgtcgttcgtggtgtcaactagtacttgagctcgttttgtgttgagattgtagcactctacttctactgagatcgntttctcctcctataatgtttaaagaccaatcaggttattattactgtgtctggctgtgtcaccatagcggcattgntggtccatccagttttgatgcggtcttcaattctcccgtctttcggctgtggttgattgcttcatcgtttttgcggctaaagtttttctgctcctaccaaaactgtaggggaaacttttggtgtgctgtctgttctatctcttatgcattgcacagcctggttttttcgctcttctgaagtatagccctgtgcgctctcatc

SEQ ID NO: 52882 - DNA, 1603 bp, Oryza sativa
agtcactaaatatcatggctgttaaggcgtcgctatggcatcgctatagtgctagggcaccctgagggggtcaaggcatccctccgccttagggcttaatgcagagagggagagggagaggtgaaggcggcagcaactacacccttttcccttttctctgctccatgtcatcaccattttgctcccccttagctctggtttccactctcttctctcccctgcgccagattcatcttgactcaagggagcagccgccagatccatccaagggaaggagcacatacagagagaagcacttgattcattctgaatcagggggaagggagcacagatagaggaatagagctagcatgattaagaagagccggtgcgaggaagaagcgatagagccgtgaggaagaaacgacatcgggggcggcgctgtgagaggagagacacacctggtgcgggtgttagggttatttctttgtctttgggctggtatgaaggatattgggcttttgtgggctggcctgctaggctggttttcttctgatcgctgctaaccacataggttatggcatcgccatgccttagcgttttactgctatagccttaccccttaacaaccatgctacatatatggcaatcatcttgatatgataatgttcttggcttattgcatagttagtgcacactatgttgtagctggcttggttcttcatcagctagtatgccccatctgaattgctaccttttgtctactttgttcatgccaatttggctaatctatgtagccaggcttttacaggtatttcatggattgcgtagttccttgtatactgtattcatgccaattttgttcattgcaggaaatgcgtgagctgcaagagctggaaaagagattttacgcattcttgcttcatatagcaacacatgatctgtctacagttctcctaactcctagttgtaggcattatctagagaacataatgcagttgcttttgattacttcatgcagccataaagagatatcacatcggaaggtggggtttaattgatcttgaatttcttatttccacttcaagcgagttacattctccatctccactttaaatagaattgtctattttatactcggttattgttttgtagacatgcgtacagacttttgtcaaccttatcaaagactggtgtagtagctctgaaattgaagataaggtattgttgtgttcagttcttcttatgtcatgttttgaagagtctatctagtacttgggcagttgcattactcataatgtcatgtatttcttgttttcctcagcttcctggcttccgagtgtttatgattgagaagttcgctactggttgctgtttgcagagtgtccttgacaagtcatttaacttccgtgatggaatttcggtaggacctgtcaaccatacaatctatatctatctaaatttctcgtacctgttttactgtgttaaatgtataccatcaagtagttattatactgtttgtctattgcttcattaaattcttggtaattttattaatgtccgtcctgatagggtttataggcatttgattgtgacctccagcctataggtgtccgattggagg

SEQ ID NO: 52883 - DNA, 790 bp, Oryza sativa
tttctcgtcgagtaatatcactactattagtttatcttttcaacacatgtgtttgatgagaacaataagataatatggtaataccgttacctataataaagaataactgttagggatactggtaggtcgaccccaaggcttgacccaccatcagggtttcttaaaccgccggggccggggttaccgcgccccggcggtaagcacggttaccgcggtaaccgtgaaaaaccatgaaaaaccgtgcaaaatttatcaaaaattcaaattattttttaaatttatttgaatttaaggaggttaccgcggtatttatattaccgtaccccgcgataagtccggtaaccgccggtaagggaaaccctgcccaccacgccccccgtgctagattatgggtcatgggtcatcttgcccccgcaacgttcctaggcagttgacccatgggtcgacccataacccaaaagttgaataagcatatgcatgagtactggcactgcaaaaggttcgatctcgtctagttacatggctttcatagtggcgatattgtccaacttgtcgcccacaacgccgatgcccctgatcctctggagcaacatcttgattttgtcatagtctatgccttgttggatctctagcagaaagacgatgctagcaatgaggaacacgatgaggacactgggccgtcaagcaagcactactaagagcctctagcctcagcctcccgtgatcttctctatggtgaaattcacaaacatggtgaccggagctccaagagacacatgttgaattggat

SEQ ID NO: 52884 - DNA, 2282 bp, Oryza sativa
  unsure (1)..(2282): unsure at all n locations
tatagggcgaattcgagctcggtacccggactagtctaagaaccacgtggatcggatgcgttgacaggtggatgggatggattcgatcgctatcgagtttttcgtcacgacttggctcattgctgattgggagttgtgaacacgtggcaaccaaaaacgtaggtgttgttgagattttagataaaataaacctttaccttaacaatgctatcaaaattttgacagaaatgtttatatgtagaccaaaatttggcaaaactaaactaaatgtgtacataactagataactttattaaaaaattgtatagtttaaaatgacatccatatgaacagcctcatagttgtctcgtcacgcgtttatcccccatcgtgtcacaacataaaccggagagcgtaagagcatgtctaataggccaaccaagatcggcgatagcgtgatcacgtcagtctcactgatatgctggaggagggaatggtagagcgagaacacgagtcgacgaaagaattatcaccggctgcaacacgcagtacaataaagaaaaagaaataagcctgatggagattggttcatgcttaaaaatatattatctgttactacaaatgatatgatagtaataaagaccattgctatatgagcagcctatactaacaggctatagatgatgtggttgtcttatagtcagcaagttgacgatattattaaatctgctttaacaagcgaaaacgttccccagcctcgcggccgccggctgcaaggacgcaggcggaggggctttctctcccgcgttcacggtcaatacggtcgggacgtcggccccggtaagagctcagggccatggcgtcgaccgcggactggcggcagtccagattcgggtgctggggtgcccggatccggtcccccacggacggacggcggcgtcctggtagctcggcgccgagttttggcggtgggtttggccggtgacgacctggcgggagacgctgctggagctagctccggtagccgagcacgaaggcgtggccggacgacgggtgtggtggtggaggtccgccgagagccggtggtgacgtcggcgatgcgggaggaggcaatgacgtttctagccagatctagctggcggcggcggcggctgccgacggcagcagtgacggtggcgacggctgtggcggcatcgactgcgacggttggctggcgagccaacggccgtggtggttgaggcgtcgtggaggcggtcgtgcggccctcgtgggtggcgaggcctgctgtgcaggcgtcgtggaggccggcggcgtgtggttgtcgtggaggccagcgtcgtgcggcagcggncagggcgtcatggaggccggcgacggtgtggagtcgcgaccggcgacatcgggtgctggtggctgcaggctgcgatggcggacggcttgtggcattggccgtggcgaccgtggacgtggctgcagtggaggaggtgaggatggcgacggcgaggtggctgggcattcggcatcagcggctgcggtggcggtgacctcggtctccggaggcatggcggcttcggacggctagtcgagggtgtggcagacggctgcatctggccagcgtggcatcgtttggaggaagtagtcgtaggccatgcttggcgcagataaggcgcagctgatggcagcggaggccgactcagcgcgagaggcgcgggcggcggagaccgaggtcggcttggcgtgagaggcgcagccgatggagggaggccggattggcgcgagaggcgtgtccggtggaggaggccgacttggcgcgagaggctcggccggtggtggaggaggcgacctcggtgtgaggaggagctgccggcgggtgtggcgcggtcttcggcacacgaaagctggccggctggggacgccggtgcaggggtctcacatgtcggcagagcttgagtggtggtggagcatcggtgcgtcagccgtggattcgcagatggtgagcggcgggtgaaaacctagcccggccttagccggaccgacaacgacggttcattccccctcctgagggcgttgtcatgctgtctcacccctcaagagtggttgccgggtgaaagccatgtcttggctcctctgagccccgacggacggcagcaacggtttttctgtcacttctcttcttgaagacgttgttttggcatccctagggggcgatcttgtatgtgttcatttgttggtctaacggcggtcggtcacgcttagcggcggccggttcggtgctagccttcttccggattgtgtgttggcgc

SEQ ID NO: 52885 - DNA, 1773 bp, Oryza sativa
ttttgcggcatgtatatgtgcctctcgatttgcagttttgattctccattgagccgttagttctattgttttcttcacagggatgctttgtgggttttgtaccttattgtggactgtgctgttggaatggttggtggcaacattattcaggtgtttgcttaacccagtgtttgtccaagtggaatatgttctcttttttttttttgttcatatggttcgtttgattgagttgtcttgaggtggttgaccgcaattcatggcgtgctctgcactaaattctgtactttctttataactagtttatgaattccagctgactaaatggatgcctttggttatattacaagagcaattttcagtaaaagtggcattaagcaagtgaaagtaattccttgctttgtcctatggaaatcaaacacaagaaggaatgtgctggtttagcagagtggtaacctggcttgtgtatcaaaaatgaggcagctaggaagaagaaatatgttgatgtgtactgaaatatgttgcttcgtgtcatttggaaacatattgtatagcttgttctttacttcagcatctagaagtacacatgatgctccattgctccttttatgtctggttgtagaatataatggcttgcagaatggagataattcggtggtgaagttatttgtcttggatgactatagcatattattcattggtgttgggtggttgttatcttgcctagcgaagttgattaacaacaacttggaaatttgtaataaataactcacatacactaatatttgatattttgaaacatctgattctactttccatccgtaggaaacatcaccattaaatgaacattaggcatctactagtatattatgtttaattatgttatatgagttgcattaatttccatgtttgtcttgttctcaacctatgaacggtttggctaatagggttcaattctaggagccgaggttaccgttggaagaagatcatataatactcaagtaattgaagtagaagatcacactacagagaatgctccaaaagctgatagtggcggactcttgaaaccccaattattttatttgacaatatcacaggtacatgctaaatgcagaactgtcttttgttctcttctttgaacttttggaattggagtcttactttgaagattcattgccatcttgccgataaagattgagggtggggcggatatttctgccacaatcagatggtctcagaagctacactatgacaatggacgattctcagtggacataccgttccgttttccatattatgttaacccattgccaaaagtattcatgaaaagggagaaaattcagttgactgtgaatagtggtttcagtaaagaggttttactgcagggaacaagccacccattgaaggtaatcatttttttttgctagaactcttttgatttccgggcaattggcatcagtgcttttacaacatttaatcttcaaaagagtttcccttactatttcaggaaaaaggtaggcagggtgagaagttgtctttccggcatgaagcaactgttgagaattggtcaagcaaagatttcaatttttcatacagtgtgagtttcccttttgtgatctctttattagctgtaatcggtagtcacttctttaagtagttatgagctcactagttcctgtgataatctgactttccaagacttctcaaatttttctttttttgtgagcatatgttagttgcagatgtaactgaaatctggctcgagaactgtttact

SEQ ID NO: 52886 - DNA, 779 bp, Oryza sativa
  unsure (1)..(779): unsure at all n locations
ctcatgatgtgcttccacaaatctttcttatgactgatggatcagttgatgatgaacataatatatgccaaactgtgaaaacggagctcatcagcagaggatctaaatctcctcggatttctacttttggactaggtaatgttaaggagagcgtcaaatatacaattatctcattattcaaaactcttgacttatctcctggatcacatgaaaattctcctccctactttttgcaccaacgctcatgtatttctctatctccaaatatcctttcttgtgtaagagaaaaatgcttacaccataagtcaacagaccagtcagtgtggtgatatatgctgccagcttgtgatgagacgaaccatattttaattactctgctgttttagttttgtactacttcgttactgattgcttacagtttacctgatatattctttttgctcttttcattttatcactggaataacaggtttgtattgcaaccactatttcttgcgcatgctggcatcaataggcagggggcattatgatgctgcatttgagacaggtaccaagcccctaaacccttttgttctcatcatagcaaacagtatgctcttacctttatgttggtctttaaacttgaaggttagaaaatgatctacacagtctaccctttctccatggatttcttagcttttcctgagacacacgatatatactgttatctcaaccacattataatagaaaaaccaaactnnnnnnnnnnnnnnnnnnnnnnnnnnnnnnnnnnnnnnnnn

SEQ ID NO: 52887 - DNA, 1177 bp, Oryza sativa
  unsure (1)..(1177): unsure at all n locations
nnnnnnnnnnnnnnnnnnnnnnnnnnnnnnnnnnnnnnnnnnnnnnnnnnnnnnnatttcatcagttcgtatacgtatgtaagtgccatcaagtgtgttttccttttaatggtgtgtgtccttttttttttatttagaaaacgaactgaggcaactgtgcctcagagatgctcgggcctctcctatgcactatgcatgcttgcatagcttatagccgtatattggctatgtataggttggtgtgtccctgttagtgattatctgtttgtttcggttttatgcggcttgttgctttgcatttttgcttcatgttcttagaaattatatacgtgtaggtggataatgtgcaagataaagtgtatccatcatgtatgtgcccttagacgatatcgatttgtaaaatgaccttcacgtgcttaggtctcctctgcttgaatcgtcttagaaggaggtgggattattttatcccgacgtgccctcatttcgtgtatatcgactaaaacatcgtttttttttcaaaaagaaataaattgacgaaatagataaatatgtaataatataataactagttgggtggcccgcgcaattgcgcggctagcacgcaaacaaaatcatatatttttccgtatgacatttacttaaaatttattaaatagctatcttattgtcttaagactttgaaagaccaaaccttatcattccggtatttctaattatatagtttttaaaattcacaccagctgctaccccttacttctgtcatatccttctttatttgcttgctcgatctgccattatttctattcattctccttgaaacctctaaaaaatggatcttatagtttttagagtttattgtctcgttaggttttgtttttataatttctataagttccgtcaaacgctgccattatactcctctacggcccatccactgtgttttctctttattgtcattgcgattttaaaaatcgaatataattattgttcgggttcaattttttactttctagaagtcccgccaaaccgtcagcggctttactattatatttctttatggcttgcccactgcctccattctttattgtcattgagattttaaaatcaaacatgattatcattggttttttttactttttagaagttctgaacctttaaaaattggatcttgtagttt

SEQ ID NO: 52888 - DNA, 1465 bp, Oryza sativa
  unsure (1)..(1465): unsure at all n locations
ggctctgcaactatactcctatacactttgcccgctgcttcttctttttattgtcattgagattttaaaaattgaatatgattatcaatggggtttattttttgtctttctagaagtcccggaggctctgcaactatactcctatacactttgcccgctacttcttctttttattgtcattgagattttaaaaattgattatgattatcaatggggtttatttttttgtctttctagaagtcccagcaaccgccttacccgtttgcttcacggcatgcctgtcgtccctccttttaatcgttattaagattctatttggtgttttattaacggtttttatatgtcgtatcaaccgccaccactctacttctttataggcatgttacttaatttatctcgtcatgtgttttacatgggtttcttttaatagtctttatttttttatcactaattttaattatttataaattatattcctaaatgatttttttctttttctaattaatcgtgtgttaattgtttaatgacgattaattgtatatgtgcagcagtgtaagctttgtttatttgacagcacaactcttatccgtgtaggtttataattgaattagattatacgtgtactgtgtacaccgccaaagaaacagaaaaggaaagactcctagtatgtaacgtacacagtacatatatatggacttatcttttctacaacaaatctatacagttaaaatctataattgaatcaaatgttttaattaatctcgtattgggttcttatgtggactcctcttacaatattgcttatttctaatttcgattttcagttattttttagattgtatttctacgtggactattcttttctttttcttcgattaatgtgtgaatttctagcctccacagagaacgtggtgccttcttttcgagctgtcttaataatataatagatggacaagtatgcaagttcagacgtagaaaaactaacaaaattaattaactgtgaatagttagcgcatactatttacaattaaatttgtttttctcctaaccagtcgtgtaaatcgaatgtgaacttatatatttaccttttttagataatgtaaatggataacatatccgatctctgcccgtaagcacacatcaaaaagtatcggaagtaaaaaaaaaggaattaaaaaaaggcgtgatgggacaaacccccaacttctgtcaataaaataatctaccaaaataacattttcaaaatcacatagattctattacaaaattttataggcactatgctatccaaatagaaataaaagttcattggctatcaatgccgagcgtgtagcatcattgcatatagtatcatgttgtttctgtgaaagcatcatacaccaagactgaagccagtcctcataatgtttaacatttttttatgttcaaaaannnnnnnnnnnnnnnnnnnnnnnnnnnnnnnnnn

SEQ ID NO: 52889 - DNA, 1026 bp, Oryza sativa
  unsure (1)..(1026): unsure at all n locations
tatagggcgaattcgagctcggtacccgtccgattttgcaggagaagactttgaggaattccaaggccagcaagacaagtcacacaaatcccaaacaaccttttgagcatgttgatcccgtttaaagctattgtttctattcaactattgcatttattttcgaatgtaattaggtggaattcacctattgtttgttatggcccttttgttcttgattactttaatccttgataccttaggctattataatttgactagttgagctttatatgatggttcagctagatattagacataattgctttgtcatgcttagaagcattagttcactacggggataacttatgattcactattatttaatgatggattaatgatagctcatgatggttaatcatgaatggttaattaattaatttgccaactaaaacctgataatggtgggttgtgagcacatggttttgatgatcgtgctcatgacaattaaggaccggttcacgattttcggctgtgaaacatttaccatgccaaccacaagccagcgtgggcaacggctttattttctatatagtatggttcatagtagagcaccagactgtgaagtggcggagataagcccacgggggtcgctggggagtccataccttgttcataagggagtgattatgatccgggaacggtgcactgctttgaattgtattatatagagggtattgtcacaatctctattcgggtacttgtcaagtatcgtgacgcatggttgacatgatgttgaggttgtgtgttgtgggtacagtggtacacctctggccagagtttgaactattcgaatagccgtgcccgctgttatgggcgggtctaacaatgtctttcgtgattagtctcacactttacactctaataaatgacgatgttaatgacttgattagctcctggtttggaatagttaattcctggtttggnnnnnnnnnnnnnnnnnnnnnnnnnnnnnnnnnnnnnnnnnnnnnnnnnnnnnnnnnnnnnnnn

SEQ ID NO: 52890 - DNA, 744 bp, Oryza sativa
  unsure (1)..(744): unsure at all n locations
nnnnnnnnnnnnnnnnnnnnnnnnnnnnnnnnnttgtgggtacagtggtacatctctggccagagtaaaactattcgaatagccgtgcccgcggttatgggcgggttgagtaatgtttttcgtaattagtctcacacctctcacaaataattattgatgcaataactggtaataatttattttgctcctggtttggagttagatctgtacagccgggtatggttgttcaggatggttgggcctgagcagcatgggtgctgctgttcagtgttgattaaaatttctaattaattactctattgttttactactcttaactctttgctaaatgctgcttttgcaaatgagcctatattatgccatcctttggtatccttgtgcacttgcatatttgctgtgtggcttgttgagtatgtcatatgctcaccttgcaataatcatcaaacctcagttgaagagaaaggatccagaaggagaagacgtttggcttataccccagttgagctgcctgtgggagtggagctgaagccatcgctagaccgttaattccgcagctgtttttcttttcttttgtaagtatgtaacgttattattatgatggatttgtatattaaattgtcagtttgtgtacctcggctgattcctggacgaggattttatgcacaaattagttcggaaattacttgtgaatttccgggcgtgacagtctatataaagcacccctgttccctcctctctcttttt

SEQ ID NO: 52891 - DNA, 1738 bp, Oryza sativa
ttttataatttctagaagtccctaaaaaaattgattttttgtcaaattttaattaatatcgtattgtattcttttaatatttttattttttattttcaaattcagttgtttcaaaattgtatttctacttgaactctcttttttttataattttggatattgttttattttttttattttgaattttaattaatctcgtattgggttcttatatggattcttctttcaatattgcttatttttaattctgaattttagctaattctaaattgttttcttacttgaactcttctttcttttttgctaatttcggattttatttttatttttattctcaattttaattaatctcgtagagggttcttatatagactcttcttttaatatttcttatttttaattccgaatttcagctattttaaaattgtattcctacttggacaatccttttcttttctaattttggattttattttatttatatttcaaatattgattaatctcgtattgggttcttatatggaaacttctttcaatattgcttatttttaattccgaatttcagctatttttaaattgtatttctacttggagtcaccttttctttttttttatttttcttcgattaatgtgggaatttctagctcccacagcgaatgtggtacctcctttcaaagctgttttaataatataatagatagatagattgttcaggtgatatatgtgttgccacggctcatgtttctagattcacatgagcatgagttaagtttgagatgttgtagatctttagccattttgtcaagtctgctaaatgtgtaacacatctggtcgccgccttcgagtggtttgatgggcacatctcaggctgaagttgactgccaggctaaaggctcagcattgtctccaatattattctctcgaggcgtcggatgtttcattatgcttgtttgatgacttgaattattcacttcatctctcaaatataatggaaggtccggagagcctaccacaatcacataggtattgtttcaccttgtgcatgttgaaaattatactctggcactggccttcccgtaacacctcgtattttcatatattttgctgaaaaattgcattccctagacaagtttgttcttttgcaaagttgcagtgttttccagattttcctctgtgctcaagtctggtagcttctgtaggtctgttctttcccgtgcagttgttttgttatgttgattcatgccactaaaaacatgaaaagttactgctgcgatagtttaagaatctaaatgatttgtacttataatcgttgtcctattgcgggtgtgctgccacaagcaaagatgctgtctggactgaagggagtttctactaacggttccttttctgtgcgtctgtgaatgagcaggacaagtggactctcttattgaaaacctggaaaaacttttgccagatgcaattttttgtgtggttggatctcacgaactgcatcatttgtatcttctgggttgaagccttagaagactaaactatccattcaagttgcaaagggaatgaaagagttagagaatctacaattagtaatgcaagatatcctgaggcgtaatgttccaggtatatatatgccagaagttatcactttatctacataagacgtgaacacgttttttttgttaactacatgatctgtctgatttgaaaattgaaatgtgagcagcaccagcagcattggatccca

SEQ ID NO: 52892 - DNA, 1464 bp, Oryza sativa
catttttttataaaatagctaaataccaagttcaatcattttgttttttcaggtgggaatgaagggagaagacatgcttgattcttccaatattttggcacatttgagtggaatgaacccttacggctataagtacaacagcactgtggaatcctggatataattctcataaacacacaaattaaagtgtgttttcctttcaattgtgcaagcattaaacacagttttcccttgctcccagtaaataagactgatgctttagaagctctattcgcaagagaagtgcttaggtcaagttattgtttctgcacactactgatttgtaaatagaattgtttccttgtcataatagagataacaagtttcaagatttgtctcgcaatttttcgatgttacaaattcagacatggtccactagaagtattcatgggaaagtaacacaaaacacaatggtcacaaaccagtaatatcagcataatctcatagcacgattaaacccagctaattcttatcatccttgtgggaagaagacccacaaatccgaagccagcagaagaatgagtaattggaaagtggattgcagttcataacatctgccgtttctactcaagttcataaacatctgtcgtttctacttacacagtatgagtgtacccatattgaagagaaaaggagcagaacttgagctgggcactattgtagtgatacaagcgcacgaccatacggggatagagaaaaaaaaactacaccataagtacgctatctaattaatgacagcactactcgatttaacaaagataactggtccaacgtcaatttcaacactaggaagaaataatctgaataataaaagaaacaggtattgagaacattttggcctctatccaagtaatacagggcatattctacaagcataaaatgaaaaacaatactttcaaaatgtttatgcatggaatcgtggatgaagatcaaaaacaaaaatcagtgacacttgagttacaaaactcaaatgccgaaaaatgcgcattattctattccagactgataattcaaccttttacaggacagatttagtaatgttaaatacttgtaaatactggccactaaaaaggtagacatcttgtttaattaattcttgcttccattttagttatcaaagcataaactagaaatagaaatacaccgttgctttagggtggaaatctatctatctatctattatattattaagccacccttgaaaggaaacaccacgttcgctgtgggggctagaaattcccacattaatcgaagaaaaaaaatagaattcaaataggattataatgactcggcatcctcctacaatttggaaagttcagagagagatttatgaatcgtacacattgcaagttttgaatcgcacattgtatctgctgcatgccatcctgacaccgtgacattggaatcaaagtagacactaaaaaa

SEQ ID NO: 52893 - DNA, 1454 bp, Oryza sativa
ggacagatcccgagctcacaactgcattacaaaagggaaacggaagccaggacttggaccaaacaacacaggcgcgacttgggaactaggccggaaccctaaaaagcatcgtagccggcttgctcctggaagaactccttaacagcaggatccgcttcatcttcttcagcaactggggggattatttatatagagcaaaggtgagtacgagagtactcagcaagccatgggaaataagtgtttaatgcaggcttcagagaaaggctgttgtttttgcaattgattttatttgaactcttttctaaaaacaactaagtgagtgcttctcaaacgacgcggatgagacagtgcgtctcgtccggtcggagtatgtgcaacacccggccaacagcttttcaaacggccactcgggccaacaactttcaaacggccacctgggcctagctgatcccatcagctgcagatttttcaaacatcgaacccctttccacaacagcaatttcacaagcagtagtcaaccaaaactacgctaggaatcacctcacatccgcccatgaccgtgggcacggctgttcgaacagattgttaacctctgcagagggggcacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttattcagccaggggtgtcccattccacccatgtggtcgtacttgtcttatgtttggatgaaattccaaggaaaggggtccttaagtgcaagagcgggaaaccgtacacccggtacgttccccggtccgcggttttgggaaattcatttagttcgcaagcaccgacccaggtgtcgggttttccaagtcttttgtaaaacccaagttttacccaagaagtttttcagattttaagtttgaaggcggccgtcgatactcgtgcagagtgcacgatttccgaggcacaactgggtggttacaagggaacatggtataacaattaacaaaggaaggatcaaatgcaacaaattaggtaggtccgccaatctgccttgcagacgggacaaacagattaagtgcgatcctatcaatgcataatatttttcaagcaacataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctatta

SEQ ID NO: 52894 - DNA, 3614 bp, Oryza sativa
  unsure (1)..(3614): unsure at all n locations
nnnnnnnnnnnnnnnnnnnnnnnnnnnnnnnnnnnnnnnnnnnnnnnnnnnnnnnnnnnnnncactgctgaaactgaaagcaagtagcctactgaagcattagatgttggattctagcaaaattagtatcagtacttgaaaaacacaagccgtacaggcacgggaaacctgatcaagactgcacgagatgtacataggaaaaaaggcaataccgaaccaaatgaatttacaagtgttgaattatgcttgagaaaccagaaaactgacctctgggatattctcaactctcagtctctctcacttaattcagaccaagagaagaaagggtgtgagtgccaaaaagatcaaaggaaaaaaaataaccaagaagttcttgctgcatcaactattgtgtatcaagtcaaccggagaaaagagaagttggttagaaataaaaccaaaagttgcagcggcgcccacgctgcaaaaagcactactacactcctagcccaaccaaaaaagatgaccttaaatgcattcatcaacggcttaaagaacgcattcaccagcacaacgctttgttgcaccttttaacacggccaaaatggaagcctaggcacaagaacacgtacaaaggaaacaagaaagttgaaaccatcttttctcaaagactcaagcaagaggcaagcacaaaacaaactttacaacataaacccaaagctgtcaattaaaaccaagtgaacctatgctcgtttcgtttgcatggtcactcgaaggctgaaaagaacaaaagtgaactaaagatgattcatcattgagtagaagtggagagggcatcagattcctcacctcagagctcaccacgcagcatccaacgccggcctgcaagctaagcactgtctcctgacctcccaacacagagcagaacacctcttgttgatgagaagagtgtgcacttgcaacaaaaaccttgggaaacagaaggaaaatggactaatgtgaagtgtacaagaacaggttaaagagcaagaggactggaaggttatataagaccgagcaacacccccccttgggaaagaatagccntatgactcaccaaccgaaggaacaaaagaaaaacaagattaggtgaagaggacttaggacctaaaccaagatatcaaagggaccaaggaagaatcaagccgatggcacaagagtaccacttactagaatggataagaagagacaaaacagtcagctttttgcactagtaacaatcccccaaaactagcaatcagagtatcagacgatcagacaccaccaaaacccaaagggctccaggagaaggaagaagaagaagacgatggagatggagatggctggccgcttgatcgatttccagaacggagaggagcacacggagaggcgttaaggaaaaagctgtcctctttactactcacgctctcttttccatcaattcgacggcaaatgagctgcctctctctcggcaacgcgtgaggcgtaggctacagtttccatccctgcctgcctgcaagccaaggaacaaccggctcgcgaaaggatcgaaacgcctaccaccaccgcatcagatcagcaaaacttccataactgggcagcttataactcccctccaccattaatggctcatcaagaacggcaaggagtaattgcgagaagaagagcagcagagcgcgaggacaaggaaacaggtgcagaattcagggaagctactactactcccacaagcctactacaacttttggcgcagaaaaggcagagacgagacaggggaatggcaagattacccgggattgtagtggagaagaagaagaagaagaagaagaaaaggctcggttcctacgcgcaggccgccatgtgaagaggacgactagactagcgcacaactagctgcaactagactactgcatccaagaaacggttttttcactaaaataactcggattcggctaattcttttttgggttcagttcttgacacgcgtgtgtgtttccttgattacttctaggataggttctaaattctctcgagttgtaaagggtttgtgcggagatttattccccacttcagtcggaagctgaattggttagttttttctatcatcgtgctcctggccgaacgttacggcacggacttcggccactcgccgcagtggagggacggacagggacaagagagcttggtcacgagcggcggccaagtaggaaaagaaaggagcttttctttttgcatgttgcgcctttggaaattctgctgactaaaaaccaatgttccctttggcatttttctgtctcatggttttagtttttctaaattttctttttttcttaaaaaataattgaaatccgacctctacattcacaccggattaccacagtcaattcattttaaaaaccgaaccttttcatccacaccaaaacgaagagaaacacccnttgacaactgatcaatacatngacatcagtaggagtactgatcggtctttttgacagttgaaactgaggcatgaaggtacatgcagtacatttactgtgagtttattctcgatatttttgttggatcagagcaaataattttcttctaaaggaaaagaacgagtcctctactcctctgccgtgttgcctatgccgtatcagtcactgacatgtggggcccaaagcacagtgagggggaagggggtggcatacgtgtacgtctagtaattcattcactcgtaccagtagctcgtctgttcctcggcgcctcgaccggcgcgacgctaacggccatctcctcgtagctgttcaactgttttcaccccaactgctgcgcctacgttctctttcagattttggtactactgtctttccagctctcctcctctgcatcttctgagcacggcgacacgcccagggaggagaatccagagtaaaaagtctcacaccttggattatctcgcagaatctgtccctaatattcttctatccccttgtgatcggtaaaaattatgcacggagagtagttctttaaaaaaaaattcagcagcagggttttttttgggtgaacctgaagaaatgttgggcaggagccaagagagtccgttggacaggtgaacggttcagcgggaaactgtcaacgattttgaactagccctgtctggttgatgacttgtggcactttggctgttcagatttgagactgttgcttgcaagtggcgcggtagaggtactagcatgaccatgtgcaatctctcatttcttcagtttttttctggggaaaacactgttgatgatgggtttcactttgaaattttggtcgggtggatatgattctttaatactcttaacaagaaaaaaaagaacaattgcataaggtgcctaccaccaatccaaaattccaaagtggggcgaggtgaattgtgatgttaggaggagaagacagcccagacaatccatggtgattttgcccatcttttgtcttcgtcacagtgcatctgcatactgcatttccctttcaaacaggaggtgctaatgcaatctcgacatggaaagattcaaaatttcactatgaatcaacgtgaggagttggctccccatttccccaacgttcactgcaaggcatgacgaaggacagtg

SEQ ID NO: 52895 - DNA, 1787 bp, Oryza sativa
  unsure (1)..(1787): unsure at all n locations
cttataaggagggacttggatcgatccatgacaagccatccgataagaccacaatgcttcggccaatcgagtatgccactgccgaggataatctgaaatctttctcttaatcaatttgatcaagctcttgttagatgcctcggcctgcccattagcttgtgcataatatggtgaagaattcaacaatttgatacccatgctatcggcaaactgaacaaactcatcggacacgaaaattgaaccttgatcggttgtaatggtttgagggataccaaatcgatagattatatgttcttgaacaaattgtatagcatccaaagaatcaatattcttcaaaggaatcgcctctacccacttggtaaaataatcggtcgccaccaatataaacttatgtcctttactcgatggtggattaattatgccgatcatatcaattccccaacctctaaatggccatggtttaatgataggattcatagccgacgccggtgccctttgaatcgctccaaatttctgacaatcttgataccctttgtaatacctgaaacaatcttctagcattgtcggccaaaaataccctgcacgccaaagcaaccacttcatcttatgagccgattgatgggtaccacaaatcccttcatgaacttcgccaattgcaaccttaacctgattggcactcaaaaacttcagcaacaccccatcaatcatcctataatagagttcatctccaataaagtgtacttcaacgctttataccttaatttccgagaagccgattgagatggattttgcagataatgatgcacatcatacctccaatcatcggctgttaatgtggcaacttctattttgacatacttcatcatcggcttgtaacccgatgcccctttagccaaatcattagcttcaacattctgttctcgagatacatgcttcaaagtcaccagccgaaattctttcatcaactcttggcatttctcattgtaaaccattaatgtatcatttttgcactcatattctcctaccaattgactgaccactagcaaggaatcacccatgatctccacagcatcggcttcaacttccttgagtaattgcaaccctttgagaaccgcttcatactcagcctgattattagttgcataaggtttaatagtataagcaaactcaaaacttgccccccgaggggaaattataaccaagccgataccgcatccatgagtgcacactgacccatcgaagaataaagtccagggcacaacttcaactgagccgattgagtcatcacgatgatcaacgataaaatcagctatagcttgccccttgaccgccttcggtgattcataccgaagatcaaattccgttaaggaaaatatccactttccaacccttcctttcaaaatcggagccgataacatatataactacatcggccttgcatataacagtgcattcattggacaatagataatgccttaaccttgtacaagaaaaatataagcacaagcacaacttctccacaggagaatatcttgtttctgcatccaaaagccgacgacttaaatatagaacacaaccctttcttttccttcaagctcctgaatcaaaaccgagccgattgacttctcaccggctgatagatataacctaaaaggtattcccttctgtggaggaatcaaaactggaggagagctaagatattctttaatactatccaaagccttctgatgctctgcccccaagtaaatttttgnnnnnnnnnnnnnnnnnnnnnnnnnnnnnnnnnn

SEQ ID NO: 52896 - DNA, 746 bp, Oryza sativa
cctccgatgccgccgccatggggtatgccatggggatagtagctgtagctaatgtagcacttctcgaggtacacctggcctgatggcgcgcccccgcactcgacctcgacgtgctggacggcctgggtgacgcactggccgcagtcccccgaggagaggtcgccctcgcactgcgccatggcgtacacctgctggtagctggtggcgtagaacccgccgtttcccccgccgacgctggcctccatctgcgcgaaggcggtgtcgcggcgcatctcgaagtcggtcccgccgccgccgccggtgccgcaggtcttgaacagcatctgggtcccggacacctgggggaacccggatatctcgtagagcgcgaggcagccggtgagctggacacgggcggcgacggaggcgccgcaaacctcggaccaggatgacatggcgcgggagacgcaggcggcgcagtcggagccggagaggtccccgcggcactggaagaggccgaagacggaggtggaggaagccgaggatgacgacgaggtcttgtagaacttggcggaggcggactggtccgagagcgaggaggagagcgcggcgactgtggggggcaccgcgccgccggggaagctctggttggagcagcccttgtagacgagcgcgtacaggtcggcggaggacaccggcagcgaccggagaacgacgacgacggcgacgtggagcagcagcagcaggagagctctgggaatgcccat

SEQ ID NO: 52897 - DNA, 1077 bp, Oryza sativa
  unsure (1)..(1077): unsure at all n locations
nnnnnnnnnnnnnnnnnnnnnnnnnnnnnnnnnnnnnnnnnnnnnnnnnnnnnnnnnnttcaatgtgacacccaaaaaatttctttttgcgaactaaacacacccttaggcttccatcggatggcctaatcagccaaataaaataccaaattttaaatttgcaaacttaattttgagatattttcaacgtagtttctttttcagtattgacttttaagtcaccaaaaacacatatattaaagttttaactacaattttatttttattctctaatgagcagttttggtttattaggaaaaagcaaaaggatagggcctttattctcaaaccatagcagaaaatggacattatgctattttcaaggtggcgcgggggatggatgaccaccaatcgggtgtgtcaggcctgcatcgaggttgcgcggggttgcagcctcgaggtgccggaccggagctgcaggccacggtggagcgcgttgcggtggcactttgtggcgcgaaggcagtgagcagcgaacaaaaatggctcaactaatcgagaccgacctctctatcaataaccggctgcagggacattttcgtcagaatcagatcaccatgaggaggagaaaagaacaattcaaaaatcagtgaaaaagataaaatggtgattcggtgagtaacgcttgcccgagcttcgcatttcatctaatcgaattttatggatagcattccagcgaaaccgattttaaagatagcttgatatccattttctccccccagcaatccccagtcatataagctttgcgcgttacaaagcaaaaacatgttactagtgttgctaaacacatcaattagcgagcgtcacagcaagtctcagctggcccagctactacccaaaccatgattttttttcatttttaattttttattttttaatatttacagaaatattatactgatgaaaatatttacagaagtagacggcagggtgacgtgagggacggacaagttgaaaaaaaatagaaaaatgcattctaaaaaattacattaaccccggcagcaagggacctaagtgcaaaatgcgcacaccttgccg

SEQ ID NO: 52898 - DNA, 740 bp, Oryza sativa
  unsure (1)..(740): unsure at all n locations
tgggnaatgaatgacatgcgacaccaccnnacananggngnatggcgactacctccgccgtcggattgcgccgatccagcggcgcgctcggggcgcctgggagtacaccgtgttctaagactgcatgaggacccaccagggagtgagatgggactgggctcctgaggactttaagatattggtccaaccgatgctgaatatcaactacgtggaggccgccctcattacccaaggaatgcttcccctctgcagcgatccaaaccgcgccttcatattgaccattatgatggcggtcggggcctcagaggagcgagctccaaagggccactacggcgcaagcaggaaccgccggggggaacaatctaccccgagagagggtcgtgcttctgtgtcccggggcaggggcccggggagcaaacgtcctacctacgcccggtggaagatgaagcatggaggaacaccttccccatctgctttccgagggggcggtgcagagcgtgccagcagaaaagcgccatatgtgtgccccccagcataagtacccgagggggagcgcaagaagaaacggtccctcaagatggaggagacagaaccatctctgggaaacccttattccccttcaaagtgggcgataaccgacccccttgatgttcgcctctaccctcgtggctgatttattctttcacgcaggttttaattacccatcctggtcgcttctggattttatttgtttgacaaga

SEQ ID NO: 52899 - DNA, 2005 bp, Oryza sativa
  unsure (1)..(2005): unsure at all n locations
actcacgtacatcagcccctttgtcagtgacacggttactactccttggtaggcgagcataccacgtatcctcatcggagacaaattcatcatgtccatcgtccaatatccaattatgaagggcacaacaagcgataaccaccattgcttgggctttcaagggtatgaatggcttattcataagaatcttgaagcggttcttaagagcaccaaaagctcgttcaattgtagttcgaagtgaagaatgacgatagttgaatagctcttttgggcattttggaccttgagggccacgaaactcttttaggtgatatcgaacacgacgatatggcggcaatatacccggcctagcagcatatccagcatcagccaaaaaatatttccctacaaccatcaatcatgtcatatatgagcctaatgttatcttcttacaacaaggctaattacgattctttcaaaatgtttaattaccttatggtattttaagaccatttgggcgcgacaatgcatcttgcaagacaagagaatcatgagctgacccctcccancctgatagaatatatgtgaacctaaggtcaaagtcgccagcagccaatacgttttgtgtggggtatgacttgcggcctctaaacctatccaccttcttggctggcacacttgccttgatgtgtgtgccgtctagtgccccaatacagccctaagtgcagacaaaataaaaacatccgagtgaaataaacaaaagttaatggaatatgaattattgtctcttggtatttagagttcccccaaaatatggatagaatttgtttgggttgctggtgatcttagtatgtgtatcggcagacctgacataaatgagttctcgagctaactcacacatggcccgcaacacaatatgaaaatacctactcactgtctcaccagatcgccaaaatgagaatcctacagatggaactgaatgatgttgtccacccttcttcagaaacattgccacttgctcctctactgaaacatgaaaggtgtcaactagtagtcccttgttcttaagacgagaacagagcctgtagaataactgacggggcattctcaattgttgtgtgcatatcctatctgaagtgtcgatcaacctaattaattcacttgttctccatacatccctatggatcaggggcccataccgtacccctttgcatttacttcttttaccatttttattcctcaaccagacgaggatcaaaaccagaagtatcactacagccttttgcctcaacaagaagcaatgcacatattgctgtcgattgctctccatctggaagcagattaccagtttgaaattactttagaaaatcaaatactattgtgccaacatacagatttatccaaaaaaaaggagatattcacttagatgtaaaaggacacactaataaagtacaggtgaaataagcatcaacactaaactagtaagatgttcggccaactaacttttattactactagtacataagatgctagggtaccgaggcagattatacatcagaaattttattatcaacacaagtgggaaagcattctatggaaggaatggttacctttgtgtgatggcacttgagcgcgacggagtcagtagagctgcagctgaaatcgcggcgcccgtatgccgtcctctgtcgcctgagcagaacccttccgcctcactctcgtcccctccccagcagatttactccaaaatttctaccccatttgatcagctcttatgggtttgattgtttgagaagatgactatggatggcaagatgggcttctgtgtcttctagctcgggattggaggagctataggttgtggcctgtggctagagaagatgatgagcggtaggtggatgccaataaatgggaatatctgcttgtgtactactgtgcagcttggatatggagcgtcatccgagcccgcgcaagagtttaaatttcacgcctacgttttggctcttgtcaatggcgtgacctattg

SEQ ID NO: 52900 - DNA, 1614 bp, Oryza sativa
  unsure (1)..(1614): unsure at all n locations
nnnnnnnnnnnnnnnnnnnnnnnnnnnnnnnnnnnnnnnnnnnnnnnnnnnnnnnnnnnnnnnnattcatgcatggaatgggattaattagctgcccttgctacccattgcccataaccacttgcaattaattcttcatagctacccgatcagattatcttcacaaaactacaaataaatacttgtctagataacatgcatcatgtcatgaaattgcgtttgtcggcaccagctgggtgagaatctttcgaactcactatcttgaaaattgaaaaatacatattttttctcttgagaaaaaagacaaattctagatctttcacgttgttccacggagctcccggtgccgtttgtgcttttgcttcgactacccacaagctcgggattttcagcgagttcaacgggcctctcgtgatgtagaagtcaccggccatctacacatttcttttttgtttttacttcacttttgcttctgattgggagggaggccatgtgatacaccgacatgtgggatatgagcttgacacgaatcacgctggatcccacatgtcagtgacctgtagcatttctctcggcaaaaaaaagagagaaaaaacccaacaatcttttttgtggccgtagtatatacgtaatcgtgtgaacttgatccattttggacggtggcgctgcccccggcgtggcgtacgaccagcgctctgcatgtgacccatcacgagatctgtgaccatgtcctcgtgtcaggacctggcatcttgcagctcacttgagcttgctattttatttccggtccatgtgattaactgacgtgatcgttaattaacggaacttcattcacggagtatttattaattatgtagataagatttgctttggccattttaagcttatgctgattgatgtgtgtttgttgcagtataccacttccgaaatgggtgttggaggagatggacaaggaccaggacctggcctacacggatcggagcggccgccgcaactacgaatacctctcgctcggcgccgacgccatgccggtgctcaagggccgcacgccggtgcagtgctacggcgacttcatgcgcgccttccgcgaccactttgccgccttcatgggcaacaccatagtcgtacgtccacgccccccactccgacgaccgattctttcttgattgattacctcgctgttaattaatgccacttctctgacttgatctgcaggagattcaagtcggcatgggtccggccggtgagctccgctacccgtcgtacccggagagcaatggcacctggagattccccggcatcggcgagttccagtgctatgacagggtatgcctggctgcatgctcgtctcccatggcggctagctttcgatcggtttctctttaatttcttgatttggcggcgaactgagtgagagatgatgtttcggcgatcgatgtgcagtacatgctgagcagtctcaaggcggcggcggaggcggtgggcaagccggagtggggcaacgccgggccgggagactccggcgggtacaacgactggccggaggactcgcccttcttccgccgtgaaggtgggtggaacactccctacggtgagttttgggtaccgagctcg

SEQ ID NO: 52901 - DNA, 1082 bp, Oryza sativa
ctcaaagcttttgcttttgcagaaaatgaatgtaactattacattttctatcataagaaaatacatgtactcaaaaacccgaaatgccagtactacattcgtgcagtgcaactccagttcccttactgtttacaaagctattagcgaaagtaagatgaggctctgactgacatacgttcgtatcatatgggaatcatcaggcagcagcagcagctgccctcttgttgatcggtttgcttctccttactccgcaggatccgatcaatgcagcagcatggcagcaatgtcgtggatccagtgccgcatcatctgaacctgctactcttatcctcagtgttggcattcgttctggagacgacccagcgaacacgctcgaagggcagcaataccgtgatggtaccggtgtgtcgccgcttcggttcggtaccctgatcgtgcaggttttaccgtcatttgatatgctctcgacgacaccatcgatcttcagaactccattatccatggtgccgaattttctgaggtaatccatgcgatctccgtaaggtggctggcctaccgggccattagcagaaggtacagttgtgtccgatccggtaaatgtggttgccgaagacagtggtgtatcttgttacgccgcgactgagccttggttctattaatcgggtgcccaactgaataaaacaaaaattagaagtcaaccaaccaggataagttacggagttagcaagcaatagccaaagcgaaacgaataaaaaggagcacagaatgagtacgtaccgtatggccgtggatggtgtggcgataggcgagtgcattgatgaggtgttcgaggcaagtgaactggataaacgcgaagccgtggtgccggccggtgtggcgatcgatgggcatgtggacgctggccacgtacccgaacagctggaaatggcggcggaggtcctcatcgccggtgtaagggccaatgccaccgacgaacatcttgcacagcgtgggcagagccatcgtcgttaccggtagcgtcgaaacaagatttcgacaataataaaaggggtggaggaaatggataggttcagagacaagga

SEQ ID NO: 52902 - DNA, 19986 bp, Oryza sativa
aaatcacgaatcttttctatcttcttaggatcaatctcaactcctctctcatgcaccatgaatcctaaatattttcccgtcgacacaccaaaaacacacttgagtgggttcatctttaaaccataccggcgcattctctcaaaagctaaccttaaaacggccatatgtccctccatgccatccgatttgacaataatatcatcaatatagatttctaagataatacctagtaaatcatggaagatcaaattcattgccatttgatatgttgcaccggcattcttcaatccaaaagtcataaccacccactcaaataagccaataaatcccggacatctaaaaggcgtcttgtacatatcctcctccgctataaagatttgattgtagccggcattaccatccaaaaagctattcaccttattactcgaggcatcattaatcatcatgtcggctataggcataggatattcatcttttggagtagctttatttaaatctctaaagtctatggaaacccttcttctccaccgggactatactagatacccactccgcataacgacatggcctaataaaccccgctttcaacaaccgatcaatctcctcgacccggtcatatagcaaagaattgaaatgtcgaggtggttgtttataaggcctaaaacccggtttaattggaagccgatgttcgacaagatcacggctaagacccagcatctcatgatacttccatgcgaagcaatccacatactccttaagtagctcgattattttaaccttataatcagctttcatgtttttgttacaaaagtcggccttggcttagttccatcacctatgtctacttcctccaaaggatcggccgatgtaaacccttgaccaagcttctctacttcatcaaaatcttcaatggtttcaccaatatcgttctttgtagaccgaaattcttgcaccctcttttgcaaccactctaaattagcttctttactcattacataaagtaatatggcctaaccgtgctacactagccagctttacagagataggtatcaatttgccatcggaaatactaataaaatcatagctataaagatccatccccaataagcattgaatattcccactcaaatgttgctttggccattgcaacctcagccgatgtatccgcttgaacaatttcaatatcatcgccgtcccgttgaattaaacattgatgcaaggtagaaggcacacaaaaattggcatggatccaacaatgacccaaaataacattgtagttaccttgcacatcgacgatgtagaaagcggttggtaatgtcttgtttcccacggtaagctccaccgaaaaaatacctttcgcctccgttggttcaccattaaagccattgagaatcatgttagtcttcttcaactcgtcatctccacgccccaacttcttgaacaacgagtacggcatcaaattcacggcggcacctccatctaatagcatcctagagaccagcttcccatcaacatgacctttgagataaagaggcttcatatgacgatttgattcatcgggctttctcaaaaaccgcatctttaggacctagtgaaaattgagcaactttggcttcatccatagcacaagactccataggcaacatgcacaccatgttgacatccatgtcttcctttggagatgattcgtccttagtaaccgattgttcttccttctctttttgcacaacaaccgattcttctccctctatggatttacgcctccacacctttgtaggcggtggtcgcaactcgttgaaccttctatccctccgctctttggcttctctctgttttaattcttgggcccgaagacgttgcaacctcctcttttggatagtcgtcaaatacttaggcatccaccttggtttcggctccgttccaggaggtaaataatgtcccctgttgattctacccgaagacaatgaagcccccgagctaccctttgtaaacctctcatcaaaccagcgctggagcccggtcagaccggctagaaggcccggtcagacaggcttgagaccggccgtagggctgcggtccgaccggccagagggcctagtcagactggccgactgcgacaagctggtcctggcttcggatttgttactcgaagactccccaacttcatctccagatggtactggcacatcatgagatcccactttaatagttatcacctccaaagtcctcgtctccaccttaacgcgctttccttccctctttccttcattgacccgatttttaacataaaactggccattgtttggtgaagacaaatgctcacaagctggcctccttggtcctccccatcctaggttgtattgcattggaggcatatgattgaacattggcggtgttgtcccccatggcatgtagaaaggaaaaggataacccggtggcggcattggataagaaccccatgatatgtaggtgattccgaccgtcttggtgaatgaccaaatcgctttctaggaggtgatcttggtctttttcctttattgcgagctttctcaccaccttgcttctcatacttactcaaaaacatatcgatggttactttagtcttcttaggagctttagaacttgaagcttcactcctattctctttccaaacaccaacctctggattctttggcaccatcatctttggcctaggctctcaaatgatcactcctttccctttagtagattcggcttgctccggccgaatctacaccttcttatcaatgaaattaattgtgttcaccagaaaaagatcactatcaagcttcatcttggaaccatcggtgaatttcaatcgtccttcatctatggccgattgaacttgtcgtcgaaacacattgcaatcattagtagaatgagaatgagaatcatgccatttacaataagctcaacgtttcaattcctcttgagatggtatgacatggcctttaggtaatctaatttgtttttcttgcaaaagataataaaaaatcttatcacatttggccacgtcaaaactatacttaatctcactttgccgatctttacgaggagtcggcattagattagaacaaacaaaaggcttatttttgttagtccatgaccactcagcaccatacatcccatgatcaccctcatcatcagaatcactagcctcagggtaatcaatcaaattaaaattatgctttttctcatagggtctaacaaatttcttactatccttaacccggttttcctgatccagagccttttgcatgagttgattaacatcaagaaattgttggccttctaatctttctttaataggaacaattaaaccattaaaagcaagatcagccaaatctctatcagttatattcaagctataacatcggtttctaacatccctaaatctcttaatataatcaatgacagattcattgtatttttgcctaaccatgtcaaatcagttagcctaagttcagtttcaccagtatagaaataatcatgaaatatttgttctaattgaggccaagtatgaatataatttgccggtaaagaagtaaaccatgtaaaagcagtaccggacaaagataaagaaaacaagcgcagtttaaaaatatcagaactactagcctcaccacattgcgctaagaattgacctacatactcccatgtggtcctactatcctcaccactaaatttggtaaatttgggaactctataaccacgagggtatgggatgttgtcataataatcaggatacggcttttggtaaaccttagcacgattcctagattcaacccgaatttatccctaataataccactaatcgattcctccatattctcaggcctatgttgatttggtggtgggtttggtggcctaattggttatggttgcggcgcaattaattatattggccatatctagtatcgggaggatatcctctagtaggatcattgtaaacattagggatatgtggggcagcagtagatacatggggatcgtgggctcggacaaggtataaaagcccgttatttgccattggatctaccccctgtattgtgataattgcgctggtctgaccggtccagggcccgatctgaccggcatccagaggcacggtcagaccggtttggggtccggtctgaccgccgggggaaaacccggcctgaccagccatctggccggtctgaccggcggtgaatgcgcggtctggctggccatttggcccggtcagaccgactgattgcgcagccactccctcgccggttgtttgcatattcactccaccggttttgctatatatttgatatacaggaggcttgctagtagtggtagaggctttatctttggatgaaaaatcggctaagaaagaaccgaatttgttcctcaaaaaatcatcaaaacgagatttaatagatgcatctaatttactatttagagtagcaatggatgaatctattgtacttgctatttgttgttggataggaagtgatacctcttcagtacttaccacatcgaaattaggtttaggcaactgtccaggcttgagcaccacaccttgacgagtcctggtgcatgttctcatcaatgcctcctgtgtgatcgtcttaatgtactccttcatggccttgcgcgcttccccatcaagatcctccaatgagattggcaacatattagatggttccacctccgccttggttgatggcggctttgtcatggcggcgtcaacgttgagatgtcgttgagcatatttccccagcggagtcgccaaaaatcgtgttggcaactttttgtgacaaattgacaaccacgatcgcagcacctaaagctttgcggatagtagagtcaccaaccaccccaatctagcaagcactagatcaagatgggtttttataagctaaaccgacgagcggagctgatctagatgaaaccgtagataactatcctctcgtgggcaaaacggaaggttttcaggacaaaccttgaaaagggtatcgcactctcgtagcggcggcggacaatttacggcgcaaatcggcaaagatagacaaactaaactagaactagaatcaaaagtaaaatgacgattcgattgattgattgtagattgattagttacaattgaaccggcgatgtcccttatataggggttggtcttgccctctacaggccctcctccatgtccaacttgggatagaatccaaaagaaacccgaaacatgccttcccgagcaaggaaacctcgagacccgatgaaatagacccggactcggactccgccggtaagaccggccacacaccgccggtctggccgaccaattgtcggcggtcagaccagccaaccaacggcggtcagaccggcccaagcagaggaaaactggcagacttccaaactttggcaattttctctattttatttctaggtgctaaatttgggtgtaaacaggattcctatagtactgtttggggagtcgataagttaattcatatggatgtctacttgctgggctggtgtgttgttcggcctgtggctgagtttagttaccttcaaacttctaacttttctgtcacatcaaatgtttggcatatgcatggagtattaaatgtggacggaaaaaaaccaattgctcagtttgcatgtaaattgcgagacaaatcttttgagcctaattacgccatgatttgacaatatggtgctacagtaaacatttgctaatgatggattaattaggcttaatagatttatctcgcagtttacatgcggaatctgtaatttgttttgttattagtctacgtttaatatatcaaatgtgtgtccgtatacgtcaatttttttttgccaaaacaactaaacacggcctgtattgtcatgatgaggacacaactagctcggatataaccatgactaccttatgtattaatcaaccaaaggtgtatatattttaaattagatttacttgttatatatttgaacaaacgttgctacacaatgagttatgtgtgttatcatttgcagagttacttgcttgggtgaaagaaaagagaccgagcataaggaatgcatggatgattgaagaagtttattggggaccaaaccaagaccttctccaagtcttctttcatctcaccacgtcacttttggtccatagaagacaagagataaaattctatacgttttggattcggattcgggcctcctgacagcatcaacttcaaatggacctagctgctgatttagaaggaattttggggcccatagtacttgatggaaagcttatggagtctactttcagatggttttggtcccacgtcaaaattcctaccgagctgccaggaatctgcaaaacaagccacgtatctcattcagtccgaatctgatttaagttttgggccttgtaattgtgtcgtgggcttagcccaagggggtgtgcgccctagggcaaccctaggacatccctaatcatactaaatcaggtggtgccacggttccacttctacctatttggtaaaatcaggtggcgcggggcatgtttgacacgcatccaaggcgtcatcagcgctaatgactcagtgctggtgtcttgtccacgtcctttcaaccctagactggctagcgctccccataaacctatttcatttatggccatctccttagccggttttgaggtcgcgcgctcacgctttttgccccataaacctatttcatttatggccatctccctagccggttctgaggtcgcgccctcacgctttttgtgatgatagttcatctgttcttaggcgagcttctcgaagatgtctttgatgaattgataatgtatttaatttgtatgttttgacttgcagaagaaagtggaaactacaaggactaaggtgtgcccagatcttaggacggggcagtgtgacttataaggactaaggtaaggtgtgcccggatcttaggactgggcggtgtgcccagatcttaggacggggcagtgtgacttataaggactaaggtaaggtgtgcccagatcttaggactgggcggtgtgacttataaggactaaggtgtgcccgggacccaggataagtgtaacagcactctctctagaaccgaatagctagcacatccgacgggcgggcccacttacacataccactccacttacactttcgtcctcgctttgtgtaaaagggttaacccaggagtgatatggttggagtgaagaggtcttataagttggttccactcgtgctaaactagcaaggttgtactaaacatgcacacacagctcacatgggccacccaggcctcatcctaattgggccaggttatcacatacacccccctcaaaggactcgacgtccccgtatgcccaacttacccatgtagccacacaagcatataggcaaatgttcaggaacacgccacttcttagcgcacgtccgtacatctagtgttggcactatatgccatgccatgtgcctcacacagagtccacatgtgccatgcgccatatgtccgcacgctgacccatacacgcaaccgcgagggtcagctctgatacaatttgtaacagccctccctccagaaccgcatagctagcccatccgacaggcgggcctacttacaaataccaccccacttacactttcgtcaatgcttcatgtaaaagggttaacatgggagtgatatagttggagggaaaatgccttataagttggttccacccgtgctaaactagcaaggtggtactaaacatgcgcatataactcatatgggcgacacatgccggggatcctaatagagtcgatatgcaggcatgctcgggtctgaggcagaccttagtatatttctcttaagatgtagatcttgtatgtctctacgcccctctgaccaagtagcgcaggacttacaagggccaaggtgagcccggaagccaagacaagaccgggtccgaggcagaccttaggttacattcttaagatatagattttataggtctcaacactcctcttcacagagcagtatgtgacctagatgagctaaggtgagcccgagacctagagcaaggtcgagtctgaggcagaccttagtctacattcttatcccgcaaacagataaaggtgtgcccctagccacatcaccctaggggtagctttttatttttagggatggtttaagtatgccatttattttacttctaatcgttttgccgggtgaatgggtaccctggttcccatttcacctacagatgcacaatcccaaacattaaatctataatgaatctaagtaaaagagactcagggcctgtttggtagagctccagctcccagatcatcttaccttgagcttgagcccaaccaaatggtccagattaaaaaaaaatgggagcggtgtggggtagagcgatctgaaaaagtgaattagagtgatggagcggggttagtccagctccactactccactccgaacctaaagatagcgctacacatccattttctcataaattacagcaaattaccatcgaactacccttccatccccccatccaacaccgtttcacatgaacccttccccgaactcgctcgaggagaacaggaggcggagagaggggtgctagggcaggactcaccgacgctggcggaggaaccctccaccccggtttttcccacctatctcggctgtggctgcgcacggcggcagcggagtaggtgccctccctccctgcgtcttcctacccttttcctcccaatcccaatgacccgtggcccaggttgtcatgctgagtgaggagcacacagggcggtggcggcgcttggctgcgaggctggaaatgtttttattttttagacttttttatgttttaattttattaatagaccattcccaaaagtattttcaaactgaaccttttggccacaccagcccgtctggcgtggccaaacaactctatcacgccacacttagctggagtggcagtgctgccctgccacgctagcctcttgtcacaccaccactgctggcttcagttttcggaaatacttttgggaatggtctattaataaaaataaaacataaaaaagtctaaaaaataaaaaaaattcgcgaggatgttcaggacgagcatgacgactaaggttgcgagcataataaaaaaaccggactaggactgggccagcggtccaaccggaaaaaaccgaaccagcactcccaccggttcggtttgctttaagaccgctcatgcaatcgacccggtgtcccggtgtgaaccggacggtttttcgaaaaaccggcgacccgagctatattgaaccgctggttcgcgaagcagatgggctggcttctaaaggcccacttggattgttgtggcccaactaccttttattgtataaaatgagaaaaatggtgcgccacatgggatcgatgcttggctgatgggatagaagagcatcaaccacaccaccaggctaaattggtaaccttgtttaagcaaaataatgtgtaataaatgtactgtccggtttaaaaattgaaccggtcgacccgccggtccaaccggtgacccggtgaaccaagagctcaagcggttcagtgcccggtccggctttttctactatggttgcgagcggcgctcaaaggttggtttttctgatcgaatcactaattttttgtttgacataaatcaaattctaaattttcctcacatgttgagtttcaatcgggctcatttatgtatgaatgattttacattttgatttattgcttggtattatgcaatgaaaacttgggaaactttcatatctgaaaatttgccctttaggtgtgtcaaatttcagatttaagcacttgtgaccatgagcattttgtttcactgaccaagtccaatgtccataatttcagtttgcatttgagaagtgattgagaaatctcagatttagcacatgtttggtagagttccaactctcagatcctagctccgaactccaactccaacggagctagctcctataggagctggaggtggctctaaagtgtttggctatcttgatcaactccaaaattcctgaaagaaaggagaggagaaagatgtacaatattacccttaagtattttgttgtttacttgatatgttattaataatagttgattgtaggacttgctatgtatatgtttaaaatttataaccaataaatcaatgttagttcccgttaagaacatgaacacgacaggtatgtccgtatgtaaggtaaaaaatatatatatatgacaaattgtagtgtacactcatcatttcaattcagtacacgatgaatcatgtacttcaacatcaaggaagtactgacaagcatacaataaagaaaaacttgagctcaaatgcctattgatctgagtaatactggcatcatttaattatgaataagaaaacttggagcagaacttttacacgaacccatagctgcataaagtcaccaaaaattttattttgggatgaatttatcaggacgtgacaatcaacatgtaacataccaggattttcacctaggaaaaattttgaggaaaaatttaaaaccttttgaaagctaaagcatttaagagcataatagttgatcttagagtttaaatcctgtaaataaaattaaaacataaagatttgttgggtcaaggtttaaagctaatccaaaattagattttataaaatcttgggttaacaaatctcaattcaaattaataagatggtttaaactttaaatagaaatttaattattttggctttgcatttcaacctaagcaaaacatttttgagctaaatgaaaacaaatggagatataagatttaaaataataaaaactcaaaatggaaataaatatacttggttgtatgtgcatttattattttaggtttgtttttgatattcttggtgcatctcataataggtttcatatgcatgtcatgtctaaagaaaactcctaaaaataaattatgcaataacaaattgcactaaaattctcatagatattaaacaacatcctaagtctacggtaattttagtttgaattaatcacatcaaatggtatctcaaataattccaacaactcatcttgaaatctggaaaacagcataccatttagcctattttacaccttcaccaaaattcaaccataacctatctagctaaaccacttggtcagaatgctaatcatagtgttctctaccgcctggtgcaatggcttaattaaattcgaaatgtaaccacatgaaataaggccacaagttgcttaaacaatatttagactgcagtcaacatcgtaacttagacctctttactaaatcaccatggtaactcaaaaagtaattaaatcttggaacttggcacattgaaccatcaaatccttgtccaccttgcagcaaccttgtctccccaaaattctaaattaaatggaagagaggagagggattaaaaccacatgatatagtttcaacacttagaaaatttagagctttgtttctccttctacacatctctctcttacatgtggggactatgctcttgtgggacccatgtgtcatacactcacagccaacacatcatctacacacctttcatttaattattcatttgttaatccaaaagtgagagagtgagataaaaatcaatttatacctaaactactactctacctctcacatacacctaggatacatcaacttggacccatttatcatccaatcttcagcaaaccacctggttagacacaccattgaatccaccttgtatttatcaaaagaagaaagagagcaagagagagttaaaaaccaaatttcactcacattcttccccataccccatcttccatctaggtaacatctacaattaaatcccagcttcatgctagaatgggtgaagtacaagtaaatcccagctcctctagcttatcaacaccctaaattcgtgtccttgccaaggtttgacacctagctaacacctagccacctcaaccttcaccatttaccaaaccaactagccactgtaatccccatatcttcctcatcgtgttccactaagaaaaccatcaagaactcctcgaaatctccaagaacatccacttctttctctcatccgaagatgtttgattcgtcataaatcttctctggtgagcttcgccacaatataatcctgagaacgtgatgtacagaccatgcctaattattccttttattttttctccctttgcatggatcgaacaccttgcgtcgagctcgtcggcgtcctcggtgtccagagcgccgccgtcggtcgcttcgccgttcccgatgatccgatgcatctccgaccgagccgctgcgccatgagcgtcgccaatgttccaggagaaggcctgccaagggaatcgagctgaagatccgccgaaaaggagatcctctctttcttcctcaagtccggccgccggccaacgtcgtccgttcctcgctctcgggttagcttcggcgcaattcctcgcatatgaagcatccttaggtgatctttgatccattcccctcctctccttggcagcccgaagaccggaacgaaccgtcgccgtgaagccgacgctatccatcgccaccgagccatctcctccactgtcaccgctgtccagaccttttcaagccgcggtaaagcttcggtgagcttcatagcacttcctaatgccacattcatacatccatttgatcactacatggctataggcgcacatgcagtagcagcccgtgcacagccgtcgctcggactcgccgccggcgttactccgatgtccgcaatccgagaaaagtagaggaatggaatcgcgagagcgttctcttcatttcatattttgacctcaaccccaaacgagccacctattgccgccggtgagctcgagatcgagctcagccatggctctgctcagcctctgcatcgaatgaatgaggtagagaaaagcagggaatttgttttgagaattcgaacaactgtagggaccaatatgtaaacatattaatcactaacaggtgggtcaagaactaaaacgtaaatatgaaagaaaacggagagtctttgtaaactactccctccgttccaaattgatctacatatagttttcttaaggttattcctaaatgatctacatatttgtgttcatttattaactctattcgttatttgtgcatttgagtaaatggacattgatccatgcatccatgcacacaaatatttataacccgcatgcaatatcttgatttgctattggctaggaaatattggaaatggtgcatgcatcaagtttattgttagagtaaatatagtatgagagagttattagctttttttgtctgagtgtacctatgaaatatttagatcaatttggaatggagggagtatgtcacagacacgtttttggactgcgggttgattcccccacactcgagggacttttctttaaaagatctatcactgaccagtgggccctatgtgtttaaaatctggaaaaatataaggaaaatgactagagaagatattttgcaattgaaaacttgcccaaatttgtaaaatgcatataaaatccattttagctcattttgatatgaatcaaaatttctgtgaactcaaaaattatggaatttaatttagaaacataaaaatttgcacttatagtataagaaatagcactaataattcgcataataaacaatgaacatagagcaatctccaacttagaaatttcatataaaattcatcttaacttaatttggagtgaaccatgttccagtatgctcacaaagccatactcttaattatcacaaactaaaacttgacactttctgtaacaaaagtatcaccaaatatttatctagtgaaataactagtgtaatgcaaactagaaactataaaatccataagtaattcattttaactccaaatgggccaaactaaaattttgttagtttcatagaggcatgtacattagtttccaaacaattcttagaagaaaacatatctagaaacatgactaaaatttaaataatgagttaatattaaagaacggtttagaaacttctgaaattcatatcaaaatgaatacaactccaaataaggtgattccagttttgttagattgtcaaaatcatttacttagtttttataaaataaaatatgacacaaacagtacccaaaacatatctaaaattcgaaataactaataaagactatagcatatgacctagtttgtaaaattcataataaagtcatgctaactttaaaagttgtgaaaccaactttgttgaatacctgtgaacattcccttcactgcagtaagccatcagttcacaaatcttgaccctaaaatgcacctaaggacttttagagcttaattaatctagtgctagtattaaactttgaaaattaataactcccaaatgcaaagtgataaaatagaaattccttcaccaaaaatcttatccacacagcacctaaccacactagtaaactcatgcattttaaagcattttagatttttacatgttttagcatttatcgttaccgttattccttttaggcggcgaaaatcgttatcggtgagatgattggtcttatagctgatctcaagaaggtcttataccaatcaaggcaagtgttgcccttcctttgaacacattgaatcccatattttcgggctaagtgttttgattgtaaagttgcacgggtatttctaactataggtactttcaaaactatagattatagttgtaccattaaaagatgcatgaattcccttttgaaaataaccccttgctgttttgaaccttaggattaattagagtactttaattgtgctcatatgagtatgctatgcttttataaagtgcaaatgcttagccttgcttagtaataaataaaaacatggttatggatcacttattatacttttgaaaacccttttgaacaatatggacagaggtgattctctgattatttgtgaaataaaatgagataaaatgtgattttagactttggcggtaagtggtatgcatatggtagtagttgcataccgatagagggagtgttcgcctgagtcgattaaggaccgaacatcatatcacccattgtgtttaccgtacatccacatgtgtctttatgggggggtcttggcctattaagttaaacacttgtctaatcttgcattcgggaggctgttgtagtataggtaggggccacgagtgtactgtgggctacctagaggaactacccatgtgtatgttgaaccttaggacgagtgtactgttcctaaatgtgtgatcgtaggatgataaattccctacgtgtgtgatttccgtgagggacgagtgtactgttccgcctcacagcatgggcgtctaagtgtgtccaatacaacgatattgtgccacatggtgggttcccgttgtgtccgtcaccacggcgttaagtttaaagcgtgggcccgccacttaacggttctaggtcatataacgtgtatggcatatggcctaggatagaggaacacgtatcttgctcatgcaagattagacaatacttaatgttaaagactcgttatgacctctagaccacattcaacatgaagagtgtggtggagtcttgcaaactcaaaacaaactagagtgttcatatcatgtgggtaaagctgtacaaactctgcagagttctaaaaactaatcgattagctgtgctcacagtcatgagcgacataatgatgtgctatgggtataatctcatgattgctaagggtgagtttgaggagaaggagattgggaagatacgtaaaacgaggtgagccattagcatatgattaattgagtattaactattttaaatttcaaaaatagattaatattattttttaaatcaactttcctataaatttttttttgcaaaaagcgcaccatttagtagtttgggaagcgtgcgcgcggaaaacgaggtgctttctcaccctatatcacgcaaacgaacgcagcctaaaagcttttgaaactaaatgttttgagatgatgatgagattgatatatgtgatatgattgccttacttccctttgtgttgtaagggaatgatgtctatctaattattttttttactggaaatactgctaggactttacctcgcagtgtgattttataaatagaaagttatttacaagagatcaaaagggaaacaaaaagatcaaaatattacacagtttgtaaccaatcaaaaactatctgttttaggggatccttcattctgcacaaatgcagaagaacatcggctttgaataaagccctccaagaactgaatgagggaagctcatttcgaaagattttcccattcctttcttccaaatgtgccaagcagcaatgaagaaaatttccaaaaatcccttctgactgaactgaatgcgagccaaaaccaccgtctgaaaaaagtccagatcaggattctatctaattatgttgatatcatgccatgattattatgccttacacattgctaaaatgcgttgcttaaattacgttgcaaatgttttgtgaactaaaatttactttatgctgaaaattgaaaccacatatagcctttctttgacttagagctttcatgtatataggtttgatagtgctcttaccagtacattatgaatgtactgagtctagccatgttttgtctaatttatgttttgtaggaatagacttagtttagtttgagtgatgtgggtttcgactgcttcttttaggatttgtacttaatggggtaaacctctagttggtgtgcttgaggattgggtagtcaagcttctgctgctctctgatatagttatatttggccggtcggcctatgtatctatttagtagttgtaatctgaattttatttgctttagatgtaatttgctatgtatattcatgcttaagatgaaagtgtgaatctagtgcatatcctgggaactagattcacatgagtatgagttaggaatatttcagatgttgtatatctttagctatttttatcaagtctcctgaatgtgtaatacatctggtcgccaccttcgagtggtttgacgggcacatctcaggctgaagttgattggtatgctaaagacccagcaatatctccaatattcctctctcgaggcgtcagatatttcattatgcttgtttgatgacttgaattattcatttcatttctcaattataatggaaggtctgaagagcctacgacaaaaaaaagcggacgacgaaaaaaaaagaaaaatacggtgaaaatagcgaaaaaatacggacgaaaaaaaatatgccagtaaccttcgctacgggtaaaatgaacggagttaacatcgtaataattttccaagatagataaattattcattgggttaatcataattagggtgaatagaaaaaactattgcgcattgatagcataatatcatttacaaaatcgaacacagactcacttggagatgcatcgtgtcacgactcatgcgtggacgatggatgatggatggtgcttggactctaatatgtcgtgtttttctgacgacggtaaaaaaatacgtacttaaaaatatcgattttaaagtttttcgttgttattcgtatattgtccacattatgcaccacacacaatatctgtggacccacatagtggcagcgggtaatcatgggctggtgcggcacggccggatatgggccggaagatgggccgattacacttgctctggatgcgcgaagcgcgcgtcccacgctagtattttaaaggtgccggtttaatacaactcctcgttaggccattcacagtgcagtgaggtggcgtgtggcaatcgttgtccacgttggcaaaatgcatgtgttgaggagaaatggaggtggggcccatgactacaccgggttcatgtacccttctttggttccgagagcgtcagtacgaaacaacttttgtcagagaaaaacgaatcacacgcatcgctctatggcaagaaagccagagagggaggaggggaggggagaagctcactggagagagggggaaggggagaagctcgccggagaaactgcatccgcgccgagcccgagctcccgccgacgccgcaccatcggtgaaggagagagcggcgccgactgtggggaggaagagccgcgacggcggtggggtgagcggccgccggagaggagctcgagctccgcgccatcccgccccgactcgccaccgccgtcgcccgccgctttggccggcgcagccgccgcttggaccaccgtcgccgcccgacgctagatccggctggatctggtcatcccatcaccgatctgcccggcgccttcactggatacgccggcgctccgtccagtgctgggaccgtcccgccgccactctgtcaaccgcctaggctgccgcgtcttccacttccgtcgcctgggccaccgcgtcgtccgccgccgctgcctgtggccgccgctccatcctccgccgcctgtggctagggatgaaaacggagcggatacggacggataatgctcataccgtattcgttttcatattttttaccggatacgaaaacgaatacagatagctcgaatacggaaacaaatatggattatctcgaatacgaataagaatcgaatatgatcggacacgaatacgaaaacaattttttctcggaacacgaaaaccaacttctaatagaaacaaatatcaacttatataattagctcactttatattaaatgtagtataatttataaatatttttaaaaatttaaataatattaatagtgtggactagtgttaagagataaaccactattaaaatctaaaaatgtatattgaaggtcatagagttataaagaaatggggtatgtctcatggcttctgcggatatccaaatagcactgttcaccggatatccgaattattatctgtatctgacggaaaccccgataccatattcgtatccgtatccgggagaaaatatccgtattcgtatctgtatccgaactatccgagaattatccgatccgaaaggtatccgtattcgttttttgccggagcggacggaaactatccgctccgttttcatccctacatgtggccgccgctccatcctccgccgcctgtcaccgccgctccatccgccaccgccgctgtcgcctaggccgctccgaccgagacttcgctcccgccgagaccgccacggggtcgtccgccgccggcttccgcgccgcctcgccgccggccagccgccagatccagagagggagaggggcgccggcggcgcagtagaggagggggagcgagtggggaaaggcagagaaagagaggagagataaaaagtgaggatagagaatgggagggacccactgtaaaggaaaacgtagaccacatgcactatggagtttgttgcttacgaagtttttagtctagatggaagttttggctcctcaaaaattagtgacacactatgagtgcccttagcacccggaaatcctattgggcaatcgatcgcctggggcgatcagatcccctcccccacgcagttttctttttttgcactgctttactttcctattttagtaagtttatacatctaaaatttgtatacctaaagtttatatctctaaagtttatccacctaaagttgtagagcgaatgtttataggtcaaaagtttatatacccgattcaaattcaaattctgattcaaatattttatattttcctcttctagtaagtttatgcacctaaagtttacacatctaaagtttatccacctgtttgtatacccgattcaaattcaaattcgaattcaaatattttatatattctatacataaagtttatgcgtgcaaaatttacggtataaagtctatgcacgtgaatgagagtattattttttttctattttttttactaattttgtttttttttttaaaattatgatgaaaggagagaagggagaggagtacagggggaa

SEQ ID NO: 52903 - DNA, 7144 bp, Oryza sativa
cccgcccattagcctcaccccttagcacctcctgttgggtgccggtttctaaattcagcatcacgtggagttgataaccgacaactaaaggctttttttttaagtagtgtgtgcgcagttacagagttaatccgtgaccgtgatcatctccacttcgatcgaccctttcgtcgcggccatgaaatcgccatcaaaactgcggcatccgatcgggaaaaggacatccccgtacacgagcccgactcgtaccagttcaccacaccacactaccccgccccacgctataaatacaagcgctcctcgtcctcctcgacctcgatcgatcgtatcccaccaccaccaccagagctagcgcagcaaccgtgagctcagttcagttttcatttggtcgtcgttcgagtcgtcagctagcttcgattcaaagaaggcaaacaatgaggttcgtggcggcgtacctgatggcgaccattggcggcaacgcgagcccgaccaaggacgacgtgcgcgccatcctcggcgccgtcggcgccgacatcgacgaggacaagctcggctacctcttcgaccaggtcgccggcaaggacctcgccgagatcttggccgccggaagcgagatgctcgccttcggcgccgctccggccgccgccgccgccactgccggtggcgccgcggcagctggggagaaggaggaggaggagaaggttgaggagaaggagaaggagggggaggacgacatcgtcttcagcctcttcgacgacgaatgagctatcgaccttcgtcttcagccctgcatctacgtgccatagtctacatgtcgtcagtctaagtttgtacaagtagtagtagtatatatactagtagtaaaatgcacatgcttcgttacgggtaaaatgaatggttgaatgctgtaaagtacacagttaacatcataataatgtttcaagatagatatattatttattgggttaattataatttgggtggatagaaaatccttacgtattttttttattaggtatagatatatattgatcttcaatcctacgatatatttatagcccatatcgcttttcaagtttgcagtgtgtacaagtctctcggaaatgctaatgagcgattgctcgcctggcgccgagggtagcgatcaattagaaccccctccccctccccctcctcttcccttcctccaccttgtttccttttttggcaccgcattactttcctattttaataaatttatacacctaaagtttgtacacctcaagtttacacatctaaagtagacccaaagtttataagtcataagtttatatatccgattcaaatttgaatttgatattgtttatatatagtatttctataaatctaaagtttatacacctaaagtttatagactaaagtttataagtcaaaagtttatatacccatttcaaatttgaatttgaattatatctgattcaaatttgaatttgaattcaaatattttctatatatagtatttctatacatctaaagtttatacacctaaagtttatacacccaaagtttataagacaaaagtttacatacccgattcaaatttaaatttgaattacatctgattcaaatttgaatttgaattacatctgattcaaatttgaatttgaattcaaatattttctatatatagtatttctatacatctaaagtttatacacctaaactttatagacctaaagtttataagtcaaaactttacatacccgattcaaatatgaatttgaattatatctgattcaaatttgaatttgaattcaaatattttctatacatctaaagtttatacacctaaagtttatagacccaaagtttataagtcaaaagtttatatacccgattcaaatttaaatttgaattcaaattttttatatatagtatttctatatataaatttttctaacttttgttttttttaaaaatttttgtggtgtactgtagtagtaagagaagaaggggaggaggaaggggagaagaggaaggaggtattgcctatatgagggagggggcgaatctgatcgctgggcgatcgcccattagcccctcccccctcccccccaagtctctatcgttctgtacccatcacccaaagcaagaatagtgcattgagtgaaagcatgggtatatctctatgcttaccatacattatacatatactaagtatttaaagctcaacatgcgagacagtatttattaatactcctaaagtctaacatacaagtataccgtatcaaccaagtaaacacttaaagctcaacatgtaaagcataataatgacatttataatttattaaattctaaaaatcaacatacacatgttaaattgtcatccttaaattatttccataatatttcaggccaaatccatccattggttatacaacatttaacaccattcaaatatcccgcaacaaattgtaggagtcacattagtacagaaagcatgtttccaaacggtcaaatcctatttttcgtgcgattgagcagcccgtctgctcaaaagagtctacgaaaatcattattttaccatgtgggtggcgaaccacacatgagcattgatttcgcacgcgtgtgcttatgtcacccaaaataaaattccaaaaatataaaaatccctaaaaatcaaaaccctaactcctatctgcacccaaatgctggcggtggcagatccagccgtcgtgggaccgatggaggaagatccgcccgcagctgaccgctcgaggtcactaagccaaccgcacctgccgatggccagtgagagagaaaagaggagaggaggtgagagagaggagagaactcagaggaggttcaaaataacgaggagagggggtgagagagatggacagaaggtaaggatgatgactttaaagattttgaagtgttgagagagaaaaggaggcaagtcgaacttctaagtggatccttaagagacctgcctgttaaaatagacccattttacatgcgggtatgttaagagatccgtctgcgaaaatcatttttttcatgtatcttagtggttgtatgcaaaaatgttctcgatttttgtagatgtgaccagttacgacccatctacaatttaaaggggggtcttgttcagaaaaaatgtttctagtagtgtcagtacatatatagaaataattcggatttaattgttctccgacaataacacgggaagaattatccttaatatatgccatatagaatgcagatgttaatctctcggttgtgctgcaaatgaggctacgagtaaaagagactaggctgtgttcagcagccatatttcctaactcatcaccatcgtttctcacacgtacgatttttaaactgctaaacattgtggtttttacaaagcttttctattggaaagttgttttaaaaaatcatattaatccattttttaaaaaattaactaatacttaattaatcatgcactaataagtcgctccgttttacgtgcacgtgggataagtttttacgaggcctttgggtgtcctcatttcacaagagagagttgagctattgcagtcagaacccatgtgacgatgttagcagcagtggcgatgtaggcctcagagctgtcgtcttaacaacgctatagtatcaaacaaaagaactaagcctactagagggaaaaggtgaattataggatcaacaaaaaccaaaaacttatagcgaaattaaatgtcgcactcgaaatcgatggagatcaatcagaccagcctaactgctccagtctgaccggtgtagatcggccggtcggactgcccttcgtgccgccatcgcctgtcgcctcctgtgctcatgtaatgtaacctttctctctctctctcgtgaacggcggtggtggcggcgactgttgtgcgtgacagtggaggaggaggattggcgcgacggcatccaccaatcccatccccagtccttactctagtcctctccccaagtagtggcagcggctctgcctgggacgagcagcgacggcactattattatctactccactgtctattaaagccactattccttctcccgttcggccattccccatccctcctctcccacgagcagcaccactcctctgatggtaagtaagatttttgttctttgattcatattgtgcaaatgccaaatattatatatatatgtcatgtgctatattgttcatgtagagttcaattgaccatgtgacagtaatgtgtcatttttagcccaaattttgtcaaatttttcaatttttttccctagtattttccaaaaccgctatattgcttagctgctgatatagcctgctatagattttcttagctattggagagctgatccgctaaatgtcttagcccactatttagaacattggttttaatcaggcaatgtcattgttttgtcggcgtgtccttctcaaaggcttcgttttagtggttttctcttgttggaccactgttcttaggttgagtgtctcggtccgcatgttagctcgcttttgtcagtgctagggtttttctatagttaatcatattgttgtaaggatgttgggttcgattttccttataaactaaatcagatatcttcttctaacggtgaatcacaggagcttcctgcctgttccatctaatttgaggaactgcacaccggttaacttggaggttataattttcctagaaattatggcggacacctagacctgatattctgtgtaattatccatgagggcataagcatgaacatgcaaaagcagtacccatcaggctttggatgtttacccaattattgaactatgtttaggattagatacaacaaaaagatctaagcattattttcaaacacaatgctttcgaaaaaactttacagcgtaatataattttatatagggaatacaaaaccctctttgatgaatatagtgataagagagtgagaagggcatttcttggatttcaaaagattaacagaaactatttcgtgggtcaccaccgacctttttttttctattttcacatgtaggagcattgtcacctcatagcagtccatatgcataagcatcgagagaacaagagatttcatttctttttctcaggcctgtagtttgcaaatgcataaaaagcaatggcaacacatggttttccaatgagttaagacaatgaaagaagaagtatattaaacaaaataaaaaaggcgcaagaccatgtaagaaatggagtaccaaaataatgtctatttatggcctgaggtcctagggtgttggcgggctcagatggccaacaacacaatgaagaaaaacagaccaacagtaggcacaccaggcctcctataatgcgctccatacattccatcagatgaagggtgttctgatctcccctcttagataaatgttttcagggtttctataaaaaaaattgagaacgagtttctattaattattgcatgcaaaaaagaaaagggttgtagtaattgggaatgggcagtatcgagaaaattgcatgcatatacacttctagttctagcagtagaacctaacaaaaatttggagaaataattgagccctgtagttcaggacatggtaggcactctgcagttgagaaaggcagctattgacatgcttgttagtgtttagatctgcttcgctgtttgtaacaattcatggcagtagaaccgattggctcaggccacagtgcagtgctctctttaaagacagtgagcaatacacctcaaggctcagatcagtagctacccatttctttcgaagcttaggaaaatctcatgcaattatatgctcgaattgaaacatatcattatttctttgctttgcttcaagatcacatggagtcatggaccagagatcaaatcgaacaaaaaaaaagaaaaaaaaatgggggtgaagagaaacagagtggttacccccagggcatgtcgagttgtcgactaatcttggtgccaccgccgggtggagatctcgctgctccggcggatcccgaaggcggggagcgcgtagagccacgccacggaggcgcacagcgccacggccgccgcgatctcggccggcgacggccgctccgcgaggccggccccaccggcgcgccaccgccggaagaggatgtagagggaggcgagcgcgagggcccggaatacgcggtcggcgtggcctcccgtcgccgccgccgccggcgcaggtccagcctcgccggcggcgacctcgtcgtcgtcgtcgtccatgctcagacgacgaggtggggaacggatttaccggtgtagttgagttcgcgaggcccaagtccgtcttttttacttgggctgaagcaatcgggcccaaatttgggagaactattgaaaacccaacttagggccgtgtttagtttctccttcaaaattttttttttgacataaacgaaaacacattcgaagtattaaatatagattaaaataaaataaattaaagatttcatccgtaaactgttagaggaatttattaaacaagtaaacaacaaacgagccaactcgatttgtgtgtgtttttttcttgtagttgatgccaaccaaaaatagctttccaatttggacaaatacttcagcacggatattgtgaatcttttgtgtctcaaatgatgagcacttaatagccattgtgtccacctattagctgctcatcactccacatgctatattaagtgttattttgtcacgcccggaatttctatctaaaattctaaacgcttacacgtatagaaacccttgtccagaaatcagccgaggtacataataacaaattgataatagagtacaattattactctaattaataagagaataaaatgtcattacagaggtagatagttcctctcaatcaataaagttctaagcaacggaaaataaaagaaacaacgcaggcgactcctctccacatgcagcttgaccagggctacgcctaatcatccactccatcggcatcactgtagaactcctcctctgataaatgattgcaaggtgagtatatgacatactcagcaagccacgcagcaaatatgcaagtgcacaggataacaaaggatggcataatattgtctcatttgcataaacaacatttaataaatatttcagaatttaattaaatagttaaata

SEQ ID NO: 52904 - DNA, 6493 bp, Oryza sativa
  unsure (1)..(6493): unsure at all n locations
aagcatgaatagtacatgtggatatttttaacatgtaaatctcaattttagaaaaatttagagacttgaaccaactaaatccgagctaagatgaattaattatgaatttttgaagattaaatcggattaaatcatttatatagattttaattgaataatgacgcaataatgaattatttttgaaaaggaaaagggaattattgcgtcagcgggtcaggtttacggtggaccgggtgcacggcggctgttcacgaaaacggacggccgagatcgatctaagacgaaacgaacggccgggatcgatctaatccatcgcggtccacgggagaagacgacgatgacgtcggcggtgacgtcatcaccggcgacagctcgggtgcgcatgctcgccggcgaacgacagcgcgacggcacaaacggaggacacctacgcaatgcgggcgacacagcaaaccttaccgaggcacgaacggcggcggacggtgaccggacgacgacggtgacgaggatgagcggcgatgacgatcgggtcgacgacgacagcgatattccggcggtcctcggcgttgtcggaggggtggacaaggtcagcggccactcggcgaacacggcggtggccttcccgagcgacgaggacgaccggagcggcggcggcgcatggctggacgaactacggcgacggcggcgcacgggctaacgcggctagagctctacgaacggcggcgagcgaaggcgaaggtggcggcgggtagaggagacaccgggggtccttataaagggcctaagggcggctgtggaggcccgcggcgaccggcgacggcgatggaaagaatagggttggggaaagaaaaacgaatccgaatcaaactcgaatccgacgatttccaaaggaaattagacaaagttcctatagaggaaaagatagaggagatcaaggggatcctttcccctctaccaatttcaccggagaaggaacggcgcgaccgaattggaaaggggcggtggctagggtttcggccggcggtctgctggaggtggacgacgaccgacaggtgggacccacctgtcagcgacgggagcgcgcgcgcgggcggctcagtttgggccgacatgggccgagggagagagagagaggtttgggccgactagccaaaagagaactttttaaacctttttcaatttaaatttttcatgaaatgcaatttcatttattaaaaatacttccttagctcaaataaatcctagaaaaatctaggaactatagaattaagcaaagtatttaataaaattttatctggccccattttatattggaatttattaattaaaaattagatcttctcttctaggcttttaaaataaattctaataattccaattaaacaacaatttatatatttgggatttttagggtgtgacaaacctgccccccttaaacggaatctcgtcctcgagattcggaagaactagcgaacagatgcgaatgagctgactttaattcatcttctcgttcccaagtggattcttcatctgagtgattactccattggaccttgcaaaaacggataactctattcctggttcttctctcatctgtctccaagatacggattggtttctcaacatatgtcagatcctcttggacttctatctgttcaagattagcctcttcggtaggtacccttaaacactttttcaactgcgacacgtggaacacattatggactcctgccaaagattgaggtaactccaactgataagcgacctctcctcttctactgacaatcttgtaaggtcccacgaaacgcggtgccaattttcctttagtgtgaaaacgatgaacccctcgaagtggcgtgacacgaaggtacacataatctccttcttcaaaacttagatctctgcggcgattgtcggcgtagctcttatgacgagactgagccacccgcagtctttcttgaatgatttttaccttttcctctgcttccctcaggatatcagttccgaaaacctgacgttctaccgtttgatcccacaaaagcggagtgcaacacttccgaccatacagtgcttcataaggagccatctggagactagcttgataactgttgttgtacgagaattcggcgtaaggcaaattcttatcccaacttccaccgaagtctaaagcacaagctctcaacatgtcttccaatatctaatttaccctttcggtttgtccatctatctgcggatgataggcagtactgaagttcagcttggaacccatctcctcctgaagtttcttccaaaactttgaagtaaactggctacctcgatcggacacgatcttcttaggaacaccatgcaaacaaacaatccttgccatatacaattctgctaaatgacttccggaataggtgatccttactgggatgaaatgagccactttggtaagtctgtcgactatcacccaaatagagtcatgacctgacgacgttctgggtagaccagtgatgaaatccataccgatttcctcccacttccattcaggaatcttcaaaggctacagcaaacctgcgggtttctgatgttctgccttgactcgatgacaaacatcacatactgctacatattccgcgatctcgcgcttcatacttgcccaccaaaatctttccttgagatcctggtacatcttagtactaccagggtgaatggagtataacgtatcatgggcttccttcagaattgcatctttcaaatctttgttgtctgggggacacagattctctcacccaaccatacagttccttgctcatcttccaagaaaccgatagctttacctcttctcatattctttttgatctcatgaatatcatgatcattgatttgggcttctctaacttgatcaatgagagtaggctttgcttccaaagctgcaacaaagcctctactgataatttccagattcaatctttcaaattccttgcacaattccaatggcaactgttgtccttccatagcattacaatagcctttcttactaagggcatctgctacgacattagcctttcccgggtgataatgaattcccaggtcataatccttaatcaattccaaccatctccgctgtctcatgttcagatccggctgggtaaagatatacttcaaacttttgtgatccgtatacacctctgttcgagtaccaaaaagatagtggtgccaaatctttaatgcatgaaccactgcggctaactcaagatcatgagtagggtagttcttctcatgcggacgtagttgacgagatgcataggcaaccacctttccatcttgcatcaaaacacagcctaacccaagcttggatgcatcgcagtacacttggaaacccttctttggatcaggcaaaatcaaaatgggagctgatattaagcgacttttcaactcttgaaaactctgctcacattcttctgaccacttgtacttcacatctttctgaagcagtcgtgtcatgggcttggcaatcttggaaaaattctctatgaatctccggtaatatcatgcgaggcctaggaaactgcgaatctctgaaacgatcttcggttgtttccagttggttacggattccacattactaggatcaacggcaactcctccggctgagatggcgtgacccagaaacttcacttcagacaaccagaattcacatttgctaaacttggcatacaactgatgttctcgcagcttctctaatgcaaggcgaagatgttcttcatgctcttctttggttcgggaataaatgagaatgtcatcaataaagactaccacgaacttatccaggtattacatgaacaccttgttcatcaagttcatgaagaaagcgggggcattggtaagtccaaaagacataatgtacattcgaacaacccataccgggtggtaaaagctgtcttaggtatatcttcttctttaatccttaactggtgatatcctgatcgaagatctatcttggagaaaacggtggcacctttgagttgatcaaacaaatcatcaattctcggcagcgggtacttattcttgatagtcacatcattaagggcatgatagtccacacacatccgctgagtatggtctttcttttctacaaagataacaggacctccccatggagatgaactcggtctgttgtatcctttctaaagcaaatcatctacttgccttttcacttctgctaattcattggctgccattctatagggtcgtttatggatcggagttgttcctggtactagatctattcggaattctatatcccttttaggcggcataccaggtaaatcatcagggaacacatctaggtactcccgcactatgggaatctcttccaaagttatttggttcaggcttgaccgtagaggtccaaagggcaatgcatgaacggttacaacttgaccatcattgctggtgagagttacttttctactggcacaatctatcacacctttatatctggctaactagtccatccctaggatgacatcaagatctttggattctaacagaataaggttggccagaaagggtacaccttggatctctattctgacagaggggctactgtggacccccgtttttataacaggaatcattcgtgtaaacagtaccatttccctggatcaagtagtttggtacacacgagttcatagctgaaataccaaatgcacatacacgagagtctagtgctaattattacaccataagccctcaggcattgtcttaaatcatcggaccgagtggtccggaatacatccaaaagcagaaatagataaggcagcggaatttaggcagcggcatgccattgccacaggcaacggccgtactaagacctactgagcgccatcgtcttcatctccctcctagtagtaggcatagggatcctccggagcttcatctcccgcttctgattaagtttatatttgcaaaggtgagtaccaaccgtactcagcaagccaccacagcaacaatgcatatgaaaggggtatttcaaaggatggctatggttcttttgcacaaagcaagttttgtaattcttttcacaagcctaaaacctagcattgactgatcaaattttagtaccatgtttgtatttaaacaacgacggttctgtccaccatccattgtgatcccaaggatagcttcccgccattgagtcgttatggttttctgaggacgcctaccttccctcttctcaggaagtggctccaacagcataaaaattcatcatgcaacaacccatcccacacaagttaataatttagagactagccaagtgcaatacatgtcccggtgctcaataaccgcgagcacggctattcgaatagatttggtttactcacactgcagtggatgtacactttacccacactccgcgactgcccaacacatgagccttgtctcaacacatgagacgcgtcacagcaaagcttttcgataacctcgcattggcagtacccgctccatgaacttttcatcctcatgcactctaggcgtacacagtttctagcagtgagaggagttctggcgcacccgggaagggaagttttacacccatgtaattaagttataactaggttcaactcaacacacgacagtcctagcaatggcgacaccattgtagagcccctgccttacacatgagaaaccactatgcatggatactgcctccgctcgattatttactccactaggtctatccccattcgagaaatgtggttgtacggggtcgtttcatgcttaacttcatggcttggtccttaattgaccggggacggtactagcctttcccggataccacccaaatccaccatccgccccggtctaaaacaaatgtttaattcctttcatgtcaccattatcatggcaatgtggtgctcatgtctccacatgccgcatctcaattaccttcccaaaggtaattgcctaagcatataatatttgataaatatgaatatgcaagcttctaaagtggcatctctaagcaagtgtcataattgactagggactcatacgtaattatggttacaaggatttaaaggtgaacaataaacaaggcatggcataatcacaaataggatgttcatcattgcatgcaatcttatttgtaaacaaaaattaattgcgcaattgggatcaacgtgatcaaagaatagtgatgacttgccttgctctaggtcttgtgggtcttggccttcacccggatccgcggctccctcggtctctatagttacgtgcgtaagaacaatttgaattcgattagaattcaaacaaaatccaaataatgaccgaattgaaaaacgagcgcgggaggtgaattctatataggctactttatttgcgaagtggaattattcttctccctaagatattttgtaatttatagtcatgtcctaagannnnnnnnnnnnnnnnnnnnnnnnnnnnnnnnnnnnnnnnnnnnnnnnnnnnnnnnnnnnnnnnn

SEQ ID NO: 52905 - DNA, 6999 bp, Oryza sativa
gctgttttctatttaacctgatttaagcctattcatttatttaaaattgattctataaacctaaattttgtacaaatgaagttcactcaatatttgtatttttccaaccaatgggtccatccttgattaattttacccatattttatttttatataattttcttgaatttaattagagttaattcttattccaacacttttaaatttaattgatacaaatatagtcgtaataatattttactcatttctatcctcaccaaatattattttaaattgcactttaattatttactttgtcaatttacttttcagggtttattcctaactaattatccattattcgcgatttataaacttcgaaatcaaaatccaataaaataatcgaacaaaatcggcatgatgcaattttatttaaaaagtttttgaaggcccatatttttggaactttgatttttgttggtcgaattttcagggtgttacagctacgttgtgatgagagtgcttggttactcggagtagtaaccatcaaaggacgtctaagctcttctacctccatcccatgatttcccgcaaaactcatagataaaaatgaatgcgtagcaccagaatcgaaaagcactgttgcaggaactgagttaacagggaacatacccaaaatcacatctggagcaccttgagcttctgcggcagcaacatggttgacacgagccttggctgctggtgcggaggagttgttttgagcagggacgaccttcgcgcgacggggcttcggacacttgtcagcataatgtcctgggtctccacagttgaagcacacactgggcttgctgccttgctccctcttggcaggctgttgctgtgatggagctgcaacagggcgtggagcttgattgcggttgttgttgcccgtgttgttgttgaagaactgacgctgcggacgagcaacagatgaagaacctccctgtggcatggactggggtcccaaagcaagtcgcagcctctaactatttccctgttgtgccttgaagtgagcgatccggcgtttcttctgctccatgcggttatacttgtcctcctgacgaatagccttatccactaacttctggaaatcatgataatccccagccatgagtgggtaagaaagctcatcattaagtccttccaagaacttctcctggcgctcttcatcagtgcgcacatcctccggagcataacgagccagacgattgaactcatgcagatactcagtgactgtgcgggaaccctgtgtgagcgacctgaatttcttcttcttgagagacaccactcccgatggtatgtgcgtcttccggaaagcagcggtgaattcaagccaagagataggttcagcagtagtcctgttaaggcggaagtgatcccaccactccgatgcagggccatgcagctggtgtgaagcaaaagagaccttctcctggtctgtgcactgaagcagatccaacttcttctctatggcgtgcaggcaatcgccagcttcaacaggattagtggtgctagacaaaacaggtggcctcacgcgaagaaactctgccagcttgttttggggaggtgcatgattgttcccttggttctgctggttttggagttgctgcatcatcaaattcatcaactgtgcctggtgagccaggacttgagcaagcatgggattctctgcattgttgttgttgttggggttggggccattcccattgctgcgagtgagcaccatctgacatagacaggagcacaagaagagaaacaggggaaaactacttaggacagggaattaaattgattaacttaacttttattgattttaactgagtttcattattacaaagctgaagactctcacaccacctaactcaccaacatcctaacactcgaaagcaaacaaaggcatgcatttacatcccaccaacgatgtaaacacatgcaagacccacacacacaaccaaacttaagcaagcaaactaacataacgatctaagacaacgacttagcaaaacggtctaggtcttccgggcatcggagttgattgaaggctcattcggcacgtccccatcatcttgagttggtccccactcgatcttggaatgggtacgcttggattcttcttcatcatcatcacttacgttgacgaccggaggatccgctggggctggggtagcttctttttccacaacccgaacctttggtgccaactggtagcgagggacgaatagagctctcttccttgcggtaagacgaactctggccttctgcggtggtgcttctcccttcaatgcagctagttccttctccaaacgatccaccttgtcttctagcttgcaaatcttgtcgcaattccggtcttcacggtcttgagcggctatcacaatctcagcgcgggtttcatcctagcccacagcatctcaaccaaatgccttgtggtagcatcattctcgatccccgcaggttcaaggtagctgccacggtcacttccctagggttgacgaggatggtagcgatactcggtgtcggccaaccggtcattgtagcttttacggagctctcctatggcgatccttgccacctcctgacaagcatgaatgtagcttcctcctccagcctcgaacattactgatggaatatcttcacgattgctgttcaaggcgactttgacccggcacttctcttcatcacgatcatgagggatctgggcatacaaaggggcaatcccaaatcctatgaggaaggacatcgtacgcaactcttggacaaatccttcggtaccgaacaaatactcaggcttgtatcgcggcatctaagacaagtgaaaggagggagttaagtcatttatccagttaatagcacaagtttttgggttagcttgaataaaaattagaaaatcaaagtaagaggtaaataaataaaataaaacaaacttgcaagataagatgaaacagttagaaacaggttcacaaactttgcacttttgaataacaggttttaaaagaaataaaataaaagagagttataaaatcattatactaagcttagttcattgcagcaaaattaaataaagcaatgttataaaacttttgatggtaaatgggccattagtacggtaatagatgtacagtagtaacaacacaggaataataaataaattttgaatgagaacaattaaagaggtcatgcattgcatgtgccattagtttgatttaattaaaagagaaagaggagagaacattgctacttttccaatatttttagagggcttctataggtaaccatttggcataacctagggtcaaggaggctctgataccaatttgtcacgcccggagtttctatccaaaattccaaacgcttacatgtgtagaaaccctcatccaggaatcagccgaggtacataataacaaattgataatagagtacaattattactctaattaataagcgaataaaatgtcattacagaggtagatagttcctctcaatcaataaagttctaagcaacggaaaataaaagaaacagcgcaggcgactcctctccacaggcagcttgaccagggctacgcctaatcatccactccatcggcatcactgtagaactcctcctctgatgaatgattgcaaggtgagtatatgacatactcagcaagccacgcagcaaatatgcaagtgcacaggataacaaaggatggcataatattgtctcatttgcataaacagcatttaataaatatttcagaatttaataaaacagttaaataatatttaaacaatattaatccaacgctatataacacaccctcttgcataggcccaaccatactgaacaaccaaccccggctgtacagttcaatctccaaaccaggaattaaccattccaaaccaggagctaatcaagtcattaacatcgtcatttattagagtgtaaattgtgagactaatcacgaaagacattgttagacccgcccataaccgcgggcacggctattcgaatagttcaaactctggccagaggtgtaccactgtacccacaacacacaacatcaacatcatgtcaaccatgcgtcgcgatacttgacaagtacccgaatagagattgtgacaataccctctatataatacaattcaaagcagtgcaccgttcccggatcataatcacccccttatgaacaaggtatggactccccagcgacccccgtgggcttatctccgccacttcacagtctggtgctctactatgaactatactatacagaaaataaagtcgttgcccacgctggcttgtggttggcacggtaaatgtttcacaaccgaaaatcgtgaaccagtccttaattgtcatgagcacgaccatcaaaaccatgtgctcacaacccaccattatcaggttttagttggcaaattaattaattaattattcatgattaaccatcatgagctatcattaagccatcattaaataatagtgaatcataagttatccccgtagtgaactaatgtttctaagcatgactaagcaattatgtctaatatctagctgaaccatcatataaagctcaactagtcaaattataatagcccaaggtatcaaggaataaagtaatcaagaacaaaacggccataacaaacaataggttaattccacccaattacattcgaaaataaatgcaatagttgaatagaaacaatagctttaaacgggatcaacatgctcaaagggttgtttgggatttgtgtgacttgccttgctggccttggaattcctcaaattcttctcctgcaaaatcggactctcccggaacgtcggaatctaaagagaaaagaacaaaatcaccaaaccagcacataaacaagcatgaatagtacatgtggatatttttaacatgtagatctcaattttagaaaaatttagagacttgaaccaactaaatccgagctaagatgaattagttattaatttttgaagattaaatcggattaaatcatttatatagattttaattgaactatgacgcaataatgaattatttttgaaaaggaaaagggaattattgcgtcaacgggtcgggtttacggtggaccgggtgcacggcggcggttcatgaaaacggacggccgagatcgatctaagacgaaacgaacggccgggatcaatctaaaccatcacggtccacgggagaagacgacgatgacgtcggcggtgacgtcatcaccggcgacggctcgggcgcgcatgctcgccggcgaataacagcgcagcggcgcaaacggaggacacctacgcgatgcgggcgacacggcgaaccttaccgaggcacgaacggcggcggacggaaaccgaacgacgacggcgacgaggatgagcggcgacgacgacggcgatgttccggcggtcctcggcgttgtcggaggggtggacgaggtcggcggcaactcggcgaacacagcggtggccttcctgagcgacgacgacgaccggagcggcggcgcgcacggctggacgaactacggcaacggcggcgcacgggctaacgcggctagagctctacgaacggcggcgagcgaaggcgaaggtggcggcgggtagaggagacaccgggggtccttataaaggtgctaggggcggctatggaggcccgtggcgaccggcgacggcgatggaaagattagggttgggggaagagaaacgaatccgaatcaaactcgaatccgatgatttccaaaggaatttagataaagtttctatagaggaaaagatagaggagatcaaggggatcctttcccctctaccaattttaccggagaaggaacggcgcgaccgaattggaaaggggcggcggctagggtttcggccggcggtcggctggaggtagacgacgaccgacaggtgcagcgacgagagcgcgcgcgcgggcggctcggcttcggccgacatgggccgagggcgagagagaggtttgggccgactttcggcccaaagccaaaagagaactttttaaacctttttcaatttaaatttttcatgaaatgcaatttcatttattaaaaatacttccttagctcaaataaatcccaaaaaaatctaggaactatagaattaagcaaagtatttaataaaattttatctggccccattttatattggaatttattaattaaaaattagatcttctcttctaggcttttaaaataaattctaataattccaattaaacaacattttatatatttgggatttttagggtgtgacatctttgactaaccggcgtcatgtacacctatctctactgctggctgtgttctttcgattgtgagtgagtttgttttgttttcagcgcacacgcttcccgtattattaaacggtgtattttttgcaaaaattttctattggaaaattgctttaaaaaattatattaatccatttttgaagtataaaattgttaatactcaattaatcatgcattaatagctcacctcgttttatgtatcttcccaatcttctttatctcctcctggaacacagcaacatgtatgtaacactctcttacacccccgcgtcactccgctccagggcgacacgggcggcgaacacaccagccccattgtcagcccctctccctcctttcctcagcatcgccgttagcaaagtcaggcggctgtagggatggtggtgccagagccgtcatcctttagttttgctcgtggtcacgacagttggggcactaacgagaccagggcagaaacttgcagcgggcagggcgctggtggacgctcctatctgcagatccagctcaggctgtgcgtgcactagtgagggtggcaacaaacacgtggggctggttgacaccgtgtgtagcaatggggacggccagtcttcggtacctcagccagattcatcgttcctacaccgacggcgaaggcgaccacaacaggccgtggagacagggagtggccagggaggtgaagcaagtagggcagtgtggc

SEQ ID NO: 52906 - DNA, 1126 bp, Oryza sativa
aaaattgctaatcggtgtcaacaattgtgaacccaattcgttccaagtgtttaagtaaaggaaaaaaatccaaattacccccattaattattactgtcgaccaaactaccttgttcaacttaaaaaccacacattttacactcaaaagctagacaaataccgcattccccctcccaaggttattccggatggtttttgtctatgtgatagtccagttagcaagttttttaaaacaaatggtcaggcccacctatcaattctctctccttatctctttgactctttcttgtcttccctacggccacaaacaacatcgctgccactcctcttcctctcttgcgtggtggataaggagctcgcgagcagcttgagctcggctcgtcgcaagctcggctcgagttcgactcggcaaggattcgagccgagctcgagcttgtctcgaagctcgcgagctctaccgagccgagctcgagctattcggcaaaagcttgaaattttcactcccgctacccatcccaatttctcccgcactccaattccaaaatcctaccaccaacagcagtccatcacctaaccatttatttcccttatatccccatcccgtatccaaaccctagctcatttgctctcttcctcgaaacatttctcttctagatctacaatcctaggctgctctagtgctccactgaccactgctgtggatctagccaagcaccgtccatccttcgcctctcctgtccaggaagaaccccatggaggacagcagcagcccaccgcctccgccgtgagtgacgaaccgacgactcggatctgagtaagtttcctcttctttctttgttttacatttttatttcttttgcacccacatgtatctagggccctacatgtattaactgtgtagtgtttagttgcttgatggatgttattgatttacattgaattttatggactaggtggagacatggagtagtacttatcttgctgtgctcctcttctgaagaaagactgaaggttgcagaacaccatgtgtttgccatttgccaaggtaaattgatggcaatgcttttcttgttgtacttgtttgattccttcccttgtgcagaatatatattgatagcagttggta

SEQ ID NO: 52907 - DNA, 1899 bp, Oryza sativa
  unsure (1)..(1899): unsure at all n locations
aaatttgatattaaaaataattaataactaacacgtatataaaatacaatatgaatattacacattagtagttttgtaaagttattgcaaaatttaaaattatgttgtcattttaatatatttaaataatataataagaaaatatatgtgctattatacgagagaaaatataatgatgccagccgcgcaagctgcgcgggccaccatactagtttagataaaatgaacacaaaaacacaagttaagaaaagttagtgccgaaagcatcctcagaaatcattttgtttttaacatcttataattacgatgtaattacgtatcgcttacaatgcattaaatttatgcaataattatatttgatatgttttcattataaagctttctccatacatactcccacttgcgctgcgctgtaacagtgatcatagaacaccgaaaaaataaagatgttttagatacttccggttgaaaaatggaccccaaataacagcgaccatacagacatacagtttgcactcatacgtcaatcatagtaaccagggacacgtacgtgacacgcgcggtccacggaggggcttccacaactcacgctctccgacgtagatgccggctccaacggtagcagatttcgctcctcctagatctcacacccgcaacaacagaacacaccaaacaatgggacgtaaatacacagctggtggtccagctagctagaggcaccatccacctatattttaaatataattttctcttaaattacttatccgatctacaatccgattacactgttgtgttcgtaacaattaaatctttacaataagatctcacatgattatattttgataaaaaatcacaaattacttttatgatatgtctaaattacttttagattttactaagttacttatataaaagtaaattcagtaaaaactaaaagtaatttacttcttagatatatatgtaaattacttttagtttttactgaatttacttttatatgtctaagaaataacttcgtgaaatctaaaagtaatttagacatatcataaaagtaatttgtattttttcatcaaaatataatcatgtgagatcttgttgtaaagatttaattattatgaacacaacggtgtaatcggattgtaaatcggatgagtaatttaagagaaaattttatttgaaacataaatgataggaatatttcccctacttgctcaataaattaatagcaaccaaaactcataaaataatagcacgtgagtggtctctggttaaaactaatttaagatgcctcttcaattagatttaccgcaaacaatgacgtcctccctgcttggaccgccactcttttttttttcctcccgcgaaaatcacgtgagatcaacaagtcggcgacgctgcctcgctcgaccgttcgatcgatcggcaccgcacggcgccatctacagcggggcttcccagaaaagcgcaaaacaacacggccatcgtcgcggtggcccccgtgcagagctggaaagtgagtcgccactcacggccacaccgtacgtaacgtgcggccgtcgagcccctccaatccggagcagagcgccaccaccccccgcccgtgtccgtcccccgcgcgacgcgacgtgacgcgtccacactatccctagcatggcggctctcccgcggcgtgacacggactctggcgcgtcaggccaaacgcctccccttcccgatgcacactgtagctacttgcaacttgcgcaaggagtatccccgaacgcatatttcctttccttcgtctacctccagcagcatcagcggcggcggcagctggatcctccctcccgagactgagagcacggcaagatttgcaaaannnnnnnnnnnnnnnnnnnnnnnnnnnnnnnnnnnnnnnnn

SEQ ID NO: 52908 - DNA, 979 bp, Oryza sativa
aagaaaagcaggagctgccagtcatgtcacaagtcaccatgttcttgcaggagcgaagtattccattcagatttgtacccgacacttcctgcgaagatgatgatactggaattcctcatcagaagcctgaggcacccaagaagaacccacaatgtgagtgatcttgatgacatgatcagcaatggagctagcacagggagtgtagttcttggtccttcggagaaaatgatgttggattctttgcattcacttgttgatgcgaaaacgaggccaaaaagtccttcattcttccactcaggaaccaagatgagaaaagctcggtcaaaatcccacatcataacacagtcagagatactgaagctgatatctcctgagacatgggagatctcctcccctggcgtgtcgccgttgaagaagagcacagctgagttgagcatgcatgagaagatggtgtcctcagatacaccatccatgagttcaaatcaacctgttctgtcctcatgtccatcttctttaagtgcagggcttctacaatgcatatggaaggatgggcttccacactttgaactgtcactggacaatcctatggcagtatacactgccaatcctacaaaggcccatgacaatgacaagccccttgactatgtctatttgttccattcaggagagcaagggagaaaagattggttaggcaactcaagcagtgtatcacggcttgtcggcaagatgaaggtgtcaagttctttggttctgaacccagacaagtctacttctatggagacagagtttgtcctgtatggttctccggatgactacctgaggcaaatgcaaagttcatatggtgttacaaaaggcaaggggctagccaagagagtggcagacattatgaagccatccaatttgaactctagtccgaaacatgtgtggaagtttggcaaatcgtcctcccaacagattgatgagatgactgaaatacctg

SEQ ID NO: 52909 - DNA, 2391 bp, Oryza sativa
ccaaaggtcagcacactccttcccgatgggtccagtgatagcagaacctgatagaacatatagaccatatataatcagttaacatgtccaatttagattattcagcatcaagaaagtcaagttctgcattgttacctttcatctcacccttaggattcacaatcactccagcattatctgcaaatgaatcacaacaacaatcagctaaatggttttggagtttatcataggagtagcaaaataaaccaagcaaactaataataactaccagtccaagaacaacttatatgaaaatatggaataattgattttccaaattgaatgaactgagtaaaaatgactgcctcatggcctagaccgaatgtttaattgcggcaacgccactaacaagggccatggaatatgagtctacattcagatggagcaattcctagggaaaacctcaacatccaaatgtttactttatgacgtctacctgggactatgcaaacatgaggtttgctccaaaaaggttgagggactcagatgtccctccatcaaatagcaacaactttaggcattacaaatacaaatgagaaaattgaaggtgagctgttaaaatgactgcctcatggcctagacccaatgtttaattgcaacaacgccactaacaagggccatggaatatgagtctgccaacagatggaggaattctgaaaaaacctcaacatccacaggcttactttatgacgttagattaggactatgcaaacatgtaaggtttgctccaaaaaaatgctgaaggactccgatgtccccccgtcaatagaagaaatgttgcatgggataacaaaagaagttccaaataaaatgtaagatatctaacagagaacaaaatatgattgttaggaagcatttaaaatgattgcctcatggcctagacccaatgtttaattgcagcaacgccgctaacaagggccatggaatatgagtctgccatcagatggaggaagtcacaaggaaaacctcaacacccaaaggcttactttatgacgtttgcctaggaatatgcaaacatgtgaggtttgctccttaaaggctgaaggactcggatgtccccccgtcaagcagtaaagtgtacaagttaatcacaacaaaaacagagtgctgaacaattataaatttgtcatacaaagtacaactctaggattggatatggaaataacaaaatacatttgtagaaataaaaagtacaaaataaaaaaaatgagaaatggtgtaactgtgtgcaataaaaatgatgactcatggcctagacacaatatttctatgcagcaatgctaaatcacagataacctgggatatgggatataatacagaatgtaaagttcagtatacaaatatatataataaatacgttgcaaagaaatgtctattttaaaatgatctcatctagaatgatattcactgatataacgtaagataaaaattcccatgaatattccagagaattaaatccagcccaagaaaaatagggcatatttgaattttaggttgggggaatattcgcctcatggccaatcccaaattttcaaggcagcaacgccgctacacaaggcaatggaatatgaggcagcccacagatggaggacatggataaaggaaaaatctttcatgcaaaaacctcaacacccgagggcttaatctctgacgtttactttggaatatacagatactgtaatatctgctccagtttaagctggagagcccggcggccctcccgtcatccacactctaaccaaacatctaaactaacagtagcaaaggacacaggtataatatagggttcaaatttcgcagcacacgattattgcaagaagaaaacaacaggtgtaagaggtgatctgtgaataataccttcgaagtacatgtagacacagtagcaaagcacacaagtataatatagggttcaaatttcgcatcacatgataattacaacaacaaaacaacaggtgtaagaggtgtaagaggtcatctgtgaataataccttcgaagtacatgtagacaccgtccttgcggcgccacggcttgcgctggcggacgatgacggcgggcatgaccttcttacggagatcgggcttgcccttcttgacggtggccatgaccatgtcgccgacgcaggcggacgggaggcggttgaggcggcccttgatgcccttcacggagatgatgtagaggttcttggccccggtgttgtccgcgcagttcaccgtcgccgccacaggcagacccagcgacatccggaacttgttccccgccgaccctcccctccctgcatcaccatcagatcgcaacacgaaacaaacagattagagcgcaagatttgcaagcacagtggttgaatcgaatgg

SEQ ID NO: 52910 - DNA, 2139 bp, Oryza sativa
aaaattaaaattttggttaaaattgaaatgatgtgataaaaaagttgaaagtttatgtatgtaagaaatttttaatgtgataaaaaaaataaaagtttgaagaaaaagtttgtaactaaataagggcctcagttgaattacagacagccaaagagccatagatgactaacctttgcctgcctggtggaatgaatacactcacatcttcccccggggttcgaattttaaccgatgaacgaatattttttcatcgtttggcagctgtagctttcatttgaaagcaaagcaaatgcagcctcctttcacagtaagaagcaacaaacgtactaacgaacagctgtacgtttccactttgcaccctgaagtcgcttactcccttcatctaaaaaaatgacaaacctagatgaaaaaatgacaaaccctgtgtttcatgtccaactttaactgtccattttatataaaaaatttttataattcatattttcattattgttagatgatataacatgattaatattttatgcgtgacttgtctttttaattttttttataattttttcaaataagacagacgatcaaatattgggcatgaaaattagggtttgtcttctttttttttttttttttttgagggagggagtagcacggtgaagcatcactgtccagggtctatcattcgttcgatcagtagagacatacccatgtgatgaagtaacatctggaaatgacagcaatgtggacccgttatacagtactactatcgatccctcattgttgcaattcaaggccttatgggttcagtttcatatcaaaattaaaagttaaaaaaaattagaataatgtgatgaaaaagttaaaaaattatatatgtaaaaagataaaaataaaaagctaatttttttaaaaaaaaagttgaaatctaaacagatccctattattgctgagcaagacccagcaggtcgccgtctgggctagtattgctgtaccacgtgcatcacatcgcacgctaaggagacagcagcaaaagtcccactcctccggttcgcatccgcgctagcgaaaacgaacacgactagtctactctactgtacgtacggcgcagccaagcccaaccgaacagaagtgtggcagggctgtgtgcgcgcgcgccggcggcgacaccgcgcggagctggtcatctcccggtacatgcgtgccgtgcgtgcatcacgtggcggccatgcatcttaccgatcaggcgatcacggccggtgagggcttttgtgttgggcccatgattctctctccttctctgtgcgtaacagcagaaaacaccggtgcgtgcgtgcgtgtgggtcgcctttgccaccgacggagaaggatggaaggcaacagtttttctggtggtacgcacactcttgtgctgttttccgtttttaaaagaagttttttctggtggtacctggacgcatggtcatcactagttgatttctcgcgttttgttcgtcaagtaatcagtggaacgtgtatgattcattaattctaagcatgcatcacattttgttgaccaagtctggagctaacctgtctatctgctgttttgtgctctacaaccagaagtctggagcacaagtttgtactatgagattgtaataattttactttaaaaaacaaattataacaccaatattttacccgtgtggtcgaggggactaattagaagttctacatagacagatcatggttcgcagagcgtgaactgaggattagcagtcgcaacgttgaggagctccggcaggcggcggaaacaaggatccccacgggactacgggaggattagcaaatccaaatccaatttaggttggcgatctaggctgttcccaataatgatttatgatgggcgccactttcccttgtctgatcagaagttatatgggccaaatgccgatcttgattaccgtaagttttgtaggccatacttgggtcgaaataatttttttggccaaacttggatctcgatcattatctgccatccataaatcttttttagaggaatctgccgtctatatttgagtatactaaattgggaatgcagttaatccgatgagatccaaatttgtgggcaacgcatatttgttgcgatacaaattgtgatcaatc

SEQ ID NO: 52911 - DNA, 2851 bp, Oryza sativa
  unsure (1)..(2851): unsure at all n locations
tacaaaatgcaaattttatgcgtggcttgtgattcaaaatagagtctaaacttccgatcgactagctacaagaggatggctaaatagcggagagtgccccctatgccgtatgacgaacgagacggcatgccaccttttagcttcctgtagatacaccagaaggatctggagactgacggccggctgggtggcttatcagcaattggatccgagcaattgggagccatgccaaagcgtacacaaatggtgggaaatgctattgctagccaacaaaagggaagtgcccaagaaagggctgcgatccttaatcctactcatagcctgggaaatctggaaagaaaggaaccaaaggatcttcgagcataaggaaacggcagcccccaatcttatggcaaaaataaaggaagaggcaagaatctggataatggcaggcgcaaggtgacttggagaattcctaccaacttaaccatagtgcttatgtaattttgtacagctctttttttttttgcccctaggggatatatttttttacgcctatatctaatgaaatagcacaatcttgtgatgattcctttcaaaaaaagaaaaagaaaacccacgtgcatttccttcgcccagaaaagtttttacatagaaatatattattctactaccttttacatagaggaaaaaaaggaggggtaatgagaacaactggattgtcatgtaagggataaaaaaaaggtgtttggaattcataagtttcggtcccctgaaatctagacactcccatgtgaatttcataaataagaatcaacaggaggtagataatcaaattgttttattgtgacatcccggcctaaggtttaataggattaatagaatactcatattaacaagttacaacttctttttccgaagccgatctctaaatctgaggttaagcgtgcttgggctgaagcaatttaggtatgggtgaccgatcgggaagaataatttatggatggatgaccgatctggtttgtgagggcaatctatgacctatgaaggctgtcatatgtaaacgggctcggcctgggataggcgaaacgttacatttatcctgttttttatgtgattttagtccctctaatattcactcaaagcagtgtactctaatataattcctcctcctttattcgtcatttctccttttcctaaatcctaatcttgtattggaattgtactttatgtaacattttaaatctatgaacgatctcacttgtcctcctaatggagcgattagttgaattgaagaagaaaaatggttttgaaggttctggattaggtcataattttttttagattattcttttttttactaatagataactttgggattattttgagaaagtattgagccacgtggtaatattggccggcagtgaaaaccgccagcattagtaagatagatacacaaaatgatttaaattgctccaggccaagcacgcttaaccctggagttctttggagattggcttccggaaaagaagcccttaagagagatggagattggcttccggaaaagaagtcctaggccgggatgttaccccgccgggatgttacaccctcacccccttaagagagatggagattggcttccggaaaagaagtcctaggccgggatgttacaccgccgggatgttacaccctcacccccttaagagagatggagattggcttccggaaaagaagtcctaggccgggatgttacaccctcactctcttaaaagagatagacgccaccgtcgatcaacctttaagtaaaaccgcgagagtcggctctgataccattttgtaatatcccgccttcccccaggccgggcccttaagtgaaaccgcgagagtcggctctgataccattttgtaacatcccgccttcccccaggccgagcccacttacatctgatagctttcatagaaaaataaactgccctcacagaccaacacatgtcttttctgtacactttgtcctcactcgtgtacacccaccgggaaagattttcccggtcggtcacccatcccaaattgctccaagccaagtacgcttaactttggagtctttgnagattggcttccgaaaaagaagttgcaacttgttgatatgagtattctattaatcctattaagccttagggcggggatattacagacagcgtaatcaagatcgttcatatgcttgagaagagagttgggtggtccaaagtgaaacaaaggcaagtttacccagtcctaagtgaaaatattgcttaaaggttgatccaaagtgaaacatcggtaacaaaaggtagcccgaagtgaaatttactctatatttcttgatagggcaaaagtaagtttgagttactaccattgttgtctaaacttggggtgatctagaccgtccaaacgcgcacagacattaactagtttaaagttcatgtctaggcagtggaaactcatcttttagttctcaactgagcacgcccagcaaacaagaaaatgacatcgtgagaaaacatattattgctagctgattacagttcgacagcttaacgggagttcagcatttatcatactgaggtgctcccagggtacgaacccgggccttgcatctggcggattaattagttgttaagcacatgccttctcttaaccctgaccatgagagcattcttcatgttaagtacgatggaaagtgcgggctcaactacatgggcggggatggtctccaaattggaacatttcaccacggcccccgccacggccttgagctgcacgaacgccatgtccttgccgaggcaggtccgtggccctgagctgaaggtcatgaacttgtacgacggtacgtacc

SEQ ID NO: 52912 - DNA, 1173 bp, Oryza sativa
  unsure (1)..(1173): unsure at all n locations
nnnnnnnnnnnnnnnnnnnnnnnnnnnnnnnnnntatatttaatactctatgcatgtgtccaaagatttgatgtgatgtttttgggaaaaagtttttgggaactaaacattcaagaaaatctttacttacaggtatgttcagaaaatcaaccacgttcttttctaattgcattcagataaacggacgcttgcagacgttcagaactatatatagatttgtaagtaaacaaatgttcagatgccctgcacttttctatctgcaatgcgtacatacggagtatatgtgcgagtaaatcagagtttgaaagtcagggcagcctgcggggggaggagatgcacgcgcacgaagcaaaaattcctcccgcactgaagaaacatcgatgggggctatgcccgagcccccaggaatgaggactgtgggatgagatctatgagatctgggggccttcctattctaggggttttagtaggggttctattgaacctagattctctctttcctcctaaaagttatttgatagctttgtttagggtctctgctgaagatgctctaataggattaataagtcgtcacgtgctgctaatatcaatatagagttttgaactaacagacccgtagtactagctgcagattctgtggtgagacagcacagacacaaacgagccatgtagtgtgagtgtctgcgttgtactttgtaattcttaaaaaaaaaaaaacgagccatgtacgtactttactaccattgaggccttgactcctttcgcgaagggaaaagatcgccatagtggattaaggtggacaggtggtacacgatgtactctacttgattgccggtccgcgatgaaagtaaaaacggcttaaggtggtacgcgacgtacgtgcctgcgtccatccactttgcgcgtcgtcttttttatcaaacaaaccgaacgaaaagcggcgcccaacagtgcgtggctggcctgattcttgatgtggcgagctcaccacgtacacgtaccgcttcgttcggctaacgaacaatctcagaggagtgcagtagtacgtcaactgctttcgtcttcttttgtagtactagttgttacgttaggtgctatggctccagtgctatatgcatgcagcgagagtggtcgcaaggacagagactgctacacccgcaagttgcaaaaact

SEQ ID NO: 52913 - DNA, 2563 bp, Oryza sativa
  unsure (1)..(2563): unsure at all n locations
gactactatagggcgaattcgagctcggtacccttctattggctgaggatgattgaagattgtttcaaatattataggggatgtgaagattgacaacgattcggcaatgttcaattggcgcccgccaccgtgttgaatcctatcatcaaaccatggccgttccgaggttgcgctttggatttcattggtcaaatttatccttcatcatcaatggggcataggttcatgctagttacaacgaattactttaccaagtgggctgaagccgtgccgctcaagaatatgactcatacggaggtaattgactttattttgaagcatattatccatagattcggtattccgcaaatattgactacggatcaagtagcttcttttatgtctaaggaagtgaagagttttgccgaatcttatggtgttaaactgttgagttcttctccttactacgctcgggctaatggacaagccgagtcaagtaataagacgttgttgaagttagtaaaaaagaagattgaggaatacccaaagaagtggcatgaagtgctttctgaagcattgtgggcgcataggatatgtaacatggtgccactaaagtcacaccttttgagatggtttatggtcaagaagccgttttgcccgttgaggtgaatcttggctctctttgatatatcaaacaagataatttatcaagtggagattacaggacattgatgggagataatcttgatgaagtcatcgacaagcgtttgaaaggtttggaagagatagagaaagagaagtagagggtggccaaggcgtacaacaaaagagtgaaagcaaagttgtttcaagttggagacttggtttggaagacaattttgcctttgggtactcgattcagagagttcggtaagtggtctcctagttgggaaggtccttatcaagtatacggcattgttcgagggaacgcatattttttggaaacccttcaaggagagcgttttcagcgagcaatcaatgggaaatacttgaagaaatacttcccgagtgtttggcaaggcacttaggaggttctatgaccggtaattgaattatcgccctaagaccaaaatatgttctatgcttttagattcacgttgttcatcaaaaagacagggggcatgtgtttacacccaaatttggcacttaggaataaaatagggaaaattaccaaagtttggaagtctgccagttttcctctgcttgggccggtctgaccgccgttgtttggctggtctggccgaccccggtccgaccaccgatagtgggtcggtcaaccggcggtgtgtggccggtctgaccggcagagtccgagtccgggtctgtttcgtcgggtctcgaggtttccttgctcaagaaggcatgtttcgggtttcctttggattctatcccgagttggacgtggaggacagcctgtagagggaagaaccaacccctatataagagacatggccagttcaattgtaactaatcaatctataatcaatcaatcaaatcgttattttgcttttgcttctagttctagtttagtttgtccatctttgtcgatttgcgctgtaaatcgttcgccgccgctgtgagagtgtgacacctctttgtaggtttgtcctgaaaaccttccgttttgcccacgagacggtgtcggtgatatgggtccgggggtacccacgctgagggaatcaagtcctttcccccggccacgtggtcgcacgcccctccaggccagacgtgtaggcaacgaacggccaagaggtgcctaacttcgtctaggggcctcggggtagctcgttgcacccctcgggcccgaggggctgcgccaccccgaggccgcattcaatgcggcgtggctggttgtgtgccgcttagcgattggacgtgccccagtcgccttgaccgggctgtgaccggccaccagcggatgggacgggtggcagcgcacccacatctcgccctgtgtcaagtggcgtgggggtgtagacccccgattttggaaatcggaaatcttctgtgtttatccgtaccaatccctggatcagtagttggtacacacatacatagttggatcacaacatatcacgaatgaatttaggctaaaagagttaaatacttacattagggccaagtaggccaacaactattagagaacaacagcggaagacaaaataatataagggcccggttaacatgccacaggcagtcgactggggaacgagacctagaacaagaccgctctccgatcatcttgtgggatacgcaagtgtaccgacaagggcttctcttcaacactctcctaaaagatatataaatagcaagggtgagtaccaaccgtactcagcaagccaccacaacaacaatgcatatgatagagggtatttcaaggaatggcttcaggttcttttgcataaagctaattttacaattcttttcacaagcctaaaacctagcatcgactgatcaaattttagtaccagtgttcactttaannnnnnnnnnnnnnnnnnnnnnnnnnnnnnnnnnnnnnnnnnnnnnnnnnnnnnnnnnnnnn

SEQ ID NO: 52914 - DNA, 2675 bp, Oryza sativa
aattcgagctcggtaccccttctgtgtttatccgtaccaatccctggatcagtagttggtacacacatacatagttggatcacaacatatcacgaatgaatttaggctaaaagagttaaatacttacattagggccaagtaggccaacaactattagagaacaacagcggaagacaaaataatataagggcccggttaacatgccacaggcagtcgactggggaacgagacctagaacaagaccgctctccgatcatcttgtgggatacgcaagtgtaccgacaagggcttctcttcaacactctcctaaaagatatataaatagcaagggtgagtaccaaccgtactcagcaagccaccacaacaacaatgcatatgatagagggtatttcaaggaatggcttcaggttcttttgcataaagctaattttacaattcttttcacaagcctaaaacctagcatcgactgatcaaattttagtaccagtgttcactttaaacaacgacggttctgtccaccatccattgtgatcccaaggatagcttcccgccattgaatcgtcatggttttctgaggacgcccacattcccgcctctcaggaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcctctcggccctacctcaacggctgtcccaccgtagtgcacctgcctcactcaggggtgaaccatctatgcagggatactgcctccgctcggctatctaatccgctaggtctatacccattcgagaagtacggttgtacgggggtcgtttcatgcttaacttcatggctcagtccttaattgaccggggacggtactagcctttcccagataccacccaaatcctctgtccgccccagtcgaaaaccattgtttaattttatttctcctttcacaaatcatgtcatcaacataatggcaatgtggcgcttatgtctccacatgccgcatctcaattaccttcccaaaggtaattgccccaagcatatagcatttgataaatatgactataaatgattctagaatagcatttctaagcaattgtcatagttgactagggactcatacgtaaacatggttacaaagatttaagggttagcaataatcaaggcatggcataatcacaagtaggatgttcatcattgcatgcaattttatttgtaaacaaaacaatttttgcgcaattgggatcaacgtgatcaaagaatagtgatgacttgccttgctctaggtcttgtgggtcttggccttcacccggatccgcggctccctcggtctctatagttacgtgcgtaagaacaatttgaattcgattagaattcaaacaaaatccaaataatgaccgaattgaaaaacgagcgcgggaggtgaattctatataggctactttatttgcgaagtggaattattcttctccctaagatattttgtaatttatagtcatgtcctaagactcatcgaattattgagttcttaatcacatgtaaattattaccgcgaaattgatttcttacggagattactaaaaataatctataatctataggagttcatccaattatattttcattaatcctatatttaaatgctagtactttaggtatttaattagtaagaattcatctaactatattttcgttaatcctataattaaatgctagtattttaggtatttaattagtaagaattcatctaactatattttcattaatcctataattaactttcgcaattttacgactataattaacctacgattaaattcttaactattttgaattttctaaacttctaaattttactcaaacgcctatttattttctctctttctttcttttctttttccccttttttttcttctttcctttctcttttcttttctctctttttcctctcctctctttctttttctctctcttctctccctcccggctcctttctccctctttctctctctcagcttcttgccctcccgggcggcgacgacgatggacgcaagggggggcggcggcttaccgacggcggcgacggcgacggcgacggtggcgacgtcgccgcaaggcgcggcgcggcgcggcggcttcgtggcggcggcagcgcggcggctctatacgacgccgcggtggcgtggaggcggcggcgcggcggcgtggaggcggcggcgcggcagcgtggaagcggcggcgtggtggagtgggtagaggaaaggaagtgaggatggagggaaagagtgggaataagggggcttatatagggga

SEQ ID NO: 52915 - DNA, 1088 bp, Oryza sativa
  unsure (1)..(1088): unsure at all n locations
gatggcgctcgtgcagatgaaggtcacggcggcggccatggcgtggaactttgccgtggaggtggtgccggggcacgtcgtggagccgaggctgtccgtcatactccacatgaagaatgggctcttggtaagggtcaagagaagagagccagtgatgaacacctgagaactgagaggatacatgcttattaagtgtgatcaatatgctattacatgatgtacagtacagagttttaatttatgttggtgtcgagcgtggtgcttcatctgtaccgtgtgcggtacgcgatagaggcctaaatttgcacattggttgcgtcagatttgtaatggaatccctcaaggatacgaattaataacttggggggtgtgtcatatgattgtgtcatggcttaagattaggacattcaacttgctatatatggggcgacgcccatatcttagcacagtgctaaggtgattgcattcatgcatgatggccccgttagctcactttgtacgtacgtaccacgggtccacggcaagcttattaaatgctctgcctcaaagctctttcatagagtaagcccatctacggcccagcttaaatcagctgtgacccagaggcccaccaatgaaaaaaagtgtatgggccggccataatcggcctaatgtgttaagtcatacatgctgaagaaaagtactttcctattgagcagattaagcaagaaaaatattctgaagagactgaaaatataacagaggccaatagcatcagccagtcaagtggtcaacaagtgcagaactactctgtcctgtcatatatttttatcacagcaaaaatccacaaatctgactatgcagcatgcattgctgactctgtcaactcttatccgtaggagtatatncgtttcatctgatatcatcacatgttctagcagacagcagggcatgatgatgtcaaactatttgacccgtccttgattacaagccagatcaggcacaatttctgaagataagtactatgtatgacaaataagacaacatctaactactgcggcacagctgtgctgctttgaggtcagcaaagctacactggagttaacaga

SEQ ID NO: 52916 - DNA, 1289 bp, Oryza sativa
gactactatagggcgaattcgagctcggtaccctaacttataagcatgcgtacaaatatagagcagatgtatatatctctactattataaaaattgaagatgtttttaccggtattttggtacgtcatatgtatttgggtcgatttttaagtttgttcgcttttggaaatacaaaagaagtcgtatgaaaaatttcttttaaaaaacttgcatgctttgttcgcttttggaaatacaaatccgtgtatgagtcagattttaaattcgtttgcttttgaaaatacaaaagatgttgtataagaattttttaaaaaaaaaatcttgcacgctaacttgagatgaaagtcaggctcctaattctagctcatgattttctaaaagcgaattcccacagtgaatttcatccttgttaaaccgtataacaataataagattaaaataacattcacccgttgcaacgcacgaataatttttgtaggtacaagtataaagcacgggtgcagccaatgagatctaaacatgaactgaaagacggtcccagcaaactggataaaacagaacaccacacgctatcacaaattattgctagctgattgcaagctcgacagcataacaaagatcttcgattatctggcagatcgattagttaacgttgttgattacctaccttctcttaaccctgaccattaagccattcttcatgtggagaaccatggacagcttgggctccacgatatgtcctggcacggcctcgatctcgaagttcttcaccacagtagccgccacgaccttgagctgcactaacgccatgtccttgcctaggcaggtccgaggccccgtgatgaagggcgtgaacttgtacgacggcacgtaccgcagcttgccgtcgtcggagatccaccgctccggcctgaactccatgcagtcgctgccccacacggactccgtcctacccatcgcatagatggacaccacgatcttgtcaccagggcgcaccttgtgcccgctcggcatcacgtcggcggcaaccacgcctttgtggtccagcggaacaggtgggtagagcctaagcgactcgcacacggcggcgtgcaggtacacgagtgacttgagctcgtccgggtcgaaggtcaccatgccgtccggggtggtggtggcgcgctcgacggagtcaagctcctctaggatcttggacgccacatgagggttcttggtgaggaggtagaagaaccatgatagtgccgagcctatcgtgtcgcggccggcagcaatgagggtcatggtcgtgt

SEQ ID NO: 52917 - DNA, 1985 bp, Oryza sativa
catgtcaaatgtcagcctcatgaacacgtcttgcaggttgcatctctcccccgttcccgcgaaatgggatatcagcggaagcagcgcattctccactttgtcactgctgcaccggaacacgaaagactggaatcggtggttgtacatgagaagctgggtcttggctcgctgccggcgccacgagtcgccgtccacgttgaagatgccatcacctaaggtgtcatcaaagatctcggcgaaatcgggtcccttggggtaatttgcgaagttggaggtgaagatgtgccggacattggccgagtcgcaggtgaagaagaaccgcatgttggacgacatcgttgggccgataaaccgaaaattgagctgggaggcggtgagaaacgaggtgatccagtcatggagctggtgacggttgacgagaagatcagggagcatgcccaccaacggccaacacactgggatggcagggttcttcctctttgatttgatgtggtagtagtagaaaacgctaaagcagaggaaacagagcgtgagctggagaatggaagagaaagccattgctttgactgcttgtacggttgctcgtacgcgcgtaatgcaaaacaaaggaggcggggtaccgagctcatgtgaatgcttgcagtaccacacgtgtataaggtgtattaatatacccgagcgagagtagtaagatgaggcggccaggcgggcgatgttagcaacagtgcttgtgatttcactgaaatttttccaagatttttgcatcatgaatgatatattggtattggaaagataaaattacttaatgttagctacatgaaccagctagctgccatcgatcgatgggaatcaactcctttgctccgcacagcgtgccatcttgtgtctcgttggcgcctgctgctcttggtatctccgcggaaagcggatactaaattatccccattctggctttgttctacctgccttacttctctaagcaaggttacagacttacagtgtcgtcatgacatacctcaatttccgtaatgccctgatatttccttcagcgctaaaaatatgtaccaatgtatcaaaatttaacttcaaaactatctactctctccgtccataaatataggagattttggttggatgtggcacatcctattacaacaaatctagacatgaagctgtaagatcaacgtgtgttttgattcttattctgtgatgaacaattggcatctgtgattattggttttgatatttggaatttattcacaaagtggttttggatttactgatattttatgtgaccggtcagaccgggcggagttgccggtcagaccggcttgtgttgagcggtcagaccggccggcccgcggtctgaccggccgacgctgtgtcggtttcagtttcgggttgtttctttggatatccgcgattgtttcatcgttatggcttctagatggatactatacgtatgtaatactgttgtttgctaataatgagtcaagttggggatagcttggtctcggaatatggtttctttgtttgtttcatgtgtaggtgactcgatgcctcgggagagtatttgcggtgatggaccgggagtcggcttggtggtaagacgatgtccgtggtggtcagatatcatgtgggatactaaggctagagttgatgcacgtggttggtgaagattccatatggcatacgatggaggtattgtgtgcgtatgggatgtggagtcgaatttggaaggagtccaaatttggtacgattggtgtttcaccgggtttcggcggtctaaccggcatctcaccggcggtcagaccggcggcgtaggcaggcagcggcaggcgatttcgtcggttcgaccgatcgatctacatcggtcagaccaacattcatcaggcggtcagaccggtgcgttcacttcggtcagaccgcgatccatcgaatttgagggtaacttttatttccgctaaaagttttggtttttgggt

SEQ ID NO: 52918 - DNA, 1100 bp, Oryza sativa
  unsure (1)..(1100): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatttgatttttcaatgccatatggacgtgaggatcaggtcaaatcagtcacgtaagtgccaaccatgatggcctgaaatcattgttcaaactgttgtggtatatcgtttgcattgattttaggagataagggatgttgtgcccggtttaacggttgagggatgcgatcaaactcaggctttagagaagggagctatagtgaactttttcctccagattataagctgttggaagtagagcctgatctgctattaggcccgcagtgtaatggaatattgagcgacatcacactgtttattgggcctgacattcctagcttaatgggctattaataggctttgacaacttggctgacgtcacacaacaggatggaccttcaactctaacgtttttatggaacacacgtgagaactagcgtacagagagggtctcgcctggtgaaatcgaacagaccgtttacattttacaacacggtgatagagatacgtaggccatgcatagtgaaaaccgtacatgcccgtgtacaaacacgtacgatatgttttcaccgatgggttaattggcacacggtcgatctaccgcttcttcaccttcaccatgaggccgttcttgatctgcatcacgatcgacaccttgggctccacggcgtggccggccaccacctcgaggtcgaagttccaggccacggcggcggcgacgctcttcatctgcagcaccgagatgtccttcccgaggcacagcctcggcccggcgttgaacggcatgaacctgtgcgccggcacgtgccgcagtttgccgtcctccgtcacccaccgctccggcctgtactcgccgctgtccttcccccacacgctcgccatcctgcccatggagtacaccggtatcaggatgttgtcc

SEQ ID NO: 52919 - DNA, 781 bp, Oryza sativa
  unsure (1)..(781): unsure at all n locations
nnnnnnnnnnnnnnnnnnnnnnnnnnnnnnnnnnnnnnnnnnnnnnnnnnnnnnnnnnnnnnnnttttgggtctaaaaccagcacatttctcttacacaggttttaggtgtcggttttatttaaaaaatgacacatatttggacattaaggtaccggttttaaatatttggcgagtggggctaggtacatgggtggaaaatacattatactattataggtgtcggttttagattttccggcacctatagtgacgacacatatttatcttttttaatagtgattttggccagccagcgaggtcgggtgttggtgcgctggagtgctggatgtaggagggtgcagcggcacactaggcgagatctagagaacttcaatgaaatcgatgtgcatcggtcggtgggggtgagagcataaggtggaatcactaagcaacacagatcttaaagtaactagcatggtggtcagcgtagatttcgcggctagcatcattatattttctctcatataatagcatatatgttttctcattatattattaatatatattaaaatgacaacataattttaaattttgcaataactttacaaaactactaaagtgtaatattcatattgtattttatatacgtgttagttattaattatttttaatatcaaattttagttatttgtaaattatatatattcctatatggactctagacttgtctttaaatttttgtttaattccgaattttctgtaaattgtatttctatatagactttaggctcttcttccaa

SEQ ID NO: 52920 - DNA, 1346 bp, Oryza sativa
gagctcggtacccctttgcacaagcctcggcatgccgcttcaaatgtcctgttccaccagatgatttcgcagataacttatttttgcatattctacatctcgcgaatgttacctgccttccatcagggcctgtcatggccacctcatcgaaatgttgccaaacaccggaagttcttgatctctttgagccggtgttcgtcgatacactcccactcatagtgccggatgcttctgaacccgccggtggctccataactggtggtgttggagccgatccggtggcatcatacttaccagttgggaatgacctcgacacgtagttagggtcgaaatcacctaacgtgaacgatggaatgttcgattcgtccattctgaaaatttaaaacaacataaacaaatttcagaatatttattcgcataacatgaaataaaataatacataaaactgaatatatgacgtacttctttcttaccacctttgcttggctttacacctcttgtatgcactatttttagtcacaaactatttttgattttagacaaaattttgtcaaattttgtctaaatcaaaaaatcgatctatcacacgaaagagcacaacagagcacaaaatgggaggtatggacgattcagaatgctccggtgggtgtcctatttatagaaacaaatttcatatttttttcgaatttttttccatttttttgctctccaacggctacttctcaaaaacagcggtcgttggattagctcactagccgttggggacacgtggcactctcgcattcgtcgtttgactagctgttcggccgccgtacgggatctcgctgagtcgcctgtcgccgtctcggctgctcccaacgaggcacggagtgacggaggcagtcagagcgagagcgacccagcctcccagccccaacgacacgtcgcgacgccgcttgccacgcgccacgcggcgacgtgcgcttcccgccgcctggccccgcggctgccctcggcggctcggccgcttggcgccacgtgcgcggtgtgcctaccctaggccgctcccgtgccgtgccgtgctcgcgggccgtgccgtgccagccctctacagtaaacgtgccgtgtcgtgctggcccacgggctatggcgtcagcccagacacggcacgggtaaacaggccgtgccggcacggcccacaggccggcgtgctgtgccgggcctgggccttctacagtgcggtcgtgcttgggcccgcccggctttggcacggcccatttggccaggtataggtggatccccacccaccacccaatccacttccacggtgggtgttaaactcccatgctattcggctggggaaaaca

SEQ ID NO: 52921 - DNA, 1754 bp, Oryza sativa
ttatgcatatctgtatctggatcctacagaacaaacagataggatgagtagtatctgatgtaaatataatactcgagaaaaattcaagcattttaaaatatttataaatatgtatttcttctcttgtcaattttgatttccccgagcagatgactcattacgtttaaacactctgcccgactagtcatagccaccaagcaccgggagtcggcctaagcacttcccaaacatgcatatgagtgacatgagtttgtcattaatggaacaaagtttcacgggtcggagtttactactcgggtacttttgcaattattaagagcagaaaataaattatcttatctctatgtttttgatttattccgaataatacttagcaccttgcattattcggtccatccaacaagcccccggtgctaggaatcggcccaaaggcaactatccattggcaaaccaaacggaaagcataggaagatggaactccataactcgataggcatgtttgtactcagaataagtcgcaagcaatcaagataaatattatgaaaattgtttaaaaaatatggtataacatctgtagcccccgactcactagtcaacagcgaaccagttgatgtagtgaggcaaaggaaaaggcaaaatatcgtataaagaataaaatgaatgataacttagctttgtcatatttccttggtgacagcagaagtagccgatgtgggaatgaagcagtccatcaatggtgacaaaaacaccagtcggcgccagtggaaccaagccagtggtgtagatgatgaagcccattaacggcggcggagtccgccaaccgtataggcgaaaacaccagtcagtggcggcaaaggcaggccggcggtgaagtcgtagacgcccaacagtggcggcataataggccagccgtacaggcggaaacaccagtcggcggcggcaaaggccagccggtcggtgaagacgtggacgcccatgaacggtggtgtgaccaaccaaccgtataggtgaggacaccagtcggcagcgatggaggcaggccggcggtgaagtcgtagacgcccaacagcgacggcataatattccagccgtgcaggcagaaacaccagtcggcggcggcgaaggccacccggtcggtgaagacgtggacgcccatgaacggtggtgtgaccaaccaaccatataggtaaggaccaatcaacggcagatgaggcggcgttaaggcgagttgcccattagtcgtgctagagtcggccggatcgatctcttgcaatgaatccatcgcatatgcaaaaagaaagcaaacatatagatctctgttagtgagcaggaaaatatagatgctttatcatatactagaaaacatctatttaaagtatagcatgataaaaaaattttaatccacgcgtgttgattgaatcaacacatcgggcatgctttccagggagctgtaatgtcctggcctgagctttcctgtgcatggagtaggcatgcatggagagagcacatatatatccatattaaatcacatgcacgtagcagttggtcaaagcctggaagcatcagcatgtcgcatggttcccgtgaagacgtggctggcttacgacttggactcatgatgagtagacggagtgctttgtcttgcacggcagcagcttgttaggtagttagcgtccatcagagcaactcagccgccagtagtatatgcggacgtgcaaaagaagaattagaaaaacaatatcaatctgtgatta

SEQ ID NO: 52922 - DNA, 3880 bp, Oryza sativa
ctttgtcttgcacggcagcagtttgttaggtagttagcgtccatcagagcaactcagccgccagtagtatatgcggacgtgcaaaagaagaattagaaaaacaatatcaatctgtgattagaaactaatctaacagagattaaattaaaaggatgaacccagatcatgcatgtcgatcggtcgacatgtgcatgtggattactcctggaggctggcgatctcgtgcgcgagccgtgagcactgccgttccacgttgctcccatgtcaggttacaccgccaccggcatctgcacacggggcatggaggaacacgacgtattgggctgacacaccgggatgacagccattggtcttgatctcagtcggcatgcaaaaataagagaaagtaataggagattaatctgtagctagaaatcaatttaactagtgaaacgataaaattatctaatgaagttggagattgaatcgatgaaatcgctgagattaatcccttcggctgaattgaatccaagacgaaaaagacatgcttcacgaatccggcgatgccgaagattgattccatcgcactcgttgataggaaactcgacgcaacccctacctggcgcgccaactgtcgaaacatgaattcggcaataataaaagggggtagcgtacgagacctaaagtggatggatgcagagacaaaggatttagacaggttcaggccctctcaatgagaggtaataccctactcctgtttggggatttgaatccgccgggtgtagtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctgttacatattccatagatataagttatcccctataactagtcggataactacgccgtgtgggtatggggtacccataatctccacagttttctttttcttgaaagggagattgtctttatctctattggccctgtttgaatcttgctatttaagagtattaaacatagattactgacaaaacctatttcataacctctaggctattttgcgagacgaatctaacgaggtatattaatccatgatttgctacagtgatgctacagtaatcagccgctaattatggattaatatacatcattagattcgtctcacaaaatagcctaggggttatggaatcgattttttcggtaatctacgtttaataatcctaaatagtaagattccggagggctatttaatagcccggaggattcaaacaaggccattgtcatgaacatcagtaacaatttgaccatctttcgttaaaagagtatttaacgttatcccaatatgtgtatgcatggtaacctatggtgtagtgagtttatgatgttcagagcttcgtcgcaaaaagaccatgcaatttaatcaaggcctatatcaattgctttatagacttgagggaacaaggcccaggataaccggaggtttttgggccggtccaagaagagaaacactaatgcgacgctttaacgtgaaaaggccaggaaaaaaaaatcgaaaatgccatgccatgcctagcctcgaccagttaattatgcatagcctgcagccctgtacaacacagaataagttatggagtaacttattttgccctaatggcattcgcagtgcgcaccgctggcattcagctctagcccttcaactcaaatatttccagccacgtcggtctctcccgtgcccatgtgagaaacatgtagccaaagttagtcacaaatccctcatcaaaatgcgtcagagattcgtcagccgacacgagaaagagagagcgagatgagggggagggcctactagggagccaaagcatcatcatgtgttggtggcacccatttgcagccgtcattggagatcggttcctggcaagtgaaggcgtcgatcactagggcgtgctccaccgtcttcgccgatgacgccacctcctccttcacgacggtcatgtcgtcctcccttccgtctctggcgcggtagtgatggtgatggcgaccccgaaggcgcggcggcaagaggaggaagggggaggcgctgcggccggaggaggggggaggcgtagcggccggagatggaggggggaggtgcgtgactagtgaggaatgagtggcgttgagaggataagggagaaacttacttttttatttgtgtacatttcacttgaggctacatatcactgtaaaacttgtggcaagtattattcttcccgtatcttcatcctatgtggtcctcaaactagcgactagtgagccgtactgtgaatggtctaagaatatctaacttatttagaatcttaaaaatatctagcttatttagaatctcaaaagaagagtgacaattgggatggtttatgtaatctttttttttgtaaaaaaacgttctcagttttgattctgtgtaactatgccttcacgcagcatgtaaaaccggaacattatcccaaaaaaggtccccgaatacaacattttgctgtgaagtttgggtttttcaattgtaaggtgtgaatcaaagagtatatcgtgttaactgcacagaacatccagaaacagcagagatgggagaaaaaaacaggttatagtgacacgaagctcagatcagtgctgcagcattcatacgtcgtaaacttgattccgcttggtgatttacaacagcagtatacacacatactggaccagccatttagcgctccaattattggaaagctagtactgaaatgaacgcgagactaccaatactacaccatgctagtttcagagacaacaggaaggttgttcgtttgttcagatcaggttgttgccgaagccaaggacgagtgagcagcagcagcggcgaaccccgcgtagcccagcgcgtcgctgctgctaccctccggcccgtcgccgtcgtccgtgtcccacaagaacgcggcgtgcgcggcgagaacgtggctgcagagatgaacatcaacacgggtcatcagaaaattcagaactgattctcgagttcgcgtcaaagcagtagtagatcgcgacgatgcgaccatggattggtgcgtgaaagattggtcgattgcacagcgcagcgaacctgttctgcggggaggctctcgctgcccgctcgaagtagctggaggcgcggtcctcgtcgcggggcacgtcccagaccagcttggcgtactccgacaggagctcgccgtcgttcgggtcggcgaggatggcacgggagtagtactcctctgccttccggctatcccctttaatctaccaaatccattgcatttgctcatgtgttagacatgagaagttgagaacgatcgccagatctccactgaaatttgcagaaatggacagtgctgtggcttacctgatacaggaactgcgcgtagttcctcaggaagaggccgttgcatgggtcctcctcgatcatcttcttgtaatgcatctcgatgtcagagcgattccctccgttgtcggaggtcaccaggtaactgcctccggcgccaccgccgccgccgccgtcggaaccgccgctgccgccgtcggcgctcagcaagcctgagccgaggcggtcgatcccgaggcctctggcgaggaacagcgggtgctcgacctgcgcgaacgtgctgctgccgctgaagcggaactttccaaagctcagctcctgctccgcgctttcgtggtcgccgtcgtcgtcgtcctcctcctcctcctcgtccgtggaagcgccgccgcgttgcgtgaacgactgga

SEQ ID NO: 52923 - DNA, 2509 bp, Oryza sativa
  unsure (1)..(2509): unsure at all n locations
acatggagtagtacttatcttgctgtgctcctcttctgaagaaagactgaaggttgcagaacaccatgtgtttgccatttgccaaggtaaattgatggcaatgcttttcttgttgtacttgtttgattccttcccttgtgcagaatatatattgatagcagttggtatttttaatttttgtagatgtttgtaaacctgcaaagacagctatctatagagatcgagtcaccgagcaatagggatggcatagcagcaacagaagcacaaccgaatcagcagctagtaccaggtgaagtaaggggagaagagggccaagagggaaacccaactaaagccaccaggaaaaagaaatctccattgtgggatttctttgaagaatgcactgtgccatcaaagaagaagaaaggagaaatggaaaataaggtcaaatgtaaggcatgtgaaactctgctcaccaagaatagtagtggaactacaacacattggtggaggcatttagagcagtgtgattatcacaagcttcaacaaaaatccataaaacaacagaatatcaatttccctagccttgatgaaggtgatgttgatcttgatgctccttgtgtttctgtccctggttattatgatcctacaaagatacgtgagcttatttgcaaaatgatcattgttcatgagttgccattttgccttgtggagtatacatggtttaatgttttgctaaagaggttaaacccttcttacaaaaaggtctctagaaataccattagaagtgattgtataaggctttatgaatctgaaaaagaaaaactgaagaggactttcaaagatgttagaaagataagcctcacatgtgatctttggacctctaaccaaacaatttgctacatgagccttgttgcccactacatagatgctgattggtcaatgcattgtcgtgttattaactttcttgagttggagcctccacatactggtgtagttattgctaatgccatttctgattgtcttccttcatggagaattgaggacaagatagctagcatcacatttgacaatgcctcaagtaatgacagtgctgctaacctgttgcttgccaagtttacaaaacatggttcactttggttttatggaaaattccttcatatccgctgttgtgctcacattctgaacttaattgtccaagatggtctggctgtgattaagcatataattgacaaagttagggacactatcaagtacatcaagaaatcaaacaatcgagcatacaagttcagtgctgatattgattctctcaaccttaaaagtgacatgggtttggctattgattcctgcacaaggtggggctcaaccttcaaaatgctgcaatctgcatttttttataggtctgccttggatgtatatgctgcaggagatgcaaactataggtggctgccaacaccagaggaatggaatctatattgtgaagtcaatgatgccctttctgtcattcatgcagccactgaggagttctcaggttcaacctacccaacatctaaccttttttattctcacattgtcgatattaagagagtactaggtcagttgttgaagtccaaagacccaattcttaaagaaatggcaaatgcaatgcttgaaaaatttgagaagtactggggcccagaatgcaatactttgtttgcagttgctttggttctagacccaaggtttaagatgggtatgattaactacacattccctgctttgtatgaagaaactgtacttcctaagaaacttgcaaatgtggaatccacattgaaatctttgcatgcatcatatgaaagtgaactccagagcacatcaaaggaaaatgatgcaaccactcaatctactagtacatctctaggcactactagtagtcatttctctgctgctaaccaatttcatgagtatatgaaatcaaagaatgctgctagtcttcctaagtcagatttaaagaggtacttagatgatcctgttgaggatattcctgcaaaaagtttcaatctacttcagtggtggaggatgaatgaattaaagtatccaattgtggcaaagttggccaaggatattcttactattcccatcacctcagtctcatctgaatcagctttcagcacagggggtcgagtgattagtgtttatcgcagctctttactcccatcaacagtacaagctttggtgtgtacatctagttggattagaggaggccaccacaaaagcacagatttagtaagttcttatattttcatgtttctaaccaattaatagagatacacaatctaataatctgtgtttacttgtttgttgcatactaggaggatgatactaattctattatccttgtcccaaatcaagcttcaactgcaaattcggttgtgggcagcaattagactcgtttgtcaggtatatgtttgaggttatataaattatnnnnnnnnnnnnnnnnnnnnnnnnnnnnnnnnnnnnnnnnnnnnnnnnnnnnnnnnnnnnnnnn

SEQ ID NO: 52924 - DNA, 1384 bp, Oryza sativa
ttcacattggcgtactgtcattgccaatagtggagtaaatattttgtgacagttgaaatttgaagtacgctgtgttagtagtataagtaatatttagatattagagcttttagatggaacatatgttgggaacttccggtgggctacttttgatgttaattgatgctctatgttctgtcaagtcattgacacatgatattgtaatgtttcttatggtgttatacacaccggtctattataaagtagtaatcctattatgacttatgcactactatgaatttgtaatctttctagtatatacctgtcgagaagctattatattctattatgaatttgtaatcctactttggcttgttaagaagcttttattgggagataagttcagattgctgaaggaaacagtcttaacgagcttctacgaatcgagctcgagtcgagccgagccttgatcgagctcgaactgagcctaccttcaagctcgaaggtaatgctgggctcggctcgagcctgtaccgagctcgagcttaggtaggtaagctcgctcgagctcggctcgttgacagccctaataaggaccattttacatataaagagcaactatatttgtctactatcaaactctctatgattgttgaagaaaaacaaataatgtcacatatgctccaaatctcattgaattcctttcacaccctagaattttgttccatccttaatgatgactatctctctcgtgacctgatcttctggtaaggggataactctcgttttgatcgagtgcgatgtttgcgatgtggttatcaactagaataagtccagaaccatgtgcaatcgctacaccacaaacgttgtcataccaaccgtgacgcacagctaatgatccctgcaatgcaaatgagagaacactgtaaggacaaaataagatgcaatctaaatattgtgaataggtaattaagcgcaaaggagtagtaacgattgaagtggtagatctaatcgacccgacaaatcaacacaccaattattgggagctctaaatttgtagtcgttggctaatcgagcgaggcctagagaaaaggtgaatggcgcttggcaaaattcaactaaataaaaatcaattgttctagagggtgtacatagacacttatagaggaaaatagatctagggttaagtgttggttcgtagagatggagggagacacttccgaaataggcctaatctattacaaggctcaaggcccaaatacagtttcagtaacaatactatcttgtttggacgttttccattgactcgggatgaaatttgatatgagaccagatgcatttgaaaggtgacgacataagctcccaacaagtccaaaatttctcaaatcggagttggaatgaaggc

SEQ ID NO: 52925 - DNA, 4376 bp, Oryza sativa
  unsure (1)..(4376): unsure at all n locations
nnnnnnnnnnnnnnnnnnnnnnnnnnnnnnnnnnnnnnnnnnnnnnnnnnnnnnnnnnnnnnnntttaatgagtactctctctgttttgtattatgacagtttgacttttttatgttaaatttctttaattttgattaaattcatagaaaaatttagcaacacttacaacgccaaattagtttattaaatctaacattgaatatatttttatagcatacatgttttgtgttaaaaatgttaatatacctttttttttatataaacttggtcaaacttatttaagtttgaaatacatcttataatgttttcataagtttttttgtggggaatgttttcataagtttgactagagaaaagtgaaaatgtcatatactatgaaatgaagaaagtactttgtttccttcaccttactcttaaaaaaatacttagaaatactcaaatacagatggagagagttggtatgtagtattactcataagtcgtaagtagctatatgcgtggtatttttctccattttttcctctctctttttttcgtgtttaccacacctaacacggcaatagaacattaattggctcaaacacgtgaccaaagcactgcattccgcctatatataggtatccatgttcattttaacttatgccttcccaatatccatgtgtgtgcgtggctatgaaaactttattttaatatcactagatttgttgtgagaaatgctagctaccccaaatcataattacgttattatatagtaatgtaaagtaatgaaatatgcactggtggagaaaccgtttgtagtcccggttggtaaccccctttagtcccggttgtccaaccgggactacgaatcgggattaaagaaagctatctttagtcccgggtgaaataaccgggactaaagatcgagctgaccttttttttttgcatggccctgtttgctgcatggttgattatatatatatatatatatatatatatatatatatatatatatatatatatatatatatgtgtgtgtgtgtgtgtgtgtgtgtgtgtgtgtgtgtgtatgtgtatgtataaatcatatatattaacacaaaagcaaatgtgtacatatataaatatatatatacatgcatatatagtacaattcatttgctcggtagctatagctacgacttcgacttcgacgccggcgttatgtcagaagaggaaggaccgacgttatgaattgttgatgatccgtcgtagtagaattcaccgtcgggattaaggacttcttcgttgatgaatctcatcagttgttcttgaacagccatgataaaatccttgtgtgggagattatccctcatgtgaatacgctatcattcgaaaaataatgacgtatcaatatatgaaattaataaacaacttaacaaatcgatacgcaatgaacttttgaatggtttatgtatacgtacatcgagctctcgtgttgtgcatatttggtttgataggcagtgggcatactcgcatacgtagtagacgcataagttagttccctgttcctgctttgcacactacatgagaaacgaagagagatttaatatactctttatattaactgtaattagagattcaattcaatataattttggatcatgcatgtactcactggaaaatgaaacctccgtccaagtttttctttccaagtcccgcggaccaattgacggaaccgatcccaagccctacatatgcagttgcaagctatgattaattaattattatctgagatcaacataatagcaatagattccccgcgactttggaatagatagcattatattacctgtctatcagtttgaagaccttgtcaaaaatcttctcctatttattcattgagtcgtacacagtgactctgcatgcatccaagtcgaagaattacaggacccagtggaatctggaatatgcgtgagatgagatatatctgatcgaaaatgtacatgctatatgtatgggaatgaaatttgttcgaacgacaataaaaactcactctgtgttgtacggcagtagtatgtacgtcttgaaatgctgctgcgttaggagatggacgagattgtcctctgtgtctttctcgtacttgtcgatcatttcggtgttgattttccgagggtcgatgaacccagtatcgtagaccctccgccgtcgggccctttgaatctccattctacaacgatgaaaggaaagtattattgcttacatatatgtcaggagctaattattgaacgaaacaaatcgaactcaaagatactcacaaaatccatgcgctcaggagagagacgtcgagggcgtccaactggtacagatcgaagagatctttgaaatggatccagagaacatcgtctccttgcaagaagtcggggtttctgatcctcgccccaaacatctctctaccgttggcgctcatttccatgtaccgttcatggaatttgtacatctgtgtcggtagggactccagctgttcaggtttgacaagcggtttaccgagttcaaacttgtatgccacttccgccttcgggattggtgcggctccaaccaactaatccacagatagaccggtgtctgcaatgaaatccgttatgccaaaatcttcaccggtcaccaacgactcgacctcttggtttggttgttctccaagctgagggactggtttggacttcttgtgataggctctctgaagtgttcggtcatagtccgatatctgtaacgcctccttgtttgttttggacattcccttgaagaagttcttcacgctcgggtcaataggtatcctcttttcaggactctgaggcttgagttgcctcttcacctctcctgccacataagcatcaagctcctcttgactgcaatcgtatggtggctccttgtttttggtggcgtcaacttttgccttcttcgttgcccttgtgcgggcaggcggtggagcttggcgagaccttgtcttgggaggtgcaggcggacacggtggaggcggaggaggcggaggagccggaggagatggtgcagcaggaggtggcggaggagccggaggagatggcggagccggaggagatggtgcacgaaatgccacttgtcgcccaggaaggatgatgtaccgcttgcgccatagtatgatggcgtggcttgtgtctcgtagatgcgtctcaccgtcccctcctgggtagtccaactcgaggtcctcgtacgcggcttccactagctcaacttcgaccctcgagtatcctgctggaatcggcctgcagtggtaagtcccggaagggtccgttgggatggccattcccgatgccaccttcacgtgatgagaggttatctattagtaatcaacctaagcagcaacttgcggaatgtacaagtcaaaaatcatcaaactacgagcataccttgattgataagttcttgaagggaatatgcagctcacatggtgtccgctgcgtgatctcatcaacggggcaggaggtttcgtcctgggtttgcatggcgtctatgctctatgatccgacctgcccggttgaggcgcagctgctacgattgcctgatgggctgaccattacaggatgaatgtacggctggggatcttgggaccgatgtgcggccatacgttcatccaccttccttgccacctcctcttgcatgctaagctcgtagctcgataccctatactcaagatctgcaatcttcgcctcggtatctctcttgttcctcatccgactcctgtatgtgtggatgtcctccttaaatccaatcttccagggaatcacgcattttcctcgtgttcgtcctggatgctcgggagtctgtagggcgagtgacagctcatccttctctctatcgggtcggaatgtgccctgagaagaggctaccactgcgtctgttagtcgactggcagcctcgcgtatctgatcgcttaagacaagggagccatcaactgggttaagcgttccaccgtgagcatagtaccagaacttcgatcgatccggccaattagcggtggccggttcgatacccctctcaagcaagctagcctccatctcctcccacttcggcttcgcgacgctatatccgcctgaccccaagtggtgatggtacttcttcttggcagcattttctttgtttctggccatcatcgcttgcccttgttgccctgtcttgtaagcaacgaactcgtcccaatgatcccttagctttgggaatacgtcgaagttcggtgttagtcccttcaggatgtatttcttgtagagatctcccttgaagctctggaactgttctgccattttcttcagagtccactatttcactaagttatccgtacccgcgggtagcgtgaacgtctcgagcattggggtccacaacatct

SEQ ID NO: 52926 - DNA, 1173 bp, Oryza sativa
ttatatatgctaagtctcacactcttatattgaatctctgacagtctgatatttactctctaatactctcatattagaattgtgatagtcatatatatatatatgcagagtctaatactcttatataaaatggctgctactctcatataaaaattgtgatagtcatttatatatgctaagtctcacactcgtatattaaatctctcacactctcatatttaatctctcatactctcatattagaattgtaatagtcacatatatatatgctgagtctaataatcttatattaaatggctacaaatgtcatattaaaattgtaataatcatttatatatgctaagtctaacactcttatattaaatctctaacactcttatatttaatccctaatactcttatataagaattgtgatagtcatatatatatatatatatatatatatatatatatatatatatatatatatatatatatatatatatatatatatatgctaagtctaataatcttatattaaatggctactaatctcatattaaaattgtaataatcatttatatatgctaagtctaacaatcttatattgaatctctaacaatcttatatttaatctctaataatcttatattagaattgtaatagtcatatatatatatgctaagtctaataatcttatattaaatggctactaatctcatattaaaattgtaataatcatttatatatatgaagactaacaatcttatattaaatctctaacaatcacttatttacatcacttgcctgcgcgaattccttcgatggctagctaccacttcggcttgagggacgacgccgacgtcttctttgcaacattaccaggaaaatgtattagtctaaacgggccaaattacatatataatcatatatgtattaccagtaaatcgtataagtagaaacgcgtttgttctaacacttttagtacaagtgcattcacgttcgtaagcatttcgtgcaagttcgttcgtgtttcgtaatcgtatcgttcacgttcgttcgcgttcgtccgcgttcgttaacgtttcgtgcatgttcgttcgcgttcgttaacgtttcgtgcacgttcgttcgcgttcgttaacgtttcattatgttcgttcgcgttcgttaacgtttcgtaatcgtatcgt

SEQ ID NO: 52927 - DNA, 11328 bp, Oryza sativa
  unsure (1)..(11328): unsure at all n locations
aaagatatctttactcccggttgttctcaccaaccgggactaaagatcttttcccgctatttccaaattctttttaaacccggttagggttaggaaccgggagtaaagataatagcagttctacatatgtgtttctataatagtaaataatgtattaaaattatttaaattcgaacaattaatgataaaaccttcgaaaaattattgttgtatgtagtagaatacgtggataatatataataagcacatgaatgatttaaaattgttaaaaattctaattaacatatgtaaatagcacatgcatgatttaaaattaatacaaaatctaatatcatatataactagcatatcatgatattaaattgttaaaaattctaattaacatatgtaaataccacatgcatgatttaaaacctttagaaattctaataatcatatatatgtagcatatggatgatttcaatttgactaaaattctaataatcatacataattaacaaaaaatctaataaccatatataactagcatatggatgatttcaatttgataaaaattctaataatcatacatattttacatatgccatacaacaattgattagtatagatattcggtacatccaacgtagtttacatcgtgtacagaacaattacggcaatacatcggcggtgacgggtgaccggacgtactttctcctcactattgttccttccttgtgatcgctacgtgagtaaggggtgtcttcatttgataggaggatgctagggtcaattgtcatcgtgaaagggggttgcccatcaaactaatcgtaatcctagttagtcttgtcctctactccgacgatttttttttttcccgggagaaccacgtggcgcttcgactcgtcagtcactttgcccttttttcctttgctagacatgttcttgatgtaaaaaacttgggttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatgtcctcgatggcaccgtaatacgtgtcagtcgtaccatcgtgtcccatggcatcgatacgaacagcactgttctggttcgtgctcttcatgtcttgggccctcgtgtagaatgtgtacccattgatttcatatccctggaatgtcgcgatcgagctagatggtcccctcgccaggaaggccagttgttggttaatcgtctcgttacccatgagatgttgtcgcagccacgtggagaaagtatcaatgtgatgccttgtaatccatgcatcggacttaccgatgtttttggcgcgaattagagccaagtgctcttcgatgtagggagccaccaatgaagattgttgcagaaccgtgaaatgggctttacggaataaattgttgtctaccgtcattattgctttccttccaaaagtcccctttccccgtagtctcccttcatggcgtgattcaggtaccccgattgggcgaagggcttcgataaattctacgcagaattcaatgacctcctatgttccataccccttggcaatgcttgcctctggacgagcacggttacgaacatacttcttcagaacgcccatgtacctctcgaaaggaaacatgttgtgtaggtacacaggaccgataataccgatcactttgacaaggtgacaaagcagatgcatcattatattgaaaaagaaggtggaaatatcaactcaaagctgacaagacattgcaccacatcattctgcagggcttctaatctatcaggatcgatgaccttctgcgaaattgtgttcatgaaagcacatagctttgttattgttgcccggacattatctgggaggataccccttattacaactggtagcagctgtgtcatcaacacgtgatagtcatgagactttagatttgtgaacttcttctccttcgtgcttattattcgctttatattcgtggagtatccagacggtaccttgatgctctccaagcattcaaacatacttcccttctctgccttgctaagagtgtagctggctggactcaagtaatggcttcctttctcctttggttccgggtgaaggtcaccgcgttgttccatatgcttcagatcattacgtgcttctagtgtatctttcgacttttcatatacacctaggaagccaagaaggtttacacaaagattcttagtgaggtgcatcacgtcgattgcgtggcggacgtccaagaattcccaatagggtaactcccaaaatatagagttcttttttcacatcgccgcgtgaccatcttcgctctctataggctggctgccaggcccctttccaaacactactttaagatctttaactatagcaaacactgttttcccgctgcgatgtttaggcttcgtacggtggtccgccttatgttcaaagtgcttgcctttcttccgtaccaggtggtttgctgcaaggaatcgaagatgacccatgtacacaaccttcctacagtgtttaagatacgtactttctgtttcatccatacagtgagtgcaagccttgtaccccttgttggactgcccggataggttgctaagtgcaggccaatcgttgatggttacgaacagcagcgctcgtaggttaaactcctcctatttgtcctcatcccacacggagacaccttccttcttccacaacagtttaaaatcttcgaccagtggtcttaggtacacatcgatgtcgttaccaggttgcttggggccttgaattataatcggcatcattatgtacttcctcttcatgcatagccatggggggaggttgtagatacacatcgtaacgggccaagtgctatggccgctgctcatctctccaaaaggattcatgccatccgtacttaaaccaaaccgtatgtttcgtgcgtcctttccaaagtctttaaattttctgtcgatgtttcgccactgcgaaccatcggcggggtgtctcagcatcccgtcctgttgacgctcttcagcgtgccaccgcatcattctagcgttccccttgttcttgaacaaacaccttagccgtggtattatagggaaataccacatcaccttagcaggaattctcttcttcgttagctgcctgtcaacttctcctgtatcatctcgtctaatcttgtatcgtagcgctttgcaaacagggcatgcttctaggttctcgcactcctcaccgcgatataggatacaatcattcggacatgcgtgaatcttctgaacttccagtcctagagggcacactatcttcttagcctcgtatgttgtctcgggcaacttgtttccctccggaagaatgttcttgacgagtttcaataaatcgccaaatgccttgtcactaacaccatttttttccttccattgcaagaactccagagtggtatccaactttttgtgcccctgctcgcaacctgggtacaacaacgttctgtggtcctctaacatcttgtccaatttatgggcccccttttcactttcgtaatcctccttggcgtcctgcaacatctgaccaagatcatccgcaacgttgttaccatcagcatccctttcctcctcgcccgtttgatttccttcaaatccagcgtactgagcaaagtccggaatattgtcgtcttccacttcatcttcttccatttcaacaccttactctccgtgggatgtccaacaattatagcttggcatgaaccccgactcaaacaagtgaaaatgaatagtcctggatgcagaatactccttctgattcttacacttattgcatggacaacaaataaaacccttttgcctgttagcttcggccactctcaaaaaataatgcacgccgtcaataaactctttggaccaccggtcagcgtacatccattgccgatccatctacatgacatgaaaaaaaatcgtacacacataattattcgtacaataatgacagtcatacaataattataaaataattacaaactctttcaacagtcacacaataatgacatatcattattcatacaaatattatgaaacattacaccgaataattatatatttactatttataaagttttaaactaatattaatgtgttgtacttattttaatttttcattttactttgttttctattattcaagattaactttcactatattttccttctcaacttttttataaaacattctttaccaaataaactaaatttctatatattctttcttctccacacaaattttctctctcatcaactaacaacaaaattttggagacaaaaaagtgtgcaaaacatagctccaaatgtaatatgaaaaaaaaatattggaggatgaagttgctaaccttttaggcacctccgatttgtatataatcaacacaataaattcactagaaattttggcatgacctcccctcttttttgaagaaattttgaagcttgctcgggctggaggaggaagaagacatatatataggggtgggactttagtcccggttggtgttaggaaccggggctaaagatcgccgggatctttattcccggttggtaacaccaaccgggactaaagttatgatctttagtcccggttggtgttattaaccgggactaaagatcccgggggggctgacaggccctgacagcatttgaaccgggacgtgttaccaaccgggactaaagatcaaatatgtctgttaccctttttaaccgggactaaagatcatctttagtcccggtttttgttgcaaccgggactattgtggaattagcccgaccgacgaaagatggtttctccaccagtgatgatagacatagttgtatctctaatattgaaaacagcctaaaacgagtagaggcggtacatcataattaccttttggtgttattttctcttacagctctatatgtttgcagaaaaacttacagaaaataacatttctgggtaaacagcatgaaccgacacttagttgagaatgggtggcgataggaatacataccaaaaaaagatgtggctcgaggttagttacagaagagaacttagggcgtcatttgctgccctccatagctaaaaactactcgagaggaccggaaggatgcatcatgcatggttgaagaactctcttgtgttgctttcaagttgcaacggtggggatgggtggggatggatcatcctgttcagtcacacatacattcatttcgttgtaatgggcgtgttttcatggggcagccctcactttttgcttgcatgaagtaccgacgctgtagcaagctgcaccgaacatatgcccaataggattatttaccgtcttttctcattaatattttcttcgactttatgcttctttgccgagtttgatcaatctatgtgcacaatgagctatacccaaatactgtcaaacagagcggcggggttgcaaaaaaaataaaacctttatttagtaccacaccaaattatatatttgcgacttacatatttaactttttccccacacgttaattataaattatatatgtacacaaaatgaatagccagctgctatatgtaaggtatactatcagtatttctttatgtgctgtctttggctactcctaaagggaacacagaagaaagaaagctaaagctgggccaaagcttagccaatattactgcatactcgtgagtcgtgaccgcacacaagttaattaatggacatatttgtgctgttctccttttttagattttttattttttatgagtgaatttaggagaattaatttcttagctttttgcttggcagagaatgggtggcaccaggaataatcttatcatgttggcatctcaaaaaatggcaacagtacagaacgtaccaacaaaatagtcctgtgtacgtcctacatcaaaattatagcaacaagagagtacggtgtagcaaaaacacagttgtgatattaccccttatggctatagggatcttatatatcccttcatactacataaagttatcacccactaactgtaattatgatcctaaagctcaaatatcaatgctccacatcatcgtcaattctcagccgttggataagtagattagatcggctctaaaccgttggatggaaaaccgcagcatatgatcagattaaacacaacccaacccatctcacacacagccaccatgtgagacccatgtatagcttcgaccacgggaagcccatctcattccatcgcagcccaatttaatagtgagggatatagggttcagtggggtctctgttggaaatttggtcataattcggcatatttttatccaaaatattaagaaaataaacatggcatttgcaatttgagtatatctagtgacagtggtggatgtaaataacttgagcatgcttaatataaaataagcatcaacatagatatgagaacgcaataacattgcgcctgacagtaacaggaaacgaagaatgaacagtaacagtaaaggattgtggcagtattgtctccgttggtattgacgggaacctccttctccttatctctagtgttgttgttgtctccggtgttcaacatgttgatgcagaggaagaacaagagcaggcgaagacgaacaagaacgaacagtaggagcagtcgcgcgcgtagcgctccccaaaaacttgatcgcccgcctacccgtgcaggttctcaagcggacggagttttggaagcatgtacacctgtgcatgcaggtgaacggaaccggagaagcagtagcagcacaagaacaaaggagtaggaggaacctgaagtgcaagagtctgcgggaagaactgatgaactgccatccctctgcggagtttgtatatgagcgagagtaacgttcggatctgtttaattccgtaaccaacgcgctcatgttaacagtgaaatttagtaagcccctaagagaattatcacgtcgccaatagccggattcctgctatattcggttaaggaaattaatatgttaaaaggaatcttatctacaagtgatcgagttcaaggaggatgcggcatggcagtttatctattaattaggcagtatttgttagtttcgttttatctttaggaaagtgtgtttagtgtcctataaggactttatgttctcatttttatcttttaggaaagtttatttcttatcctacgaggactagtatctccacatgggtataaatatgtatatccgtggtcattgtaaaatatatccacgatcaatacaattcggcgcatcgccaccttttaccttttctacctttttatttatcatccggcgggacttagcacctgacgcggggctgcatcggcgttcgatctccggcgaaggggtaagtccaatgttccgttggtccaagcaattgtctcatctacgtcggcatcgttcagggctacatcagtacattcgacctcttggattgctccgatttggatgatatatgtgtctgcctatttatcatatgtcttagttaatttagtcttagtatctcaatttagctctatcggttgtctctcgctttaaggtttctaccggtatcggctaaattgttttactagattagattagccaaggcatctaccaccctaaaaatcagtcaacggcttgattctctagatattgtgtttctttttatacttagtgccgcatcaattaagtttgatctactaagttgtgtttagaccataatccctagcctgctttctgacagccaataagggtttcatcggggtttcagctaatgaggtatctagacgttgcattggcttacaaggattgcatataagttggatttagccgatggtaacaaagatttcaccgtttaatctaatatgtggattttatgacatcggacctccagccgatgtattctttaaccttcagatcaatacttgttctatcatatcattgttagccgattggtttctacttgattatattgctattttattacatcagtatcagccgagcgattgcctctatattgttatttacatcatgtcagaatctacattggatgtatagccgatagctcaaaaccctatcgatatcggctggactacttcatcggcttgtcagtcgatcggctcgatcagctcactggtcttgtcagttgtaggatcaaactgactggcacgcccgcacctcaccaagatttggacctgcactggagctaagcagatctcccaggccagtgtgtatttttcgcatcaacagctcgttaacacgaaatcaatccacggcgatctctgtgtttattgccgtccgttataaaacgagcgagagatagatagatagatagatagatagatagatagatagagagagagagagcagccgccgcctgccttgcctcgccctcatcggctcggctcgcgcgcgcatgtggctatccgctcaccatctcaaccggttaatagagattctccactatctccatatttaagttgaaacctcttcacttagaattccaagatagtattattacccatagcactaatgtgggccaatgaaatttattaggatttgattgggcctagcccattaatgtaacaatccccatcaaatttcatggctcacaggaaatgctcttgattctgatcctgtttgttataccagtgtttcggtggagacagttaagttgaacttccacctaggagaaattctgatcatgtttgttataccagtgaagaagcagtagcagcgcaggaatagaggagtaggaggaacccgaagtgaaagagtctacgggaagaactgatgaactgccatccctctgcagagtttgtatgcgagcaagtgcaagagtctacggcggagtttgtatgcgtgcaagtgcaagagtctacgggaataactgatgaactgccatccctctgcggagttacaaaacaagagagagccgccgccttgccacgccaagtcggcccggctcggcgcgctcgcgcgcgcttatggctgatcgcccaccatctcaaccggtcaacagagactctccactagctccatatttaagttgagacatcttcccttagaattccaaaatggtattagtacccatagcatttaatatgtgctaatggaatttattaggattattgggcctagcccattaatctaacagtctcctcctcccgagtcagagtggcagcggcggttggttctctcggtctctccatcggcggtaggcggggccgtagcgcgcaccacgcgtggtgcagcgctggctaagggtagcgcacaactcgtggctagctctggagcgccgctcatccgttcaggagacagctcggttgcgggagggtttgagcgcgcgcgctatggcgagccctggagcgacgcgccaatggagagacacgtggatgtttgtttctttctcggcgcagatccgtggaatgcctaatgttgagccacctatcaagccatcatgcagttcatgatggattgcaagttatggtctagactcatgaccaggccggtgaggtactttgtataaaagtttataataaagttggggggaaaactctaagaactgtttcaacaactagatcaaaagacgtttacacgaccgctatattcatattttctaaaaaaaccttgaaaacccatgatatattannggnnnnnnnnaaggggaggnnagaagtgatgggnnnnaagatgtgaatagtggagaattccngcccccttnnnnnnnnnnnaaaannatcaggannaaccnnncaattatgctatttcaaggcataagacttgactccgacatagttatgttgtgcctccattctattatggatgactttattcaatttggaacctaataatgattgagtagtgttttgctgttagccatggttctgtccaagcacttctggttgagatatcaaagagagaaacgatatgcaaataatgtgaaaagttttcgatctacggatgtttgcttagggatgttgcaccatgcgtgtgaagcacataaagccaaaggtattgttatattgagatatatataaggttctctctctttttctggttgacagtcatttaataaatatattggttacaacttcaatattgtgtgcattatattccatatctctttatttccttctctataggttttaaccattacatcttgcatggttggctacaatcaattttttatttaatttgtgatttctcatcattgaatatgatcgaagaaataatttataaaagctcttttacccccaaaatgtcacaaatagaacttttatcatgattgcttcttagttcttacaatttccgcaacaacgcacgaggtatcatttagtcatcttgatattaaggatccataattttattgggcagatagacgaaaacttttactggcatgtgatacttaataaataattagcatgtgattaattgagtattaattatgataaatttagaaataaattatttgtaaagaaactttatatattttatcagaaaatacattgtttaatggtacagaaaatatgatctaccactctaaaagactccaatggtggtggtggaccaccactcactatcacatgggtccttgttgcagtgtaccaatcgtatgttcaaaattcaaacaactttagagtgatcaatacccaatatacttatgcataacttctaaattttacatgattctccaagatagcaagtgaccgtcccctccgtaaggaatgaggtctcttaaaaaggtaaatgggttattttttagataaaataaagttttccaactataatatctatattgattaggcacatagtcgaattaaaactgatgtatgtatcaactaacaactctaacatgtcctagtcaaaactcctacgatttagtctataagaagacacatatattttttcttatagctttgctgggtaaaattttgcacttagtcagcatagattttcaaaatatttccaaatatctgaaatttccaaatctcattgtcctcacaaaagaaaagaaagaaacaaagaaaaccaaccaagccaaggatcagccacagaagtgcaaattaacaggcgcgttggcgagagaccagacagaggctagaggggataacggtcgccgaactatcctccatccacgtggcactcacctattggtccacgaatcggcaccgctcatccattctctctctctcacctcttcgctcgccgccggccaccgtcatggccgccgccgccgcagcagcagcagcagccggaggcctcctgcacctgggggcttctcgcgtg

SEQ ID NO: 52928 - DNA, 2634 bp, Oryza sativa
gagttgttacgtgtgcgcaggaggtggagagcgctgttcaggctctggaagcactgggaggtttgcccgatccggtgggtgcacggtgccttttcttttcatttgtattgtctgaattatactagtatttaactaggtaattgttgggtggctagagaatatagcagtagttaatattgaattaacgattttataaggcgaagattttaggtgaggtgcatgcatctcaatagttaacgatctgaatttaattgagaaacaagctgttttgcatcttgatcagtgcaaggtaagcttgagtttcttgctgaaataagttgaagctaaacagagaacttctggagtttgaatcgtaagattatatgataaatatgttacaagtgaagcttgccagttgccattgaagtgattcatagagcatagtagaaagtactttctgctgaacgagctagatggcatcttggacttacggtcagaaactccataaatgtgatgatgttagggtgttacttttacttactatgggaaagtatgttcttatcaaagtttgatatgattggcttatctacaaaattgaacatagctagtgctcccattatcatacatgtatttgacgtagctggaaagtttctatgcaacaaaggctgtcgtcttatctttcatggttcatatgcagaccaactcaagtctaattgaaggtagttggcagctcatatttactacaagaccagggtcggcatcccccattcaggtaaaataccagcagtatgccccactgaaaataatgttcagtctcccatttatctctattattttttggattttcaggccgaccgcatatagataaatgactgattttattcttcattcacattgcctgcagagaacatttgttggagttgactctttcaagatctttcaggaagtataccttagaacagatgatcccagggtgattaatgtagtgaagttttcagaatcaattggtgaactgaaagtagaggtattgattagcctacagtaaacttgcaagagatacactactaggaatgattgaatcaatagtatgacaaaaagagacacatgattagcaaacagaaattctgttgaccactcctgtttgttaatgttgtgcccatggattaacctagccagcacacagcgccagcaactcatcagattgtgccatgactggtctggaacaaagctattggcatgaaccgtgcatgaacagagtccaattcaataataaagtcctcttagtctacatttagcatgactcgtgcagtgcctctggttgtctcgttggttgttcaagtgtggatatgtttgcaggtagagtcttagttgcattacttggggcttgtttgtttgctaccttcaatctgcctgaggattgttttggttggtaccctgagatcctccctgaccaggcaacttcatctaacttccatgaagatcctccgttgcatcacctccatggacaagaaaaacctcacccaatttcagattctcgcaagagcactgctatctcactggtcttcttcgccagcactgaccacacattgctaccctgtcccgaagcacctccacctcagccatctttactgggaagttcgacaggtcacactgatccctgttcaccctttccttgatacctgccaatgagttgtctctgtcaccagtgttctgtctcagccgctgcgtgtaaccagtgaagtgtcaccatgcacctctgggagaagaccatcacactacaggatgcccaacatactgttgcatcctataggaatctgcctacatttgcgaaagggcatgtagcctaatggttgcagtgacctaagtagcaccccaagatcctgggttcaaatatccataggagtgaatttcagattgagttgtttgcggggctaagttcccaatttaaatggctgcatatatccggatggatgtagaggctaggtaaaatattacccttctctaaaaaaaataaaaaaaaaacatactgttgcattcctcttgttagggatacacttagataaatagagtgggtcatcatcagtaacaagttcttccaactagatatctatagcacactctctatttctctagtgatcctctaattgcctattgcttccccattttatagtgtgccctcctccagctccatttcttctcaagccatttaatttatcatctaataaatagtagttatcttgtcgggaacaaaaatcctgacgaccttaagactgatagttctggagggctgggcattatattgaagaacaatatattgtacattgctccgactacttggtaaagccgaaatcagaaacatcattggcatttttatcttttgggagacttcattgtttaattaatccattccatagtaaacatggaataagttggtaagagcagtctcttacactcctaaagagagttgacagaacagtgtgcttattctgtatgaagggggataaatacttctactagtcaactaacttcgattactgctagttgctaaatttatagtgcttttacaatgttctacatgactttatgatgagatttatttaaaatataccaggcagaagcaactattgaagacggaaagcgcattctttttcgttt

SEQ ID NO: 52929 - DNA, 731 bp, Oryza sativa
cctgggttaagcgttccaccgtgagcatagtaccagaacttcgatcgatccggccaattagcggtggccggttcgatacccctctcaagcaagctagcctccatctcctcccacttcggcttcgcgacgctatatccgcctgaccccaagtggtgatggtacttcttcttggcagcattttctttgtttctggccatcatcgcttgcccttgttgccctgtcttgtaagcaacgaactcgtcccaatgatcccttagctttgggaatacgtcgaagttcggtgttagtcccttcaggatgtatttcttgtagagatctcccttgaagctctggaactgttctgccattttcttcagagtccactatttcactaagttatccgtacccgcgggtagcgtgaacgtctcgagcattgtggtccacaacatctctttctctgagttcgggacaaagctgtcatcatccccgcgtgcccttgttctgcgccagtacaccgtgctgacaggcacgttgtccctcacaacccaaccgctgtggcgtacaaaattcttggctgcttctgccggtgcactaggtcagtcgtcttcgtccacctcagttatgatgtgccgaccctctatcttcttcgcggcacctcgttgtccgcgtgccctcttctgtccagcagagggctgacttccactagcctcctttgcatcgttcccctcctcgttcccctccgcatccctctc

SEQ ID NO: 52930 - DNA, 915 bp, Oryza sativa
tggccttttccgataaggatgtggggggcctagccccctgcctggggtggcgcgacactcctgaggaggctgcgccttcccccgcattggcgccgcgacactcatcatgccggcgctcgaaacaacctcaaaaatcacgaacgcgccccctacctggcgcgccagatatcggagaatgaactcctccaccagggaaccgggaggcccccctttgtgagttcggccgggggcagtgggtgagattcgaggattcggtgagcgaagctgtgtgatcttgagggggttcaatcccccaaagacgatgagacaaaaggggtttatatagatttgggccgctaagaagcgtaataccctactcctgtgtttgggatcatggtcgagtgtagaacacgagtgcctggggttgcgagactcaagcgccagttcgctcggaagtcccccccctccaccactaggcctgaaccttcttttatacctcaaggggttaccacatgggcccaacaacctaacctagctttggtggagaagtattataatctttgcattaaatgcatgtctttgtctcttgacttgggaagccaagcgcacgtcgtcttgattatggggcctgtcaaatcttgccgcctgatatggggggtgcccctgtcagtcaccatttaatgggtgaagacttatgggctcctattacaccgggaaacaggagccttgctttgaccagagcgggaggaccgactccggctgggataagaggatgagaacctctcaccatcattatttgatgggatatgtcgggctgcacgtcgcctgacactcgcgatggtgcgcctgacattctgggtcccatcggtcattcgactgggtcacagaccgggttgagtgcactgcacaccgcattaaatgcgacgtggcgcgacc

SEQ ID NO: 52931 - DNA, 1192 bp, Oryza sativa
  unsure (1)..(1192): unsure at all n locations
nnnnnnnnnnnnnnnnnnnnnnnnnnnnnnnnnnnnnnnnnnnnnnnnnnnnnnnnnnnnnnnnnnnacgtgggacagaggtagtacgcacttcattttagcaaggacccacgatttgtatattctctggagaaaaggatattttccctggatgcgtcgcttttggtaattgcagaattgttgggaaaagagtacagtgacagcagtaaaagcagccaggcagacttcaggtctttggattcgtctgcagtcgacgtgtcactgcacttacagatagtctgtaatatcttcggtcactatccattgagtccattccattgaacggattgttagcttaactggaaggagtccaaaccgggtagacggacaagggccgggtaggggaagatgaaagggctgtttgattgagtactttaaattacttaatatttttttattttttaagaaagatatattttacacctctacatccaacccaatccaaaattcgctatttaagatttaaacttaaaatctttgggtgctacttagatcactgtaaccactaaagtattacatgtccttttacttgtcatgattcttttaagctaacttatcaaagatgtggttaatcttacctagtgaaaagtaaatttcaaaatgctattaggatgagccacatcatcagataaacaataaccattgaatcgagaaaaagacaaaatagagagaagctaaagagttcagccattgattatagagggaaaaaaagacgatgaactaccgaagcattccagcaattcagaaatgagagagagaaagagcaaacaagaaaagtagctttgtaagagagtgggggcgttggctggcgtatggcatgtgatataattttgcactatacgcactcaataaaaattattttacaaataatcattcaaaattatttatatatatggatatacaattcttacaaccgactaatttccaaatactactggaactttaatgcacaaaatttatttttaccataaacttttcaataatttttctatgaatttaatggtttaactttggtaacctttttaaggtaaaaggttataaggtggccttaaaaatgagtggttcatttacctatatgccctaattcttgcaagtcatgggtgatcaattacactttttccagcacatacttaaagaataaacattggttact

SEQ ID NO: 52932 - DNA, 734 bp, Oryza sativa
tcactatgggcgaattcgagctcggtaccttcgccaccggttttcttctgttgccactgactcgtgttcacttcatcacggctttgcaactttgtcaccatggtggagcaacttcatttttattatcttcggcatcggcaaactctattgcctctacttcgcaaactttgctacttcaccaaccacgacgactacaagagtttcgacacctcggcattcgtcaccaaatatgatgccgtgttattttattacaacaagtggtgttccaaatttcaatatttatctttactcaagcaatgattactcgacgacaagctacagttctcgactctatgttcagttgtttcccaactaaccaaagaatcgggggctacacaaatacaagactctcaaaattcgacaagctttatgtcaagatgaagcaatcaatcaatcaatgagtcaactccaggagtcattatcttcgtctttgcttcggagcagacgttctacttcagcaacttcaattatttcactgacaattttggatgccctatgctgccataatctacttcaagtatcaatcaagcatctgcaaccgctatagcaccaagttctacagccatcttcataaatcaaggggcattgcatcagtcttcattatgcacacgctcgtatcaagaaaattattcgagcttcgatatcttctcaacagtttgatggattattgtcattgacttcatcaccaacacctc

SEQ ID NO: 52933 - DNA, 6209 bp, Oryza sativa
gactactatagggcgaattcgagctcggtacccccactagtaggcatcttcatcttcttcccagctgccttgtctgtcaccgactgattattttgctgccatggctacacaactttatcgctgggcgccttcatcttcattgctggctgacctgactgctgccgactggtttctttgccttcacggtagtgcaacttcatcacttttgattggtatcactatcttcactaccaccaatatttttgccacttctggtggacaatattatctctatattggtcgtcttgtctctatgccaactacgtcagctactatcaatggaccattgtaactacgacagaaggacaagctatatgatcaggggcttactaactcaaacacaagtatcataccttcaatttggacttattccggatacatgcaacatgaatttatgatcacgagtctattttctatgctaaaagactggactatttattattccccataagggttatcaaccgaatacttgcgccagtcgggattcaattattatatctattttggagcatcccataagggataatcacttagatcagaaactattgatatgagctacacttggtctatatcaccccgaagatttactactcggagcatgttatatgcgtcatcctttaaagggtgtcgaaggcatattttttggcctaggcctaatatgtttgcagcccatattttcaggtgtggcctgtcacgttcttttagggacttaggcatctttttgcttaggcaaaagtgcgcgtgattatgtgcccaataccttaaaatccttttataccacagttactcaactttttaggagttggtacaatgcattttaaaaggtgccaaacagtaatgctttatatagctgcccgctgaatttttttatataagtcaaggcgttgtttggattcataaagcaattgattggatacaatatcattgctttttgccacgtaagtgtgcacttttattgaccaatattatggcttaggctgattatatattttggtcattttctaggcggttagtaaatcctttatgagtttatttactcggattttataccacatatgccatatatttctaggtgtggtggaaccatgtgtcttctagggacttaagcacatctgttaaaacagtgtgcgcatggcgtatgcccaatactttggaaatttctttattcacaacatacaagcttctttatagctgttttgctatgtgaattttcaatgatgtagctaactttaggttacacttatcatatcttacaaagcagtcggtatatcactcggatcatgttatttagggattcacaccgcatatgctacatgttaatatcaagtcgcttgtttgactataattatcaaaaccactcggttggttggattatttattccttgactatatgcttggtttgttcaattaaccacatagtcggggctacacctattaggtgcatttagtcgatgcacctgactttatttttcagccctccacagtcttcatatttggtaaaagtactcgggagaccatggcgaagatgattgaagcactcggttttggggtaatctagttcgagagaagattatcttttcgactgtgaaggtctcaggggctactgtggagattatgggtaccccatacccacacggcgtggttatctgactagttataggggataacttatatctatggaatatgtaacagatcatgacttgggtattacgtttcctttatattacggaacggtctaaagtcctagtttaataatattgtaaagtagatttaggaaaccgataccatattggttaaggtttctatcatgtaatcctgccccccatcctatataaggtgggcaggagtccctctaggggtatgagacaatctgatcgtcagataataaacacccggtggattcaattccccaaacaggaatagggtattacctctcattgagagggtctgaacctgtctaaatccctgtctctgcatccatccacttttaggtctcgtacgctacctccttttcatattgccgaaaatttgtttcgacaaaaacacaatcagtaatctttttcagcaaaaggtcatcggcagttttgatgcactgcacagagctaaaagtcgttgaaactactcctctgtaccagatatctaaccaaaatcttttatattttagatcggatggagtatattggcataccgtgtgcccatggcttcgtttcaccggcctttcgtggaaggatagtgtgatcgctgccatttttgcattttgcagttgcaacgtcggtctcacagtcgtcccgctatatcgttgttgacgttgctggatgactactatagctacatccatctgtgcagagtaattggtaatttaaatgcctactatatattataacgcacaaacctctaaagtttggtggacgtgaacatgtttacacctgataattaccgtgttaatacgacctcagtagacaacaacttaaacaaaaaaaaagattatgataatagtgaaaacctagaaggtacaatcgaaaccttcgtatttgttgacacttgagcaatttctccactcctaaatactccctctatctacttttgatagttatatttctaaatctgaaaattttatttttgataggcatatttcaatccaacaacctatcatcttaatgactttctcggatttaatgcgtgactctttattcttccacacaagatttgctacatgggtatcgagaaatgtaaatattaatgaatcgcttgtttacgagaaataactagtcgcatatttaaatagatgataagtagaattacttatccttggtctgtgtgccaagatgaaatatgacttttaaaaatagatggagggagtatatctccacctatatagactaaaaaggagaaaaagaaagaaagaaaagaaacccatttcgattcccaaaattttcccatggaccatggttcaattcgtggcaacttaaccatgaagataggaaacatggaagggctactattattatactcaccgtggatcgaccataaaatccacggagagcgggagagcgcaggggttgtctcgcgctagcgcactcccatctcctcgtctcacctcatcttctcggcgctaataaaaagggaccctgagacttctccgtctcaggtcaaggcgacccgacgacgtgacgagagaatctctcctctctctctctctcgctctcgcgtgaggaatcctcgtccgtcccggtcccacgctctctcgctcgctcgctgacgtgcgggacccaccggtgctgctccgccagtccgcgtgccatccgcgggagccgcgaccgcgaccgcgaccgcgaccgctggcttccaccccaagccccccctccccaacccgtaaacccctccagcagcagaggcctttgcagttgcttcgccttctccatctctctgcttcttttgtttgtttttctttcccatctactccgctcctccgccgttgcctccccggctcgccgtcaccgggagacgcgaggtgaattccgctcatctccagtcccttctcttattttcttgcgatgatcttgcggtgttgcagaaaatagtttaaaacctgcgcctgttttcatctcatcctcctctcttgtggtttcttgatgagcgcaggcattgcttcttctcccatgcgccgccgcaatctcatctctctgttttttttttctgttttctgtttgcaaggtcctgacctttttcaaaggcgcgaaagattgtgtttttcatcgtcttggggggtgtcttctgtgatgtgctttcaagaaaccctcttctggtttcttgctccacggcggcggtttgagtctccgtctcactgataatccgatttggagcgcgattgcgattttggaggggtgaatgggtgcggccggggctgttgttgagatcagttcggacgacgaggcgattcctgttgctgccaagcgtcccaacgttcctcccgtgtcgtcttcacatcctctacctgaagactgcaacggagttgaggagggtttaggtgatcctgctgccttggtggaattcgtggcatctatgctggatgacaaaaggtctgcgcgtgatgtggctgctgctgatgatggggacgacgacgattgcgtgatgctagatggtgaccctgataaagcggtcctcgttgtcaatgagcagagacctgggcaaggtggcccagaggaagaactgcagatagtttcagagaaaggagaggtaccagtactttcttgcttatttccatttaatttttctagttgcacttcagaccgtacattgtcttcgtggtggtaagtcaattcaaggcctgtttagatccatttggaatggcaaatggcaaatgttttggcattgcaaaagtactagttggtgtttagatgcatgttaaagttttgccattctagcactaaagtgagagagagaaagagagagggagtggtcccaaagcactttttggcacaatttgctactatggactagcaaatgccaaatgccaaattgccaacttttgctactagtgtttagatccaaaatggcaaaaagtgctataaaatggcaaaacttttgccattttggaggatctaaacaaggcctcaaattgaaattttcaactagtatatgcataaccatcgttgtcttatggggtgtttgggagagaggggctaaacccctttgtcgactagctattgacatggcgggtcctaatctctattaacatcttggactcgtcgaatgtagctaatctatgcacaactgtggttcatttatgtaggagtttatttaaggttaagtcaaactttatttgttagcacaaattaatttcaatgttttagatcttggttttgttaaaacctcttcttttataaacatcaaatctgcatgatcgtatatcctgttgttaatcacttgtgcaacactcttattgatttatctggtccgttttattgaatttgtatgcataccaaactcatactgaagatggagcttttgtggaaggtagtactatagttgagtgatcgttttgccttgctgatgtatatcattgggggccttgtctgagtttccatgcacttattatattgtaactaagatggctgcaagtggtgtccatattactatatagtggtctctaactggacaatattgtactttcatgtcagatctttttgtcctgggtattggtcttcgaaacatattatattgttcttgtagaagctaactgatgaattatcaataacatgaaaacctaacttagaactgattaatcgttcctaacccaaggagttgctgatgctgcagtcattgctatggcaatatatgctttcctttcatcatctctatcgaatgttatactttcttagcattcttgattcatctaaaagctcagatgttacaggagagtatatgtaacctgacaatttccccccttttccttttttcagatagcatgcagggatttccctcatccacgccatctatgtgttagcatgccattcacaagttctcatgcagatcattgtgccatggtcagtaatcaatccctaccctcttcatattatgaaatgatatttcttggttcatataaaagtatatagtcaatagtacttactccgtttgtattttaatgtatgacaccgatgactttttgaacaacctttaaccatttgtcttattcaaaatttttgtgcaaatataaaaatatttatgtcatgcttaaagaatatttaatgataaatcaagtcacaattaaacaaatgataatcacatagtaatttttttaaataagacaaatggtcaaacgtatctcaaaaagtcaacggggtcatacattaaaatacggagggaatagtacatattacttacagttccatcactgatgcattggcatgaccttgcttatttcttcttccaaatataaatgcagtgccactgttatgtttgcgactctcctgctccctgtgccttttggggcaaaggtacagagcctactgatcattgtcatgctacggacaagaatgcaaaatggacgaaaatgaggcagtcattgaagcgcaaaaacctgccatcatctaaccgtagaggtatcaagaatcattttcagccaatctcagcaacagcatccttgcagttgcagcaatatacaggggatc

SEQ ID NO: 52934 - DNA, 1041 bp, Oryza sativa
gccacggggtggcgtggtattccccgggagaggttgtgtggcacacgttacacgtgtgatgggcatatattaaaatttccgttctggctgtcctactgttctagcagcagtatgggaagcctggttggatgatacaaatttacacacaccaccgtctttagctgtttctttcaactaaatgttgctgttgtttcctttgtgtatgttttggtgaatgtttctgcattttgagtccatttctctatataccacttgccttgcctgctatgactatctgaattttctgtttttgattcatttagcatatacctttctgccttaaatcataggtgcttatcgattttagaatggaacatcaaatattgagtattgaacatcaaatagggctcgctacttgatgtggcaacttcacattgaagactctgttttctgtcatcaggtcggtaaccgcatcatcaggaagaggatccatgtccgtgtggagcatgtccagccatccaggtgcaccgaggagctccgcctgaggaaaatcaagaacgatcagctcaaggctgatgccaaggcccgtggtgaggttatcagcaccaagagacagcccgagggacccaaacctggtttcatggttgagggtgctacgctggagactgttacccccattccgtatgatgtggtcaatgatctcaagggtggttactagaatgcttgtttcttgaactggagaatccaattagcgtctatgcttatcggaatgttttggtactgattagccctttttgttgtctggaatctgaacctctatgtggttaacattaaagatttgctatggttgaattcatcctcgttatggtattgcctaattcgcgatattgtcttgttcgctgttgattcgattcagaattgcggcgaatgatgccatgccattttgcatttcaaggctccatttgctcgtagttagtaatgccctgaataatggtgaaaatgtttgtagtgatggtctgatggatcaacccactttttgaatggaaaaacgttctgatcact

SEQ ID NO: 52935 - DNA, 16898 bp, Oryza sativa
  unsure (1)..(16898): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttatcttcatgcacaagctgccgattggcttggattgtggctttgatgtccttgcgctcccgacgttcggctagtcttagcttagctttctccagcttgaattgatgctgctcaagatagacagctggggtaaggatatcggctaactcatctgggattagagcttggatctcatgtagccgagtcctaatcggcccacagtttaccaccaagttgtccagtgatgatgcctctacccgatgagagatatctttaagcgttttcttcacatcattggataagggggctagggctttgctcgaagtatcatcttctgcctcattaagataatctctaatgtcaaaagagaagagatcggctaaaacctgcagaaacaatttaggaagattgagagctaagtagatatagccgatctaatttcttgcatcaaggggaaacttactgggatagcaggagcagttggttgtacttcttcctcaatatggtgactctccactgctgatggagattgctgtacaaaaggagaaggaggaggaggaggctgtaaaagaaataagtgttaggcaaaatcgactgaaatcaactaataaaaattaagaatgtcttactggtggagccggtttgagaattgttgctgccgatttcttctttgcagcagttttcttcttctgtaactataaagtctgtgagcaatcggccgaaaagagaaatgatcataaaagagatcaaagaggaaattgcttacccttgaaaaatgggctggagcagacggagttggaggagtttgcttaggagaagctgatggagttccctcgctgtcacttacttcatctgtggcttgatcaacatcttcgccgatttcttcttcatccagagcttgttcaatagatggctctagggcaggcaaatcattagttggtgtaggcttctttagtttggccttcttctttggagcaggagctgatacatctacagtcgatgatctggtccttttctttttgccagcatcggctggttctctgatgagtccttgaagaagagttgaagtcttgggggcatgaaagccgatgacagggggagatggtccgcctccattaggaattagacccggagcatatttgatatttctaccactattgctctggtgaggaggagaagattctgttgtctacagatcaaaagaaaatttgtcaagttatgaatcggctgagcaattatttacacaaaattaaatcaagacatacctgagggataacgtctggaaagagatctgtcatatacatggaggccgattgatgcaataggtgcagtttccattcgccccaccatctgtcaaatgttttgctcctgaaggttgccagctcaatgttttcaatacttcctagaggggatccttggagatttagcagccgatccatcatcggggttatgagatttctcctcggcattggatcttatcagcgaagaacaagctgattgggagctgacccattcccaattgtctgccgagctcattgggtgatagaactcataagagaccttgatatttcttccttgatgaatgccgacaggaaggatacatgggctgattgcagctgaaaagacttctctagacttttggtatctttcatgggtgatatcctcgaatctaaagtctgatggattttccagaagtgctgaatcttcatagagaaaccaaattcgagtttctttgagaaagccatcagataagctgcagaaccagtccttgagcagttcggccgagagttttgctcctgcatcggttggtgtggaggcgtattctccataagatgtgcacctacgatgggtgcgttcctctccatcatcgtctacgattggctccagtcttgggaattcggcttctgttatagatggccgattgacaaacttcatgacaattaaattcagccaagattgtaataaccaccatggtccacctgctccaactactgagccgacgactatcttagccgatgcattgttcatcatttggtacaagtagccaaggaggatcttgcctaaggggaattgtctttttgattccaaggcttcggctacaaactgccagttggtcgtagggccgcagcttgatctacagaagagaaatttctccagccacattagaagaaaggctacatgctctcggggggttaccgaaccttggcccatatatgctgccacgtagcctgaccaactacctatgcttttggtcctgaagtcatactggttcttcgtgttcaaactcatggggttagccgatgaggtaacatccaaaccggtgatcatggtgatgtctactagagttggggtcatcggccattgattgaacaagaaggcattaatggtgttggaccaaaaataagaagcggctgccattaaggtctcgtccttaggtgagttggctatggttaggtcaagtgcttggccgattccgatttcgtcccaatgaactcttttgctagccgacatgcgcttgaaccatgtgatccaacttttctcgggtggagttttctcgagagatggccaggatttgaaagtgtttttccagtgacctagatctgggttggccaatctgaagggaatcctattggtttcaccaatgatgaactcggtaggatcagggttgccgactggaccgagaaagtagtaattttcgtgcgacaagcttgaaattgcactaggttggaaagatgctacaaatccaaaagaactgagaaggggaaaacaggatgaggggctagaagatcgatctaatgtgaagaaaagaaatctggccgatgagaacttacctcagcgtactcagccaacggcgtggcatacgggctggcggaagacgacatcgctgcaggcggagatctaattggagatgaagtcgcctagggatcgccttatgcgtcggagaaatcgtcgaagagagagaagacaaagttagcttcggcggtgaaaacgcaagaagacggtatgaggtttctcgggggcaacgattagtatttaaagcgctggagtaacggttagaaaacggcaagagcgaattttgctcgaaatcgatatatggcaaatccgaaacattaccaaatattccggacttggggggcatgtgttaacaaccaaatttggcaatatcagcatcggggatgaagattagatcggggtggaatcgaagacgaagatcgattcgggaacagagtaagagtccgagtcagactgggtcaggtggtacagccgattccgacaatacgacttggtgtatgacatcgggttgagttgatatgcttcaaggtgattgccacgcatggatagagtcctgagaaggcaattatatctattaattaggatattttatgtaacttccttagagatatgtttgggcaaaagtctgccgtaaagacttatggtatcttagagtttgttggagataagagtcgtgtccgttatggacattatttgtaatattcgggtatatatagaccccgaatcccatgtaatcaattaacacacacgttcaatacaatttcggcgcatcgccaccctttttgctttagtttatttcgacgagttcttgctttcgggttgagctgcatcggttttgatcttcagcaagaggtaaaatttgttatgatggcttgcgttctcgggattagtgcttccatcattatgatactctaatcttgtctatgtaattcgtcgagttatcatatatcttatataatctctggcaatatcgttatctaacctacaatcggctaatatctatcaatagagggctgccgattaggttaaatattgatgttgatttagattatatacgatatccatcactctatgaaatttccaatggcttgattgtctagacattgtctttcttctcatacttatagctgcatcagttgtttgatcttatgagtcgtgattagaatctcaatctctagcctgcctcttgcttgccgattagggtagtatcggggtttcagccgatcttatctgatttaactacatttgctctatatgttttattgacatgttaaatctgccctatatgtcaagatcttattgcatctaagtatattaagcttttgtttggtgtattctgcttgttttaatatcttaacatagagttgtatcagagtattagccgatacatgctagatctatctgatcggctatgctatgaacatatatagtcttgttgttaatatatatttcgatctaagtgatttatactgtctcggtatggcgaccgatctatcccaatcacttgatttaagtatatatcgacacaaggaatatatattgttaatatctacagccgatcgagtagatttagttctttattatctatttataactgccgatcgatttacatatgacatcggatcgaagataaatgatatgtcatcggtatctagtcaatcggctatcatttatggatttaaccacggtttctttgcctttatttcttgttgattgcaggatcaaatcaactggcatgctagcatacccgaaggcgagttttggacctgcactggagttaagcaaatctcccaggcctcgtgtttttcatcaatagtgacccctaggatatcgcagggattgtccccgagctgagccatcgtggccaagggctagaagctctcaatcagttcatgcggatctcgctctcctttttatggagggccacgtgtcgacccaaggttgtcctacttcatgttaagtagtagctgactttaagattttaagctttactgatttcatttgcgatttttgctccgacaaccttaactccttctcctccagctccggtgaccagtgacggccgaacgagttagggtttagggtcctaggttggtgggaggggagagggtagatgagggagattggtggagtgattgcaatgagaggcaatggcctgacagtggacacgggcgggagacgaagtgctggcggaggcatctatgccgtgaaggatggaggggcggtggggtggcggtagcggtagggacaaagcgaagaggtggttaggaggcagtggacaagggtggtggatctagtggtgcgaagccacaagagacaagggagacgatagggtgggggcacctgaccgctgcgggcttgaggaggaggaggaggcttgctgggggacctcgttggcgttgttgatgcattcactactacagaaagggtaaaaagtgccggttgggaaaccctaataggtgccagttttcccaactggcacaaaggaggcagcactgatgatacttgtcatcagtgccggttttagaactggcacctattaggtaataggtgccggttttgaggttaaaagcagcacctatatgtactaataggtgcatgttttaagacaaagagtcacgtggctgtcaaataggtactggttttgacctcaaaaccggcacctgtatggtcctaataggtgccggttctaagccaaagagccacgtggctgtcaaataggtgccctttttaggttaaaaccggcacctatatggtcctaataggtgctggttctaacctaaaaactggcacctacttgttgggtaaaaaaaaattacagtaaattcatccatacaactccaattccatataaacccaaattcatccctacagccccacatccatacaacacattcattcacattcacattcagattcacattcacgttcacaacaaataaaacattcacattcagattaacattcacattcacaacaaataaaaacctacaagactaagtcaaaattcggtaagtctaaaaattcgtaagtctaaaaattcctatctttaaatcctagaacatttgcatatatatcttgacggctgttttggtactctcctattcctacattttggtgcacatgtgatgggtatagccattttccagatgggccattcaaggtgagatatggaaactgaaccttctgatcttcatcaaaggttcagttccctctaatcctcatttcaaatggcacatataaatatggtcctagctgctaaaacccaacactagctgccaatctgttcatgtgctgcccaactaaagtattccatcaagcaatcaacctgaaggtgagatattggagaaaaacaatctgaatattaattgtttgccacactgttgcaagcatcaaccagcaatcagtttgttttcctccaattctcacttccagtgcctgaacaagcacagcatatccaacactgaagctagtaactactctgaagcgctagaaattgtaaagcagttgggttcaggacttcaggtagagagagatttatagccgtggttgatagaacacaaatcattcagattcagcagcagcagcaacagaagcatctgtttctgttacacctgcccttcatgccaattgtgtgttgtctgtgatgaagaacctttctactcccattttcagaggactagcagtacaggtaatggccaaaaaaaaaaacaaaagcagcttcagaatgtgatgggtgcatagtggctagtcactagtgacatgactgccctacacataggtgccagttttgggtctaaaaccagcacatttctcttacacaggttttaggtgtcggttttatttaaaaaatgacacatatttggacattaaggtaccggttttaaatatttggcgagtggggctaggtacatgggtggaaaatacattatactattataggtgtcggttttagattttccggcacctatagtgacgacacatatttatcttttttaatagtgattttggccagccagcgaggtcgggtgttggtgcgctggagtgctggatgtaggagggtgcagcggcacactaggcgagatctagagaacttcaatgaaatcgatgtgcatcggtcggtgggggtgagagcataaggtggaatcactaagcaacacagatcttaaagtaactagcatggtggtcagcgtagatttcgcggctagcatcattatattttctctcatataatagcatatatgttttctcattatattattaatatatattaaaatgacaacataattttaaattttgcaataactttacaaaactactaaagtgtaatattcatattgtattttatatacgtgttagttattaattatttttaatatcaaattttagttatttgtaaattatatatattcctatatggactctagacttgtctttaaatttttgtttaattccgaattttctgtaaattgtatttctatatagactttaggctcttcttccaatattatttatttttatttctgaatttttattatttctaattgtatttctatgtgggctctaaactcatctttcaatattctttaatttttaatttcgaatttcagttagttctaaattgtattcctatattgactttaaactcttcttcctatgtttttcttaattttgaattttagttatttgtaaattgtatttttatacagactctaaaatctacttttaattttattatgtttattccgaattttagttagttttaaatttctatatggactctatactctacttctaatattccttatttttaattctaaatttctattatttcctaattgtatttctatatggactctatactctacttctaatagtccttattttaattctgaatctcagttatttcctacttgtatttctatatggactctagtctccttttctaatattctttactttttaattctgaatttcaactatttctaaattgtattttgatatggactctagtctcttcttctaatattccttattttttaattccgaatttcagctatttctaaattgtatttctatacggactctgctttttctttttttcgattaatgtgagaatttctaggccgtatttctatatggactctgttttttttctttttctccgattaatgtgagaatttctaggccatgagagcgaacatggaggctcatttttctattcctttaataatataatagatagacagattagacggtccgtgatatgcaagattctaggtttttttgtgtgagatgatatttagacagtcccttaatcaaaatttgacaaagagtcgaacataggaccactggttgtcttggtcgaaatcacataccgaggacacataccaagggcctgtttaaatcacacctaatgtttttacaacatttcacatcaaacgtttgaacacctgcataaatttataaatatagacttaaaaaataactaattgcataaattatgaataatttgcgagatgaatctttttttggagaattacacagtacaacttagacactcacaatgcgcgcatactcacccatatgaacgcacgcacgcaaatcctacccctatgagcatattcaaagactggccggcaaatcctggaaaattctctctcggtagagacgaatctttcaagactaactgctccatgatttaacaatatggtgctacagtaaatattttctaatgacagattaattaggcttaataaattcgtctcgcgatttaccgagatattctgtaattagtttttttattagtaccgaacaccctatataatatccgatatgacacgctaaaactttagaccctgatctaaacaccccctgacatatctctgtcactacgggcgaaaagtccagttagatgtccaagatcagtacgtaagtgaggactgaagacctaacaccatcgacacatcaattagttctgattgattttaccaacgaaatgacttgaaagtatgccgcgccttccgtctcctctgtggtgtgtgcgacttgtgagagacatccagcgccagtggtaaagttcggccattattatatcaaaagacccgcccatatatgaaggcggcatttgcgtttgtgatgcttgcctgaatctctaccttacgcccatgcatgcaaccatgttaaagagatcggtgcttccgagtatggcagagcccgggcaccttgcccagctgagcgctctcacgacgacggtgatcacctgcctgattctcatcaccccaacaccagccgccgcgtcgggcgcgagctgcgtcgcgagcgagagggacgccctggccgccttcagagcgagcctcctggaccccgcgggccgcctcgcgacatggagcgggcacagctgctgccggtggcgcggggttcactgcgacggctcgaccgggcacgtcgtcaagctcgacctgcgcaacgacctcaccgtccacagtgacaccgactggatcttgttctacgaggtccgggttgacatcgacagtagctgggtacacagcgcgttggccttgcgaaatacaggtgagatgatctcctccttggctgctctgcaccatctgaggtacctagatctgagctggaacaacttcaacgactcgagcatacctctgttcatggctgacctgaagaacctgaggtacctgaacctctcagggccgagcttttcggggagaattcctccacagcctgggaacctgtccaatttgcagtatcttgatctctcatatggacctactccctccgtttcaaaatgtttgacaccgttaatcttttaacacatgtttgaccattcgtcttattcaaaaaaaaattgtgaaatatgtaaaactatatgtgtacatgaaagtatattcaacaataaatcaaataatatgaaaagaataaataattacttaaattttttgaataagacgaatggtcaaacacatactaaaaagtcaacggtgtcaaacattttgaaacggagggagtactatttcttcagacctgtcatggttgctagggctgtcatctttgaggcatcttgacatgagttgggtggatcttagtgccgtcagggactgggtccataccgtcaacacgctctcttccctgaaagttcttcgcttgaggggctgtaaacttgagagtgccatctctaccatgtcacatttcaacctcacacgtcttgaggtcctcgatctttcagtcaacaaattcaatgcttcgattcagcagaaatggctttgggatcacaaaggcatcaaggagctctatctgacagaaggccattggtttgggtccattccggacgcatttggtaacatgtctgcacttcaggttatggatcttggccacaacaacctaatggggaccataccgacaaccctgcagcatctgtgtgatctgcaggttgttagcctatatgacaactatattgatggggacgcaacagaattcatggagagattaccgaggtgttcatggaataagttgcgagagatggacctgcattctacgaatttgagcggtgagctgccggtttggataggaaagttgagcagcctggattttgttgatctctcacacaacacactgactggtgagctgcctgtgggttttggagcacttagaaacatgatttacctaaatctcggttggaataatttcaccggacagatttccgaggagcatttttcaagtttactgaacttaaaatatttgtacctctctgggaactctttcaagcagatggtcttcgaggaagattggattcctccattcagactgaaggtagcacatttgcggtcgtgtcgattaggtcccaagttcccatcatggctaaaatggcaaactgaaatcagggtgcttgatgtctcaggcacgtgcataagtgattctttgcctgtttggtttaagaccgttttttctcaagcttactcactgaacttgtcggacaatcagttatgtggtaccttacccagaactccagaggatatgttggcaatggtgatggatcttgggtccaacaatttgacaggtcaagttccacgcttccctgtaaacatcacctactttgatctctcaaataattctttgtccgggccactaccatctgatcttggagctcccaggttagaggagctgcgtctttacagcaattacatcacaggcaccatccctgcttatttctgccagttgcgtcgattggtatctttgtatctgtcaagcaatcacctgacaggagaattcccacaatgttcagataactacaaagcactaccaccggatgatctggatccgttcttctcgccttattttggcgccgcatgtctacaatagacctgagcaacaatagcctcacaggcccattcccacagtttcttgaaaataccacatatttgcgttttcttgatctctcacacaacattttttctgggaagctgccaacatggatagcaaagagaattccgtactcacggtttttgcggttacagtcgaatatgttttctggccacattccagaggaattaaccaactcttttggccttcattatttggaccttgcaaacaacaacatatcaggaataatacctcaatctctagcaggcatgaaggccatgaggcgcactactccggatgggaacaggggcgatgtctacgagggcagcatatcatcgttcaccaaaagccaagagcttcactacaccttcagcaactacaatctggtcgtcctcctcgatctgtcaggcaacagcttgacaggacagattccagaggagatatcactgctccttgggctcaagagcctgaatctctccggcaaccacttgggtggaaagattccgaacacgatcggcgatttgaaggggttggagtcactggatctctctcgcaacaggttgtccggtgaaataccgtcaagtttgtcggaattaacttccttcagctggctgaacctgtcctacaacaatttgtcggggagaataccatcagggcatcaactacagacactcaatgaccaagagtacatctacatcggcaatcctggcctttgcggccctcctctccgcaagaattgtgcaatgagaggaagacacgatgaagttgacgatgtgtcagatgatttagcagtcctgtatcttggtatgagcatagggttcgtagtgtctctctggttggtgttttgcactttgctgttcaggaaataatggagaatcgcatactttgtgctctttcataggctatgtgacaacatatttgtgcaggtggcgtgcaagctgggcaataagtcgagtgttacaggtcccaagaacaatacttaagatcaactgataggaaacttgggagtcattaatatatgatgttttggacaagtaaatgaacctaagttgtttgtcctagcaacaagtatcttttggacaagagtatgctgcaaatcggttgtcatttcctccttttttttgtgtgttttccttttggggaaacttatacacggtactgtagatgcttcagctactttatatcaagccatgtacttctgcaacacagtttttgcgtgcacttaccccctcatgttgttccatttgctaaatacatattaaatctatgatcccaatttctactaacaatatattcagatttaggttagttttctaatagaacttcaagtcttcccacattagaagtcttatcttttatctccgatatatatctcttgtaaactgcataagaacggtgatattccattattattccctacatttgtagccaaattctcaatagtgatcattgttgtttggcgcttgtggtttttcccgccagaggttttcatgtaaaaattcgtgtctccttaattttgcgcgtttggagatctaatgcccagccactggcgcttttgtccttgggcgaatccatctgtctgaactacggtaggtgcacatcatcgatctgttggccactgttaggggcgcaactgccaccaaccgtgagccacctctaggttagattgtgcctgctccaccatagttccaacgggagccacaactttaaattctaaacctacataacccaataaactagtctaacagatgagtattgtttgtcatacatcgggcctaacaatatcctccgtcatatcaacacatctaaccctgaatatttatttcagtgccaagcctacaatctcacatgtcgcatcaaagcccatgcgatcggagacacttgttaccaagctctcctaccatgcgacctagggctctaatatggcttattagctggatttttcacattttagtccttttgaaaaacttatttcgcaaatagacccctggaaaaacttatcccagaaatggtcctttttggggcatcagagtggctggcgccgttgtccaacaggacggaaccagcttttctggcaccgtccccctgccgacgtggcggggcgatgctgaggtggctagggggagcgccagagtggctggcgccctcctccctcccccccctcgaaattttttatttttcttttatttttttgatatttttttcacgcttagggatacacaagaaccaaccatagaaaaaataaactcaaatggacgtaatatgtaacctgtagaatttttcctcttctctcctctctctccgaactagtgcagaggagagagatgtgcaacttttttatttttattttatttttttgatatttttttcacactcaggaactcaaaagaaccaatcatttaaaaaataaacccaaacggacaaaatatgtggtctgtggaattttccaaagctctaccaaaaaacttctctcctcgaaaacacaatcttgaaagctgaatttggaggttttaatattggctaagccaggaagaatcggatgtaactttttctgtagatatccgtggatatattatttgtctgattctgagtccgtatgagaaagttacgcctattttaataaatgatatattttgtccgtttcgctagagctttggaaaattctacatgtcacatattttgtccgtttgagtttattttttctatggttggtttctatgttctcctaagtatgaaaaaaatatcaaaaaaataaaataaaaataaaaaaattgcatctctctgtactgtttaacttataaacttatagctatcatttcatgtggttatattttgaattagattaagtaatttcatatagtggtagagtgcattatgtttaacatgctgatcaaagggttttactaaaggagttatggtctaattttggtgaaggtgcaaattaggctaagtggtatgctagctatattcagacttagctaagtggtagttcgagtttaaattttttttgtggtgggttgtatcgtgatcctaagtgtgaaaaaacattcaaaaaataaaacaaaaatgacaccgttgcaacttcatacagagaaacaggaatanaggcgaggggtgggttgggggatgacgcgccctcctccctggggcggcgccagccatacaggcgccctcctcctaccacgtcggttcgagtgtgccacagtggcaggaggtcggcgcctggcacgtccccgttgaagnacggcgccagccactctaacgccccaaaaaggaccatttctggaataagtttttctaggggtctatntgcgaaatagtttttcaaaagacccaaaatgtgaaaatcccagggcttattagagtgcaaacctatgctttaatacatgtaattagagcgcacagtcctacccaccaaccttaggcttgctccaccttagactcaactagagccataactttaggtgatggatctacacaacataaaatatagtctgatgagtgatgatagccctaacattttaaatcgtgctctttcatcataatttttcaatgtgggacaaaaaccaatatctgcttggtgcagctaacctgaaatgatgtcggatctccaggctctattacataaatgatttttttgggcgaaccccctctaacttgcaggtgggttataacattgtctgcctatgataattttgccccaggaggaagataaggccaacggacctcttaatagacccacctgtgaaaataggtttattttcacaggcgaacatattaagaggtctgcctggcacccagccggctgccccatccgcttcctctcttttattttctcatctcttaaaatatctctccccactccactcctcacccccttctcccccgtcccctcctcccctacctccaccgcagccatggcgacgggagctgccctgcgacaggtggatctagcactagctaatgaggtgatgacaacgttggcggcaagccgcacggtggcggatccctggccccggccccaagaggggtggatctagtggtgctggcctcgagagcggcggatccaactccacagacctcggcgatgatgacaacaatgacaacggtggctagggtggcgacgacaatggcagcaagctgcgtgagggcagatctggcggcgctagactcgagactagcggatccccctctgcgggcctcagcgacgacgacaacgatgatgccaatggcaccaatggctagggcgacgacgaagaccgtggcaagctgtgcgagggcagatccggcgggactggtctcgggagcggccgatggtgatgagcgtgtcgatcgacgggtgcctgtgctccgccttgtcgcgcctcgggtcctcctccaccaccgacgacctcaggatgcgggttacagttttggggatgcggtgcggcggtggcaggcatgcgggctagggtttcacaatttttcagaattttattttattttttgacaaaattctagtgcaggttggcggcttaacatgcctgcctgctaaaaacaatttttgcatgagggcgtggtgcccgcatgtggaaatcttcatttttaatacacgtagttgcaggcgagtggagccgtgcctgcgaaaattgaagatagccacatgtaaaaaacattttttattagtaggaccagcgcgaaggagaaaaaatctatgcacatagtctacaatacggatggatatcaagctggctcgacctgatctggctttaatttgatttgttatcctaaagaaacatagcttggctcgacttgcttaccagcttgtttagcttgcgagctagcacattaataacatgacggcagtagcgtatgtgctcgctcctcatactccaatgccccggcatcgccatcttactcgtcgagccctccaatgctcacacgacccggacgaaggatggcggcttatgactggaaggagagatcgagaaggggacaacagtaggcggcggcgttgcacacgcacaaccggagagactagaggggggaggcactagctaggcggcgtgtggagcgccgacgctgcacatcgccgcattgcatgctcaagcgcgagtgcgcgactactgcttggtcgaccactatgagctgatgtgcatgtggctgcgtcgccgttgtgttgtggttccggcttaggctgtgttcttctcccatttttctaacccatctctctcctttccacgcgcatatttttcaaactgctaaacgatatgatttatgcaaaaactttttaatatgaaagttatgttaaaaaaatttattaaaataatcatattaatccaacccctccactagaattttgtggcctgagggagatgtacggctttactgtgttggtgtgggacttatatggcctaggaaaaagtacaccgaaggtccctcgacttatcatcgattttaaaaatcgttccccaaccgcaaaaccaggtatccagcatcactcaactaaccaaaaccggtgacaataggtccttaggtggttttgaccccggttttgtcctacg

SEQ ID NO: 52936 - DNA, 1805 bp, Oryza sativa
ccgccgagatgtctcgtcggtacgacagccgcatgacgatcttctcgccggaggggcggctctaccaggtgcagtacgcgatggaggcgatcgggaacgccgggtcggccctctgcgtcctggcggccgatggcgtggtcctcgtcggtgagaagaaggtcacctccaagctcctccagacctcgtgctccgccgagaagatgtacaagattgactcccacctcgcctgcgcagtcgccgggatcatgtccgatgccaacatcctcttcaacaccggccgcctccacgcccagcgttacatcctctcctaccaggagcccatccccgtcgagcagctcatccaatccctctgtcacaccaagcaagggtacacccaattcggcggcctccgccccttcggcgtctccttccttttcggcaggtgggacaagcaccatggcttccagctctacatgagcgaccctactacagtggctggaaggccgccgccgtcggggccaacagccaggcgacgaagtccatgctcaagcagctccttcccctaccgtcgccgcgtcacccgtcgccggccgccgatgccctcctcccgccggctaagtctgagaagggagagagagatgaggaagggagaaaagaggggaaaggaaagagagagagagaattggctgatgtggcagcctgacatgtaggtcccacgtggctcccgcactgattcagctgccacgtaggataaaaccgggtcaaaaccaccgacggacttactgtgactggtttttgttagttaatggacgatggatacctggttttgcggttggtggacgattttgtaactcaatgacaagttgagggaccttcggtgtactttttcctatggcctatgaactgattaatgggcttgcttggacgtggctgggttgatggattggatggtccaggcctccagctcatttggctcacgagcatagccagtgagctcctatacatacatcaatttttccccctatacattgctgcaagcctacaaccgtggctcagcttgttaacaattgtgaacgactcaagcacatccgaaccgagccacatcacgagccgagtgaactagcaggccagagtttttctccgctccctagttgcctgatccaaaattatagtgaatttttgctctgcgcacacatctaagctacctggagatcgatttccatatcttctcttcatgcagacagaagtgcactagggtttctcgtttctgctatgttaacataaattaacatgaatgcttacaaatacacgcagaaaagaagttcaccttttggcttttcaagaaatgattaatagaaaggtatgctgactagatatcgatgtagtccgctaatttccggcatctagcaatgaagttaccgatgcagtccgatgatactcatcgatctgactctaatcatcgagatagattaaaaacacgtagacattccgatcactaatgagagccgccactactagaaaactcattttcggcgtcataggggttcgattttcgcaggtgtgcatgtaattcggagctaaaaccccgctggcaaaaaatgtacccggggtggagggggcggtctgcctgcgaagatcgatctttgcaggcggagcatataagcggcgcctacgcggaccatattgaagaaatatgggaaatcaactatggacacacaatgcaattccccatatttaagtgccagtgggtaaaatacccgaacaggatcaatgttgataagtttggtcttactgttgttgaccttgcgagtgtgggtcacaaggat

SEQ ID NO: 52937 - DNA, 1576 bp, Oryza sativa
ttagcacttgcgcctagtaagatttttgtttgattttccgctatcgttttagagctctctaaattatcaacccacacgctgaatacatattgcaagaagaaaattaataatgtgtctccagtgctaaaccataacttggactcagcaaaaaaaatggtagtattttctttgatccttggtgccattactgccaatttactgcaaatttctcaagagtatattcacattcagtctcttgaacggggtggcctcagcagccttgagggagtgcctccgagacaactccaccaccttctactccctgacaatgaagtagaccattctaggttccagcagctgcaagtaacaatcattaatcctccttttcaagttctattagttgggagctattaacttgattgtttagatagcatcagatgtttatcataggtaatgatgactgtcttcgctaatgcctactggattgcccagatttgtaacaaaaaaagattcaaggggaaaaaacagaacccagggaggatatatatgtcatataatcagttttatcaaaaaaaaagcacttgacaactatgtaaaggatgccgatgttggtcatactcaacatggacaccagggtagttgaactatcctttcacttggtagctgtcagtagaagataaaaaatagttaattattcagtgctctctaatctgatactacctaacaaagctgagtacaaagcatagataaaccgttgatttgatcacaaacagggaagcaactaaagagaaaaaagggcgagtttaattggcagtaataaagcaatgtttaaacaactaaacattcacctacagaaaccaatatcagattatatgagaatctttttaggtgatggacgaatgaagcatgtgatgctaatttccacccacagattatcattgatgcattttacttgtcaaaaggagaacaaatgaggaaacattctgcacaagatgccaactctctgcttctatttagaaggaaaatattgaacctccatcctggaatacaaatcgttgtcccacagcttatataaatctcttgcattagatttaaagcacagtgttgtgctcaggacaggctccttctgaaatttggttctactacaagttcagtccaagtagaaaattaagctaatcctggttttctatgtgaacttatatctagcaaagaccctcatcttgattttataatctccttaacccacacctcatgcaccgatttttaattttgaccttagtattatgttccacaattctgaagggtagttgccacaaaaaaaaaaaaaacttacccaacttgaacacaatttggaaccatgatgccatagattaaggtaccattattgtcctccatgaagacatgaaagggagaaatttcgttgtctcacatccaaaatattaatatacaccgaatacatccaagtttctgaaaacatcatgaactccccaactatgttatattttgtgcatgattgttggatatgtgaaaagaactgttgttaccattattgtcctccatgaagacatgaaagggagaaatttcattgtctcacatc

SEQ ID NO: 52938 - DNA, 8093 bp, Oryza sativa
  unsure (1)..(8093): unsure at all n locations
agaagtaccaggattggaatggaacggtacagaaccagaaatatttgaagacccttctcctgcgtaagaccccgaggtgcaagagatcacggttctgaggtgcctagagtgcttaggagccacgactccaagtccaaagatgagaacaaggagaagttcatggtaaccgtcttcaaaggggataaggaacgtgccaagctcagagatgatgacccccagaaggccgctgaactagccgggccaacatacttcacaactcatgattgcccggaaaagtacgaacatgggaaagcactcttgcttgaatgggcactgaacgaaggaccatgggagatgaaaaggttacataccttctacatggaggccagcaagaaaggcttggcaatataacagctcgatcaccggcagactgtttcggcgaagaaggttacatatggctatatttcttagatctccatgccatatatcatcgggataagatggacgtcaactatgtcggtgtttggtgcatgtgagtatgagttttaattaattatatgaaaaatatgtacaatacaaatccatgtgattgttactaacaaacttcttctgtaggatgcaatacatggatgctaagaagaaaaaagaacctatcggcttcttggatctaactcggatttgccaaacacagcatactatgaggctagcaccagggtctgaccagctgaagggcaagaatccaaaagagatagctaaatacagaagggcttgcacaaggagaaattgattactgtcgcacagtacattggacgagccttcttgcactttcaaaataagagagtcgtcatggccgcttataattttaagtaagtccggcacatttatcttgtacacatgtgtcttattttagctggtactaactaactatgctgttgttaatatgtagtgatcattatatctgtttactcatccaccctgaagacggaaccgtggtagtcttggaccctctcgattatagtcacaagcaatacaaagaatttctaacaatcttacagtagtaagtgattatgactcttgcatttttatatgaatgtattataaataaatatcctccttaatgtgaaacggtacgacatccatacagtgtgtaccaatactacaagttcaagggtggagaacagacccgaacaagggagaagctgctagtacgtacgtattggccggtaatactccactcacttaatgtattccaattgtttcactaattgcaaattttaactatttttttatgatatgtcctgaagtgtcacaagcaaccgcgaggaacggtcctttgcgggttttacgcgtgcgaattcctaagggttaatgggaggtacaggactaacccggaggatgtaagtctctatactatgtgctaaacagcttcacatatttatgatactaatatattgtttatcttcaatgcatgcagttgccaagattagaacatcgaacaagctttgacgatacaggcatcaaaaatgtccagcgtgatctgtgccacttcatccaccatgagtgctgtcatgtgaaagtagatttcttcgacccagagggtgccttagccacaagtaacgaattcaaggatcttcgggagtggaacagtgctatgccataatgtattaactagatggcgtatttgaagtgacaatgtaaaaaaaatattggaatatatatatatatatatatatatatatatatatatatatatatatatatatatatatatatatatatatattgcaacacttttgagttatgttatatatgtacatttatcagtaccaaatgcttgataatcttccaatatatgtatataataatctacctgcaagaatttctattaaataatttaaaagtaatttacgggcaaattattattaaattttaatattttctacctatcttcgtaggcggaattttttttttttgcaggcggccggttcctattttcgtaggcggaccggactagccaacgttcgcctgcgaaaattatcttcgcaggtggacggccaccccgcctgtgaagatcggcgatcgtcacagtcgttggcttacaagcggacatccgccccgcctgcgaagaccctttttggccgcttgcgatattgcttttctagtagtgacatctactatgtttaatctaggaaattaatgtgctccagcgcaaatgtcttggccaacggcatgttgtcgatgatgaagcggcttgacaaaggacgctgggtgcggtgtttaattattttcttcgcggcggcgcaggcttgctactgttgctacctccctgttgctagcgccggcgggctttggtcttctggatttcctaatctaccacctccgactctccgagtttccagcactcgggatgatgagatcacgcattaattctcctgataaaccgacgcacagataagctaatccatcgacgtgctggagataaaagtaaaaccaaccacgcgtaccggagtccggagataatcatgaaattatctctactaatgacagtggccccacctttaatttagttggaactgcatctgtgatcgctaccaacaaatcaatgtaatctatacctagtactagtcaatctcctttgtttgaacagctcaaatcttcaaaccatgtattaaagtcgaaatccatttgcaccattattttctattcaaaatatgcagcgaaacgagtctaatattgattatattatcgtatgatatttgaattttccgtgcctaaacgtcgtaaagacacgcttcacatctattttgtaaaattgggctgcaaattagtgcccaatgatttattattttttctatgaacaaacaaatgatagaattgagatatcaagtaggcgaattatgtcaatattgtagggttcatgtgcgaagcaacaagactcgactcggcgaaatgacaaaaatgagcccaatattgtatgtacattgacatcatttattacttatacttttggtccacatgtcattgagccttatatgggcccaagaaaatattatttgcataagagaatgatgccaaataattttagtattatttaattcgatgaatttttgcgtacaacgacaatataaaagcataacaattattagtgctttctaaagcttaatttgtaaaagtataccaatctagtaagcattcaaaacgtagagctcctgcaccaagatagaagattgtcacttgacgagtgaatttttggacgacgacaatacaaaagcataatactccttcagttctaaaatataaaaacatttagcactcagaatttgtcccaaaatataacaacttctctactagcattctctttccaaccaatcacaaccatgcaccattcacttttcctacctacctttactactcatccaatgacaaccctacaccattcacttctacctactataaaacttattatattctgggatagaggtagtaattattagtgctttctaaagcttaaatggaaaagtataccacatcaatctactaagcatcaaaaacataacatgcaatcataaaaattactaacatcaacaatttatcacattctaaaattcaatatacacacatgccagcaaaatcatcgtccccacaccattttcacaatattctaacccaaatccatccatcatttctaccacatctaacatataatcattcctatattttgcaacaaaacgcgggtgtcatcagttaatattgattgtggctaacacataagttgtattttcaaagactgcgtcaatgtccgaaactacttaatttgtgatgggaggacgaaccttgcacagccactattttgtcccggccactctgctccaagctttgtgggctcgtgggccacagaacctatcgcgattggaactacagttggcacctatccgtagcgggattcccggtggcgcaacgtgtggtctccgccgcgcccaaatccaacccaaaattctcgcccccgcgcccgcgtcgcaccaccacatcacaggacagacaaacagatcaccgatcgatcacgcgttcaccgccgcgccacccgctcggtcaccccaccatggccgccaccacctgccgcctcgccgccgcgccgttcgtcctcgcaccgctgcctcgccgccccaccacggtcgcctttgccgtcgccgccaccggcatcaagtacggctagacctcgcaccgaatcgttggctcgctttctcgtgttttattcgcaaaaactgaatcattggctctccatgtcagtaggtctcagggcgtcgaggggcgtggcgatcagggcggccgacggcaccggcagcgagacggaggtgccggaggtcgtcaaggcagcccaggacgcggtcagcatgcaatccttatcttctgctgctgctgctagctgctgcttctgcatcatcatttcagtctcagtttctgcttcagttagttgtgaggccattcctgtgcaatgtgcgtaactgtgaccaccgttgtgtctaggcagtgggccaaagttgaggacaagtacgccgtcaccgccatcggcgtcgccgcgctcgtcggcctctggactgccataggcgccatcaaggtatacgacgcgacacatatgcttccatgcatatgatctcttgctccttcaagttcagatatgatgcttaatttcattttcttggtaatctgcatatcggattaggccatcgacaggcttccacttttgcccggcgtgcttgagctcgttggaatcgggtatacaggggtaagttataggcattcagttgcaaatttcgttgtcacatagagagtgaggtagtgtaagattgcttctcttacgagctccaattaactgctgctttgtgttcatgcagtggtttacataccggaacctcatcttccagccagacaggttagacatcctgttttaatttttgctcttcacatccggttctacagtaacatgatactgcaccgttgttacagaactgacaatttctctggtttaaactcgtagaattttacatgtataaacattgtggagaggagttctgttttgcaatccgtatgaatgacaatgatttcgttaagactgaaatacttggtaaccgttggaatatgtgttatgtgtgatttttagtccttattgataaatcaatatactcaattgacttagattggaagttgaaccctgctaattaaaaaaaaccttatgttaaagaaatgaggagatacatggttctatctatggcttcgaatatttgacttttaagacaagatttggttgagcttttcgaattgagaccaaatatttagaagtgatggctcaagtccaagctcaatgttttattcaataatatccattaatactggcttgagaactagacaacatgtaaatacacttcaattagtaacaaatgttcataatttggtaaccttggataaggttatgcctcaaatatccttttgttctcgtatataaaattactattagcctttcatattcttatcatgtttggcactctaatggatttgcagggaagctctggtgagcaaaatcaagagcacctacaatgaaatcaccgggagcagcagctaatttcataccattttcgagaagatttctgtaaatcagagagcagcaggactgcatctgtcggcagccatgccagtgaagaggaggttgctaacgttttgagactggtccctccattatttccatcttatcccctggctcaaagcagacaaaatactattattgctgatgagctgctcatgtacctattttaattcaacaataatgaaatatgttttcagtttccgctccagacaactgcgtactacaaacatcattacatcaatgtggggttcccaatcacctgtattttcttttatcgaattcaatttgaagccgttggcatgagaagttaatgataattaagaaacactctttgttgtccaagctcgacgatactgctgacctaaccatctctctgatggaatccttaactctgtaaataccataaattgttgtagttctacatggttgtttggttggttcctattacttgtttaagttgtcacgccttaagttatacaaatttgactgacttagatggctgtttggttcttagccaatcttgtgacaagatttcctctcttattctctaccatgtagatcctacattttatcgatataaaaaaagtgtggcaagagtgactcatgttagctaaaatgtggtttcaattttactagcctatgatatcgcacgtttgcacgactttaaccattgtgttatatgtgtgtgtgtgtgtatatatatatatatatatatatatatatatatatatatatatatatatatatatatatgagcatgtaatttaaattggcatcagtaaacaatgttttattctgttaagtatgtgcttgggagaagtgtaattgatcagccatgacctgcaagcatatagggcatataggtagatgaaacactcactcttaaggccaacctattaacttttacactaaagaggtgaaccaaagtaaaacattaaaatcatagaaaaatttattgatatgtttatgtgataataaattttgtgacattaaagttacagtagtaatttggaattagtcggttgtaaggattgtatatacatataatataaataattttgaatgattatttgtaaaataatttttactgagtgcgtatagtgcaaaattatatcacatgccatacgccagccaacgcccccactctcttacaaagctacttttcttgtttgctctttctctctctcatttctgaattgctggaatgcttcggtagttcatcgtctttttttccctctataatcaatggctgaactctttagcttctctctattttgtctttttctcgattcaatggttattgtttatctgatgatgtggctcatcctaatagcattttgaaatttacttttcactaggtaagattaaccacatctttgataagttagcttaaaagaatcatgacaagtaaaaggacatgtaatactttagtggttacagtgatctaagtagcacccaaagattttaagtttaaatcttaaatagcgaattttggattgggttggatgtagaggtgtaaaatatatctttcttaaaaaataaaaaaatattaagtaatttaaagtactcaatcaaacagccctttcatcttcccctacccggcccttgtccgtctacccggtttggactccttccagttaagctaacaatccgttcaatggaatggactcaatggatagtgaccgaagatattacagactatctgtaagtgcagtgacacgtcgactgcagacgaatccaaagacctgaagtctgcctggctgcttttactgctgtcactgtactcttttcccaacaattctgcaattaccaaaagcgacgcatccagggaaaatatccttttctccagagaatatacaaatcgtgggtccttgctaaaatgaagtgcgtactacctctgtcccacgtagaggcaattcctaacatccgagtgcaacactaaaggagaggataaatatccaaactaccccttattattagtaaattagtattggtgggtagatatgtaaggggtattgaaggaataaaaatttttaatttacgaaccgagagtagataagaaggtagaagttgatttattttgaaaaaagtttgaatggtaaaagttgatttatttttggacggagggactacacagcaaccgagcaccaaccgtcggttcttgctaaatggcagagaactactgtactgtcgttagttaagtaaatatcgctactgcttgtctttgctaataagtgcctaagtgtcagtcacgttcaaatgctcttttttttggacttgtcgatacacaccctgcttttggtcgatcgatggtcacgtcggagagagaggagacatgaattaggatattgctatgcacgcttgtgaggaggttaccaacacttcatgcttgctggtgtaatggtggtcaccggtgagttaactaagacattttcgacgatnnnnnnnnnnnnnnnnnnnnnnnnnnnnnnnnnnn

SEQ ID NO: 52939 - DNA, 5437 bp, Oryza sativa
  unsure (1)..(5437): unsure at all n locations
ttagtattggtgggtagatatgtaaggggtattgaaggaataaaaatttttaatttacgaaccgagagtagataagaaggtagaagttgatttattttgaaaaaagtttgaatggtaaaagttgatttatttttggacggagggactacacagcaaccgagcaccaaccgtcggttcttgctaaatggcagagaactactgtactgtcgttagttaagtaaatatcgctactgcttgtctttgctaataagtgcctaagtgtcagtcacgttcaaatgctcttttttttggacttgtcgatacacaccctgcttttggtcgatcgatggtcacgtcggagagagaggagacatgaattaggatattgctatgcacgcttgtgaggaggttaccaacacttcatgcttgctggtgtaatggtggtcaccggtgagttaactaagacattttcgacgaaatttttaagtcgtatgatagaagagaaaagtcttgttaaacggctgttaaaagaaattagaccaaaatcttacacatttttaatcttagcatttgattcacgattcatgcttcaatgaacccagctcatcctctagctgaggcgagctccgacaatcaatgacagagcgacaagttatggtttaaagttctgggttaggataaaggtgagacgaggagggaaggaagattgtcgggcttagaaggatggcctaggagacaatgacatgacatgccggtgggtggcgaggcgctanaggtgtgtgtgtgcgcggccagggggaggggctaggatagtgtgggtggcagggccaaagcaatgcttctagtttgaacgcggtgttttgtgatggtgatccagcagaagggaaccgttaaagacgaagaagaatgcgggacgggggcacctcgccacagttagcttagggagggggtaggtggtggagaagggaggaggcggccagcttcgtcagctttgttgagtgttgatgcctttcggccggtggtggcgcagcggagatggcaagacaattttttggtcgtttgactcatgccctctagtgtgatgtagtgactacgactaggaggtaggagaagagtaaaggttattgttgagagtaaagcaccaatctaaaagcaatataatggtatgaaaattttttctgagatatacgtttccaattgaattacttatcagtaagacccatataactagttgtaagtctgttagtgtcatactgtcatcgacatataatattccctgcatcatcttataatataagatctagaactgaatgtgacattgtattatgtaatgctttattcgatcctatgtatatgtagggattagggattgtttgttactttgtacgtctcctaatataagggattttgacattttacttgtactgtttgaccattcgtctaattcaaaaaattttgaaattattattatttttaacttattttattatccaaaatactttaagcataacttttcgttttttatatttgcacaatttttttttgaaaaagacgagtagtcaaatagcctaagctacagagagggttttttttttgtgcgccccaatttccatgtacacgtagcagtttctcccaaaaggttccatagaaggcccaagcgtcggcccccacaccatggcatcggataagattgccattcctttacttcggtaaacaaacaaaaagaatagttcaataataataaaaaatagaaaatgctcagcagaagaaacgaacggacatggcatcgcatcgcatcgcatccatctctccagaggcctccatccaaagccgcgcaaaacgccaccacccacaccacgctgtactcgcgacgcgagggaccccgccggcggcggcgcgaggaggagaaggagaaggagagagagagagagaggatgatcctggtggcgatcgtggcggagctgctggaggagtacacggcggcggtggcgcgcgccatggagctcctgctgtcgcgggcgccgccccgcatcttcccgcgccgcgtccgctttctcgtcctccggagcctccccttcgcctcgccgccgccgtccccgctctttcccccgccacccttcaccgtcgccgccggcacccgctgatcgatcgatcgatcggtccatgacggctccacgtacgtacggcaaccagcaaagacagtacgctggctgctgaagtagtctcgccttcgaatcatgaattaacctgctcgcgcgtgtgcatagttcaactcgtgatgtttgtagcagcgtgctagattactagctagttgttgtgttcttgcagcttagtaattaattaatcatttgcttagcttctgatcctgaaaaagcttgcatgtagttgtagcccagcgactgagttacggtcacgggctcacggccagttgactcggagcgagaagatgtgtgtaatctgtgtgaggttttgaattacttgaagaaaatttggagatcttgtttgtttttggctgctgatgtgttaaattggatcaaattcgtttgaaatttggacctttttctatataaccgcgcttccgcaggctggcgattcgcaatttttttctcggatcatttcatttcccagcacacaatcttctgtgctagtactaccgtttgcagaattgtgatcagtgtgggcccaccctctctgaactctgattcactagtatatttttgggtcgacacgttgaaccgccgattggacttacatgtgtgtctgtctggtgtggtggcggtttaactttaatcaaatactccctccgtaccaaaataaactaactcctatgatttaaaatttattctaaaataaaccaactcctactccctccgtcccattttaagtgcagtcatggttttccgtgcccaactttgactatccgtcttatttaaattttttctgaaaaaaattaaaaacataagtcacgaataaaatactatttatattttatcatctcataacaacaaaaatactaattataaatttttttcaaatatgacggacgatcaaaattgggcgcgaaaacttatggttgcacttaaaatgggatgaagggagtaccttcttacctaccatcaatccgcaaatcgagaaattttattacttcaatacccctcacctactcatcgagcaatacaaattttacattaattaagggtaatttgtttttttgtttcttttcttaatagttttgtgagattctaggattttattttattagggacagagagtttgattttattaagcccagagggagagaccccgatggtgatttatgcgatgaagttgagaatggacactaaccttttctttttcccgccaggttgcactggtgaagaaaccctttgtagtcccggtttgtaaccccctttagtcccagtttccaaaccgggagtaccaatccgggactaaagatcgagatgaccttttttttttgcatggccctgttgctgcatggtttatatatatatatatatatatatataaaccatgcatatatatgtttcaatacatatatacgcatacatatatatatatatgtatatatatatatatatatattatattatattatatgtatatgcatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctacaaggcagtggcaatacttgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcagaccaaatgacggaaccgataccaagccctacatggagtttaaagctatgattcgtagtagcaattaacataccaagatttcttaattaacaaaggaacttatgacggtacctgtctataagttcgaaaaccatgtcaaacgtagactcttttttatccattaagtcatatacgttgacggtgcaggcctccaggtcgatgagtaaaagcacccagtggaatctgcaatgtgcgtgggatgcattacatatgaaacacttagcaagttcgtatgggaatgaaatttggtatgtaggaagacagtaaaattaaactaactctgtgttgtatggcaacagtatgaacgtattgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggaactaattaattaaaggagacgtataataagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtaggtagggactgcagcagctcaggcttgataagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctacttgacagatgcagacatacccctgaagaagtttctgacactggggtctataggaatcttccttttttgacttcgaggcttgaattgcctcttgacttctgatgc

SEQ ID NO: 52940 - DNA, 2267 bp, Oryza sativa
tgtgtgcccatgcgttcatcaatcttccttgccacctcctcttgcatgttgagtttgtagctcgatacccggaactctaggtctgcaatcttggcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctctgaatatgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttctacttccgttatgatgtgccgaccctcaagcttcttcgctgcacctcgttgcccgcgtgccctcttctgtccaacggagggttgactaccactagcctcctccttctggttcccctccacatccctttccacgtgcccctgctggttcccctccgcatccctctccacgttcccttcctcgttcaagtactggtttggatcctcgttcccctcttcttcattccagtactggctgcttccctccgcgattggatcggacaatatctgttcctcatcgcggtcagccatctgtgatacaagaaacatctgtaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataattttatattaaaaatcaaataatattacatgctaagactaaaatagtcatgtatatgctaagtgtttcgtgcgtatatgctaagtctaattaagactacaatagtcaattgctacttgtcgcaccaattccgttgtcaataattacataccaagtctaattacaaataaagtaatattatattaaaactcaaataatattacatgctaagactaaaatagtcatgtatgctaagtgtttcgtgagtatatgctaagtctaattaagactacaatagtcaattgctaggagtcgcaccaattccgtagtgaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatgtattaggataaatgcgaagtaacatatatatatatatatatatatatatattgcatttcacgttaacgttcgtcctcgttcgttcgctcgttctcattcacgttcgttcgcttgttctcattcacgttcgttccctcgttctcgcttgtcttcgttcgatcgttctcgttctcgctctcgttcgttcgatcgttcttgttctcgttcacgttctcgcggcaacgtacgttgacgtgttcgttctcgctctcgttcgttcgatcgttctc

SEQ ID NO: 52941 - DNA, 2105 bp, Oryza sativa
tttcccgctatttcgaaattctttttaaactcggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattatgaaaaactctaatatatgaatgatagttttaaaaatatattaaatttaatacttttaaaaattctccagtcaattataattagcatatgaatgatggtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtcatttaaaacttttaaaaattgtaagtatcgcatataactagcatacacattatttaaacttgttgaaacctctaataatcgtgcgtaattaacatatgccatacatcaattgatttatatgtgataatcaatacatccaaaatagtttacatggtgtacacaataattgcggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctggtcagtcttgtcctcaactccgacgatttttcttttgcctggagaaaccacttgacgcttaggctcatcaggccctctgcccttctttcctttgctagacatgtccttcacgaaaaagacttgcgttacatcattggcaaggacaaaaggttcgtccgagtatctaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcaattgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacacggggaaagtatcaatgtgatgccgtgtaatccatgcatcggacttaccgatgttcctagcgcgaactagagccaagtgctcctcgatgtaaggagctaccaatgaagagtgttgcagaacagtgaaatgggctttacggaataaattgttgtctaccgtcgttattgctttccttccgagagttccctttccctgtagtctcccttcatggcgtgattcaggtaccccgattgggcgaaggtcttcgacaaattctacgcaaaattcgatgacctcctctgttccataacccttggcgatgcttgcctctggacgagcacggttatgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagtcattgcaccacttcattctgaagggcttctaatctatccggatcg

SEQ ID NO: 52942 - DNA, 9991 bp, Oryza sativa
  unsure (1)..(9991): unsure at all n locations
nnnnnnnnnnnnnnnnnnnnnnnnnnnnnnnnnnnnnnnnnnnnnnnnnnnnnnnnnnnccagagtggtatccaactttttgtgcccctgctcgcaacctgggtacaacaaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacaccgtcaataaactctttggaccgccggtcagcgtacatccattgccgatccatctacatgagtaaaaaaaccgcacacaaataattattcttacaataatgacagtcatacaataattataagatatctttattcatacaaaaatcataaaatattacaccaaataattcttaaaaactatttgtaaagttttaaattttaatgtgttttacttcttttaattttcattttaatttgttttctattatttaagattaactttcacgagagttttccttctcaactattttataaaaccttatttagcaaatgaactaaatttctatatattctttcttccccacacacattttctctctcatcaacttacaactaaattttggagacaaaaaaagtgtgcaaaacataggtgtaaatgtagtatgacaaaaaaaaaacattggaggatgaagttgcaaaccttttaggcacctccgatttgtatgtaatcaccaaaataaattcaatattaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtcccggttggtagcactaaccggggctaaagatcaccgggatctattaccaaccgggactaaagttaagatctttagtcccggttggtgttagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcagtcgaccgatgaaagatggtttctccaccagtgttggtggtaaagatccacggtcagtttatgaaatttggaataaatttggagcaataataataaacaacccacctcctgcaaaggagatgataatgggtctaactaaaatttccacgccatccagaatagaacaactgccgtgccaaaaacataacggagcacttttaacgaaataagaaatgaaataacgaaacaatgtagaaaagacaaaggcaaaaatgtacgggacaatttcgttcttgcccctattttgatgttcaatattgattttgcccttattttttaggtttttgtttttacctctacttttttttttgaaatgaatcaaccgtttgcccctattcaattcttgttagcggtgttaaatgtgggtgtaaaaagacaaatatacccttagatatattccggtacttttgacataatcaaaataaaaatctattgatgccatactatagcaataatttaattgtccaaattttgttaaagtttaccaaaatttgggtcaaaattgaaagtagtgtacaaaagtactggaaaatatctaagagtatacttgtcttttttacctcacatttaacaccgttagcaataattaatggactatgtgaaaacggtggtttcatttcaaaaatgtaggggcaaaaacgaaaaccctaaaaagtaggggcaaaatcagtattgaacatggaaataggggtaataacgaaattgccccaaaatgtatctatggtttattaaaaaaggaatatcgcctgttacagaaaagaaaaaaaaagaccgttaaaacaaatcagggattccgggcggctaaaagtagaagcttgaataaacatgagcctcagaaaagagagaaaggatgaaaaccgcctaagcaaaaaggaaaaaaaaagactgatcagaccataatctcgcgatcgatcgccattagtctattgatcacaaacaattatactatgtatgaattactattggaccttcttatgcgttcaaaaaaataagctgtaaatctgcaatacgtacgtacatgtaaattttttgcaacaacattctccggtgaatttgcggtgggctcctgcagagatttctctgggccgtaaggtagtgtgaggctttatttgaagatgtggcccttccaaatagatgtcttggagtccaacataactggtaaatgtccctggcccaaacctaacacccatagcaggccgaaagctgaacttccaaacgggcccttaatctatatgatccatacgagtaattgtcaaagactcaaaaaccgagtcaactttatacggactaaaaatatcaaattaattagttgtagtttgtatctagaggacataattaccatcttcaaaaaagtttataattgtgtgttcatgcaacgtatagcgcgttttgacacaggatttttcacacgatagtggactataaaagtcccaggttattacaagaagtgttttatgctcaaataacttggagactttctgcttgacgaatcctcaagtcgtcaggaaattttcgttgctcgcaattcgtagaaactctctctctgcaagaaaaagaaaaggactacaagttgctcttgatagatctcctgacgaatatatatatctccaaggctccaagcacgttacgtcttgtgccatcgataagataaaaaacctactacctcatattttttaatatatgacgtcattaactttttttttcgacgtttgaccattcgtatttaaaaaagtttatgtaattatcatttattttaatgtgacttgatttattatcaaatattttttaaacataacataaatatttttatatttacacaaaaattttgaataaaacaatggtcaaatattagtcgaaaagtcaacggagtcatacattaaaatacggagagagtatcactaaagtttaatattgttgtgcatatgcttaatcatgcacgagtccatgaattcatcaagccgacaaattaaacaagtcccaggttattacaaaatcctccatctatacacaactccactatataaactggtggaaaaagtacaccgaaggtccctcaacttatcatcgagttacaaaatcgtcctcaaaccgcaaaaccagatatcccgtgtctcttaactaattaaaactggtcataatagattccttgacggttttgatctcggttttatcctacgtgacgactgagtcagcatggaacccacatagccccacatgtcatgatgccatgtcagcaggccgacctctcccttcctttccttctctctctcactcaactactgggcaggcctgccggcggaggggatgaggtcgtcggcgtcggcagggcgaggtggcgtcgtggagggcgaggaggctcccgaaccctaaccctaaccccctccttctccttcaggttcgtggagggaagcgtgtgcagcatctagccgcgcccccgtcgcaccagctgcgctgctccggggtcctcgtcccctccccgccaccgatgcatcaggtcagtaattgcccgtgtccctctctcctgttttttgcccaagctgcgcttgatatttgagttggtttggtttggtgtggagcggtgtggtgtggtttgattcgggagtggaattgaacggatcacctgatggaattccgtgcgtgattggattgtcgcaagctgctgaggtggattttttcctgaacttgttagctgaaatggaggggaattggggagattaggttgcgtgattgatcgaattttccatcctgctcgcgtgattagtcccagattccaaatttccagttgttttatcacttcatttccacgaaatttcacccataatctgttccttcatcctacgcatgacctatatttaatgcatttttacgaattagcatctgatttgggactaatcagagaaaaaactgcactgatgcaggtatgctacccggtcccctttcccaactccgtcgcactgccaccggagctcgtagtgtatccctctgtgccaggcctgccgccttcagccacgccgccgccgtcgtcgtccataggctccagcattgccattgtcgtccttgtcgtcattaccacgaccatcatgatcgtctccattgttgtcattcgatgcagctaccgccgcgggttgatccacgggtcgtcgtcgacaccggtggtcgccgggcacacgacgctacacatcttcaccacattctcacgccatcgccgggtcccagtcctcggggtggtcggtgagccaggccgttgactttgccgccgagggggagcctctcggagccggcgcgcatggccatgttggaaataagagaggtaatgaggtggcatcctggtatgtggggctcacgtgagtcccacgctgactcagccgccacgtaggataaaaccaggatcaaaaccaccgagagacctattgtgaccggttttgattagttaagagatgcgagatatctggttttgcggttttgcggtttgaggacgattttgtaactcgatgacaagttgagggaccttcggtgtaccttcctaaactggtagccaccttagggaatagtacacgcaaggtccctcaacttgttagccacatacaaaattgtccctcaaccgtagaaccggacatccggcgtcccccaacttacaaaactggtcacaaaaggtccctcggcggttttgaccccgattttgtcccacgtggtggctgactcagcgtgggacccacgtgagccccacatgtcagtaagccatgtcatcacctctccgctcgccggcctccccgcgcttccgctgccccgcgtgtggctccagctcggctgccgcggttgcccgccgctcctcctcgtcggcgagcacggataggaagctgacaccgccgccttgctcctctcaccgccgccaccgccgccttgctcccctgagccaacgccgacgcattcgtcccgtctcgactccgacgctggcctccccgtgcctccccgctgtcgtcaccgtgttcctcccgcctcgccgccggatttggacttgggaggagcacaccggcctccccgcgcctccgccggcctccactgctgctcctcctctccgccgcttcttccccgtcggtcgcgccgaccctcttctccaccgcgtnggtgacgccgccgccgccgacacacgataggccctcctcttcgcgtcagttatgatggccacagccgcgcgccgccatcgccgaccgcacgagggggacggggaggccggcgaactcgcacctgcctgagcccgcgcgcccccacccgggagccgccgttgccggctgcaccacctttcggccgcgcgcaccgccgcctgtgcgagagcagagagcgagaggaaggagagaaatagagaaagagagatagggtgctgacgtggcttactgacatgtggggtccacgtgggtcccacgctgagtcagctgccacgtgggacaaaatcagggtgaaaaaccgcgagggacctattgtgaccggttttgtaagttgggggacgccggatgtccggttttgcggttgagggacgattttgtatctggctaacaagttgagggaccttgcgtgtacttttcccgccaccttacggcttcgttcggtttgggtgtaaaccggccttttccccggccctttcgggaaagcccaccacgaggggaaagaattcctgggttgtcaaaaaatgcattcggcttggcccgggaaggtggatatcccggcccaatacccccaaaccctagggatattggtccaccaccctgagcaacacaccgctgcctcttctcgactggagcggcgcccaagccgccgctgctcgtcccgtcgcccgccggcgcggcacaccgcatctgctcgcgccggcgcctcacgtcgcttcagcctcctcctctcgccacaaatgacgccgcctcctctcaccgtagatgccgcctctcgtcagatctgacggagctcaacatcggtgcggccttctccgttcggtctccaccatccggccactgcgtcttccccatcaagaacctcaaggacctcgtcatcttctactaccttgtctaggtatgtcaaattccatccttctcctgaattgattggtttggtggttgggaaggtgaactcttgggctagatctgatcgattatgttgcgggatagttaatcttgggctaggtaatcttgtgctaattttacttgtgaaatctctaggcattatctatcacatcctgttctgatctctctgttttttttttcattatcaatctgtgcacggttagcttttacttttcctttgaggtctatacgctcagtatggatttaggatattaattttgttcatatacattaattagctctgtttttcaatgcaaacgatttcctaagttttgttttctgtgtgtttttattcacatgttttatactctgctccaaaaatgccataaatggatggtagcctgattttactactctgtcattgtttccttttaatctcaagtactgattcctgcagttacatactgttgagtttatcgttgagagagtcggtgctgcttacaggtcataactcatatacgtagtttgtttttgtagggtattttctgaaatactccagagatttatgtataaaaatgaatttattttgtgacatactaagtagtatatatataatttttgcaggatattgaactgtgccacctgctaaatttgtttaggatacgtatgaaaatcgcctttgctcagtatggatttagtatatatatttagcagccatcctaaaccttgctttttcattatcaaaggagattttacatattggtttggtggttgggaaggtgaattcattggtatggatttctgaaagaacatacatctgttctggcatgatctatcacatcctgcattatgagaaagtgagctgcacgcctgggcattagtgtgtgtttgggttaagctgagtggccaatagtgatcagctccattatatatatctgaatctgatgagtagtgaactagtgatagatcactagtgtgagtagtcagtgacatacatatgatagaatcttagctgggcatgcatatgctgctactgttgtgctgttgtctgaagatatgagtatatatagtagctgtagtgtggtgtagtgcgcgcgagtggggttttaattggttaaagcatgttggttgctggtagctaggtgtcaggttctctcactagttgagtacatgattcagggctttttcgaaatgcatgatgtttaaaacataggaacaaaaggaaatacatataattaaaatactctatggattgaaaaaatgaataactgtatgaatgatcatttaaatggagcacaggaaaaaaaaacacagaagattcttttttatggtgataaaaagatatactctgctgtttatctttttaatgctttgtaatctaatctacagaagtacagaacagccattactacctttgacattaactgcaaccttctgttatctgttaattttttgtagtttggtgcttagaagattcttttttttttgttaacatttgtttgcttgatatcacacttttatgtgcttagaagtcatctcacacatgtcaacagttcctggaattaaaatgggttcaagggctaatcattaacatgtcagcacttttatgtgcttagaataacatgtgtttgttcagagtcattagctgaaattggacagcaagtatattccagtcagttagcatagaatctgatattgttctgaatttttcctttaattctgcagtttgggtgtctatcaactgctttgaccattggatttgttaatacaacacgtgttaatacaacatcaattccatctatacactctgaatgtgcttgtgtttcttgcccactgactgcattagtggtgtatatgttggggacctgctgaaattgagctcaattatgaattctgaaattctgaaattatggttcaggttgaggagctggctggctgacagaaacatagtaccatggtagagactgaatttaactgtactatttagttcttgtgaactttgaaaattataggatctcttctggagattgatattttggatatatgaattagctagatcgatcaactttgttaaggttttagctagaaaatgacatgtttgcattagtaatagataataacatgtgtttgttcagagtcatttgtagagcaagtatattctagggtcccatcgtttggcttttcttttaataagccaaaacggcttattagagtaaaaataaatttgtaggtaaaatttttatatatgtgttctcggtgacttaaaagccaatgctgaaaaaaaaactacgttgaaaatatctcaaaatcaatgtcaaaattaagtttgaaaattcaaaatttggctttttctttgtctgaataggccatccgatgggagccctagtcagtatatgctgagtttgcatatctgaaaagaaaatcattctttttcttgtttgaatagtaacaaaaagatctttctttccatgtacttgtttgtaaagtgtctccattggcttcttgcaacatgaatagcatgatgataggtggtcagcctcttttcatttctcttgtagtcctgttgagctcacaatgctctttttttgtgttctttggcattgattttaatattttcttgaggtcacaatgctcatcattttctcctcccaggtcatggagctactattatttggtgaagatcgaatggtggcaaagataggacaacaatgcatgcagttaccatcttcatttcttaaatttatggacaaatcagattttgggacctgggaacttagtttgtggttgtactcaatgttctaggtgttgatgtcctttgcttccgattttattttaccttactgtggtgatgtataagaaaaacttctcagtgggctctttgctaaacactaaaatttaaatgcttgtaatattgtttggagggcacagattgacttaccacatgtgaatttgtcaactgatacaatgcatagcagtgttaattatcgttttaaaaacttggcagtatttttattttctttatttaatgaactgttttcttaattttggttttcttctatatatgccattgtagaaattagttatcagcttttctttttgaaatttcggattattttgtgtgatttcgtagtttgattctatttctaagttgagatgtgctatctatgctcgtttttgctcagtttttattcaaagagatgcgtttaacctgctttttcccctgttttccccagccgaatagcatgggagtttaacacccaacgtggaagtggattgggtggtgggtggggatccacctatacctggccaaatgggccgtgccaagccgggccggcccaagcacgaccgcactgtagaaggcccaggcccgnnnnnnnnnnnnnnnnnnnnnnnnnnnnnnnnnnnnnnnnnnnnnnnnnnnnnnn

SEQ ID NO: 52943 - DNA, 2666 bp, Oryza sativa
  unsure (1)..(2666): unsure at all n locations
nnnnnnnnnnnnnnnnnnnnnnnnnnnnnnnnnnnnnnnnnnnnnnnnnnnnnaaaattttgtctaaaatcaaaaatagtttgtgactaaaaatagtgcatacaagaggtgtaaagccaagcaaaggtggtaagaaagaagtacgtcatatattcagttttatgtattattttatttcatgttatgcgaataaatattctgaaatttgtttatgttgttttaaattttcagaatggacgaatcgaacattccatcgttcacgttaggtgatttcgaccctaactacgtgtcgaggtcattcccaactggtaagtatgatgccaccggatcggctccaacaccaccagttatggagccaccggcgggttcagaagcatccggcactatgagtgggagtgtatcgacgaacaccggctcaaagagatcaagaacttccggtgtttggcaacatttcgatgaggtggccatgacaggccctgatggaaggcaggtaacattcgcgagatgtagaatatgcaaaaataagttatctgcgaaatcatctggtggaacaggacatttgaagcggcatgccgaggcttgtgcaaagaagcaaggaatccaactacgacagcaacaactactactaaatcctgatggtacggtacgtacgtgggagtatgatcctatggtagctcgagaaaatcttgcccgtttaattgctagacaagatttacccttgaactttggtgagagtcctgcatttgaaaattacataaaaaattctcataatcctaggtttcaagctgttagtagacaaaccacaacccgtgatttgaaaaatgtctatgacaaaggttatgaatcactgaaggaattatttagtacatgcaccttttctgtcagtgtcacctcagacatatggagtagtagggctaaagaggattaccttagtgtagttatacatttcattgatgatgattggcaaatgcaaaaaagagttcttggcttaaggttaattgatgtttcacatactggtgaaaatatagcagagagaattcgagaggttattgatgagtttaaccttgcagataaaatttttgctgtaacaatggataatgcatctgcaaattctagggccatggaaattctacaaccattattttgtatttatgctcaatcatttcttctgcatcagcgttgtgcatgccatatcattaatctaattgttaaatgtgggtttaagagagttaatgtacacatcgacgctgttcgtcaagcaatcacgtggttaactgcttcaaacccacggattgcacagtggaaaaggtattgttgtgcatcgggtgagcccccacgtaagtttttaaccgatgcagaccatcggtggaatgccacttattttatgttaaaggttgtattaccttacaaggatttacttactgttttccttcaaacacgtaatggcccaaaaaacagtgacggccagccaatactgactgatcatacctggcacattgttgaaaggttcaatcaatttcttgaaacgtttcatgactgtactctcttctgttatctcaagtatattatccaacagctaatttaattttgcataatattcttgaaattgccactttgttgaaagagtatgaaaatgatgaccttttaatgcccgttgtctttaatatgaaacaaaaatatcttaaatattggaaagacatccccatgttgtattcttttgcatttattcttgatcctaggggaaaattacggggattcctcaatattctttcacttattggagatattattaatgttgattattctacctattatgctgatgtcaaaactaaattctatgaggtatttcgaaagtatgaattaaagttttagtgagatcgcttgcaaagacccccacctgtccttgcagcaggtaagaaaaaattacagtggagcagaatttggggcggttcatcttctagccatggtggtggtaccagttcatcagcagcaagtggggacgctagatcgcatggtcctgccgaagagttgtccaactatttggatagtgatgccatcaggcatgaaacgtcagacttcaacgtactcgggtggtggaatgatcataagatgtcatatcctgtgctatcaaaactagcacgggatgtgttgacggtgcccgtatcttcggtatcctccgaatcagccttcagtctatgcggaagaattatcgaggataggagaacaagtctgagcagcgatcatgtggaaatactattaagcgtcaaagactgggaacttgctgcagaacatgcccaatacactgctgacaaccaagaattggccgcacagttcgaaaacctttatttagatgacgaacaattagggtagctagtttatattttttaagtattgacctgttggctgtactcttttctttgtcatggttttctcaaatatgagtttttacatgacaaagtttttaacgaggcagcatgtatcatgtaaacatcaataaaggtcattactctttttccccatatttttctaatatttttctaagtctaattatttttctatttttctccaactatctattaattttctcttagcttagttaactttcggacctttctctttgatttgaattgttccactgacagagtgacaggcgatagacacacgga

SEQ ID NO: 52944 - DNA, 2071 bp, Oryza sativa
ccacgacccatgggccattgacgtgcccgtgccggcatggtacggcacgacgttccctcgggccgtgcttgggccggggagtaggcacgtgggccggcacggcacggcccgctacaggagtcgtgcctaacgggccgtgccctagcgggccgtgccgcgggcgtgcccgtgccgtgctgggccgggccgcccgtttggctaggtatagatccacccaatcctggactggtggtgtttcccccggggaaatccctacacacgtgccgaaggaggccttagtgatcgtggtagtaacttatgttatgcggttttaattaggaataatgatacctggatcagtatgatatcatgtatacgtatggaggagaaccattttatgctaaatgaaatggcgaaacattaccagtagcagctagtaacatttattgaatataatcttttacttaagccatgtgtcgcgcagtcttttttgtctgatgtgttcaatctattttgcgcggtgcaactacgcgcggctacagtacttgtagcactcctacaatatatcctatcgcaataagaaaaaaaatgcccaatacattcttgttaaaaaaaagtaacggctttgtgccattacaggggggattgaatcgaacttttaacatttgaaccgatgaatgccatacgccccttcttccatctaacaaacaacaacgatctccatgaaccctgatgttatatgtggctgtatacaaccaggttgttgtagaggccgaatttttcccattatcaatgtggtacgatgatgtgtttagcccgtagcaacgctatttcgatgatgtgtttagcccgtagcaacgctacttacctggaaccactctctttgatttatgacatgatccatgttgaattaccgatgtatttgggggggggggggatgaaaaacggtcggaaacggtagcatctcttcggaaacgatgctccgaaacggtagcatctcttcggaaacgatgctcgatcttatcatttagactactcaatgtcgacattaatacgatacagaaacaaattagaaaaaaaacaaaatttttaaatagccaaaaatacaaaaatagcacggtcggaaacggcgctaagtcgatcgagaatttccgagaccgttttcaccccctatattggtaccatcaatttactaatttcaagcctccgactattttgttctgtttggttggtaccacatcaatcaataccgaatacttttatttctgtttgcttggttataacacatcaatctgactacttctgaaatataacaatacttttatttctgtttgcttggttaacacatcaatctgagtactttcgacatatgccagagaactgaagagacatcaagatcaaagagggatcctcttccgcgggaagagggatggtagaaacaaaacaaaggaaataatatattcgagaccagatttccataggaaataatatattccagtaccgattactctttgataacccacaatccgaacaatactagagtttcattatagatagctagctaagcataaggaacaactctaacaaatttggacaacgaacagaccaaattaaatattgaacgacggacttaaactaaccagaccacacctacatgagcttaagatactactagtactagttccgcacggatgaatcataaaaaccgtagtttaacactttagcatactcctgctgggtatatctctggaggttggttggtacggactcggccagaagtgggcggctaatcaagcaagatcacaccccggccacggtcaccgcggtcggcccggccgtcacggacaccacgaccgcgacgaccgggacggtccccacggccgccgtccccgccgcagccgccgtccccgccgtggccaccgccgaggccgccgtacccgccgttcccgtcgcgggcggggataccgccggggccggcgtccccagcggggccaccttgtccgccgtacccgccggggccggcgcgcccgccgtcgccaccattaccggcgcgtggttctcgtggaggccggtcgtcaccgacgtcgccccc

SEQ ID NO: 52945 - DNA, 6865 bp, Oryza sativa
acccgaaaccttcctccaaagtgagcagccatctctgatctgagtaagcagcggcgctagttttttttttttttttagcgagttggggtagaggcggagagaaaggtcagggcaacaggattttatagtctggtaggaggggaggaggggtaaaccctagtccaattcgggatttctgttgattttatttatttatatactttttttattgaaaaattacaaaaataaaaaatagaatacccgtttcggaacagctatccatctgctgacagattttgtatggcttagtcttacacattttttttttacggtcggatgtatttgagatttacgctacgctgagattcgtgcatggcatgagaaacaaaaactcttacacgtaccaggactcgaatccatgatttttaactcatccctttcactgagctaacttgtttttatagttacttacactataactatatattaattacatatgtaattttagtgtatttatgatgtaagtctgaaaattacatatgtaattttagtgtatttacgatgtaagtctgaaatctacttgcccatttgagcccacgtaagttttagattgtccacgtggctcgtttgtttgtttttttgtttgttgtttatgtatattgatgccatccgttagatgttaatctaaagggtaagaaatctgcatgacctatatctgtctcatgatgtatatacaggcagtccctaaaagttttgcatacctatactctccttccgtcctacagtaaggatggagaagaatatttctgtaattttttttccattatttgtttcctaaattggcggaaggaacatttttttttaaaaaaaacattcattctattatttatttttgaaatttttaacagaaaaacatttaataaaaatgattccaatttcctttcagccgcagcccgggatccctgcctattatccgagagacctgccccaggcaaaaaaataatttcatgggccaacttttcttcaattttgctatatatttgtcgacagatttttttcttaaaaatttaacagatgtaaccaaagtatacaactatagtgtaactacaatgtaatttgcatctaactttcacgtaattttgaaccgttagatttgttttaagatttgtgcaagtggagaagaaaaagaaactcactgcacgcacataagtaagaggattctgtcaatgaatgatactcggggaccggatgagtagagtactagggtacgttggaacaagggtctacgtagtacgatatcaagcagacaaaagacaaggattatactggttcaggcctcttgtcaggtaatagctctaatccagtttatatggtatttatgatgatgagaacagattacaacgagagtagtcgaattagatgataccgacgagattgtagtcgaggaattcgacgagatctcccagcgacttggctccgcgtactccggcttcgtaaactatggtgggtgtgttggcgatagaattgaatgcctttcaccgctccctggggtcccttttataccgtggatcatcttgaccccaagaaagatttgtggatatttgatctggtacggtataacagaagctctatccctttcgagtaggactttggaaagagatattttccataatttgaagcggattccatacgatattcatggggatgatctgtgtatgtgaaggtatatcttatcggtatatttcataagtcgtaggatagaaggtatgccttatccgtaaccctgacatattcgtttacatgatctccattttcaccgaaatagcatgttatgaagagatttttgaaagttacatgtaagttatagtgtactatcacgattgtactttaattacatctgtaaaatttatagtaaaaaatttatcgacaaatgtataggtgatcccattgtaacgggatatactattattttcaactactattgtgtattattgttatatataatatgtgttctaaagggtgatatgttttttttctttcacactccaacttgctcgacttgtaaacagatggtcgtaggaattttgaccgaatttacagcagaattatttttacttttatatttttattaaaatatttaaaattatttttgtttcaaaaacttacaaatctaaacgcctcacgcagtcctagatggcttttaagaaaaacaccctttcgaaaagcgttaatgttctaaatgtagctttcttcgagtcttttcaccattcaccaaagtagcctcatgcgtcgtacactcaaacataacaaatctcttaacttgtttgtcctgtttgctaatgctgaaacaactacaaactacaacttgctctcttttttttctcgttagtacgttttttaaactgttaagtagtagattttttgagaaaaaaatatgtataaattgtttaaaaagatcaaataaatccatttttagtttataataattaattaatcatgtgctaaaaagttttctcgttcctaaagcggttgaaggaacgcagcaattggcattgctatctctgtttccagcatagatttatgcgtaattctctggcatatcttatactttttatcataaaataaatcaatttttaatctagaaatcttattactcccaatatcccttatatatagatacgcccatattttcctataactaataccgtacccaatttgaataaacaaggaggaataattttataaagttggttttttatctagttcattggtggtatcattttacgttggaacatttttttagagtgttttttttaactcggagaagtgcgaggaccgatgcttaaattggggaagagaaggacgtcccttatcatagcaaagataagagatactacagttctttttctctcaccattaaaacagtcttgggatgaagggtttgattgtgtatgtttggaaaggaagttttgggtggataagatatggcgtcccctttttttgtgtgtatgtgtttggttggtgggccaggtgggatacaatggcctgaaagggaatattcccattggatgcaaccgggcgagcgcggtgagcggtcgcgtcaccccatggagaggggggcgacaacgatgaagatgtgttgtggctgatgcgggaagtgagcgccacatcagcgggaggagggagtagcgtcgagcccggagatccggagcaaaagatgagcgtgacggctgcaacaacgacgcccgaccggtgcgacgacgacgatgctagcccggcggcgacgacaacgattcactgctgctggtgcgggaagaggacgtggcggtgtgcccgaagatctggcacgagagatgagcgcagaggcgacgatgcgagcccggccgatgacgacgacaatgatgacgattcgttgtggccagtgtgggcggcgagcactgcattgatgggaagagggagcagtggtgagcctaaagatttggcgcgggaggcttgcggcggtggcaagcccggagatctaccctacttttttatttttccttttatttttatttttcttgttttcttttttctctgtgtatttataatggaggtagtggtgtaaaattgttgggaggagtttgatgggggtatatcaccatattaagtgaaaggtaaccacaccaacaaatccaccttactctctccaaccaaagaaaaatttggatcatcaaatccaccttcattccgttgaccagacaaaaaaaattcaccatatccatccaaccaaacaaaaaattgaatcaccatatccagcaaaatatgagcggccatatcacatccacttttgacagtgaaccaaacgcacctaatcatcaattgttgtcgagctggcagcttggctgctacagtacgtgattggatcacttgtcgtggttaaacttgaagataaacgatctcatcttttcgtttatacttatgcatataagctaaaatttaaatttttaaccttaaatttggagttgattttagggttttttcatcgtagtttatttttcggcttttgcttttagattgttatgaacatgtacgtagaagttttattcagaaattatttttgctttgtaaataggttgttgcaaacgatggggctgaaaagtaggggtccggacccctagagttaattccaactccagcaggtagatttggccaaatctctgccatctgctgttctctgaggctgagatgaagccacctcaatttcaactattttttttcttctgagaaattatttcatctaatctttataactaacaattagttgtccaaagaaagaagatatatagtgatttttggcatagtgattccagttcccggccaacatttttttttcgcataagaatggctttatctctattatataaaaaagaaatattgtatactattaacaaggttctgttaacagtgaaatttggtgtttttgcatcaacaggttctcttgtgttattatatgtatacgaggaaacattccgttggcacattattgttaattttgaagaagagaacatgtatactccgttaacttggttgcaacgttatcattgctaaatgttaagaaaataatttttcctttaaatccatgtgattaactgaattaattaggagacgtggcttgttatcagccgtagaaaaaaatagatggcagagatttagctaaatctaaccggtggagttgaagccaactctaggggatcaaacctgaaaattaggattttaccgaggaagaaaagatccagtgaagattgtctgcagtactgctgatgcagtagcagacactgacgtgtgggcccggacccatatgtcagccactgctaccgctcacctacaagcattctcagcgctgtgggccacacgtgcttcacgtccatatgttgcaattgacaaaaagtcactcgctgatccaaatgctccacgcagagagaggttctagtttcattgaatttgctttaggctcgtaattcgactttcatcgttatggattggtaccaaaccatgattaagtcctaggtaagcggactttggggagattatatgagtaaatgcctgaaccaaaatatgtcattgttatgggagcttgtactattaagggggaatattcaatacggatttgttggcaactttttgtaacaagttgacaaccacgatcgcagcacctaaagctttgcggtgatagtagagtcgccaaccaccctaatctagtaagcactagatcaagatgggttttgataagctaaaccggctagcaaagccgatctagatgaaaccgtagataactacccatctgtcaagggataaccctctctagcgggtggtcgtgagaacctcctttgtgagttcggccggtggaccgggcacaacgatcaggagcgtgactttgctctaggtggagtgggtgaagtggaaggcaaacgaattcgaaacgggggattatccaggttcgggctacagagaagcgtaacaccctactcctgtgtgtggattatcttgaagtggttacaagggagctcaagctcaagagaaactatcagctagtcttctcctaaggttcaagcttctgggagtcgtccccctgctcggtgggcaaggtcctccttttatagtccaagggcataccacatgcaccgcctccatacgtctctttcccaaaaaggggcctacctcaacctggtgggaccgctacccatgccttaggcaaaaagtaaggcggccacgcgatcccaggcggggcccagcgtcgtcctccgcctaacacgggggacattccttgtcattccctcataaattcatggagacttttgtaggcttggtgcgtgggatacatcggtccaacatcgatcccctgccatcgatgggacggggcatacctgccccctgtaacatcctgaaaattcaatacaataaaaatcactaaaattttgaactttttaaaacttttgcatcatgctggttgttatgattgctattgcttgccaaaccataaatgatcacaaagaaagtaaagtaaggatcgatatttaagcaatagatataatttatgagaatatatttaatcctacaaacaattatgcacaagatagtaaagtcaaatattaatttctattacaaattacaaatcaggtattagatattcgaaccatgattgatagcttgatgtcacaattagctaaagaaatagtaagattaaatctaattcatttgaatcgaatctcacatgaaatataagaacacatgaaatgatgatcaccactatagtgatcgtgtttataaataagtaattcaccggaatatatagattgatacttgcaacatgtcgccgagttactcatgacaggaaaatcactcatataaaataatggtcatataaataaattaatccttatatataaacaagaatatgtgagtgtttaaaattagattaatgttgtaccgagtcttaatatactatttatagaataaatagattcaacctatccgtgtaaaatatattgctataagttcattcaatgtgctattgtaataataagggccacactaggatattttagaaccctcaaagcctccaaaattatctaggctaattttagaattagacctcatttaaataatacaatagaaaaatatatataagaataaaatatgggtaatattaaaatttggtaaactttcatctaaattaaaacatatattgggtaaacctcatttatgtaaaattaggatttatagaatgaaatttatacaagggataaactaaaatcgggttaaatagaaaatggcactgttcattgcgcctaaggtgttcgatgtgggccctagccttccccctcctcttccacctctttccctagcc

SEQ ID NO: 52946 - DNA, 1646 bp, Oryza sativa
  unsure (1)..(1646): unsure at all n locations
nnnnnnnnnnnnnnnnnnnnnnnnnnnnnnnnnnnnnnnnnnnnnnnnnnnnnnnnnnnnnnnnctcgcgccccgcgccctgccgcgccgcgtcgccatcacatcgccgcgtcgagccccgcgccacgccaccccgccgacgccatgaggccgccgcccctcttccctcttccccattatctctttccccttcccttatataatccccccctattcccactctttccctccatcctcacctcctctcctctacccactccaccacgtcgccgcgtcatcgcatagagccgccgcgccgtgcgtcgccgccttgcgccgccgtcgccgtcgtcgccgccaccgccgccgccggtgagccgtctttctccccccttcacctcgcgcccaccgccgtcgccgcccggggaggcaaagagccgagagagaaagagagaaaccgagggagggagaagccgaggaagagaggaaggagccgggagggagagaagaaaagaaaaggaaaagagagaaaaagagaaaaagaaaagggaaaagagaaaagaaaagaaaaaggaaagggagaaaaaggaaaaggaaataaataggaaattagagggagattagggaagtttagaaaatttaaaataattagaatttaattatagattaattatagtcgtagaattgcaaaatttaatataaattatggattattcttggtaatttctacaagaaatcaattcgcggtagtaatttagacgtaattaataactaaacaaatagatgaattcttatagattattatagattatttttgggtaaaccctataagtaatcgattcacggtagaaattcggatttaattactagggattttagccgtgtattatatttaatcatttagtcatagactaaattaaatcatataatatttctaggatttcgttcgatatttagctccgatttgagtgaaacttgaacctaaattcatctaaattcataagctttccaatgatatataattcactatttgataaaatatatttataaatattaaataattaatatcaagatgatgcataatagtcaacttaaaaatatgttaataaataaaattagtattgtacagtagactagatgtaataatatttgtctctaacatgtcttgccactataacaaccacacaaactaattttatgtgatgtatcaaatgaatggatgtataggaaaatactagtacttatttaatattcgatggccatataattaaatccatggcttataggttatttaaatcaagtgtagccttatgattatgcaactaaaatataaacacacatagatgaatctttaacctgtttaggagaataataatagagctagatgtggaggaatcactaagtaaattaatcgacgcaataccatatagaatagcttatatatgcctaaattgattaccacttattagtaacccaatagaaccagtgcttaaacttgtcgcatcacatatacaatatcactcatagaaactagctaatgtatattaaactacaatatattcaggaatcacttggagcattgggtagtacactttctaaataagctcatgtacagtaggcgaccaaaaccttatacgttgtagaacacatatattgtacatcccatt

SEQ ID NO: 52947 - DNA, 1185 bp, Oryza sativa
  unsure (1)..(1185): unsure at all n locations
nnnnnnnnnnnnnnnnnnnnnnnnnnnnnnnnnnnnnnnnnnnnnnnnaataacgaccgtcaacagagaccccagggttgtactccaccaggttggagcacaccccacatgagccctacttagactgaggtcccaaacaaagttacaagcccaaaggcctatgacaggtggcgcaacatcttgtttctctatttgtcgacggctgactcagaatttggagatgagactagatccattggaaagaggacttcgagagctttctatcaagtactcatgggcccaaaatggagctcgtatgcaaatttgggggctgtttgaagtcaatgctgctgcaggtggctgaatttgattctagaacttgtgtggcttgatattgctgtctctcggttggatatgagcaacggttgtaccaatagcggctaaccatcattgaacgattaactatttttaattttaatcggtattgcagcattgagaagcgagataattggtgcactcatgccccgccctctgagaccgcttgcaccggcagggcgtgtaatctcaccgtagcacccgacgagaacgctctacgtgtttgcccaccatcctgcgagaccgctactgtttgttcgcgataaccagatggtatacttttgcacttttatcccaaaccagtattttcttacaaatctgataaaaacatatattttcaattttttcctaataatgatttttccataggtccatcaatgacattgaaaatgccattgaagaggcaaatgaacccatagaatattaggtagatacaaaagggacatgcacctcaatttgacgctccttgtaatgttttatacgacctttgtgcataatctacaattgaaactttaactcaattgcctattgttgatgtaaaaacgcgaggcttaggagatctgtttaactccagtgcaggtccaaaacttgctttgggtgtgtgagcgtgccagttgatttgatcctccaatcaacaagaaacaaagacaaagaaaccgtgattaaatccataaacaatagccgatcagctaagtgccgatgatatatcatttatctttgagccgatgtcatatatgcatcgatcggcagtcattaagaagtaagaaagagctaaatctactcgatcggctgtagatatcaacggtatatgggtaccgagctcgaattcgc

SEQ ID NO: 52948 - DNA, 1245 bp, Oryza sativa
atgtcatttaagccgactaaaaggtcagtgaaaacagttataagttatgagttcccttttacttgtaaaaataattattaactatgagtagttgatgtgattgtataaatagatttaatctattggattaaaaaagataaatgatctaggttatttactaaagtaaagatgcactataaaacacctcattaatgtgacctcactaatgtaaagagagatcagatgatagtaatctcactgctggaaaacccttctttagttccggttttgtcacgccccgaactagtaccgaccggaactagcccgtgacgctccaaattaacctgttaatcgataccagtcccaggaaaacagtgctggtatcacagggagacagaatatcacagcaacagaggtctctttattatagagtagaagtacagtcatgttgggctgcggacagatcccgagctcacaactgcattacaaaagggaaacgggagccaaggcttggactaaacatacaggcgtgacttgggaactagaccgaaaccctaaaactcatcgtagccgacttgctcctggaagaactcctcatcaacgggatccacttcatcttcttcagcaactgggggaggattatttatatagagcaagggtgagtacaggagtactcaacaagccatgggaattaagtgtttaatgcaggcttcaagaaaaggctgttgtttttgcaactggttttatttaaactcctttttgaaacaactaagtgagtgcttctcaaacgacacggatgagacagtgtgtctcgtccggtcggagtatgtgcaatgtatcagtctttgaattgattcaaggttggcacccggccaacagctttcaagcggccacccaggcctggctgatcccatcagccgcagatttttcaaacatcgaacccattccacaacagtaatttcacaagcagtagtcaaacaaaactacgctaggaatcacctcacatccgcccatgaccgtgggcacggctgttcgaacagtttaataacctctgcagagggggtacactttacccacacgacattactaacccgaatcacccagcccgtgcagagcggccacgtctggagaccttgaggctttcatgacaaggcatttcgaaagccgacacaggttcaccatatgccaacgagaggggtcccagaccaacaccaggttaggtcccagaccatactgtgccaggaaacccgggggttctccccggca

SEQ ID NO: 52949 - DNA, 1900 bp, Oryza sativa
cagttttatttacgcctaattcgattttttttatccatatatagattattttgacttgaaattgtgaaattactctctacatcatcaaaaaaatcaagttattttgttaactatttgattggtgttgacaggtaggggcaccttttttaatgatttaataccggcaacatcataccctattttataaaatctttgtttatgcataccagctaaattaaggagttgatttttttttctcaaatgagcagaagagctgcgcatcatcatattaaggaaaagagatagcaagtaaaaggtcaacattttacaaagatatgtattcaaataccgtatatcataacttcataagagaacagattaatagaatcaatacaaggccatttatcatgatagacacccaggaaaaaaactcggagaaaacatagtggaaggaagcttccttatatctgacatatgttcaaatgacgcattatagcgcacaaaaatagcaccccgagcaaaaaatagcatcccggcatgctcgatcacatgcttaattcttagctttgtcctagtttctatcctcgttcctctcctgagcgcgagtgtagcacacaatttcggaccgtcttggacgccatctttactgcccccaggcataacggtttgtcttctcaaggataaataggacgaatacactgatattcggttttgggtccaaaagagctccaccgcaatgcaaccaatcccttgtctctccgtcgaggatcagtaatgcttcacgacgattgcatcggtgtaattgtttcgtcaacacagatctttgctcagtttttcttgatgtttctgagcctcttctatgttatcgtcttaaatttttcatgtatcttgtttgtgcgtatgctcattggattgtaactgagatgacgacatgctgctccccaggccaatcagtacatacctgcatacatgatacaatagttattatgaagtctatagtgaaaaaggaacgcacgatgtagaaattttattcaaaagcatcagatcaacatgaaacctttcggatttgggtccgtggcagcagtaccagagatctttttttttctatgacatcctgtgagctgcaatagtcatacatgtgcaaatttattggaatggtctgttgttcctataattctttcttataataaaaaatttcaggtaataaaaggtacttacaggttcattcccatttaattttacaggagggactctcaagccccatagctgctcaaattcttgatttctgcgatgacggcctaggtgatgatcttttcgctgcagtggccactacctccgagcaatttgcagcctctttcgaggatggttcatcgtcgtccacagccacacctcccttttgcagcaacagcaatgacatcacagctgttgcagacacagctttctccccattactctccttcgactccaccctttaagctttcttgagcaagagcaaaaccctgaccaggacaccaagctacttccctccattgatgaaacctttactgcaccagcatactatccagctgccaccgaggccaacatagaacaattcagccaaataatggttccagagcatacagatgcaccaatgcccccaatgcaaacaaacaggactgccaatgccttgctgcctctagcttcagggtatgacgacgagtgtttcacagcagcactagctggagggtacatgggtctggatggaactctgtatgaccaaacaggagtaatgattccaaattgcaatgtggagacaccacaagtaggatttttcaaccataatagtactagtaacaatggtatggtgatggatttgaataattttggagagtaccacaggatgatggaaggtgaaggacttgaccagaacatatagcgacac

SEQ ID NO: 52950 - DNA, 1054 bp, Oryza sativa
attattctcgtcgctccctccgcattgcacgcaccctctaggacctctatgagatgcatgtacacaccttccgttgcattgcaagcatatatgcatctatgccaagccatcacgtatcgcatgtgtagggattagagcataattaattacaccggccgaacccatgcacgcatgctacctaccactgttgatgacataatttgctaatggtgccatccaggatatcactatagagagataatagagatacatgcccatgagcatcttcggatcatcattgacaccaccaatcaatcaaaccgttttgttaactgctggcagcgatagctagcattgatagagtgtgccatcgatcgaccttggccgcgcgtatataagcactcgccgcattcccatgagataactccacacacaaaactgttgcactccactgcgctataaatagctacgtgctgcattcgcgcgcgtgtgcatgcatggcagcaattggtaacatgaatttgttcgacttgttcttcgtcttgcagcttctcctgtcaggagtatgcgtgctcgtcatctgctaccgatatcagcggcttaaatccatgaaaaaatgtagcctatgggttgtccagtggccgatcgtcggcgtgctcccggccatcgtcgccaacatgcaccgcctcctcgacggcgtgaccttcctgctggccacgtcgcagctcaacttccagtgccgcttctggctcgccggcttccggttcttcgtcacctgcgacccggacaacgtgcgccacatcttcacgtccaacttcgacaactaccccaagggcgacgtgttcgccgacatgttcgacgtcctcggcggcggcatcttcaacaccgacggcgagcggtggcggcggcagcggaacaaggcccagatgctcatgaccacgccgcggttccgcgccttcgtggcgcgctccagcctcgacaaggtggagaagggcctcctgcctttcctcgcgcacgtcgccgacgcccggaagacgtgccaccttcaagacgtgttcacgcggtggtcgctcga

SEQ ID NO: 52951 - DNA, 814 bp, Oryza sativa
  unsure (1)..(814): unsure at all n locations
gatggacnttggtactcaatgaacagccnnnnnnnnnnnnnnnnnnnnnnnnnnnnnnnnnnnnnnnnnnnnnnnnnnnnnnnnnnnnnnnnnnnttattttaggatctccattttcttcgattaattcgaaagatgcttctattttttttaagcacgtataaactgttaattcaggttcaatgctacgaaatgcactagttataacctgtattgaaggaaagatcttctgatactctttccagagatcttcaagtctggccatggaaattgacttggctgcatattctaggtcagtgtttatgatagtttctctattctctctgaatgcggaaaaaaaagcttcattcaacaatgatagtaaatccctgggccggtaaagggtaaattgcaaacatcgcttaaaaccattcctccctttaagatcatccgctgtgcatctatcccaaactcgttgatctttctcaatatctagcttaaatgctactttcattcttttagctgacagcattaggagttgtgcccagtcccaatgcaaccttatgacttgaccctctatatttctcgagtaatcaggatcttcctttgatagcgacctaaatatattaatccttaaaaaaattattggacgaatgcattttgctttttgatttaattcaatagatgcatatgctagacctgcaatgattccaattcctatattatccggttcatacgcctcatctaagctatccattaatatgacaacttttctgtctgagcgttcaagaagtgatactattatattntctatttctgagatattcaaattgaan

SEQ ID NO: 52952 - DNA, 733 bp, Oryza sativa
  unsure (1)..(733): unsure at all n locations
tccaaatcaaatacggacaagcagtgtctgttataccaaaaattcgatttaattaacacatttacaagcnctgtttttatgtgtgcaatattaaataatatttcgacggtttcaaaaattgttaatgaatacctgtcaggtaggaggcctgatatgcctgtcgcttttttaacctctgaccaaaacaagaattcgggttgttatgctgcagaacctaatgacgtgcacctggcgcgctattttcatcttgatgaacgggatctggccttcattaaccaacgacggggcaaacataataggttgggcattgcgcttcagctcaccccagcccgttttctgggaacatttctgacggatttaactcaggttctgcttggtgttcaacattttgtcgcggtacagcttaatatccaccgtccagaagttctctcccgctatgctgaacgggacactacccttagagaacatactgcattaattaaggaatattacggctatcatgaatttggtgattttccatggtctttccgcctgaagcgtctgctatatacccgggcgtggctcagtaatgagcgaccgggtctgatgtttgattttgccactgcatggttgcttcaaaataaggtattactgcccggagcaaccacactagtacgtctcatcagtgaaattcgtgaaagggcaagggtaccgagctcgaattcgcctatatagagcgaaccactnnnncccc

SEQ ID NO: 52953 - DNA, 757 bp, Oryza sativa
ttaatgctattgctgaacatattatcaggaaaagaaaaggagaaatgaaaacaaaattagaaaaatgcagggtagcgcgagtcaacacatggtgggtggacgaagtgccttggggggtagataggtccttttgtgtttttcagtcatatttctttctttttcttacctcacttaatttaggtctatctcacagaattttgaagtaggggtaaatcggagcttcaattttaaaaagaaaggacaaagacacataattagaaaattaggtgtaaaagtataattgcagttgaaaatatattaccccagaggaaaaggagaggaaaaaaagagagggaagcttcgcaggaatgcttctcccgccaccatctttcttccaaggctcccttgcacaaaaccgagaaaatcaaaagaggcttctggtgtggtgactgtgaacaagcggctggtcgctttcaccttcatctagcgaacgctcgtccagttctcttcctgccgaaataagttcactgtgaattatatcgatgtgctaacgtgtgacggtgtgagaacaacgattgggggtcttttgggtttcgatcgattgtgctgcaagccatcaccattattttatttttgacttagccatcgcaatggaacaaacgggggtagtactaattactaatccagattcccgttttgatttggataagttaatggaaactaaatgttggtaatatgaattaatttttcacctatcacgtcagtacctgaacatagg

SEQ ID NO: 52954 - DNA, 856 bp, Oryza sativa
tcaaaaaagaattattccttttcaggttataagttattttgactttggtcaaaataaaactcaagtttgtagaaaaaatagtaacatttttaaaccaagacaaatttattatgaaaatatatttaattattgatttgatgaaactaatttagtattaaaatattattatattttttatagaaacttagttaaacttgatcaaagttaaaacgacttataacctaaaataaatggagtaaactttagaaatgaatctgaatacacgtgttcatgtttaactctagagtttgactttttttttacggggagaattctcctttgcaatagcacaagcacggcaccggccgttcagcagaggagcaggtgcactaccatgcccctttccctgtgtgtacagtacaagtatacaggaagcaacccatcgataaaatggaaagcgaggttcagaaaacccctcgcctccaaaaataaaccaaacgaatcccgaccccttctccgcctcttcttcctcctcccctcccctcccctcccctccttccctttcctttctctcctctccaatcgccatacttcccgcttcccgctttgaccgcctccccttcccccatatcatctccccttcctctcctccacttcccgcccgcgcgattcacccaagagagatgtcaatgtggcgcttctcccgctccctcctccgcgccgccgccaccaccaccaccgccaccgcggcgtgtgcctccgcgtccacggcggggaagcatgccgcgtcgcggagtgggtgacgccgcgtgagctccagaggtgctggtacgcgttgctcccggcggcggcggcggccgggcccgggaaggacggg

SEQ ID NO: 52955 - DNA, 10002 bp, Oryza sativa
  unsure (1)..(10002): unsure at all n locations
nnnnnnnnnnnnnnnnnnnnnnnnnnnnnnnnnnnnnnnnnnnnnnnnnnnnnnnnncggaagaagccaagcagggtattccgcttgccaaccttgaaggccttaaaccgaaacctcgggaacggcaaggtaatcccttccccgaccttctgcgcgcgtgcgaggaggccgaacccgccagaaccgccccaaggccgcggccttcgccggccccctcaacaggccggcgtcgtcctgttcttcccgaacaaggtttacctccaccccaacagggtcagctcacccccctccccaacttacttgtttttttttccaaaattttttctctttctttttttggatttgtggcgtcgcccctcggcgattcgtgggacttggccgattcgaagtttggtgtgttcggccgacagcccatgttagcttcctgatcgattagatttcgtttttgttttttcggtgcaacccagagatttgtttggcgcatccccaattcggccggagaagcatatggtccactaggaacagatcactccgcggttaacggctaaagtacagatccttggccccctggtactgaatttgtgatgttgatatgcaacatttggtagatctcccgcgagcagaagtgcacttaaccatcggtggtccaatgctgcatgcatctcatgcaaactctggcccaagtttgacgccctaattttagtgggttttgcctaatggcatccaaatcgctctaatgagtaattaccccccatatttttaacaatttaatccatccatccatcttcagctttgttgtgtagtaccgtttaactgctgatgggaactgaccaaccatcgtggggactggccgtactgtttggacctcttggcaaatccacctgttgcaggaaaaggaaaggtctcgcttgcttctggacgcggttccaagtggtggcatctggtggctcactgcgtgcgtgcaagatgcaccgcgcaggtgtgcgcacgcggaccgcaccggtgtaaaagccgtcctcgtttcttcgatggagaggaattcttccgattaagtgtgctgataaagaatctattgaatgcttttctcttctacctttctttcctttgccctttcggtgtcatatgggatggtcgatggtgggtcactggctcattgccgtgtagaggctgatgcatattcattacagtgctttctagtcttgggctcttggcctctcgggtccctgttagttaattactgacttgttagtagaagtagatgagtgcctgctgggtctgactaggtttatccaacagttcttttcattatcatgtagtatgagacaaccaatctatcatgcataacacttgtttgatagcaagccccatttcttggtaatgagcaaactgattcactaaaaggtacttcctccgtttcaaaatataagactttctagcattatctacattcatatagatgttaatgaacctaagcgtatatgtgtgtctagattcattaacatttatatgaatgtgggtaatgctagaaaatcttacaatatgaaacggagtgagtaaattgttcgtctgtgcagtattctgtgttgtgtctagttgtgataagtatgaattagtttttacgattttgcatcaaatctatcagtgcaggctttaggtttgcagaagttctctacgcggttttactctaaacagcaagcaactttatctgatatttaactttgcattaacttgctagcaaaataataataataataataataataataataataaagaaacttagcactaactagttccttttgtttgtttcttatagatcgtggatcttgtaagaaaagctatgccactcgcgctgacacctgaggatgatccaagaaaggaagaactcaagaagctgcagacacagttggaagatataaacaagctcgcacacaagcaagttcgtagaatcctctggtctgggctagggttcttgatcacacaggttgggctctttttcaggctcaccttctgggagttctcgtgggatgtcatggaacccatcaccttcttcaccaccacgacaggcctggttgtagggtatgcctacttcctcatcacatcaagggatccaacttaccgagacttcatggagaggctgtttgagtctcggcagaagaagctgattcagaggcagaacttcaacctggataggtacctggagctccagaggcgctgtaaaggtcctttggagaagatgtgtggcacaaaccaaactcccaaccctgacatggctcaccttcacgagttgtccgttaacaaatgacaaccttcgctcaaacactaatctaccattgcttcttttcttgttcaattttcttggagtaatgatcaagaaaatactagcaaagctgatattttgcattgccgaggtggacatatttcttttgcgaccctttttatggtcttccattatgcaaatgtgtaggtttaatagctactataatccttttttgtaacaatgctgaagcacaagcacatgatagttggaaggaaagctttacatgtatgatcatatgaccagaagctttaccgagagctgtgtatctctgcagccactgctaatctactgtgcaatgtggacagattcattagctttatggtctttttggtcgatttcgaatacttgccatatattttctgtattgtgcctgatctgctagtgtgtgatggtgattactgttcaaaacaggacagaacgataccagggcattctgatggtgtgtttgatctcccatgagttgtaaactaccgtgacattaccatacaaatgcaccttttgaaaccaaagcaagagagaactgcgattcatttcaagagaatgcaccggccggtcctgaaggagaactccacaaatgggaaaaagaaaaagaaaagaaaatgagaactccacaaatggtcaaccagtctacatgcataagctgaaaataaaatagtctgatcgcaatcaggctgagattcattttctaatgaagggccttgcagttttgagccgatggttccatgtgatgaaagcaatggtccaaaagcagacagggtcgtcgagcctgaaacccgatgcccgcgcacggcggatgatccgctccgccacccacaattcttgaatataatgccggcgccggcgaggcgtaggccagcatgtcccgcgcctccacggctctagcctctagctctactgaggccgagtttagctccaaactttttcttcaaacttccaattttttttatcgcatcaaaacttttctacacacaaactttcaactttttcatcacatcgttacaatttcaaccaaactttcaattttaacgtgaactaaacacaccctgagactgagttcagaactccacctccccgtactgaaaatggtgttacccattaacacatttaattaagcattaacctaataaacttaaaaatagattaatataatttttttaaagcaactttactataatttttttttaaaaaaaacacaccgtttagcaatttgaaatgtatgtgcggaaaaataagaggtgagttagaaaagaatagggaagaactcagtctgagccgcctggccaggtgacccaagttgacatcagtttttggtttaagtcaagatacttaccctgtttgcgcacgaagatgcctggcatgatacggcggccgctgctgctaagcgggacgtcgctttcttggaatcaagatggcaagattcaggaatcaagaattccagatcgctgtgcctgtttctgcttggatttgtctgatagcgaccttcgtgtaatcgcattggattatgtttggctgtttgagtttgactgagatatgctcgagataatcaattttgcgctttctgcccactgctgtttggaacttcgtggtatgcttagaaaaaacaggggacgacgctcaaatgtgcaacacgtttaaaacatatcggttcctgaagactgcctttgggtgttttgggtggatcagatactcgaagttgactggccgaagttgtgttccaacagttacaaagaaaagagtacaagaacaggtcgtccttaaactgggaggcctgtgtgaaatttaaaccgagccctatttaagtggcaaaaataaatgataataattcatatgaattcatgatatattttatagcaacgtaaaatagaacaatattttacgatgcactgttgcacttatcaatccatactattttaaaagactttaatggtagtgaactgccaccaccatcctatcgtcgacgtgtgggtcctaattatcggtgtgtagcatgtgccctttagattcaaaaactgccttctgtctctcatgggaaccagtttctctgacgttactgcacagcgtgacatgaacactaacatgtgggatccattatctatggatccacatgtcagccaccaaatctctctaacatgtcagaggatctctctcctccctcgcgtaccttgctcacatttgtccgctcacagactgacaatggtaggcttaaggctagcagctagtccccttgctgaatgattttgttataggcactaatgttccaatcactctgtaccaaaatatatcatagccgaataaatattatttataaaatcaatttattttgaaagaccttagtacacattttctccatactcgagacaatcaaagtctacacagacgattgtagcactataatcatcggcaaggcaatcaactttattataatcaggagcctctaaagtgcaatgttcagtgacaaattgtcttcactgcgatatactgacaataatccgtcgcaacttatgtgtattcagctagtatctaataatttagtaacactaaagtattaaacgaaattaaaaacaaaggtggcgcttgccgctggcggccttgcgtgagtcgtattctccgtggtctatgcagtcacacggcactacatgacaacgtcatggagtatatgtagaaacaatcagatatggactggagcaggctgctattgcaaccagtctttaccttcgaatcataggttagtgacttaggccgagtttagttgcaaacttttttttttaactttcaacttttccatcacatcaaaactttcctacacacaaacttccaacttttctatcgcatcgttccaatttcaaccaaactttcaattttgacgtgaactaaacacacccttatcttttttgcaacacttcatctaacccggcgattccggcggcggccggtaggatgacaacaatagcagtggaggggccgagacaaatgtagtggtacacacgaattgtagcgatatttttttcaatttgataaagttttaatgatatgaatctaattaacccttaaatcatatatgtatggagcagaatacatattataaaaaatgtgtaatcttcttgctaagtacattttatttctaagttaacacaaactatgggattgccccacggcaccacgtgagctagataattcgagcccatttgataaggctccaacttctaaatttaacttcaggaatagggtctaaagtaaagttgcgaagaaacctaaattcagctccatctatctagtttattttgttagagcacttcagctagctccacttccttcttcggtgaagctaaacggttgggttccagctctaggagagatggagttgaaactagacccatgccaaacaagccttagatttaatatacaactctgaaattttatttctactagaaaaaatgctcgtgcgttgcaataggtgaagtctattttaatcttattattgttatatggtttagttaagatgaaattcactgtgggagtttgcttggatatatatatttttagaaaatcatgagctacagttaggagtccgatcgtctcaagttagcattcgagttttttttaaacagatttcttatatgattccttctgtattaccaaaagtgaatgatcttaaaaaccgacttaaatacggatatgtatttccaaaagcaaacgaacttaaaaacctaaacgaattaaaaaaccgactcatacacggatgatgtaccaaaataccggcaaaaacatcttcaatttttataatagtaaagatatagaaatcattatatgtagaaatatatttggatttcatatacaactattagcttctatttctatagacatagatttcatattaaacttttaacttctatttctgtagatataattgtattttatatacaattatattgtattttatatacaattatatcaagcaatccataccgttacaatccggacccaccatgatttaacgattaagatctttttttcttcgattaatgtggaaatatgtagtaaccacaatgaatatgatgcgctctttcaaagctgttttaataattcaacaaggaacttgagcaagagaacatctcaatattagctagcttgccagcacaaagaaaaaaaaaagaagatttagccaatcccagttctctgatctctcaaagcagtgagatcaccattttcatcttatcagtcatcaggtctatcatctcgacctcctcagcgcgataaagaacttttcagtgcaccaaattaaaaatgatttgtaaaggtaatattggtgggaaataaaccaatttcgatctaaatatcatgttgtttcttgtggtccaaagcaccgagcaaatatcagctaacaaagcggtaaaaaaaactctgatttttgaatggttagtgtttttggttggcataaaaaactcacggaaatccctgggattgatgcccattagctgggtggcccgcccaattgcgcggctaacacccaaacaaaatcatatatttttttaagtatgattttacttaaaatttattaaatagctatctcattgtcttaagactttgagagaccaaaccttatcatcctcgtgtttctaattatatagttcttaaaagtcacaccagttgctaccccttatgtcatctcctttatttgcttgctcgatctaccactatttttattcattctttttggaacctttaaaaattggattttatagtttttagagtttattgtcacgttgtgtttcatttttataatttctagatgtcccgtcaaacgttgccattatactcctctacgggctgtccactgtctcttctctttattgttattgagattttaaaaatcgaacataattatcgtttgggttcatttttactttctagaagtcctgccaaaccgtcagtagctttgccattgtactcctctacggctcgcccgctgtctaccttctttattgtcattgagattttaaaatcgaatatgattatcattgttttttttactttttagaagttctgaacctttaaaagttggacttgtagtttcattttttataatttttagaagtcctatcaaatgatgccactatgcccctctacagcatgttcgccgcctacttctttattgttattgtgattctaaaaatggaatataactatcgttgaaatttattttttattttctagaagtcccgtcaaccgtcggtggctctgcaactatactcttatacaccccgctcgctgcttctcctttttattgtcattgagattttaaaaatcgaatacgattatcaatgcggtttgtttttttactgtctaagaagtctcggcaaccgccttactcatttgcttcacggcctgcctgacgtctcttctttttaatcgtcattaggattctatttgatgttttattaacaatttttatatgtcgtatcaaccgccaccactccactcctttataggcctgttacttaatttatctcgtcatatgttttagatggtcttttctttcaataatctttatttttatcaaaaatttttagttatttataaattgtattcctaattgaaatcttatttttctttttctaatttcagtatttttttaaaaaaattagttaataccaatatgttcttttaatgtttttattttttattttcaatttcagttgtttcaaaattatattcctaattgaactctcttttaatttttccaattttagatattatttttatttttattctaaattttaattaatctcgtattgggttgttacgtagatttttcgttcaatattgcttatttttaattccgaatttaaactaattttaaattgtattcctacttgaactcttattttattttcttttgctaattttggatttatttatttttattccaaattttaattaatctcgtattgggttcttatatgaaactcttcttttaatatttcttatttttaatacctaatttcatctatttttaaattgtattcctacttggactctcatttccttttctaattttggattttattttatttttatttcgaattttgattaatttcgtattgggttcttatatggaaacttctttcaatattacttatttttaattccgaatttcagctatttttaaattgtattcctacttggactcccctttccttttctaattttggattttattttatttttatttcgaattttgattaatctcgtattgggttcttacatggaaacttctttcaacattgcttatttttaattccgaattttacctatttttaaattgtatttctacttggactctcttttttttttcctaattttggattttattttatttttatttcgaattttgattaatctcgtattgggttcttatatggaaacttctttcaatattgcttatttttaattttgaatttcagctatttttagattgtatttctacttggactctccttttctttttttttctttttctctgattaatgtgggaatttctagccccaacagcgaacgtggtgcctccttttctaaattttaattaatctcgtattgggttcttacgtggattcttcgttcaatattgcttatttttaattccgaatttcaactaattttaaattgtattcctacttgaactcttattttattttcttttgctaacttcggatttatttatttttattccaaattttaattaatctcgtattgggttcttatatgaactcttcttttaatattccttatttttaataccgaatttcagctatttttaaattgtattcctacttgtactctcatttccttttctaattttggattttattttatttttattttgaattttgattaatctcgtattgggttattatatggaaacttctttcaatattgcttatttttaattccgaatttcagctattttaaattgtattcctacttggactctcctttccttttataattttggattttattttatttttatttcgaattttgattaatctcgtattaggttcttatatggaaacttatttcaatattgcttatttttaattccgaatttcagctatttttagattgtatttctacttggactctccttttcttttttttttgtctgattaatgtggaaattttttgctcccacagcgaacgtggtgcctcctttcaaagctgttttaataactatttttagattgtatttctacttggactctcattttcttttttttttctttttctccgattaatgtgggaattattagcccccacagcgaacgtggtgcctcctttcaaagctgttttaataatataatagatagatagattaatacctgaagatgttgtccctaaaattcaaaaagcaaaaagatagagaagaagatatggtacatttatggattcctaagtaaccctgcagatgaggtacctctaccttttcgatcaaaggcttcgttcgagaagacagattggctaatctttttcgccgcatgcaaaacgagaataatcattagcatgactaattaagtgttaactattataaacttaaaaatatttttttcaaaaagagaacttttaaaatatacaattttgcacagaatatattgtttggcaatttgggaagcatatgctaatga

SEQ ID NO: 52956 - DNA, 1214 bp, Oryza sativa
  unsure (1)..(1214): unsure at all n locations
nnnnnnnnnnnnnnnnnnnnnnnnnnnnnnnnnnnnnnnnnnnnnnnnnnnnnnnnnnnttgtatttctacttggactctcattttcttttttttttctttttctccgattaatgtgggaattattagcccccacagcgaacgtggtgcctcctttcaaagctgttttaataatataatagatagatagattaatacctgaagatgttgtccctaaaattcaaaaagcaaaaagatagagaagaagatatggtacatttatggattcctaagtaaccctgcagatgaggtacctctaccttttcgatcaaaggcttcgttcgagaagacagattggctaatctttttcgccgcatgcaaaacgagaataatcattagcatgactaattaagtgttaactattataaacttaaaaatatttttttcaaaaagagaacttctatatatacaattttgcacagaatatattgtttggcaatttgggaagcatatgctaatgaaatacaagaaagatgtcgtttgtcgttttgatttgctgaaaagaactcatcctaagaaggtgcacaatatactttaaaattaacattcgaggcccaaccccaaaagggcaaaacctgcacctgaatacaacaaggttggaagtacaccctccgtagagagagagatatagctccaaacatttggatgtacaccctccgtaaaaaaaagagatttagagggagagatatccctccaaatattttttaaaaagaaaatgtgtgttttggggggagagatatccctccaaatattttttaaaaagaaaatgtgtgttttggagattgaacacatgattatagagttgaaaccacacatcttttaccatttcactatcaattgtatctcatcattgtttggatacacaggaagagggataaaagcagcatttgctagcataacaactttgagaatgttccctcgcgagtaacggtgaaatcacgttctacactatgggttgttttgtttttaagtcctatcaaatttttggttggattgtattgtttcaactctattgaattggcataatttggcctcaatccaaatagttagtaaatactattcaaaactatcaaataactggtagggcaagaattgaccacaatccaaacgacgtactnnnnnnnnnnnnnnnnnnnnnnnnnnnnnnnnnnnnnnnnnnnnnnnnnnnnnnnnnta

SEQ ID NO: 52957 - DNA, 1923 bp, Oryza sativa
tggcgcgtcgccggctatcacccacgatccagcctcactgctcgacttgagtttttcgtttcaatttgttatcaataatcaatatatattagattgatttctaatctcagattaatttcttgctattttttgttgttgttcgcatataattacgcggcactactgaggcgaacgatgttggtcatggactcaaggcatctcagctttccggtcaatcggccgcgagtccactccgccggcttgtcctcgccaccgccattgctgatatcaacaacgacttcaccgccggcttgcctccatcgccgccgactggtgtctccgcctacacggctggcctattatgccgccgttgttgggcgtctacgacttcaccaccggcttgccaccgtcacggccgactggtgtctccgcctacacggctggcctattatgccgccgttgttgggcgtctacgacttcacagtcggcttgcctccgtagccgccgactggtgatctcgcctatacggttggttggtcacaccgctgttcatgggcgtccacgtcttcaccgaccgaccgccacgtctgccgccgactggtgctttcgccttcacagctggcctattatgccgctgttgatgggcgtctacgtcatcaccaccggcctacctccgtcgccgccgactggtgtccccgcctatacggtcggttggtcacaccaccgctgttaatgggcttcatcatctacaccactggcttggttccactggcgccgactggtgtttttgtcaccattgatggactgctttattcccacatcggctacttctgctgtcatcgagggaatacgacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaacaattgcaaaagtacccgagtagtaaactctgatccgtgaaactttgttccattaatgacgaactcatgtcactcatatgcatgtttgggaagtgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtctttaccgaccggcttgccttcgccgccgccgactggtgtttccgctaggggtggatatcgagccagctcggctcggctcggctcggctcggtaaagctcgttaggataacgagctggctcggctcggctcgttatcctaacgagctaaaaacccagctcggctcggctcgtttaaaagctcgagctagctcgttaagctcgcgagccaaaccatccaaaaactgcccctagccctcagcaacagccaacaccgcaagcagccaagc

SEQ ID NO: 52958 - DNA, 2129 bp, Oryza sativa
ccctcagcaacagccaacacagcaagcagccaagcatgcaatgatagtatgataaatggttacatgaaaatatcaaagcaacaaatcacattcacatataagtaatctactcaaagtcttggattaaacacatttcacaagtacataaacgtccacactccagtactccacagtcacaatgacacattctgagttactgacatagtgacatacatcatcagttcatcacatattgcaattaacttcaaaatagttcaacaaaagactgtaattaaacataggttcagtccagtacaataatccatgcttcaagttcaatagttcaatacttcaatacaccaatatttagcataagtgcataactagtaaagctgcagcctgcaaggttcatcattttcatgatttcatccaacacagttgcacataaacacaaaacacaaatagcatggcaattggcagctccctttctcccatagtcccacactccctttctcccatagggtgtaggcttgtagcctgcaggtaaacaaattatagagtatgatataaatgggtgaaagtcataaacttattaaataaatataaattgtccctactagttgcttgccaccacacaattggggaagtccactatttcgatgtcatcatctccattttctccctatgaaaacagtccaaagtgaacattttatacaaaagacttgacaaaaataaagaataaaaaataatcattgcattccataccacagggataggtgcactattgtcattttgagaggctcttatccagcttgaagcacaaaccaaagcctgaactgtttctggcttcaaagaactccggtagtcatcaagaattcttcccccggtactaaaagtggactctgatgacacactgctagctggaacagccaagaacctctttgccatgttggacacaacaggaaacctatgggcatttaccttccaataattgagtaagttgaaagtgctatcttcgagggacacatttggttcatctagatagatgagtaactcagactttgaggattctttagcatttgactgcaaaaaggattgaaatccacttggaataattgaagccaatgaggtggtagtagagattgaggatgaggccgagtgaccattgtgtggactgttcccaccttggttgtggcgacatatccgctcatactttctgtagagtttttccatctcatcagttatggcagcaacctctgttacacaccttgtctcaccaaaaaattcactgaagcaccatctaatgtacctcattttgaacctagggtcaaggattgtagcaatgatcatgatattgtttgtgttctcccaatatttattgaatttttccaacattgcatcagccatagtcaccagcaatacatcattagggtcaggttcataaagtccagactgctgccctaaccttgcagcttctaacagtgcagtttgtgcttgtgctctagaagctaatattgcaatcttaactttagctatgtatggatagaaaacattggcagtggggtaggttgaccctgaaaatgcagtggttgcaccagacattgttcccaagattggctgaattttctcaaacaaatcccattcagattgtaaaggtagccattcatatttggtgtctgattcagcataataatcaaaaccatttctatactcaatgcatgtctctagcatccgataggtcgaactccaccttgttttaacatcaatagacaaccctctaccaactttaattgaataagtgttgcacacacccacaaacttatacatacgggctggagacttcttaaagtacttcacagtgttcctaacattggttatcaaagattgaatttgttgcaggccatcattaacaaccaaattaactatgtgggcagcacaacgaacatggaaataatctggatcaaactgagcattctttctagcagcaagcttagacttcaaatttgaaacagcggtgtcattgtttgaagcattatcaagggttattgtcatgacctgtcctctattttccaatcaaccaagcaatcaaaaatagcttgagctatgacaataccggtgtgaggaggcctccacctaaacaaatttaagac

SEQ ID NO: 52959 - DNA, 6605 bp, Oryza sativa
  unsure (1)..(6605): unsure at all n locations
annnnnnnnnnnnnnnnnnnnnnnnnnnnnnnnnnnnnnnnnnnnnnnnnnnnnnnnnaaagtcaaaataacttagaacctgaaaaggaataatcttttttgacaaaagagtactattatttactccgtgttaatactaaaacaatgattctaaatattttaaaacatctatattctaatgttttggacctacaataaatttagtcgcatgtaggttataatatcttagaacaggttataatatcttagaacaaaagtactctatccatttcatttcatattataagatattttgactaaagtcaaactgctttaagtttgactaaatttgtagataaatatagttatatttatattatcaaattagttttattaaattaataattaaatctatttttaaaaaaattattttgggtcaaaaatattattattatttttttataaacttggtcaaacttgaagcagtttgactttgaccagacttaaaacatcttataacctgaaacggagggagtagtaataaatttcttccatatgccattatgcaaatagtggtaacaatatgctaaatagtcaaaacggtgacagagtatgacgatattgtttatgctcatggcaaaattcaactctaaaaacgtggcatccaccaaagggggaaaggaacaaaggcagacgatgtagtggtggaggttagttcttgtctttatttcagaaattttccgtttaatcccatatttgttttcttaatttttgtgggggagcccgtctttgtatctttattctgttttcaaaagtttagtattctgttttctttgtatggctctatctgttgatgtaatcgtctgaaattaataaaagcttcctttataaaaaagaatcgtattcgtccatatatgcaaatatacttgctgttgagtactcaacgccatcacaaattatataagagcatgtacaacggtttttattagtggtctctctctattaccatgcaagtaagtttggtaacatggaagaaagagaaaagaggaaagagaaatatagttgttatgcatgataataactgttcagcaaattttgttgcatggtggtgaaaaaaagaaaagaagagtaagaaaaagtattttgatacattaatagtagagaccatattatcttcaactgttgtaggacgttagtctctagatagtatagagcttatacctgtctatacctttgtacatgcttatgttcatatgcaaatagtgataacatagaataagcaataatgcaaatagtcaaaataattgcaggacactgttcatactcagaccaaaattcaacttaacgtgactcctactcagggaaggaaagaaagacaaacgtcatgatggcaggcgttaacactttgtcttcccttttatttcaaaattgtccttcgcccgtattcgtttctaaattttgtttcaaaacgctcaagactagagtttaaatcttatcataccagattttagaaaacataggtcacgtatggagagctagaaattggggttttagcacctacattctcctaaaatttacagctttctaaaccatttggattctcatcgaccatacaaaatatgtagtgtaaataacatataaggtgtatggcaaaatctattgaagagaaagtatctctacaatcagattctcattttttgtcaggtctcataaaggtcaaagataccttcttagatatgagttcttatattgtaaataataggaaacaaataaggttttgggaagataaatggctaggaaatctggcttttaaagacaaatatccatctttatactctattgtccgaaggaaaagttctactattgctaattttatgagatatgttccactcaatgtttcctttaggagatcattagttggttagaatcttgcatattggcatgaattgtgtgcttctattgtacatattcaattgaatcaatcctctgatagctttagatggaattatcatcagaatagaatattttctgttaggtcgatgtatctagctttaattaataatggttatattaagagaaacaagattatttggaagcttaagatgccacttaagattaagatttttatgtggtacttgcttaaaggggttgtgctaaccaaggataatttggcaagacgaaattggaatggcagtttaagatgttgtttttgtatgaaaaatgagactattcaacatctttttatagagtgtcattatgcaaaatttgtttggagagcagtacagttctctattggtttatagcttcctactaccatatctaatatgtttgatggttggctcttgggggtagacaagaagaagagtaaactcatacttgtaagagcttctgccatatgttgggctctgtggttgactaggaatgatatggtttttgacaaatcatcatctatctcatatatgcaggtaattttcagggcaacatattggctccgattttgggcacagctgcaaatgtgtgaagatgatcgagagcttatgaaggttgcatgtcgtaggcttgagacaatggtcatgcaactccttgcaaactatggatggagattcacaaatagacttgaataaatgtgctctccttatcttagtttgatcttttattttgtgggttgtgtttaattcatttgaactacactcagtgtttgggtgttacttttgtaataattgactgtaactctgatgagcaaaggccgggatgttttattccattatctaaaaacaataacttatatattgtggaaatttaaaaactatcgtagataggatgtgaaaattaaaacgtatgatatttttttacacgtcaccatgagtgaaaattaaaactgactcttgaatttacatcatactaagagttaatttcacttgtaatgatgtagacgaaatctcaatcattcaattttgcatcgtacagtagttttttaagtttctactacatataattttgatcacatattttgccctgccaaactttttccaggattgatttctatagctatctacgcgctttacctgaccatccggacgatgtttccacaaagaaagagaggggaaagcgagattcggaggccaaagaggaactaccattaacagcaggaggaaaaaaacttggaaagcgaaacgctcccggacggagtccactactggtcgacacgtctttgacgctgcgctcgcatgttccgcggctaaggcaaagctcacgcccaaacgcttggccattttttttctaccaccacacactgccactgccattgtcacccctaattgtcgaggaggtttcatcagatccactaccaaccccacaaaggcccgaagcaccaaactaccaatccacaggttttataacaagagcaaatgatttgattcgttcaaaaaaataacaaatgatttgcttatcgatccacgaaatgcacgtggaagtccacgaaaattgctgcaagttgccgacagttcgatagtacaatattactgtgtgtctgtaggtaagcagctccaagcgaggagtgacaatgctgttataagatagtgtacagttgcctggatggacgattaaaaagaggagaggttagaattattgtagtgactgcagtatgcaggctactctacaataaagttctcacactcgcaggcaattagaattgaaaagatatactactaatgaatagaaaacgcccaaatgtaatgtaagtacaaaggatgtttaactttgatttgtcgaaagttagacgcactaacaataaaagtgaacaaaacctccttccaccttccttgtaagttctactctgcctttccgttttcactttgctgtctccttttagacagggtcttcaacattcccttgaatatcttccagaaccaaaataggttcatcactgccagcgccggtggcaccgtcagtatactgtagaagcccagggggaagatggacttcacctgaaagtatggcatatgcgtacagagagcattagaacagaaatgtaacaagaaaaatattgccggtaaaatgtaaaggtagatgaatttaatagctatatttgatttgattatctgggaaacctggtaaagtcatgcatacctgatcaaaatggaagtacatgtgagtgaagaaatatatgaacaagattacccgagcaacctgcaaaccaaccaaaggtttgtaaatcacgtgtttcaaaagagcaataggagagctgaaaatttgattaattatttaaatcaagtcatcatgggttataccagccatccgacaaacagagccaatccattgtataagtaaaggttatgcgtcttcttaccagcaacctccaaatacctgcagcagaccatcatgaattcagaatgagcaaaagcttcatcaggataaacagatttaatagaactggacattaccatctaaggttcacaaagggagtggtggcttcagtaaagagaaccatgagtatgtacatgtgtgctttgccactcaacagagcaagacagattgcatacatcgaaagtccatgatgcaggagctgagataaaataaatcctggtcagggagaaactgagacaacaagttttacagatagccagtatattcacgtgcactcactctaacagtgtaatacttacatattcctttccacctaaagaggggaaataccacagaatcatcaccaaatctgtcaaaaagtaaccaatcgagacctgcacaatacatgaatttaaaatgatacattatacggttatcatttgcatgttgtgccacttgatgcaaagaacaatatgaagaacattttttagattttctttttattttgttctgaaaggtgtgcataattaaattatatgagaaaatttaactttctcagaacagagcaggaaatgaacagcttaccccaaacatggcatcagatagccatgagtttctatcaattattatgttgctatggaagaggtcagatatcacaaccaggtaaaaagaaacaacagctgcaaccaatgcatggaatgtagagaaacccctatcaacaagtggcatcatgtagttagactcaaaatggaaaacaagcaacaataatgacagcagataaataacaaaaattgtgttggagaatatcttacctattattccattcaacctttttcattgggcttatattgtcataacccttgaagcaatgagagctaaccttttgagttatgtcatatacctggaagggcaaaatgatgagtgttggtagcaagatacaatgaattctaaaagagataaaactatctgcttcaacattggtagcaagatatagaatatcattttcagtttaggagacagtagttaacgaaaataagaggcagctattgccaccattgactattgaatatatgatatgtaacctaagtaccactcttattcacataagacataacccataacagagcatatttttcacacacctttgatgtgaaggaggatggcgtatactatgaagaggatatcacgtctaatttcagcaatctgtacttttaaaaataaattagcactaccatgtgatctagggaacaaactccgcaacttctgcatacggataaatattcccctttgcagatggcatgtactcgtttatatgcttcatagaacttacattgagatctgtaaatctcaacaacacaaaggacaatgctcaacttggttaaataaatcgatacatgcatatatcttgagcagatttcttttgttaatgcgtgaatgtatctccaactaacctcacattggaggatgcatgtctaattgagggaaacatactaccttgcataaataaattgcagcataagttttcatgatattggtattaggcacattgagaaaaacaaatacttattccttttcgtgcaaaaaaaaatccttattcctaacagaactgaatgtgcccggccaatgtttccttcttttccttctatgaagtacagtgcagagaaacagaacagaacacgacaaatgacgagaaacagtgcagactactccaaaataactagagaacctttgccagagcacacgagttatactgactgcactaactagagaaattccaacaggagagcagtaattacacgaaaatgagatatttcgcttaagcgaaaactattcaacaatcaacactgtcttgctcagctcagcacggttgaatgtcacattcttgcattgaacctacggcctatcaataccaggcagccacacatcatgaatcagttatcaccaattgacaagtataagcaccatcatccagacttccagagctgtggccacccgcattaatttcaccagctactaacctcttatcttcctaacgatattgacactttaacagtagtatttggacaacctccatgcaacacagaaagcaacatgcacaactaatttcatagagaaaaaaaacaaagagtaaatttcacaaaactacatattttttttatggttcaagttgcagaaaaccacacatattttgacacttggcacttaagtacatatattttggtagtttatttcacaaaaccacactatcgataaatggattcacttgtgatatgacgacgtgg

SEQ ID NO: 52960 - DNA, 2361 bp, Oryza sativa
  unsure (1)..(2361): unsure at all n locations
gggtgaatctatacatcgatagtgtagttttgtgaaactacacgaccaaaatatatgtactcaagtgccaagtgtcaaagtgcgtgtggttttctgtaacttggaccacaaaatatgtagttttgtgaaatttactcaaaaacaaaaaaccgagaaaagcatgaacatggcatcaaactagcagatagggatgaaaacggtcggaaacgatcggaaaacagcctcaaccatttccgtaaccatatttttctcggaaacgaaatcggaaacggtaaagtcggaaatgaaaacgatatcggaaatatcggaaaaccggaaacggaacaatacggacggaaacatgtcggtacagatcggaaaccggtaacaaatacggaaacattaaactataaaaacatatatttaactttacataagtatgttatatatatacataaattcaagcttatactatataaattataaattaacttcattttagccatgtacaaaagttagagattttattgaagagtcattcaatctataagctgtgggtcaagtataaacatgtcctataatattgacatatttagaatacggtaattaccatattataagaaacggtaatttccgcaagaatacggtaaatacggaaacgatcggtataacagcaaaaccatttccgttttcatttccatattttttaccatttctatttttgtttcggtcgattaccatttccatatggctcggccggtagaaagtcgaaaatgaactccggtcggccggtaattaccgttaccgttttcacccctactagcagactaaaactgagcgattgaagtgctgaaaactaagccagaaaaagaaagagggttaacgggttaagtggacatcttaccgcggcgcacatggcgatgccggcaagaaccgacgccggccacagaatccgctcctcgctcccgaaattcccatccatccctcctctatccgctcaaatccaatctaacagagttaataaagagaagcgaaatttcaaaagagactcctccaagaaaacaacctgcactcccgaataatccggaaacacaccgctcgttctttagttctcttgcaaaagatagattcgccatgggcatcaagaatttggtgcgtacttacctggatgagattgggatggggagtgacccgcggcggtggtcgcgtctctcctcgtcgttcgcttttgcttctgtgcttgtgcttcgcgcgggttgggttttcttcctcgtcctgctcggctgctcctgcctcttcgttggggggttttaaaaggggaggagacacacacctcgaggcgagtggcacactagtacacgaccatctggtccatctcctaggcgctacgggggattgatttgtcctccttgactccttgtgcgtgcactcgtgctggacctggaccatgggagtcgtcattagaaatttaaacggaaataggatgtgacgtacggcagttttttttttttctctttcgacagagagtgatggtgcttttttttttccaatcttctttcacgtattttggtcgagctaagctagagcaattaagaggtgctttctaggttcatgtgcgatctcacctcctccatgtctgtcctaagtaaataaaagcacgtaatggtgaggtaccatatttagaattgaacataagagtgttgtgctagctagtgtcaccaactaaagcgcaatgcatcatagtatcataccatatgcagatatgctcttcgaagtcattaagggcctattcactttaatgccatttcaaatcatatccttttttttttttgctaaagttaacgaaaatgtgcatctgtttagtttcttatcaaactttggtaaatatactaaaaatttggcaactgcacagtaatgatcaaaatttagtagcatgtacgttggtaacaaagtgaacatattcaaaatagttatcttgccaaaatttgacaatattactaaccttactaaaattttattattgctttggtaaggtttgaaatggcatcaaagttaatacgccctaagccaaactaattgtcaaatggacctcttggcctcattcctcattttagcaatatacctggagagacgtgttagaggcatcagcatataaaaaataataataatgtatgacatgatgtgaaaaaaaatcattagtcaactatttcaccgaactctagaaagaacctttgcataattcaacatattataattattggcgtggtacagccgtacagactacaagattcacagaaaaaaaagggccattccaatgagtannnnnnnnnnnnnnnnnnnnnnnnnnnnnnnnnnnnnnnnnnnnnnnnnnnnnnnnnnnnn

SEQ ID NO: 52961 - DNA, 3119 bp, Oryza sativa
aaatagttattcttgccaaaatttgacaatattactaaccttactaaaattttattattgctttggtaaggtttgaaatggcatcaaagttaatacgccctaagccaaactaattgtcaaatggacctcttggcctcattcctcattttagcaatatacctggagagacgtgttagaggcatcagcatataaaaaataataataatgtatgacatgatgtgaaaaaaaatcattagtcaactatttcaccgaactctagaaagaacctttgcataattcaacatattataattattggcgtggtacagccgtacagactacaagattcacagaaaaaaaagggccattccaatgagtaactgaaaaaaaacgtgtctaactccgtgaagaaaagctgttccaatggattttttttctctagaacatatagtagtataatccaaccaatctactcgaaaaaaaggctacatttgtagcacaattatgtttctgcacaacttattagtttgctatgtcaatagaaaaatagtagaagccaagaacacagatctttccaggggaaaaaacaaatgaacataagcaagctgagaacgatgttaataacaacgtagggtggttttttacaactcgtgtatctctacaacagttatttttttctttaactaacatactgcgatatccaagtgcatatataatttatatatgacaaggacaataatatatttagtcgattatgtcatgtaaaatagcaagcctaatcaacccgtttttaaagttgtttataatgtggttggagacaacgtacaaccgatacatatacttcattttctcgaaaaccagccaactaactgaataatcatccctacatctgccatctactacattgtatcataagggcacccacaatggttatctataagctctctacaagagatccatgtcagcatattttcctacttggaagagattaaatgaagagagagagcaaagctatctactaacatggagatagtctatagagaaaaacgaggcaatggattagagagctatagatacccatgtagacataccattgaagtggtttactattaatctagtctattgttgaggtgtacatgttttatagatagcatcttactttaccattgcgggtgctctaggagcaaggtcaatagtagtgctcgctaccggcggcaaaaataccatgtcagcatgttgcagttaatattcaaaactagctcgtacagtagtgagctgcactccatctctacacagcttccaatgacagttttcctatttttttaatcacagtttccctgctcagtcgattttggccccacgtaaaacattattttattgtcacctgtgctactcgcgcataaaaacttgtgctggcgccaggccgtagattagtcgccggctttattctctttgcttgtttctcttcctttcacctagagattaaatgacgtggcatattttagagtctgctgagtcatcctattgtacttgctctaaccagtccctttccacataatgtcaagctacttgcattgacattgaaatttcctaatcaatcgtgaacacgcataaggatatatgacgtcccaacggagctaagagatcccactcagcccgagttttattcgtagtactccctccaggggcgtgcctaggttatactacccggtgtcacagtacaccggatagattattcaaatcctatataaattacactatattaattaatatgttagtcaataattagataattagtatgtattggacccctggtaacttttcttctgggttcgccactgagtctccctccatttaattttgatagttatattttatcttggcacacacaccaatgataagtaattctacttatcatccatttaaacatattactccctccatatacttttgatagtcatatttcatcttgacacacagaccaaggataagtgattctacttatcatccatttaaatatgctactagtcattcctcgtaaacaagcgattcattaatatttacatttctcgatgctcatgcaaccaatcttgtgtggaagaatgaagagccatgcattaaatccaagaaagtcattaagataataagttgttggattgaaatatgcctatcaaaaataaaattttcagatttggaagtatgactatcaaaagtagatggagggagtattagtcattcctcgtaaacaagcgattcataaatatttacatttctcgatgcccaggtagccaatcttgtgtagagaaatggagagtcacgtattaaatccgagaaagtcattaagaggataggttgttggattgaaatatgcctatcaaaaataaattttttaaatttgaaaatataactgtcaaaagtagatagagagagtaactcatatacggtcggtgcatttatctccggcttaattagtagatcaaagtatacgggactttgtcattgtcattcaaagagaaaattaagcaaggcacagacgcgacatcgtgcgtcataatcttggttagtcacacgctaggacgactgcgcagcaacacatcataacgctaaacgctccccggaattacgcaagtacgcattgattagtcaggcacgccgggagcccgggacagagttggggcaacacacgaaccgacgcacccaaccaacccgccctccgttccacgcacgcgcgcgccacacgccacacgccacgggagaaacgaacggccggtgcgatgcgacgcacggtcgcaccacacgcgcttcccttccactgctcgctccgatggcgtgtggctgcgcgcctgcgcccccggggccactccggcgtttcgcgtgggcaactgggcaaccgcaccgttcgacgggccgaggggcgacgaggactcggaggcgggagcgctggtgcgctgcgcgcctgcgcgtgcggaggcgggagcgctgccgaggcgacggaccggcgttgggtgagagatcgcaggcacctgtcccacgggccaggggtgcatgtgtagcggaggtgtgtcatgtgtgtggtttggctggttgcttcgcgcgagctttttatttatttatttatttatttattgtatatttttggg

SEQ ID NO: 52962 - DNA, 1750 bp, Oryza sativa
ccggtcgtcgttggattctgagctgcaagtctgcaacgtgggtggatcccagcgtgcgcgtgccgcagcgcatcctcaccgactacggtggaaaggtggtctagaaccctcaccaccggtggcactaggacgcccaggcgagctcggctccatgactccggcaacctcgtgctcgagaactacagcggcaacgcggtgtgtcggtgtagtagagctttgatttttccaccgttgccttggtactcaatatgtactagcttgcattcagattgcaatatgtaccactccaaataaatagatgcaagaaaaggcaacagcagcaagtggtcgtgctctagctgctccgggtggtggttaatgaacccatccataccggacctaaccctcttgtggccgggcatgacggatggtgccgagtgccgatgaagccaccatcggaggcactgggccgttgtcgttggagccggcgaagagcgaggagagatcgccatggccattggagctgttgcagcgctcacacgtcatatcgcggagggcggcgatgccggagatggtggtgcgtgccaactggagcgctcgctcgccatggggtagcgtccgtcgattaattgagataggggcaaaatagtacttttcttgttgtttctcactcaatccacactggatataataaaataaggtgtttggtgtccagtagctaattaacaggtttttgcagtgtcctatagctaattcacttatttgcagtgtctcacggccaattacacatcttttaagtgtcctatagcaaattttgcctttggaataacttcaccttaagtgtctatcatattttgatgtcggatttaaattacatcattaacccaatgtatttgagatcctagttgatttaaaacttttaattggcatggtgagttgacaacaaccaacacagctgagtcagcatgggctccatatgtcagtggccaactcttcttccccctatcccctctctaccccatttctcattcgaccatctctcacccaacctattgcttcttcttcgggtcccatctccagcttcgtcatcatcccatctggtgttgccgcctcctcggcttgctggtcaacacgaagaggaggtcaataaggagacggatgagctctgtaggccatggagcgcgagacgtgagagtagaggaagtgaatagctttttgttcccctcgtggatgtaatcagatggcagtgaatggaagcaatcagcacagcaaggagaaggggaaggggaagggccagctgccaccctccaacggaaccatcgctctagctcaagctcctcacttgttgctgccgcccttcaccggaaccactactccaactctagctcgagcttcccactcactgccatcgccgcccctttcctcttcggccatcgtctctatccacgcctctcatcctggatttatggatagagttgggaaaagaggggaaggagggaagaggaggaagaagaggctgctgacatgtggggcgcacgtggtcccacgctgactcaactgggttggctgcaaaatcaaaaactacactatcctgggacctcatgtataccgattttgtaagttgagagacacattttatctagtatcgcggtcaaaggacacaatttaaactggatttttcacatttttgtccttttgaaaaacttatttcgcaaatagacccctgaaaaaacttatcctagaaatggtcctttttggggcgccagagtgg

SEQ ID NO: 52963 - DNA, 746 bp, Oryza sativa
tagaccataactcctttagtaaaaccctttgatcagcatgttaaacataatgcactctaccactatatgaaattacttaatctaattcaaaatataaccacatgaaatgacatatataagtaaacaatacatagagatgcaatttttttatttttatttcatttttttgatatttttttcacacttaggagaacataggaaccaaccgtataaaaaataaactcaaacggacaaaatatgtgacatgcagaattttccaaaactctaccgaaacggacaaaatatgtcatctattaaaataggcgtaactttctcatacggactcggaatcaggcaaataatatatgcacggacatctacagaaaaagttacatccgattctcccccgctttgccgggttcggcgatattaaaaccgacaaattccgcttgcaagattgtgttttcgaggagagaagtttttcggtggagctttggaaaattccacgtgccacatatttcgttcatttgagtttattttttacatagttggttcctgtgagttcctaagtgtgaagaaaatatcaaaaaaataaaataaaaataaaaaagttgcacatctctctcctctgcactagttcggagagaggagaggagaggaaaaattctacatgtcacatattacgtccatttgagttcaatttttctatggttcttgtgtgtccctaagcgtgaaaaaaatatcaaacaaataaaacaaaaataaaa

SEQ ID NO: 52964 - DNA, 1446 bp, Oryza sativa
attcacggcgtgcatgcgatggcgatgaattcaccggcgttgtcagcgtaggccggggtggtgctcgggccgtcggtgatgggcaggtggaagtctgggcgaccatggtgttcccgcagcgcagcctgctgacgctggagacggtggcgcacctcggctgctctacttcctgttcctggtcgggctggagatggacctggacgtgatccggcggtcggggaagaaggcgctgttcgtcgccgtggccggcatggcgctgcccttctgcatcggcatcgccacgtccttcatcttccggcaccaggtgtcccggaacgtgcaccagacctccttcctgctcttcctcggcgtcgcgctctccgtcacggcgttcccggtgctcgcccgcatcctcgccgagatcaagctgctcaacacggagctcgggcggatcgccatgtcggccgccatcgtcaacgacatgtgcgcgtggatcctgctcgcgctcgccatcgccatctcggaggtgaacagcaccgcgctgtcgtcgctgtgggtgctcctcgccggcgtgctcttcgtgctcttctgcttctacgtcgtgcgccccgggatgtggtggctcatccgccgcatccccgagggcgaggtcgtcagcgacatgcaggtctccctcatcctcaccggcgtcatgctcgccggcgtgtgcaccgacgccattggcatccactcggtcttcggcgccttcgtctacgggcttgtcatcccgggcgggcagctcggcgtggcgctcatcgagaagctcgaggacttcgtcacgggtctcctcctcccgctcttcttcgccatcagtggcctccgcaccaacatctccaagatacgcgaccccatcaccgtcggcctgctcgtcctcgtgttcaccatggccagctttgccaagatcatgggcaccatcatcatcgccgcgctctacaccatgccgttccgcgagggcatcgcgctcggcttcctcatgaacaccaggggtctcgtcgagatgatcgtgctcaacatcggacgtgacaaggaggtacaaaacacatactagtatttgacacacgttgatctcctcctcttctaagctccgtaatggccgccaatggcgttcgttgtaggtgttggacgacgagtcgttcgcggtgatggtgctggtgtcggtggcgatgacgacgctggtgacgccggtggtgacgggggtgtaccggccgtcgcggcggctggtcgggtacaagcggcggaacctgcagcgcatcaggcacgacagcgagctccgcatgctgatctgcgtgcacaccacccgcaacgtgccgtcggtgctctcgctgctggagctctccaaccccaccaagcgctccccgatcttcatctacgcgctccacctcgtcgagctcaccggccgcgcctccaacatgctcgccggcgccgccg

SEQ ID NO: 52965 - DNA, 738 bp, Oryza sativa
caacagttgcaatcaggccgaaaggtttgttttgaaagtatgctattcagcttttgcattttagcagaacttctgttcacctatagggaagcatttcacaaagtgcattgaagaaaagcctatgaactgctcaccattagtttcccatcaaacacaggcaaggtgtatagaaaacatgcagctctcctaaccattgaccaaatatattcgaagttttgggggcatagcacttcaaatcaatttttttaaaaaaatctcttccaatgaataaaaaggcaaagcataatttaggttgtacaaatgtgaaacttaatcatgatcagcaagcaagaaagattcccttacctgatctttatttcttgaacattcttatcagatattgtatacaacaaagtgtagtttttcaagtcaaacaccttgtaagtactggttggaatgagaaaggaatgtcacaattcgaatgaggttaatcttctcgccttcaaagaaattagagctagaatacctgtcttgggcagaataagtcagcaccttcccgttaacatcatcaaattccacaaaacctggccatttcaaggactctgtctcgaaaagagggaaaccagcatctggcttcccccgtcgtatataccttaaaagacaaaataataaaaagattcatataaacaatataacactaccgtagcagaatcacaggaagacaagcttactctattcgagttgtcctgcatcttaagg

SEQ ID NO: 52966 - DNA, 1160 bp, Oryza sativa
tggaggaggagtttattttgttgtcttatcgatcagatagcatactgccagttactcaatttcaaagggaacaagttttttaattcgattatcaagttcagaacaaaacaaaccagtcagatattattggagtccgtcttgcacagagtatcaccaggaaacaaacatggtcaaaaaaatttgaaatctaatggtttcggaagagacacgatttgttcgtgttttacataattcacaaggaccgtatatgctcttggtttgctcggaatctgacgaagccgcattatgaaacaaagtaaattcgggtaagcctcaatcccacatccatgtgtgatcaatatttcgaactaaaatcccggcccattaacatagatgggccaagatggcccaaataaagtcagaaaatcatgaaacccatatgctcgaatatttttagggcccggtgaagtttttccggaccacttgcaagcccaccactatcggctcatccatcagctatcgcctatgggactagcttagcaaaatcgatcgcataccgggctaacgtgtgtttgtgaatggctcggagctgttaagctatcgattatcatgtcatacaagcatatataatgtttactgaccaacatcacagccttgctcggcgtaacattattcattgctgtttagctatagtaattaggaagcaagtttggccaagctcagtgcatgttcactttgattgccattttcaaccttaccaaattttgataatgttgtcaaaaaagtggctatatttagtttgctaccaaattttagtaactatataagaaatcctgccaaatttttggcaagtttgtcaaaattttggcaactataccaaaattttggtaaaatttggggcctgctcactttgctgccaaaaaaaccttactaaattttggcaatggcaactataccaaaactttggcatgatttcttatatagttatcaaaatttggcggcaaactaaatgtagccacttttttttttgacaactttaccaaaatttggtaaggttgaaaatggcaccaaagtgaacatgcctttggtaaggttttttttcatcaaagtgaacaagccctcagcgttacatcagcggattagacattgcccgctgaattaattaagttatagtaacattt

SEQ ID NO: 52967 - DNA, 37312 bp, Oryza sativa
  unsure (1)..(37312): unsure at all n locations
acagttgcgcgcgcgtacccccatccaccgcgagtcgccgtcccgtcgtccggttcgcggtgtgcggcgcggtgcatgcatgcgatcgagcgatgggttgggcgtgtgagtgacggagagcgacggtgtcgggggacggaggctgtggccatggctttgtgggggttgggggacaggctgcctggttcgacgggggtaatccgaaagcgaaacgaaagcgtaccgcactgctgatcgatcgatcgatccgacccacactcgttttgatttaatcgcggctgggctcgctcgaacgccactgggacatcgaattaaggagagggattaagagagacgacaagaagacacaatgatgggattttttgcttagttggggtcctgcaatttggttgcccgcattaacccgcctgtcccctgccgccctcccaccatgtttgcacttgcaggcgatcgccctcgcccctatcggagtgtgaatgtgatcgatctcgcatttctcgcggtacgaccgtgttttggaccatgcatcatttgtcttaaccatgcaagcataggacccctgccgtgctggccgggacgtaccatagatgtctcccccagcactgcagagttcccagctgtttgggctagtttacctgctggagacgcctgcggcctgccatttgcgtacttcacaatggtcacattttctgtttcaatgtgtgctagtattatatatctatgcttggtaaaatatgatcaactcatcaacatgagaatctgagcaaaagaccctgctaattagttatatattttactatatagaggccactgtcgaaataaagatatatctttcgtctagtaggtttgatgataattgataaagtatttcttttccccctgttttatgaataaaacctgctactaattagatgtttagattttcctacagatgctacggtggaaataaaggtaggactatctttcttctccttttctttttttttttttgcaagaaaggactatctttgatcttagtactttcacgataaagtattttcttttcctttttctagattatgatgagcaggtctgcaggtgatcgaaagatgtttgcacgcattactagcagttgagagcagaagcaagtggggtgatgtgtgcactgagtcatgcaacctaaaaagtgtcagtttgaaaactacaaacaccattctaaaatccaaagatgaaaaaaagggagtgctgccactcatagaacttctcgagcgaagggtccgctggtatcgataacggcgagcaagggcttaatttcttaccccgtttgttgattgtgtctgtcctttagccatcgtctttctccatgaaaaaacaagactaatcattaatttatcagtgggtaagtgtgcgtgcctagctaattaatttatttgggttaaaataacggcatgaatattgtatccaaacaaaaaaaaatgtttcaaaatacatatagtacaagctttgccgaggttaagcagtgcgtacctttcttgagcaatgcaatgctggagtccactaattattgcaaatggaataacgtaattagcaccctaacagatatagatttttgctactgtatgctagttgttgtttggatttccagcttatttttcttgtcaaaagaaaatgtagcaaccttacttcaaatccatgatattttgcttagattcttcaatacacgtaccccccttatcgattacactacactattatacggtcctttagaagttgattgattaggccgggaattatggacaaaatcattgtgccataagcaccggtctcccccagtactgttcccaatcctaatcgagcatctcaccgagctaccaacggccgagggacagagggcctgattgctcaccggtttgatggacgcctcatcagcatgtatgtacatatactgctgcagactctgatgccccacctaaaccgatgtactacttctgtagaatgtacttgtatatgtataattaaatctcattgatagtattattaacataggaggaattaagtgggtagtttaatttgaagaatgtaaataccccttagaccatattcaaacggaactactattaaatcttcagaccaaggagtattaagtacaactactgtaagtcaggctttccgacctctcgtgccgcccctcccccacgggcgactgggaggcgacgacctcaccggcgctcgtctccccttccctcctcctctgcctcgccgccgcccgagcagccgccggcaaagccacgcggccacaaggacggcggcgacggggctttatcctcgcgctcaggcatgggagggggacctgctcgggggcggcggaaccggccagatccgtgccgcccggtaggatctggcggtggagcaaccggcggcggggctgaacggtgtggcggcggtgtctggtggtggtggcagcggcgtcaaggcgttggcggcagcggaggaaactgccagatccgcgcctggatctggcaggacggcggccggcggcgaggatagtgacggcggcaagggcggcgaggggatggcgtcggtgaggtgaacctggccgcgccggcggcggatccagcgcctggaggtctggcggtcgcgacggtggtggcgacgagttcgcggcgacagcggcgcgggctaccacggcgggccgtctgcgccgtgtgtcgtcggagctcgacgacggcgacaaggtgtgggaggatgacgagatggcggcggggatggaagggcaacaacggctattgtggtggcggcggaggtggcaaggggatggcgtcggtgaggtgaacctggccgcgacggcggcggatccagcgccggaggagtctggtggtcccggcgatggtggtgacgagttcgcggcgacggcggcgcgggctaccacgatgggcagtctgcgccgtgtgccatcggagctcgacgacgggagaaagggcgagaggatggtgagatggcggcggaatgaaagggcagcagtggctgcggtggtgccgaccgtcaccccggtaggggaaggcatggcaatctcgggtggctagccgggggcgtgccagacggccgcatccgccggcgcggcagtgtttggaggaggggttggaggccggcttggcgtagagaggcacaaccgatggcagcagaggccggctcggcgtgaggggcgcgagcggcggagatggaggccggcttggcgcgagaggcacggccggcggtggaggaggcgacctcggcgcgagggaggagctgccagtggatgtgggtggtctttgtcgctcgaaggctggccggcgggggggcgccggtgcagtgatcccacatggcggcagaggttgagtggtggtggattgttggtctagcagcggtcggtcacgcttagcggcagccggtccggtgctagccttctcccgggcttgtgtgttggcactgtcggtgtgtgggtggtggtatatttttttttcctggttacgaccctccagaattgtaatcttgtaatattttcctactctatcaatagaacttcgcaccgtctcgtacaagtcgttcaaaaaaaaatcttcagaccagattaactgactgtgtggcctagtgataaaacccggagatgtacactgtttgtattatctacagaaattaggtagcatagaaaagaagaataaacttcgtattagtaatacaagcttagctaacgtgtatcaaaatcgactgcacacaagcgtgggtgcacacttgattggttacagctaggacaaatcacacaagaaaatggcaaagtaatgttgcgaacaatttgatgaagtcaatcagtatacgtagtttctcaaattatggccacaaactaaaatacccacacttaccaaaattaatgaccaaaactttacctttctattttcttggcaaggtttgtattggctaattaaaaaccctaggtgtcttggtgcctggggtgaattgcaagtataaacccgctctcgtatactccctccgtccaaaaaaagacaaaccctgggtttccgtgtccaactttgactgtccgtcttatatgaaatttttttttataattcgtatttttattattgttagatgataaaacatgattaatattttatgcgtgacttgtctttttaatttttttcatatttttttctaaataagacggacggtcaaacattggacacggaaaccagcgtttgtcttttttttttgggacggagggagtacttgttgtcttattcaacttaactttaaattaaaattttaacacttaatttaaagtaaatgtgatgaattttttgtcgttgtttatttttaaaattttgtttttaaactgctaaaaagatggatttgttttgcccgtatatattttttgcgggttgtttagtctaattttccacatctcttcagccgtagagaaacaatcagagccctaaagattcatatcacacgttaaccttcttaaatatgttgagtcgaaatattaacatatataatcttcttagttgcgctcaactccattttttgtgctgaacatggccgtgctcacgtaagctcacaccagcttgttagtttatttatttatggcactatatctgcagctattatcgctaatactcaaatgccaggaatttctaatgattggctaaattacgaacgtacaattaatagtgatcctaatagcatgtacaatagtagactattagctggctataaatatattttaataagataaaagatgagagagaagagcagcgggctacaaatctgtagtcagctgcagcacggactccaagacatagtatgtgtatgacaggtgagaccatatactaataatatagtaaatagttattgtatgaattggctattagattggctacagataaattggagggctatactagtagttattgtatgattgctctaaatctctatattagtttagtttgaggagaccaaggcagccaatgaaggacatacagatggctctgatttactacaccgtactagtcagtctcaaactctgacttttttgcccccctccacatgaaagaaaaatcaagaacaaatacgacgtgcacagtcaactcccaaaacccggtctacaatcaaacaactgaaatgatcaacgtcgtctcgaatgcaaacaaaagaattgtatagctagctagctagctatagcagaggctggctcatcctcaaccaatcgatttgtgtctagtccaccagttaattaatcaccaaagataattaacatgacctaatttatccatcatcaatcacacattcacacgcgttccatatgtgatcagttcaccccactaatcatcgtgctgcttagctctgcaccaatagaactccttcaatctgcaataatcttaataatctttcgccgaccttacccttcaaggctctgcttctactcaaaatctacccacccaaagcctcgcgtctcgccgcgtgtcacagatccgggccccacccgttcatatttctacggcggtgcgttacgtatgcatggataacataaatagcgagaattattagggtcttaatcccggaccggtaatgcgtctacgtttgatgcgtagcccgccttatcgcccaaggagataaacccaacaaaaaaacgctaaataaacaggtatatgttcggtctcgtcgatcacacatgtgtagcacgcacaaaacgttttggtttgtaatctgtggatatatacatgatcggtggattgaacggtatactgcattacgtatgacatagagctatcctgcttgatatgcagagtggtaatgctccatatataaaaccaccgatattatattatctaagttacacaaaatcacaacgactttaacatatggcacatcattgacggtaacatagctttgcaaaaccatgccattgaccaatttggcttactaccttaccaaaaaataagaaatgatttattacttggatagctaaagcatgtatgcttggagatcaaagattttgtaaatttgagatttgattttagaactttcgtatgcagtggatcacattataattggtaagcagtatagttttgtgaaactctaaaatcataatacctatgccacatgctaaaacaactgtgattttgtgtaactcgagtcacaatatcagagttttataaaatttactttagcgtgagtttgaatctacatattcttatcttctacttcctcttttttcgggtatacgcttcccagactactaaacggtgcaaaaaaaaacataaaagttgctctacagacatattaatatattttaaagtcttttagctaacatttaattaatcatatactaataaaccattcctcttttttcttgcatataggagaggtttttaacccctgcttccgaacatatatttggattagaggatcttcacatgatttttggaggaatattaatgttgttcatatgattttttttcctttcctatcgtccggatcatgaaaattatttgtagaaaattcaaaggaaaatttcctccggtgctgatttcacagcagaagtataggaaaaatccatcaactcaagctcttttttagtttttgcttcctgcatgcaaatactagtcgatcaacttcatgtgatccaaatacctcaactttggtatttctttgtttttcattcttctactttacgcttaaattccttttctattcatatacattttatatcatatattttttaagtaaaatacatggccggtccttaaagttgagcgtgggtgtcacttacatccataatcttgtaaattgcacatctagacataccatcttgtttaagtgactcgttgaggtccaaacctcacttgaccggctctgaccgcagacgtggcatgccacacaagcaccaattttgcaaataagcccctccgcaacagtagcgccatgaacaacacaaaaatccccaaatcctccttctccgcgcgcgctcgccactggccaccccctcctcatcgcgcaccatggctgagggcggcggcgggtagagcagcggtgggcgagcgcatgggggcgtgcggcgaacggcggcgtcacggcaacgtcggaatcctgctgccgcgccgcccctcaccagctcaccagcacgacggcattgagaatggcgatggaggagtggaggacgacgacgaggacgacgctctggcgctgacggcggcggcagaggcggaagttgcttgggcggccgtcggcggagcggaggaggaggtagcaatttacaagattatggacctaaataacacccgcgttcaactttaaggaccggcagtatattttactttttttctatctaggtataatccgaacgagcccataattagcgtgcatgtaacgttgctatatgggtttctttgagctgaagcgtagtatatgtacgtgatggaattgattagaagccagccaggcaggggagggtcgttaagtagcatcccatgtcaccccctgcccccacacatgtcagagcaacatgcatttgcttccttggttttaattaattcaatttctcgcctcttttcttcctaggtgtacaagtgtacagcccctctctttttgcttatcacaattcagaaggtgtgtgtgtatatatatctctcctacctccagctacttcacttgtcaaatcccaaacacaaacacctagctagcctcctgagctcatcagcttagcttcgcctagctagctagcctgactgcaatcacctgattgatttggttgatttgtgggcgcgcgcgcgcatggcgaaggtacatcctaacgtggtgcccgtggcggcggcggcagggccggccggcggcgaacggcggggggaggaggaggaagaggcggcggcgctgacggtgtggcggaagtcgctgctgttcaactgcaaggggttcacggtgttcgacgccaaggggaacctggcgtaccgcgtcgacagctacgacacggagagcggcgacgaggtcgtcctcatggacgccgccggcgccccggccttcaccgtccgcaggaagaggcagctcagcctgcagggggagcagtggctcgtgttcgccggcgaggcggacggccggcggccgcccgtgtacgcggtcaggcggacgggccgcggcggcggcaagtcgctggcgcgcgtgacgccgtgcgcgggcgcggccgcggccggcgcgtcggcggcgtacgaggtggagggatcgtacgcgcggcggtgctgcgtggtgtacgacggcgagaggcgggcggtggcggaggtccggcccaaggaggcggtcggcactgacgtgttccggcttgttgtgcagcccggcgtcggcgtgtcgctcgccatggccgtcgtggtggcgctcgaccagatgttcgggaggccgtctctcctgaggagctggtcctcgtagacctctcctctcagtttttacttaaatttagtagctagtttctttctgtctgaattttttttgcccctatttcttggggttaatgaatatacatgagtgttcttgattcctacaaatgatcttatttttttttctatatacatggttaacatgaagtcccagatccggccttgtctatggcttttttggcagtagtactaatcaacttgaccaagacctctgtaaagatgttttacaggtgtgtatgtatatatgtacaaaaaaaaaagagaaatatcaagaattaacaatgggcagttattttttccccatacaattcttgggttcttgaaatgtcatcttatccattaacgctacagtgccatgttaatcatctcaacgcgtaaccatcgttcgcgatccatccagggatggggagtttgcgtcgtcttgtagtagccttattagccccagctctgaatgggggaagatggagatgggaatagcgcacttgatgagtcagtgttgtttgcatctgcatgtggactgtcaggatcgtgactccttgtctagctaagctcgggggaccatttgccatgcacatcgccatcctggagaaacgaactcgctgttttttttcagtcttttcgctcgcctatctgaagatttcagttattatgagaagggaaggagagaaagttgctgctgctttggtgcgttccaggtatcggggcgagtcagccccgctaggtaaaaatcccaggtggcaatgtgccagatccaatgcagcctgcaaatgaggtcgtgtgtgtgccgcccttgctttcttttgttctttgcatgtgcttgcgagctgggtcttttgcgtcactgcgtgtgaggcgtctgccaattggttatcatcagtagcatctcaccgttgacagcttacagaaatcagaggttcttgcgaggtctggccgtctggatgaagtactcctagttcatcttcgtctttggagggatgggatcgccagaaaaatggcttgtaacatcgtaaaaagacgagaacgatagtttacactacgttttgttgggctagaacagatgggccatatgtccagcaacacgtcccagccagaatacgtcaaagtttaatcggcatccttaatcgcaataccagaaattttaaacctttagtcacaaaaccggcttaaattagatcttccgagttccgatggtatagctgatagttttggctgacgtagcaagttgattcggtccactttgtaccgactaggtgattacgtggctaaaaaaagtaggtccaacatgccatcctcattctctcctcctcctcctcaacctctttctttccctcctttcctcatcgagtgcaccggccgctgagcctgagtgtttgcagcccccaaacacccaccgccacttctgccttcgagcagacgagcactcgtcgccgtcgtcgtttgcacctcggagcaactgccatccccgctcgtcatcgtcgtagtagcctgcacctcgttttttaaccaaagggcgcataagatttgtagtattgtgggttagggatgtcgattatactcgacgtaaagcataaggacaacaagtaaacttatttccatcccagccaaccagacatgggccgcatggccgacattgctccctaccaggcccaggatgtaccggccggcccaaagtagtagcaaggtaggctggccagagcccaagcgccaaatctgaccgactgccaccgtgccgcccgtgatgaacactggagtacccgtctcatggagagcgagaagaaagtacacagatgtcgatgtgcgagaagaaagcgagagcgccttcgggcgtatcgcacattccaactctaatggtttagcccccaggacgccggggcccgtggcggcgcggccaacacaacaccggagaggagcattcgttcggcgaggagggcttttcccattggaaaatctggagaaacccggcgaaaaatcccgtcgccgctgggaatatctcgatggaatatccaaacccagcgacggaattggactgggaccggactggacggtcacgatggagtctcgtcgctcccacgtgaccgccgccgccgccatcgcggccgtccaataccagcagcggccgtagtaataaaaaaaacaaaattggtggatcccgtcccccgtttgggctttgggatccaccaaatcaagacggagccacctatccgcgccgtcagatctctccatttctctccacgtggcgtcgagaggaccgtccgatggtaacgcgaccatcctaaacaaggtattcgcgtggaccctacacgtcgccgtcgcgctgcttattaatatcgcgccgcccacttcgtcatcctcctcgcgtactccgctctcgaaaaagaaaagaaaggctttcgtctcggtgggcaaaagcgcgagggcaaagcgaaggtaagggcctctctgatcttcctcatcgatggatgcgtcgttggttttgagcgcggtagcttgtttgtggttcggttgttcgccgatcgatcggtagatccgcctgtgcgaatctgatctgaggctcgaaatctgataaaattggcgagatttacagcgttgcttagtgttaattatgctcgattaggccacgagttggttcggattgctaaccctgatattagttgacttaattatgtgtagtttctgtacggatctgaggatttgctgcacctaactgttgtatctgagctttgcgttggtgtgatttggtaggtatagcatctagtaggcgatggcgagctccggtttctcatggacgctgcccgaccaccccaagctccccaaggggaagacggtagccctcgtcgtgcttgacggatggggcgaggccaacgccgacaagtacaactgcatccatgtcgcccagacgcccgtcatggattcgctcaagaatgtatgcttccttgccacatgattatgatttggggtcatgcaattttttctgcctttaatgttgttagtgattgcaaattgcttttcttgttttattttctgtagattaggcatcctgcttgtaactgtttggttatcccattgacaacagacagtttggctaagatgattaagtcgtaggtttagcctggacatatatttaatgaagttgcatccatgattccatgttgtgttgggttgcccttgtgctatgaatttacgcctttgcctgcactctagtttcagcagttaactctattttttttgtacattaaaagggtgctcccgagaggtggagattagtgaaggctcatggaacagctgttggtcttcctagcgaagatgacatgggcaacagcgaagtgggtcacaatgctcttggtgctggtcgcatttttgctcaggggtaagctgttgttgagttttgattcatttgggaactataggttggatcactctgcatgttttgtgacaagcgtgtttcattctcactgtagtgctaagcttgtggaccttgctcttgcctctgggaaaatttatgatggagaggggttcaattacatcaaagaatgttttgacaagggtaccctgcaccttattggtttgttgagtgatggaggcgttcactcccgtcttgatcaagtgcaggtttgttaagctctgatgaatggcgccttatattgcaatgtgttgtttatttactgtcaatttttaaattggtgtgttctgtttcactctatttcagctgcttctgaaaggtgccagtgagaggggagcaaaaagaattcgtgttcacattcttactgatggacgcgatgttttggatggcagcagtgttggttttgtagagacactagagagtgatctttctcagcttcgtgacaagggtattgatgcacggattgcatctggtggtggaaggatgtatgttaccatggaccgctatgaggtaaaatcttcatttagttatacgagttaaaccatcaacttttaatatttaactgtgcagatcgctatttttaagttgtttgatttcattatttctgaatttaataacatgttatatccatgctgaagtttaagtcttaaaaatgcacagaatgactgggatgtggtcaaacgtgggtgggatgcccaggtgcttggcgaagcaccctacaaattccaaaatgcagtcgaagcagtgaaaactctaagagcagagaccaaggctagtgatcagtatttgcctccatttgtgatcgtggatgagagtggcaaatctgttgggcctgttgtagatggtgatgcagttgtgactttcaatttccgagcggatcgtatggttatgcttgccaaagcactagagtatgcagactttgacaaatttgatcgtgttcgtgtaccaaaaatccggtacgctgggatgcttcagtatgatggtgagttgaagcttccgagccattaccttgtctccccaccagagatagagagaacatctggtgaatacttggtaaagaatggcgtccgcaccttcgcttgcaggcaagtacctggcttcccactctctttcctctgatactaaaaatattgactggtgacttagtaatttttgaggtacttaggccataagggagttgattcaaatcctctatactgagttttactttctgtgctaattttggtaccaagtttagcagggatatagtattttttgctttaattgtagtaataaaacaactcatttgatataaaacgactgcttgggtgcagaagaactgagggaattacctctggttgcctattagaccttccatgatgctattcgaccttaattgtggagtttatagttgtctattgtgcttatataaaataatattctgtcttagtccatttgtatttatgctgtaactcattgatttgtttttttacagtgagacagtgaagtttggccatgtcacatttttctggaacggaaaccgatctggatactttgatgaaactaaggaagagtacgttgaaattcctagtgatattggaatcacattcaatgttaaacccaacatgaaggcacttgaaattgcagagaaagccagggatgccattcttagtggaaagtttgatcaggtaggtaattgtttcgtcggtgctcagatgactgtttgcctatataaaatgttgcttaaaatttttattactcttttaggtacgtgtcaacctgccgaatggtgacatggttggtcacactggtgatattgaagccacggtagttgcttgcaaggcagctgacgaagccgttaaggtgagcacaaacaagacaaaatatatgcagacagttatttctgcaagtcgtcatgtaccgtaatggtaatccctcccctcctggaacagattattttggacgcgattgaacaagtcggtggtatttatcttgtcaccgctgatcatggaaatgctgaggatatggtgaaaagaaacaaatctggccagccacttctcgacaagaacggtggtatccagattcttacctcacatactcttcagccggtacgtgcaaatgttcatataatgctatgttttatgttgtgtgtttgttgattactgcgatgcaccttacatattcgccctgtaataccaagtagagtgctttttttttgttgttgttgatttgagtttttaatgcctatataaaacttgcaggtcccggttgctattggaggtcccggtcttcaccctggtgtgaaattccggtctgacattcagacccctgggctcgccaatgttgctgcaaccgtaatgaacttccatggtttcgaggctcctgctgactacgaaccaaccctcattgaagttgtggacaactaaaatagtaaaatcgcggtagcgaagttttgttcctatagtgttgagatgatcaagagtgatcatatcatttaataattgaataatttatgtttgcccgctcgctgctcaaactctactatggagagaaaagagtgtatttgacttgcagttctgctcttatctgtaactagacgttgtcgcgcaggctggcctgacgttttttcatccgctatatgcgataatgcgaggcgtcaaacatgctcttgtccagtatttaaagtttggatcgtgttaaaatcgcgtaatgttatgtgcaatgtgcttggttgcctcgctttgctccaagaaagcagcaaaaccggagctgcatcatttgatgacctttcgcttgtttatgcatcattttgacgcatcgcccatctgtacgcttcgccatcagaattcagaacacaaaacgacatctctgatcccgaagttgtacgcttcgccatcagaattcagaacagacaatgaatctcagattggaatcagatatatatagctcggggggtaagatggcacgctaacagtgacaaaccttccaaaacgatacatatggtaaacagtaaacacccttggagctacaccgatcaggcacgctagtatctccccgatgatgaactacggttgtagctagtatctccccgattatgccacgctaggtgaggattgctgttgcccgaaggaaagcttgactgcctgagcaactatcaatttgaccacacatggacaaggcctagtcggttgccggtgtatatctcctcacgctcttcatcgtagtacagagctgtgatgtcccccagtgcctcggaaggtgtactttggaacttagacaccctttgcttgttaaggttccctgcctttattttggccaagcattttccggttaagatctcactgatatttatggagcaagctgcaaaagaaccaaagtgaagatcatgttatgtggggacaatagatgcatcagcctcaattacctactgcagtaggtctgaaaaggacaaatttcttatcaactgcagcaagtctgaaaagcatacattttacgagcataaaaaataattaaaacgatacagtatataataagtgcatcagtatgtcaaccttttgaggcctcttatattttattgatattcaaagctgatatactcactccgtactcataaaggaagtcgtttaggacaaatttttaagtcaaaccttgggaatataaatcataaataactcttaagttgttgagtttgaaaatgtaaaaattatatgaatagatttgtcttgaaaaatactttcataaaagtatacatatatcacttttcaataaatatttttatagaaacaagaagtcaaagttgtgttttggagaccgtgtcgctgttctaaacgacttcctttatgagtatggagggagtatatcagaatgacaaagaggaatgcaataacaagaaatggcaacaaccaaaaaccagccaaatataagaggcagtagatctatcatcacttcactaataaataaacacacgggcaacacaagtttgattattaccattttcttctgaagaaggatcatttggatcagccttgcagtaagaaataataagatcttggttgctggtgatgtaaatactgttggtattgcaatcagggtgccacaacatatggtcctcaaaagatgtgactaattcaccacggaaattccaaacggatactgatctactacggaaggtcaggaacagctgcatctcatacagaaagataaacgcagaaggagtcacaaattcacttctgcttacttcaattgattggaagtttcttacctgcagcattgcacaaaaattaactacaattctacaaataaagagaggaaactgtgttgtttcatttgctgttatccataatctataccaagaaaaaaacttacatcaagaatttgaaggttctccccttcctgtttgatcagaagtttttcattgaattgctcaatgaaatcaacttttttattgcgatgaagaaggtgtttgaatgacttcaagcgtttaccatcttcaatagaaagaatgtcaaggggaatacagcccttttttcttgagtatatcaatagcattatgccagggctgttggaaggtagcaataagcaaaaaggtataaatttggaagctcgaaaatggaaatgacctccataagttacacatacaaaaatttcaatcaatccagccacatctcacttgacaaaaagcaatcaattcaccatatataggaggtcaccaagaataaacccatgatagctcaattggcaatagtatttctatgctctccacaaagctaaattacataaatgttcaatcagtaaagttgtcggtttagtaatcaacagttgccaatcaggccgaaaggtttgttttgaaagtatgctattcagcttttgcattttagcagaacttctgttcacctatagggaagcatttcacaaagtgcattgaagaaaagcctatgaactgctcaccattagtttcccatcaaacacaggcaaggtgtatagaaaacatgcagctctcctaaccattgaccaaatatattcgaagttttgggggcatagcacttcaaatcaatttttttaaaaaaatctcttccaatgaataaaaaggcaaagcataatttaggttgtacaaatgtgaaacttaatcatgatcagcaagcaagaaagattcccttacctgatctttatttcttgaacattcttatcagatattgtatacaacaaagtgtagtttttcaagtcaaacaccttgtaagtactggttggaatgagaaaggaatgtcacaattcgaatgaggttaatcttctcgccttcaaagaaattagagctagaatacctgtcttgggcagaataagtcagcaccttcccgttaacatcatcaaattccacaaaacctggccatttcaaggactctgtctcgaaaagagggaaaccagcatctggcttcccccgtcgtatataccttaaaagacaaaataataaaaagattcatataaacaatataacactaccgtagcagaatcacaggaagacaagcttactctattcgagttgtcctgcatcttaaggcactgaagttttcagaaccataaactgatacagtaatgagtgagtcattgttcttgttgtaaaacaaactgcgaatgacttcatctggtcttccattcagaaagcaaatccgctggtttgagactaaaacaaatacatctcagaattcaatggtaatttataacatcagtacatgaccaatcattatcgaaagttgtacctctgctgaatgcagcacatactcctgactgtgataaagcaaagatgatatcactggctccaactatctcaataatctcagaccttttcatcaagtaaggtagtagtgaacccatctccttgggatcatgagtatcaaactcttcctaattgtaagtgaaaagaatttgaagatgtgttataatcgtaaaaagaacaggtcatgctaactaaaagttagaaacaaaattttggtgaagatcggctgttctatgatatgaagggcactgaagtttcaaccttttccaaccgagttatgctccagagtatacttttatcacagtaaataccaaagagagcgaccacatctcaaaatatagcaccaaacacacctttcccctcttcctatcatcgtccataatgctaaaacagctgtactaatccagggattccgatatccgatggagaaactctccgcaaacagccaaagctatcaccatcattggggaatatttacgcctcgtgaattctttgaccgtaggcgaaagttcctcctcacaacacccacactacctatatgctctcgggctccaactcttcccgcaattgattcattcaaataatcattttttaaaaaaacaattatcctctctccaagccctaacctaccgacccactcctgccctctacgccatatcgatccagacctaaatgctgggagacagggtgtggggaggggggacgcgccgagcgggccggctgacctggagctggatgttgcggaaccgctcccgcgtggtgctcgcggagaacgcgcggcacggcagcgcggagatctcccgccgttgcagcttccgcgcgctgttcgccgtcgcctcgggcctccgccgcttccgcgcgagcaccctccgcacgcaggacggccgagggttcgcggagacccgcttggcttcaatccttggcggccccggcccccggcccaaccccacttggccgccgacgagcaaggttcagacgcgggtgggcatctcgccggaaatcgaatgggggttagggttcgaggcctcggctcgcgcggagtcgagctggcgcctcctcggtctcgtgctacactgtggttgccatcgaagtggagtagtaggtgtgcttcttttaatttggagtacagtgaaaccgagagcctaaatggaaaattaccttcgccgtacaatgtccgtccgacggtatggattccataccatggaagggctttttcgatgggtgagataaataaaatgaaatgtaaggtctttttccgaaaactcgtgtcatgcctcgatcttagccgcatatcgttcgtctgacggacaatgttagccatcaggaatacttgcaagttgaaggaatagaaaccttttgcactgttgaacatctttgtagaataagcgaaacgacatatttataaatgaaaaataatttgtgaataaaatttttataaatgtgtttttaacgatctaaaggcaaaggctgaaaaataaacttcgatggaaaaaacctcaaaatcaccttcaaatttaaggatggaaatttaaattttgactgataagtataagcataaacgaaaagatgaggtccttcttaacttgccatgtaaatgatgtagccttatatctaactcaggcctacctggaggaggttagcagttgtaacttattacaaaatcttcagctcttaaacaatgcataatatcatccatattccaaagaatcaaaagctaaagaatctataaaacaaactagaagctagaaaccggaaaaccaatttctctatattctaataatctggttaccgaccggttgattatcagctctccaaatatagcctcatttagatgatttgtgtttggattctgttgttttgtggactaacctactagagaagattagttccttttaaaacaaaaggcttaccgcgagaaggatcttaaatgtaaattttttgtttgcttttatacaattatcgttgcttttaatcaatataaatattaatactcattttatacactaaataattttaaatgacaaaaattataaacaacaaagttttagatctcatttagatctacagcttttatataaaacttgtcttcatcaaaggtcatttgaagtatatatttgagattttctaaaacaaactttagattttataacgaatatttggactctaaacgatcttaaatgaaaaagttgtgaaccacaaagctgtagatatcctcaactatgcaattttgatataaattttaatttcatccgatttcatatgacctattttcaaattatagaaatacaagttaacaacatatgcggtaaattttacatttaagccacttgccgctcttctagagggcgatttttttttagaaaaaatgccctcccaaagggcgggaagggtacagatctgtaattttgtaaacacaaaattatttttgtaaatattgtttaataaaaaattcaatgcgtcttcagtagtcattgaggctgaaggccttattgctttcagagtccacaaaatgggaccttcctgccaattggacttaaaagggccaataagatccaaacacatcgaaggcctaacaatttgctgggctttgactggaccttggaggaggctggaggcctggggcctacctacttataggctagcacaaaaggggttaatattcaatagagcaaatcctatttgtcaaaagttcacttaacttcagtattgctaccagtacagtcacagtaaccctctgaatctttgatagagaaaaaaaaagagagcgacaattctcatgttgtttacatcatataattaccaccacaaaaaattttcacattccttcaacgccacgtactacgtctgatttggtggtgcaagcttaaaatgctttaatcctgcctaagtcctaaccaaccgtgctgaccacagactctatattttactttactgcttattaatcctgctttattagcagtatattttactcaacaaacacagcatttacctagcccggttcatcgtcggcagccttcaaccagcccggttgtaacttacaaaagcttcgataggtgtactgttttctggagggatcgataattcgatgtagctccaggacaaattacgagacagtgatggcatttttgctacagacaacactgcagctgcacagagcttagttgcaaatcctcctatgccacagcgcacattttgtaagtatatagattaggtatacagttaacgatttctaaggctaagaacggtaggtagagtgcaggtggaacataaatttttttttccaaaagacttttagccttttttctatgaacatatatagtctctttttggaatggatcgaggtagtaagctatataaatggtgataaatctgaataatttctactgctaatagttagctgcttgatgtctgactgataaccaggtcactgcaaatttcccatttcgttgactgaaacagcgaaaaagttccagtaaccaaattgccattttcttcgaaaggccagttagatgaattgacccctggacgcctcaagtgccaatttagaagctgctactgctgaactaagctaaactctctgcgagattgcacaagctacgtacctaaaccactacttcttaggaaacagtaatccaaagtccttttctaggatcacctaactaacctctttaatttgtactacttcgtcagcgttactaaactctcttgcatgtcaaaattaaattaaagtagctacctggatcaggatgctagaagcctacaacagtcaatgttactagagatacttattactacatgctgctttcgttgatctccttgtgtcaatgttactgactcccaggtgtcaaagtacatcatccatctcaaaataagttaacattgtactaggacaacaaatctagacatactctatatccagatctattatattaagatgtagtatcacattctactacgatgggtgtgtttagttcacgctaaaattaaaagtttggttgaaattggaatgatgtgacggaaaagttgaaagtttgtgtgtgtacaaaagttttgatgtgatgaaaaagttaaaagtttaaagaaaaaatttggaactaaactcgatcgatgttggtttatttttggaccgagagagtacatgtcaaagtttctttttctgatctttttggccaagtgtaagaagttgctagctgcaggatcaggatgctactactcggcgccggatgcgcgtgcatcgcatggttaaaactgcgcgtgagagttggttaagacgcggccagctaaaaccagaactcggtggagcttaataattggccatacctgatgaccacctgtgagagtcttgatctttttcatacctcctgtatcgatcgagaagatgacaactttttttaaggcgatatgctgctgatttgggtgactaactgactatctgtccgtcttcccgaaggctgtactgtgtcgcacttgttcttaattcagcttgcctgacgactgtgtttgacaggtagactaatatgcaagatattacattgttttctttatatataacaaacgatgctagtttcttattctatacatacgcttctctaaaaaaagatcaaatatctttaagtttgtaatatttacaaaaattccagccaaaccgctggttggtctttattggtatactctctccgtataaagaaaatcgtttaggacagcgacacggtctccaaaacacaactttaacttcttgtttctataaaaaatatttattaaaaaatgatatatgtatacttttatgaaattattttttaagacaaatctattcatataatttttacattttcaaactcaataacttgagagttattcatgatttatattcccaaggtttgacttaaacattgttctaaacgaattcctttataagtacggaggaagtatatagcaagaataatcatggtatcatagcataacaatttgctattgggatagtataattttcattggtatagcatgaatcatgcttgcatatggcatggcataaacaatctccttttgggagcttgggatagaatagttaactacaccctcccgaagcaatttcttatttttgacccccctctttaagcaaccgaggtgaatcgttcctttcctggcgctttcgttgcggcgacggcgacatcttttgccatcttggaccttcgtcacagccatgcatccctttcagcgaagaaaatataaagacattctcacgatctgctcgagccggcttgggggagccaggtagtttaattatagccaaaccgcctgtacgcgcgtcccgttctcgtagctgcgccctatgctgtgatgatctgtgctacgtatacttgttactatgttatatatacgacgattgctttcgctaaattgtgccacctaattacacttaaggtttttttattgaaaccaatttataacctgccaaaattttaatagctgtaatagtattgtttgtatatttggggcatgtttaaattgtagccaaaataaatctcaccaacttttgacaatgctaaaattttagcaagatggcaatactaccaaaattttgacaggatttcttatgtattgactaaatttgagaacaaactaaacgtatactttttttttggtaactttacccaaaaatagtatggttgaaaataacatcaaagtgaacagacccttggtttaatgccaaattttacccatagtatatacacaaatctactaatgttttgtttcggcattatcaatattttagtatgacaagatgtaggcttcaaacgaaactaagcgttaatacctgtgatatgtatatccttgttatatatagtcaattaattttgctaaattgtgccacctagctacacttattgctagagatcctctagagtattacacactggtatatggttctgagggtttgtgggaaaatgcttcatgtcgtgcgtctgatcggaagacaaacatcgaacaccaactttctcctttgtactagtctcctctggacttggtttgattcaccttttccataactctaactttacatctgcacaattccttttctctctcaatgtctccttcttgcatgtagctagcatctattttgtttcttatagtctatgagtatatacatgcacgaagttctagttgtaagctttaaatgaatttttcttgaaaactatttatccaatttactatccgattgcacagttgtattcgttgcaattaaatctctataacaagatatcacatgattatattccgattaaaacatacatatgtttcaaccgataaacttggatgtttcacgtgtaagaaataaatgttttaatcagagtttggctatgttgcacattttaagttttatgttgccatgaatcttacaaaatgttccatgccatttgaagtttcaataaatatttttctgatgtttcactagtttatttgtgaatattgcacgttatattattggatatttcagtaagtattttctaatgtttcactaattcgtttataaatgtttgcacatgttgtttgggatgttgcaatgaatattttctaatgtttcgataattataactcgttgtttcacgtataatatataaatgtttcaattagtaatataatcatatttataaattttatcagaaatataaccaagtgagatcttattgtaaagatttaattataacgaacacaatgggtgaaatcggatggtagatcggataagtaatttagaagaaaaaatagtttaaagctctattggtagagaagatgaagagagagatttcatgcatgcatgcacgagagtagggtatagccttgcatcatagtagcttaactaggatggtttttttttacgcagttagacatgtgggtgaacaatgtccaatcttttgctaaatatcggacgtccgatatgtagcagtatccgagtttgtgggggctcagatataagtgagcagatgacccctgcatcccatatatctttatatactactccctccgtctcataataagtacagttttgcattattcacgttcaacatttgatcattcgtcttatttgaaaatttttttataattagtatttttattggtattagatgataaaatatgaatagtactttatgtgtgactaatttttttttattttttcataaaattttcaaataagacggacggtcaaatgttggacacggatatccacggctgttcttattttaggacggagttagtaatattaggttggatagttttagagaaaaccttataaaaaattagatagcaagatggctcgagttccataaatccgtacgaatggagaaaacaaccaactatctcatcaccatttaccaaaaattaccaatcgcgcgctatagtcaactggaacataactttgagattttattgctttgggtgtgtttagttcacactaaaattagaagtttgattgaaattagaacgatgtaacagaaaagttggtagtttgtgtgtgtaggaaagttttaatgtgatggaaaagttggaagtttgaataaaaagttgggaactaaaccatgcctttgtatagtgacgttgtcggagacactcacgcgcatactccaccgtctaaaaaaataaatataaaattggatgtgacatatcttaataaagtaaatctgaacaacgatctttccagatttactgtactacaatattctcatctaattctaagtttatttttttaaggacaaagaaagtatatatgtaggctatcagccattggccaagatccaatggcgatcctaggtacattttcccagtgtcctcggactcggaccctaggtaaattattcaattctaattaaattatatgatgataactattatataagtaaaaattagataattagtacgcattaaacccccggtaatttttttctgggttcgccactgtcaagatcggattcggacggagtagtagcagtgcatgtgaatggatgcaaatcagacagtctagatttacggagcgtaattactgtagcatttgatataaaccgtttatcatgcaaacggatggttaaaattgtgttcgtatcttgcatgtacaggtataactgcacctgatctcaatccgtagaatcctatgttcaggtactgacgtgataggtgaaaaatcaatcagtattacgaccatttagttcccatcaactatcccaatcaaaacgggaatctggattagtaattagtactacccccgtttgttcccattgcgatggcttagtcagaaataaaattattgtgatggctgcagcacgatcgatcgagacccaagagacccccaatcgttgttctcacaccgtcacacgttagcacatcgatataattcacagtgaacttaattcggcaggaagagaacttgacgagcgttcgctagatgaaggtgaaagcgaccagccgcttgttcacagtcaccacaccagaagcctcttttgattttctcggttttgtgcaagggagccttggaagaaaggatggtggcgggagaagcattcctgcgaagcttccctctcttttttttcctctccttttcctctggggtaattatattttcaactgcaattatacttttacacctaattttctaattatgtgtctttgtcctttctttttaaaattgaagctccgatttacccctacttcaaaattctgtgagatagacctaaattaagtgaggtaaagaaaaagaaagaaatatgactgaaaaacacaaaaggacctatctaccccccaaggcacttcgtccacccaccatgtgttgactcgcgctaccctgcatttttctaattttgttttcatttctccttttcttttcctgataatatgttcagcaatagcattaagtggtaattgtagatccatcaactcttgttctttataacgtgacaaggaatttaaaaagttaaagagaaaatgagtttcatttagatgaaaccatgcctatattgtttcccatacaatttatctctttcatgtattgtctataaaacaagaaaaataaaaccacattttgaaacataaaaacgataccacccattggaaatggccttatgcgattgtccttgctcaggattttgatcgaacaatcaaaggttattatttggaaacacattacattatttgcatttaaaatataaatatatcacattcctggaagaggtaagaaaataaggtgacaactttaagatggatatgtagtggtttttataatacgaagtagatcaagtggtaaaaaaagaatgtacttttatagaaaaaaaccaattcaaacaatccaagaacaacgatttccttttagattcggctaaaatggaaaaatgttgggtctatttgctaggattggtgcaaagtgtaatctacggaaacggaaactagtacttcagtcgatactactccctccttctctaaatgtttaacactattgactttttttaaacatgtttgaccattcgtcttattcaaaaacttttgtaaaatgtgtaaaactatatgtatacataaaagtatatttaacaataaatcaaatgataggaaaagaattaataattacttaaattttttgaataagacgaacggtcaaacattttttaaaaagtcaacggcatcaaacattttgggatggagggagtactctagctaggcagactctagctcatcaagatctctcttcctattgtcatttattttccaccacgtacaattttcttactgtgccatatttcctcgtctgtccagatagaaacaactaatttatcatttgcttccgttctttgtccaaaatatctttgacttctgcttctacttgttccacggttattgcccacggattctgacagaaatgtaagtgtaaaacagaggattgcaaaacataggaataacgtaggaatgaccgtttgattggaccacaggaaaaatataggaatttgaggagagataaagacttaaaaggattttttctatgaggttctacctcttgttaaaattcctccaaaacttgtatgggaaaaggcattccataggaattttataggattccatagggttcattcctttaattcaaagggctttgtaggaaaaattcctataggaatgaaatcctctaaaattcctatgaatttcctttgaatcaaaaggggcctaattgtcaaagtgccatattaatcactctctctgatcttaaatgctcatgttatcatcgggtactattcaaacctctaatttattttaagaacttcaaaatgtagctaattagctaattttatgaagtgggcgtagctcaactgattagatttctcgagatggaatcaaaccatctgatttaagtcctatacttaaacatgagtgttcgcatttacggctaattattcttttggtggtaaatgacgtacccgtgtgacggagctcgtagctcctcaccgggagaccgcgcaggcccccctttgccagttcggccgggggcttagggtgaaatctcaagctctctcggtgtgtggaaagatcatctgcccgcaagaaaacgcgagacaccggcgatgtatacaggttcgggccgctgagaagcgtaataccctactcctgtgttttggtgtatctgtggatgaaagagctacaaagtgtgagccggcttccccccccgttctaggctctcaatccggaaaagaatcaaccaaccccccactctaagggcaaggtcctccttttatacttcaaggggataccacatgcacccttctctttccaaactggactgttctttttctctttaatgggcggagatcggtatggcttccatccgggagcccttctgatgggacagcccacacctacctccactcccggcggagacaggcgcaacgtgggatcgtggctgcccgttgctgatgcgaccagtgtcagaccggtcattcttgtccaccacgtgtcagtttaacaacgtgcatgtttgcccttcttcgtgtaacaccttgcctgtaatggttaggatgaagcctggtataaatctgaccagggctaacgtgccatcttttaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaatgcgctgtgctgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaagaggagggcggacacctcaccctcgggcccgacgcccccgaaggtgccaggccacgtgggcgattatgtctgcctcaagcctctggtcatgatactcccggtcccatatcaccgacagtagcccccggcgttatgccagagcaatttcctttcccaagggaagcggtcaggtgtgacgccacccctaaagcctggtgacaggtgggaccggtctccgtagttgggcaaaatacccaacggtctcaatccatgcacatcggtattggtaactttggttgtccataatgggcggtctattcaagactgccacaccacttgagcagcgcgcgaatctgggtgagcagatttatctcgcccggagatacggtaacgccgcttcggtcggcaagcgggcctctggaaaggccagacgacggtgccccccaccaacctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttccctcccgggaccgaggacgacgcgcgcgcgcgcgtccgggatgccgccgaccacatcgtcaacggcttcgagggctcggcccctcggctcgcgttcgcccccgactccgacgaggaggggaacgccggcagtgcaagcgatggtggcaacgaggccggcgactcgggcgcgtcgggatgagcccccgagcccccgccaatctttacttttttctttttctttcttctaaggccttcatgcctcttttgtgtacaaattaacttaatctgcaatcagaaatgacgaaaaaatttttgtgttagttttattttgctatatatacacgatgaggatgatctgcgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaaccccccgagggcaaggttgaatacgagtgaccttattttaagttaagattcttcagaaggaaaaacggcacagacacaacctctttgaaactgcttttattgaaatgctgaaataagaaaagtaagactgtgcatgtgtggtagcccccggctaaccctgcacacccgaggggggtgcggggttagcccgagcccgaaacctgacacccgacccccccttcccctcaggggtagaagcgacgaaggtgttcgatgttccacgggttcggcagttcagtgccgtcgcccgtggccagccgtacggagcccggccgggggacgccgatcactcgatacggaccctcccacattggtgagagtttgctcaatccagcacgcgtttggacgcggcgtaagacgaggtcgtcgacgcagagtgatcgggcccggacgtggcgctgatggtagcgccgcaagctctgctggtagcgcgcggctcggagggccgcgcgccgccttcgttcttctaaatagtcgaggtcatctctgtgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgagcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggagaattccgttagccgcgcgccgatagagggtcccttctaccaacacgtagcgtttggaaatgcgttgtacgcgttcactcccttcgcggtcctcaggtagagtcttatctgtgaggtatgtttggatctcagagatccaagcaatcaatctaagggagcttgaagcgctcccttcgggtcccgaggcctggactccgacgggcctcgggggccggtcaggcgcatccgtctcccctaagggatcgggtcgcgccgacggctgggtaagcctttcttcaaaggcgcccggtggggtctgggctcgcgaggacgcgagccttgagagttcatcggcaactatgttatcccttctgggtacatgccgaagttctatcccatcgaaatggcgttccatacgccgcacttggcgtacgtaggcgtccatctgtgggtcagagcaccggtactccttacagacctggttaacgactagttgggagtcgcctaataccaagaggcggcggatccccagtccagctgccactctgagtccggcaaggagtccctcgtattctgccatattgttagtcgctcgaaagtcgagacggaccaagtatctgaggacgtctccgttcggagaggtcaacgtgacccctgcaccggcgccctggaaagacagagaaccgtcgaactgcatcacccagtgggcggtgtgaagcagctgagaggggttcgtgctggcctcggttattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctaggggccgtacccccggggcgttcttcgtccaagtggcccctcgggtcgcactcgtcttctgtgccgatgacctcggggtcggaggacgacaggagcggccttcccacagtggcctcggggccgtcctgggggttgggggctcctggcatcgtcggacaagcgggcaaagggccaactccggtcgtcaggggcctctggcctccgttcggctcgggggcctcttctccctgctctttcccgggtcgaatcagcacagggctagcctcagggtcaaagggtggtaggtgcggccttcccgcagtggcctcggggccttcctgagggtcgggggcatccagcaccgtctgacaagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgccgctaagtaaagtagcaggggctcatttggctccggggcgactagaactggaggagagctgagatacgccttcaactgggcgagggcattttcagcttcctccgtccgagtaaacggccccgagcgcttgaggagcttaaataagggtagcgccttctctcccagcctcgatttaaaacgacttagggcggccatgcaaccagtgacgcactgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagttttatgcgggcggagcggagattttcaaaagtttccgctagatctgagagtaaggtctcttggctgcgcgtttttacaaccaagtcatcgacatacgcctcaacattacgtcctatttggctacccaaagaaattcgagtagtacgctgaaaagtaggacctgcattctttaacccaaagggcattgatgtataacaataggttcctacgggggtaatgaacgcagttttttcctcatcctccctagccatgcgaatctgatggtaaccagagtatgcgtctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtcttgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcaaagacgtcagcgtttgcccgcaggaaggagacgagcgcgtcttcctatttgccatccagaagaccaccgatccgtgtggtcttggacgggccgtcgcccaaggcaacctccttgaccgggacctcgtcgcatgtggcaatccgctgcctcggggcggtgggggcagaagggccaagcctctcgtcaccaccctcgggcttggacgctgcagcgaggcggtcggcgcgctgctccatgcaagcaagcgcgactttaagatcgccatggacagagatggggccaccggggcccggcatcttcatctggaggtaggcgtagtggaccgccgccatgaacttcaccaacgcgggcctccctaggaccgcgttgtagggcagaccgaggtccgccacatcgaagctcacccgctccgtgcggaagttggcgggtccaccgaaggtgaccggtaggtcgatgtgacctaatggccacgtgtgccccggcgtcacaccgataatcggctgggacggttggagcaccatccccggggccttgatagcatcaaaggccgcgggggaaaggatgttgagagccgctcctccatctatgaggacacgccccaacttcacattgcagatggtgggagaaaccaccatcgcaatctgccctccccgggcaacacacggtgggtggtcggtctggtcgaaagtgagagcaacctccgaccaccgcgcccgacgcatcgcctcatgagtaggggccatggccagaagctctcgcttcatagccttgaagctccggcgagagacgtgagcacatgctcctccatcgacggtggcaatggtggccccaggttcttggaaacctaggtcatcatcgccgtcatcgatgtcaacagcgggggccttctgcttggcctcacttcgccgtttgccagaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctactgggagtaccagcctctttctttttgtcgctcgcaggcctcccctttcgagtggcccgcggagcgccctcgacggcgaggacatggccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaacccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcgcggggagtacgccggttattacgccggcgctcgatgtcgatgcgggcatccggctctccacgctgatcctcccgagttggaggtgtcgacgagggagtggcggccgaatggcgcgcagcagccgccgctcgccgtgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaagaggcgacgctccccatctcgccgttctcctgcatcacctgcgactggtgatgccacggaattgtcgaccctctcaagcgcctccccctgctttgggctttggcccggaggaggtgggggagtacaagctcgacggcggggattcggctccccgtcgtcgccgctcacactcgaggagaggtcgtgcgcttttccttgctcggccattaggctgaacaagaaaaacttggcgcacacggaagagtctgagagctcagaaaacacacactgagtcccctacctggcgcgccagatgacggagctcgtagctcctcaccgggagaccgcgcaggcccccctttgccagttcggccgggggcttagggtgaaatctcaagctctctcggtgtgtggaaagatcatctgcccgcaagaaaacgcgagacaccggcgatgtatacaggttcgggccgctgagaagcgtaataccctactcctgtgttttggtgtatctgtggatgaaaaagctacaaagtgtgagccggcttccccccccgttctaggctctcaatccggaaaagaatcaaccaaccccccactctaaggcaaggttctccttttatacttcaaggggataccacatgcacccgtttcttttctaactggactggtttttttctctttaatgggcggagatcggtatggcttccatccgggagcccttttgatgggacaggccacacctacctccacttccggcggagacaggcgcaacgtgggatgtggtgcaagttgctgatgcgaccagtgtcagaccggtcatttttgtccacacgtgtcagtttaacaacggcaagtttgccctttttagtgtaacaccttgcctgccatggttaggatgaagnnnnnnnnnnnnnnnnnnnnnnnnnnnnnnnnnnnnnnnnnnnnnnnnnnnnnnnnnnt

SEQ ID NO: 52968 - DNA, 4340 bp, Oryza sativa
  unsure (1)..(4340): unsure at all n locations
cgaccccccctcgggggaaatcaagaggagggcggacacctcaccctcgggcccgacgcccccgaaggtgccaggccacgtgggcgattatgtctgcctcaagcctctggtcatgatactcccggtcccatatcaccgacaccgtggacaacgagacgcccgtagcgacttcatcaatctcaaaatatactgacctagtcatccggaggtgctcataagagtagggtgtgtggtgctcatatggataggatatgcatatatgggtttaggggtgaaaacggccacagaaattcccgatcgacttagcgccgtttccgtataagtggtacgggctcataagagtagggtgtgtggtgctcatatggataggatatggatatatgggtttaggggtgaaaacggccacagaaatttccgatcgaccgagcgccgtttccgtataagtggtaccgtttccgaccataccatttttgggtttttttaattttttttatcacaattctttatgcattatattaatgtcgatactgagtagtttaaatgataaatatagtcatttaccgactaaccaaacatcgtttctgaagagatgctaccgattccgatagtttctgaccgttttcacccctatatgggttcatattgataagtatgtgcgtgttgcgatcgtctgtatatgtaccgtgtttctagaaaaaaatatgtagctaattttatttatgtatctagatcctaattttagccatattttggtattgagggatcaagtaaatcacgttctaaattcaacaatacaaatttttgtttgtcaatattcgataatttaaaaagttgcattcaagaacaaagcattgctcatattttcggctacttattctttttggtggtggacgatgtcctggtcaacaacaaaagacgtttgtggtaattaacttcatcaacctgaagacatgtcgatgtcgttttcggatgtgctagtacgggtaaggtgtgcatctgtgttgataggagttgagcgtacatgcataaaatttgtaatatgagcgcttgcatatgtactatgttttgagaaaaaaaatccccgtcatgcaaacaatcaattggtaatgctccttgtggtgaaatttggccacctgctagttcttaaacttgccacgagtacctgcattaacggttaattaattttagtgctaggcgcctgtatcaatgtcaacaatctcaaatatgctcgttcagtcttcaaattgttcaaagaagtagggtatgcatgcattgtgctcactgctcagcttttgaaggtatccatgggacatggtgtatccgtgtatgtgtgtgtttatacagtaaactaggtgaaaccccgtgcattactgtaagagtttagtatgatagtaataagtggaaataatgtgtaagataggtagacaacatgagcttacataaattgatatgatttatgataatttaagtagtatatagaatgatgataaggtgatgtgcctttataagagaagaaaagaagatcaggtaatttggaccatagcttaatcatctatgggataaaaaatgggatgatatggtctaatgagagaagaaaatgagaaaataacttggtccataaattaatgatctaatttgatgtgatatgccttaatgagataagaaagtaataacattaactaagtgatgatgaactatatatgtatataggatattataaaatatgattgagagatgtatttaaatattatttgaattatgtgggatgatgatttaacatctttatattttaaaactctaaaatttaatatattatagaattatagataatataatatgcttgcatcatgtttgagatttaataattgttagcgaataataatgtggtatctttgtatgttaagttttagaatctagtcgattgtaattctataagaaggtaggatgtggaaaatgcttgtgatctgtcgtccgatgtagacaaataaaatgaacgcagagacatctccccatgtgcatgtgcatgtatttctctctcctctcatccgtgagtatacagtacctatgatgcatacaatatctgctaattttatgtatgcatgagactataaacgtaagctttaaatatctttccctcaaaactacttatccaatttacgatataattgtaccattatatttgttgtaattaaatctttacaataagatcttagtcgattatattctaacaaaaaaataaaaaaatatgttttaggttgtgaaaatttaatgtttcatatgtcaaaaataagtgtttcaattgaaatttgattatgttgcacatttaagttttgtgttgcaattgattgttttttaagtgtttgcacatgatgttattcgtatgttttaataaatattttatgatgtttcactaattcatctgaaaaatgttgcatgtagtgttattaggctatttcaataagtatttttatgatgttttactgatttatttacacttgtttcacacggtgttatctagatgttttagcaagtattttgtgacgtgtcatcaattacagcttgttgtttcatttataatattaaaatattgcaataagtagtataatcatatctgtatatttatagtaaatataattgagtaaggtcttgttataaggatttaattataaaatataatggtgaaatcaaatcattgataggataagtaatttaaaataaaaatagttcaaaattttatttaaaatattgttaaaaaagaaatagagatgttacatgtagcatggtagttcatatggatatgcatgtaacctgcgtaagcgttcgtaccgcgtttgagaaaacctgtaacataaagtccaagttcctattttcatgaatagaattcaataagtcgtggtttttatgttggtgtgtccctcaatcaatttggttatgtccttcatatttcgttgtgatgtgattggtttggtctcaaattcgataataattggttctaactatatgagcagaggccgagattttatctagaaaaaaatcgctgtttttctatgctgctgaatattcgctgatctttgacctcgaagaaatacggagtagtagaaaataaaaagaaatcaggagaatatgatccaccattggcagccgagcacgtctcaacacgcacgggacgggacgccatcgtcggccttccgctgcggactccaaaacgcgtataaatcagcgtgcatcgacccacccatccggctcgactcgacccgactcaatcgatccatcccggctcggctcagctcggctcgagcgactcggctggtcgtcttctctccaggctccggagccaccaagccagatcccccacagtatcccacggtcccacccgccttgccttggccgcctccctccggtccacgaatcgccgccactttaaccaagcctccttgatcacactcctaatccgatagcttaatctcgagcgcttcgagttcgatctctcgtgaaggggacgacgagggcattgtctccctcctcgcgcgcgcggagtcgccgccgccgccgcctcgtcctcggccacgcggtgagtcctcgcgccgacctcgccgttttggttgcgtttttttttagttttctctgcagcgggatttggagacgatgggtgtcgctgtgtgtgctgtgaaatggggatttgtggtttttttttttggtttgtggagtacgagtacgcgggggaagtttcgaggtcggttgcatccggagctcccgctggagtggtctactctagtgcggatttggaagcggagaagttggagttggaggtggcgtgacggatcaagcggagtcgcgatcgctcgccggagccgtgcggattccggtgctagcgaacaacggcggcaccgtcggcgttttgtagcggtcaagctgctgctgctgctcggaatctagctaggtttttgttctgtcctaatccgggtttcccgattggatttgatggtcttctccccacgcatgagagttggttagcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 52969 - DNA, 878 bp, Oryza sativa
  unsure (1)..(878): unsure at all n locations
cctttagctgatggttctatggttgtgcattctactgagtatgatcatgatcacactaaacttttgattggccgtatgataattctacatgattacccatttagaattgttgagcataaagggtttaatgccttgatgaagtggatgaatcctagctatgaattcattggtcgcaaggccataaaaagtgaatgcatgaaattgtatgaatctgaaaaggaacatctcaggaaaagtcttagggaggctgagaccataagtttaactacagatatgtggacatcaaatcaaaaccttcagtatatgtgtttggtggctcattacatagatgttaattgggttttgcaatgccgtgtcctaaactttgttgaggtggagcctcctcacaccggtattgtcatagctcaagctatttttgattgcttggttgattggaaaatagaggacaaggtcatgacaataacccttgataatgcttcaaacaatgacaccgctgtttcaaatttgaagtctaagcttgctgctagaaagaatgctcagtttgatccagattatttccatgttcgttgtgctgcccacatagttaatttggttgttaatgatggcctgcaacaaattcaatctttgataaccaatgttaggaacactgtgaagtactttaagaagtctccagcccgtatgtataagtttgtgggtgtgtgcaacacttattcaattaaagttggtagagggttgtctattgatgttaaaacaaggtggagttcgacctatcggatgctagagacatgcattgagtatagaaatggttttgattattatgctgggggatcccaaannnnnnnnnnnnnnnnnnnnnnnnnnnnnnnnnnnnnnnnnnn

SEQ ID NO: 52970 - DNA, 1098 bp, Oryza sativa
taccccatacccacacggcatggttatccgactagttataggggataacttatatatatgaaatatgtaacagattatgacttgggtattacgtttccctgtatattatggaacggcctaaagtcctggtttgataagattgtaaagtagatttagtaaaccgataccgtgttggttaaggtttctatcttgtaatcctgccccccatcctatataaggtgggcaggaggccctctagggggcatgacacaactagatcgtcagatcaatacacacccggcggattcaaatccccaaacaggagtagggtattacctctcattgagagggcctgaacctgtctaaatcctttgtctccgcatccatccacttttagggctcgtgcgctaccccttttattattgccgaaatctagtttcgacagttggcgcgccaggtaggggttgcgtcgaattacctgtcgaaaagtgcgatggaatcaacttcagaagaagcccggagatcaatctcatcaatttcgacggctcaaatctttaatcgggtttatcgttccaatctaatttttattagattgatttttaatcgttgtttgatttcctgatattttgatgcatttcatatactcgatgagatcgagacacggccatcatcgtcgcctgctcgggtgcccttgccgtgtccgagtgctcctctcttcctttccttgcagttggacgtgttgctggagtagcacaggccgccaggagcaaattaaacacacgcatctgttgatttattaatcaacacgtatatgcagactggaattaatctactaattgctttctattgcatgtacacatgtgccgttcgattcctgtttccatgtatgacagttgatgtgctccgccggccatctccgataatggcgtcataccgaaagaacatcgagttagcagttagttgccggggcttatacatgttgcatggcgcgtcgccggctatcacccacgatccagcctcactgctcgacttgagtttttcgtttcaatttgttatcaataatcaatatatattagattgatttgtaatctcagataaatttcttgatattttgtggtg

SEQ ID NO: 52971 - DNA, 898 bp, Oryza sativa
ctgcagccctggccgtcgtcatggaccgcggccacgatctcctgtagtagcggcgaggccggcgggatgtgaagccgcccgtcgtaggtgaccatgtccgtgatcacggcccacggcgccgcgcgcgtgcctgcacggacctcgtcgtggatggcgaccaggctcagatccgtggcctggcgtggagcagccgctcgatgaaattgaaacggggcgcggagatggccaggagctcgccctcctcgacgtcgcggcgggagagggcgtcggcgacggtgttcatggcacctgatctgtactccaccgagaaatcgaagcccaagagcttcccgacccagtggtgttgcggaatcgtcgctaggcgctggtcgaggaggtacttgaggctgtagtggtccgtcttgacggcgaaacggcgtccccataagtacggccgccagtgccgcacagcctggacgaggccgatgagctcgcgctcgtacgcggcgagggcgcggtgacgaggggcgacgggtcggttgaagaaggcgaccggatggccctcctgagtgagcaccgcgccgaaaccatgggacgacgcgtcgcactcgacgatgaagagcttggcgaagtccggcattgcgagtactagggctgtagtgaccgcggtcttgagggccgcaaacgccgccgccgccgcatcatcccaagagaagccgtctttcttgaggagggcagtgagcagcgcggcgaccgtgccgtagttgtggacgaacctgcggtagtagcctgccaagccgaggaagccgcgcactgcccgaggcgaacggggagccggccagtcccggatggcctgcactttggacgggtccatggcgacgcccgccgccgatatcacgtggctgaggtacgcgacccg

SEQ ID NO: 52972 - DNA, 749 bp, Oryza sativa
cacgcagtcgctgacgcgtctcctccttggcatctgacaagagagaggggtctgagaggcgaaatagataatgaggagcgaaatagataatgaggagagagatctgaaaggtgggccctatcaactttttaatagaagaattgttgactggactgccacgtaggatcaaaatcgcttataaagctacccgtggtggttttttatctggtattgatagttaagggtgaaagatgtttggtttttaggtctagaggggtaagtcgtactcacccaaaagttcaggggtgtaattcaaactttttcttttttttcttaggtagtattgtgttttatttgtaaatttcatttgaggtgaaatgtcaataaatatactgggaaaaaatggaagccaaacagaccagaagaaaaaaatacataaaaaaaaaaagctgagccgacgggaagtggaaaaaaggaaagcagaagtctctcgtttattccaatcttctcagtctctctattccccacgctttttacaagcgtcggctcacctttccttttactttctctatcgacagctctatcccaggaagccacaaagccagctagcaccaccatggttttgcctccctctcgaacagctccacagcgaggtgatggtttccttttccattcctttgatctggagtggatgggctgagaacgcatatgtttattttctctttttacttttctttttctaggatttctggtgcttggtgaacagtgtg

SEQ ID NO: 52973 - DNA, 1830 bp, Oryza sativa
tcatggaaagcatgtcctcagtttcggggaaaggtgattctaatttgagctcgaaattgctcaccaggtggctcaaaatcacttttatctgctggtaggcgtagccctcgcccatgcatgcatgcttcccggcgccgaacgacaagtaggcaagatcacgggcgccggcaacggccttgtcctccgccctcccggcggcgaaccggtccgggtcgaacacgtgagggtccttgtagatgttcgggaggagggtgttgaccaccagggggctcgccagcaaccgcccggcagggacgctgtactcgccggcttccttgtcgcgcacggtgaagccccggcgcgcgcgccggaggatcatcggcgtgaccgggtggagcctcaacgcctccttgatgcagcggtgcaggacgtccatctgcagcagcaccccgtagtcgatgccaccgccgccgccgccgccatggtggctgcgctgctgctccgccgccgccacgagccgctcctgctccgccctgacggcgcgcaggtgctcggggtgggtgagcaggcgcagtgccgtccagacggcgaccgtggagctcgtgtggtggccggcgaagagcagcgccactagcagcccggtgacctccgtgtccgtcgtggcacggccgtccccgtacgtcgagtctatcaggtcctgcagcatgtcgtcctcaacacgtccagacatcttgcgcgtcttgacgatctgggagaatatctccccgagcttcgcgcgtgccttgtcacgccggcggtgccccggcgtcgggaggtaagggaagaacatgctgatcaggtgcatacctcccatgagctcgtgaaacagtgaggcaacctcgtcgaacatgttctcccggacctccttcccgagcaggcaccggctcgcgatcagcatcagcacgtgatccacctcttgcatcagatcaaccacgccacactctccccattttccaaaatattcctatacaaaccagattagtttacggagatgataacagacatgatctgagctttgatttataggatcaggtaattgacaaaaaaaaaatgtacttgcctcgatctcacagaccatggggaagaacatggcccctcagttggcgagcctcaagccttttgggcgaagaaggaaggtcgttgcttccttggggccaaatcgatgtggttagcaatttcttttgccaagaatggccccgggtgacttcgtccaagcaatggatagctatctcaacttctgggcgtgaaaaaaaaaaaaagtggtcggagcactccggcccgacgaggaacgtcaccgcaagcccaagtgacctgagcgtaaacacgctgcccagcgccctgtgctgctcgcggatcacggcctgcaggcccctgcgcagcacggctggaattatcccaaccagaggagcacctttcgcctccggcggaggccgcggcttgctcgtcttctctgcagggagagttactgatgatcttaccaccttcgcagctagtgtaatgatgaagacgagggctatggtgagccatgcgttggtggagaatatgtgatccatgatcacaacccagctggagcctctgctttagtctatactacgctctaagaaacaaaattaactacggagacggatttcattcaatataaatatatagggccgtggggcggagaacatgtactgatccatgatcacaacccggctggagcctctgctgcctctgctttagtctatgctacgctacggaatgaaattaactacagagagagacttcattcaatatatagagcgtgggacagtaagttagctgtcctactaa

SEQ ID NO: 52974 - DNA, 1382 bp, Oryza sativa
ttaaattgtcagtttgtgtacctcggctgattcctggacgaggattttgtgcacaaataagttcggaaatcactagtgaatttctgggcatgacaagttggtatcagagccatctcaactgtaggataagccaaatggtcaaaccttaaggacaaattttccgaaaacatgatttgtgaaaaattttcctttcttccttctttagaattctttgcaaattgagtagttgttaaacttgatggagaaactcgaagacgtcgatgttgtcaacttctgcaagtccagtggatcgaggaataagaagatgatagtcgaatcaaagtgttccgctgtcaagatagagtgaagtttggaacctatcttagcacctataccaccaaagtgactttgaagaatagttagtagggtaaaacgttgttgcttgttttgtgtgtaggtacggttgcattcccatcattggtgtagttcaatgatgagcgtgtaattatactaggttgcttgcttaatcaacttaaacaatataatgaactacacacatcagatcagtggtaacttggttaaggtcttgtctttagtgtaacccctctcctcctaacttttccaactctgcaacgaaaaaaaatgcaagctatagtggaaacaacaacaatgctagtggatcaggaagttggaccaatggagcaatttaggacaatcacttgggcggagttcactgaagcattcaagaagacacacatatttgcaggagttgttgctttgaagaagcgtgagttcaggacacttaagcaaaaggatcgtatcgtgacagaatatcttcatgagttcaaccgtctagctcgctatgctccagaagatgtgcgtactgacgaggaaaggcatgagaagtttttggaaggcttaaaggatgagttgtcagttatgttgatctctcatgactatgaggattttcaggagttggttgacaaagcaattcgactggaagacaagaagaacaggatggacaaccgtaagagaggaaggattgttttccaggaggcacaggatagtagccagaggcagcgtatcaagccactccaaattggtgaatcttcttctgcaggtcaagaacagtcacaacaattggacataagtggtgagatcaactcagagactaatacaagcactgaagttaacatcgagcaagctactcaattagtgccggttgcgtcttcaagggatacagctcagccaccgtttcaaagcaagtagttttttttaaagccttagagtaattatcggagttatggaataagatagactgcagtttacctatttcctttttctttctagccgttccgaatctcgggacgagattctttgtaaggggggtagatttgtcacgt

SEQ ID NO: 52975 - DNA, 1162 bp, Oryza sativa
tcactgcccaacactaaaccacgttgcaacatgcccgtccaaaccacttgaactacaccagttcattatgtcatattattaagaataagactaatcacggcgagctggttgaccgctcaataaccatgggcacggctattcgaatgttttactctgataagaggtatacaactttacccataagacacagcctcacaacacgttactgtgcgccgacatgctaccatgacataccagaaagaaactgtgacagaacctttcgcataaccctccctaaccaagcatacccaccgtaggtttcacctccactccttaaaaaggcagtggacagtcccctctcgtgcctaggtaaatccagaaacagtagagaccagagccaagtccgaattgcaccatctcctctacccttgccatggtatgttgattaggttaggctacactctagattcagcctggagcccatgctggcctttgataagtatgtgtttatcttctagggactcccgagaactggtctttaattgtcatgggtacgacttgcaaaaccatgcaaccacaacccaccattaaagcatattttagtttaattaaaccataaccatggcggtacatcatcatataattaaggactaatttatagcgaatcccattgtgaactaattaaaagtgcatctaggcccctaatgattttgatgattgattacaatgcgattagagaggactaacacttttattcaagcaaatgtgaaggttgttatgtcctcgacatgttgtaatgtgatgcatatctcgtgaatgcgacatcacgatgcaatgcggcaatgatcaaatggtatatgtatcttttaccttgcattgtgtcgtaggaatgccgtactattaagaggaataccacatgaatataattggtagaacactagtgctcaaaatgcttcatctttgtgtgagttgaaaaacctaagccaaaatttcaatcccgagttgtttcacttgtcacaacacttacaccgggtttctttgcaagtttttcaacatctcttgaaggttttggaccatgttttatgttgggtttgatagcccacgaaactagctttccatagagtccaagatcttagaaatcggagttcggagtaaaaagttattgctttcttacttgagcaac

SEQ ID NO: 52976 - DNA, 752 bp, Oryza sativa
aacggaatcagccagtcagaaatacaatagtccataatacctccctagctcagcccaattcagcataatacctcccgtagtccataatacctcccctaacctagaggcttagagagtagagagtgaaggactgagagggagagtgaaggactgagagggacatcgaagattccagagctgagcggcggagcgacgcatccagatctcacgtcgcctcgtccccctccgtctgtttgaagtttttgtccatcgaagtttgaagctcagtttgagggtttcttgtattccgataaattttcgttatcgtatccgtgccggttcgttttcactccgttttcggtttcgataatattcaattccgttttcatatccggtgtttccgattctaattctgaaaaaaatatgaaaacgaaaacgataaaggtagtttccgttcgttttcataccgttttcatccctagtgataagggacaatttggtccaaaagagaatgacaatataccgaaagggtaagtagttacatatttccgatttcaaacaaatttataacgacatccttttaattagatggattgtaatggtattttttcaaaaccgttaatttatagagatatggattcaattaacccaatcaaataactctaattaacaaatgctaacataaataataattgtgttaattagccaaattaaacctttacaatttatgaaagtttctatcaagttattttaggcaaataaaaatgaatatg

SEQ ID NO: 52977 - DNA, 1056 bp, Oryza sativa
  unsure (1)..(1056): unsure at all n locations
aaataggagataaatcacattggtcatgcatcctcgcctttgatatgatctgactctcaatgctacgagcaagcatgaataggtgcccaatatgattatatgtcacattatcaagcaaaacctgaatttcagaattaagcccattgaaaaatctacgcgttgtattttcattgcactctttgagaccactgtagatgatacagaccttaaattcatgaatgtactccctaacagttctgtcaccttgtttcagatgttctaatttctcccgaagagtacatttgtaataagatgtcacaaagcgttttctcatcatggttttcaattcatcccaagtttcaggtttattactaacataagtccaccaaaataatgcagaagaggtaaacttattactagcagccttaatcatttgagcatcagaaaaatcatatatatcaaattcattttgtactgctagctctcaatcaatgtatgcaacagaatcatacttcccatcatagaagggtaacttagatgcaacttgttcacaattatagtcatgtacctcatatgcatcatttggagaagtcgtcatatctcgtggaaggtgtagaagttgatgttctcgtattccattacgcaatcatgccatggttagtaccaaacaagaaacacacaataatatgcatgctcctatcaactactaggtagtggcagctcaaatatcacacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 52978 - DNA, 716 bp, Oryza sativa
aagaacgaagtgcatggtattttaaaaatgatgtaacattttattatacacaaactataatatgttcgcacttattagaatatatgccattaacgatgattataatcctaaatttgtcatgcagtttttacaactgaagccttaaatttgttgtgtaacttttatgactaaactacatttctacgagtgtttccctgttttttaggtgtgtttatttataagtagacattcacttaagttacatatctattttttagcattcgatttttaccgattaacattttgtggttagctagactattcattcatttgtgcagacacaaggcagtcccactataggtctttacctccagttaactaaacgaataagcttgtaccaaatgaaatacagccaactaatcatataattagcatctgaaatcaaggctgagatggtcatatgcttgaataccctacctactttgggcatgacataggtatggccggcgccatcccttgccacaagagaaggtccgccactgaaactaacaaggatagctacagcacaatactcccaaaacaaagctgcaaagtaattcgacttcagacgaactttagtccaatccaggacataccttggtagagtaataattcccaacttgtttcttctcagcgttaaacctcactccctttgctatcatggagttgcacccaccacaccaaatattgaatggcat

SEQ ID NO: 52979 - DNA, 1129 bp, Oryza sativa
ccatccaaacttgctcctccgccatgattttctgctggtggaagtatgactcacagcgattaatgaatacgagcggatcggacttgccattatacttgggaaaatcaagtttctggaagcgcggaggtggccggtcggtgttggtctcccccatgcccgccctgggacctgaggacgacgacttgtcggcggagagtgcgaggattgccttggtgttggccgccgcggtcgcctggagggccttgacggtctcggcgagctgcgcgatggtggtcttgaggtcgtcggtgtcgctcatggcggcagcgcaggaagcggatgaagacgaggtaggggatgttggcacggcgggcggtgtaggggaggtggtgcgggaaggagaggatcgccgggatcgtgataccaggttgtcaagtgcctcggcacccaacgacgctggaccgcgactacgtagctcgtagctgcgctccagtcctcaccgcaaggttttgcccctcggctggtggcttgcgattagtggagagagagattaggaatgacaatctattggctgcccttccaacgagactgattacaggattatatggccactggcctaaccaattatagaaggctatccttaattctagggacaccaaaagtagcagcagatttcttctttcctttcttcagccactggacgtcgccgtcgcgcgctcggccgctcggcgcatgtcacgcctgcgcctgtacgtgcggccgtacatgacatctccccctccgtcgaagtccagctcgtcctcgagctgaaacgctgggtaccgggcgcggaagtcgtcgaggtcttcccaagtggccgactcatcagcctcgtcgcgccactggacgagcacctgccgaacgccgcgagccagacggccacgtgtgacgcgtgcacgttctggaaccaccaccccatggagagtacgaggcagcgccggggtggaagtgggcggcctgcccacaaacttgttgagcattcctacatggaagacatcatgaagacaggcgcccggcggaagctgcagccgcacggccacatcgttgatgacttccgtgacgcggatgggcccgacgtatatgaggcttcagtttccccgtagtggtgcgc

SEQ ID NO: 52980 - DNA, 1404 bp, Oryza sativa
tgcatttgcacccaatagagatgtcaaactgccatttcttgccatctaaagcagactagcaaattaactagaaggtttggagtggagtagctggcagtgaacatggaagctaggatctagctactaagagcaagtttaatagtatagccaactactggtatcaaatcatctatagtcaatctaatagtcaatttatacaatagttaactataaatatatattacatcactaataattggtcccgcatgtcatacacacacaatgttttggagttcgtgctgcaggtggctacaaatctgtaacccgcttgtcttctctctcctctcttatctcctccacgtaagcttgtagccgacttatagtctattattatatatgctctaatataggcaaccacgtgccaaagtaggtcgtgaacaagtggtgtgtaattaattgccaccacctatgtttttttatttatgatatcattgattttcgcataacggttaaccattcaccttaactaaaaatttaatataaatataagttgagattatagttttccaatgataaaacaagtaaaaatagatatttatattttaattaatatgaatggttatatgtgacgtcaagactcaattacgttatacattaaaaaattaaaaaatagagggaatacttattttgtttcgtattataagatgtttcggattttaaacatattcatgtatgaatccatgtatatatgtgtttcatatataaatatatgcataatcatacagatgttaatgagttagactataaatcaagagaccaaaacgtttataacgtaagacatgggagtagtatattaatgtattatcaagagatcgaatgaatgttgagtactgagtacagactacatgcacaaacaaattcagcacgcatgcaacgttggaaaataaaaatatcccagatcgaacaatagaggaagaaggcaagcaagcgtatgatcctgcttagctcaaaaggatgcgatgaacagtgcgacagcggctatcagcagtaagcacgcatcagcaaacggtcatctcgcccctagcaagttgcagttgccgtagtgcattgactacacagtggagatgtttttttttttagtaaagaccatcaccggtctctaaacttgtaccgctgtatcatcgcggtccctaaactcgtaaatcgaccgttcaggtcctcaaacttgttcaactgtgtcatcccggtccctcaagacgcatatcactcgtttagattctccaacttgttcagttgtgtcacctcggtacctaaacttagatttgaatatcatctgggtcaaataggacggtctaaagactttatatttaaaaataattcataactttttcatgtgaactctaataaaaacaaactttatatcaa

SEQ ID NO: 52981 - DNA, 8592 bp, Oryza sativa
cttcacaaatatatatagatttaaattcgacgtatacatgttaaaaaacactctcactagtatgtgaactattcatagccatgcgtgtttgtacgttttttttctatttgtattatttggacttgtctgttttattgagttatggagtatgtcacatttatctatggctgtgtttagttcccttcaaacttctaattttttcatcacatcaaatatgtttggacacatacatggagcattaaatgtggacgaaaaaaatcaattgcacagtttgcatataaattgtgagacgaatcttttgagcctaattacaacatgatttaacaatgtcatgctacagtaaatatttactaatgacagattaatttggcttaatagattcgtttcgcagtttacatacagaatctgtaatttattttattattagtatatgtttaatattttaaatgtgtgtttgtgtacgtcaaatttttattgccacatcaactaaacacggtctgtgtcaacttatcaatttttggacatagaaaaacaaagtgacaacggagaaaaatgaaaaactcttcctacgcactgaacagtgtggcagagagatggaagaggttgttgatcaagcaaccgccgtagcttgatgtgaacacgaagcaatattgtcagttggcgagggatgcactgatgactatgctagtgcctactagtaaccagtatactcaatgatacttgtgttataaaatccctaatgctaaaattcattcgagcacaaatcttaaagcaaatcgaatgctgaaaatttatatagtgaaaaagaaaatgaaataatagttgtaagttaggattaatctcacacaaaatctatatatcgtgcactgtcgtacaagcaattccactgcacctcttgtgttagtaaaacccctaatgctacacttgtgttataaaaccctgatgctagaattaatttgtccgatcacaaatcttgaagcaaatcgaattttaaaagtttataaactggaaaaggaaatgaaataatagttgtaagttaggattaatctcacgcaaagggtctcatcttttcgcttattcttatacttatcagctaaaatttaaattttcaaccttaaatttggagctaatttaaggtttttttcatcgaagtttattttttagtctttgcttttttattgctaagtacacgtatataaaagttttatttacaaattactttttttacaaatataccgtttaatggctccggaaaaatatatatcgtgcactatcgtacaagcaactcctctgcacctcttttctttaaaaaaaaaaaacaaaacatcatctgcgtgtttactcaacgtgccctcgcgccatcaacacaaccaacgtcccattgccaccttttatacttctaccttcttcagtagttcatcaatgtcgcgagcaccccaagaaacgtaggatcatccaagcaaacccgccaccacctgccggccggccatgggcggcggcggcggcggcacgccgcgcagcagcatcggccacatccttcccggcgccggcttcgtcgccgtcggcgtgtggcacctgttcaaccacgtcaagctcttctcccagcgcccggacacctacgtcgcgccggcgtggttccccgtgccgggcgcgcgctacctggagctcgccctcatcatcgccggcagcggcgtggagttcgccatggagatgttcgtcggccactcgacgctcctccccttcgccgccgacgggtccatcccttccgaccgcctccacaaccacgagcacgccatcatctgcctctccctcgccgtctacgcggccgccgcgctccacctcgaccgcgcccgcgccccggcccgcggcacgctcggcctcctcctcgtggcggcggtgttcgcgcaggagctcctcgtcttccacttccactccaccgaccacgccggcgtcgagggccagttccactggctcctgcaggtggtcgtcgccgcgtgcctcgccacgtcgctgctcggcgtcggctacccgcggagcttcgccgtcggcctcgccaggtcggcgtgcgtcgccttccacgggctgtggctcgccgtcataggcgccatggtgtgggtgcccagcctcgtgcccaggggctgcgagctggtgcgcgaggacggccgcgacaccgtgcgctgccgcagcaaggagagcctccaccgcgccaaagcgctcgccaacctgcagttcgggtggtacctctcgttcatgacggtgttcgtcgtcgcactctacctgtacgtgagcaacaggtaccccgccgcagaggaggcggcgtacgcgccactgcagaaagccggcgccggagacggtgacgacgacggcgatgacgacgcgcacaagggtggcggcgccggcgtgcatgggttcgctgcgttggagatagaggtttgattggcaaaattgtaggacagaggtttctgtgtgaagaggattttgatcgctcgggggatatcccttcgttttttacatgtcacttaaatggttatgaaaaaaatttaaaaaaattgagaagatgtattaacatgtgatatatcactctataaatattcaagtaaaaattcttctacatctcgcaacgaaaaaaaaaataaatttgactctgaatatacgttaagtagctccggtttaatttgttttcttcgttacaagatgtagaagttaaatttttacttgcatgtttgtggagtgttatattacatgttaatacacattctcaattttttttcaaatatttcataaccatttaagtaacatataaagaacgaggggatatcccctcgagggattaaaatagtttcccgtttctgtgtacagttgcttgtattgatcgatcaaagtgcaatgaatttcgtttgaagaatggtgaagctcctataaaaattcatgattggtttggaatttggaaacatattgtacatatatatgaatgtgtttgtgtcgtgctgagatcatgatttttgttttttggcgaaagagagataatgaattatttgtacggagtatgtgatttgctatccatcatcatgacgtgtgcccttagaaatgtgaaggtgtacgtccttgctccgaagccaagtcatatgatgaaccatcgatctaagaccatattagttccactgggcactactaatgcttaataacgaggaaataagcaatatatttgttagccctctgaatttctgaaataagcaaaaatgcatcttatacagtaatttttttaattactggattttacatggatttttcttctaatgtaaaatgtcataaaagtttgttttttattgctagtaattagtggatgactcgattatttttctagattagcatactgctgttttagcaccaatcttgatgtcaattcaatgcaccacaaaccgacgtatttttaaggaaaaaactgtcgccactattttagcgtttccgtttgagaatagggttagcgaaatatgttaaaccaataggacgcgtgggagagctcagccctacaattaattttacaattaatttatcgaatatctcatatccctgccgtagaaaatagcaatgcctcagagtcacttgtgctatatactcactccagtttcatatttttttttgatgttttggataagattaagatcaaaattttctaactttgagtatcaataacttcaaaaatatatttaatttaaaggcactagaataacatatttgtcttataaactactacaataaaattaaaattatatttatttattgtacataatataataaaaaatagttaaagatatttattttagagactgtgttattatttaaaacgttaagaattatgaaactgaaggtaatatggccatgctaacactaaacacattgcaaattacaataggcttgcatggccaaggaacctttagctaatagctttctgaatggccaaggaacctttagacgagtaggttcgctcctacatgaattccacaacaccctccattcctccaataactagtagcttttggcggcatactggcatgatgatatccatcgttgatcatgatgtgtattctttattgactccccacttgtagtcattcatatgtgttattcttcatttctttccataaggcctgtttagttcacaccaaattcccctccaactctcaactttccatcacatcacatcacatttaaaactttcctacacacataaactcctaattttttttccaaactaccaatttttctcaaatttctccccaattttagaaactaaatacaccctaagagtatttgtaacactacatcatagactatagccatgcatgtagcgtccccttagagttgagggatgcagggcccacagcccttctgggcacatgtcagcctccagtactatacatacaatactagggatcttaattcagagttgagccttgttggtagaggacaacacacacaaagagcaagggggtgtcatgtctcgtgtggtcttagagggaatcagcatgccttgcagaggagacgaatgctttaatttagtgagattaggtggagagatcgagcatggctgagcataccatcacaaaatgagaaatgttgtgtagaacacatatttaatcatgatatgtgtcacagatgcaatgaaagaagaaaccgaaggcaagccaagttaaaagaagaacaaattaaatcgaacgcaaagacatgaaaaatcaaagacaagtaggagctcataggccaaatctagtaaggacatggttagatgcagtactacaacgccgattgcgagaagtgatggatgagaaaagttcacggtaaatcatgatgggtgatggaacttgtaaagggacgttctcacctaaactagcggttaacggtgtagccatttagggggcgtggagaaaaaacaatgacaacacgttgaagctagattgctttactactactactccatctattttatattataagatatttaattttttcttagccaaacttctttgaatttaactaagtttgtagaaaaaatatattaatatttttaatacaaaacaatatattaataaaatatagttaatattaaatttaatgtactaatttagtatgacagatattactattttttttataaatttgattaaataagtttgacaaaaaaaaaaagaaacggagggagtacttcacaatgccaactagagccgtgtttagttcacccccaactatcctcaactttcaactttccatcccatcacatcgcatctaaaactttcctacacataaactttcaacttttttttctaaaattttaacttttttcaaaaactaaacacaacctagctgtacagcaaaggttagcttgaaaggcaaaataatgtgtcgttttttaggcggggaatgtgtcgtgcccagaaacgtctttcatactgctgtctcacatgtgatctgtactccaaccgtgtccatcctgaattttgttgctactaaaactcgtaaactcggcagcaccggaatggccaagcaggacacgcatgacgcagcacgcccacgctgagagtcgtgcagtgcgcccaagcacgaatctcgagggtggtgcatagaagctccccgcccaatcaccgcccgccacgtcgcatccccgttccacacccttcccttcccttcccttcccttcgccaccgctttgcttcctcctctcctcctcctcgcttctgcttttatcccactcccactcttcctcgcccccaccccaaaaaccctagccgccgccaccgccgccgccgccgccgtttgctcgagcatgtactactactcgctgcgaggtggcgcgtgcgtctaccttgtggcggcgtgatacgatacgacgcgtgcggggggaagggaagccgaggtttgacttgagtggtgagccgggcatggaggagaggccatagatcgaagggaggcgcctccgccgccgaaagaagcggcggcggagaaggtggatggctccccgcaaccccagccccaggcggagctgcggctgcggctcccggcggagatcgactgggaccggctcgacaagtggaggttcttcgtcctcggcgccggcctcttctccgccgtctccaccgcgctctaccccgccgtcgtcctcaagacgcgcctccaggtcgccccctcgcccgcgcacgccggggcgtcgtcgctcccgccctccgccgccgccgcgggcaccgccatcctgcggagcgaggggcccctcgccttctaccgcggtttcgccacctccctcgcgggcaccgtcccggcgcgcgcgctctacatgggcgcgctcaaggccacgcgctcggccgggggcccgacagcgctcgccctcggcgcgccagagcccgtggcttccgcggccgcgggcgccgtggcggggctcgccgccgccgtggcggcgcaggtggtgtggacgcccgtcgacgtcatcagccagcgcctcatggtgcaggggaacccgtgcccggcctcccgctaccgcggcggtctcgacgccttccgcaagatcgtggccgccgacggcctccgcggcctgtaccgcggcttcggcatgtccatcctaacctatgcaccctccaatgccgtgtggtgggcgacctactcgctgtcgcagaagacgatttggagcggaattggttgctacctgtgcgagtacggtgttggtgtccaagaaatcgatgccggggaaggggattcctccctgcagccgggttacaagactgtcatggtggtgcagggagtgagcgcggcgatggccggtggcgcttccgcccttgtgaccatgccattggacaccatcaagaccaggatgcaggtcatggatggggaaggcggcgagccgattacggtggggaggacggtgaggaggctgatcaaggagggtggatggggagcgtgttacagggggctcggcccgaggtgggcgtcaatgtcgctgtctgccaccaccatgatcaccacgtacgagttcctcaagcggctctccgccaaggggcatgagagcagcctcccctgacgagacgaatagatgatgcaaataggtgaccttgctttgttactttcattcctttccaatgcttgtttcatcttttaggtgttgcaaagagttgtttgtagatagtctttgtttgctcctctaattaagctaagcaaatcaatgcaatccactctttcagaatgttttctgtgctatcaataggttttgccttttagcttctgaatcttcacaacggagtaattcatgtatactgaaaaattcctgtccatctatataaacggctggttctccatgctgcaatgttttactataagaaattaagaatcatgctcattgtattatagctacaacctaaacaagcgaggtgatttggaaattgtgatggcactgatgtggccactaacagtgttgcacgttaaatccttaactctgttgaataacagtattgcattagcgagtttctttaggatgacaaattgaattattcaatcaaatgatttgcaaagacgctgctttgttactgaatggtagagtaaacatgtttaatgttgccatccaaagctggagctgattctggtatagtggcatgggctattgttgcctattcgctgctctgcaaatccaacttgtcatgcaggcacctgttccatagtccataccactcttggatggacaaaagctcatttcattctcttttctctgtccctattctgaagccacaccaggaatctgaatacgttgagtggcacacatacagactaggatacagtactaacttacacagatgcttttgtgcagtaagttgcaagtgatctctattccacacatagcaatgaacaataggcacaaggtatgcatggattggattggtagaggtgttctcatacgccctagtgcattgctgctcctggaaacatggaagatctgctcatcctttttcaatgttctcccatttgatgttttatgccttttctgatttgataagtatgctaaagttagtgtggctgaggaagtcttttcttcgaattaataaatactcgcagttgatgctgttccaactaaatgcattcttgcccgtcctagtttaatgttgattaggaattagtacaagcaaatctcccattttaataattataaacttttgcccatgatagtgaggcgtgtgtttatccattgtttatgctatcattatcttgatgatgggtaggcagaaaattaggtagccttctttcctattaccctgtttcttaattgttgctttgatttggatgagttcctctcttggttcctccacttctactcaagtctactactccactccgtactacatatcagaggatactcttggacttagattggtaccgctgccctatcttcatctgctatcaggaatagtaggatatgccttatgtttctgtatgttttgattagttgattaccacagtgccccaactctgtaatcctccaaatggtgcttttgtatatggtaccgaaccaaaatcttttgcttgacgaaaatgtgtggttgttggctaatgaaaacggctttg

SEQ ID NO: 52982 - DNA, 3093 bp, Oryza sativa
agctgacaatactacaatcactgggtttcagaccacagaaaatttttttcaggaaacattgtgcttgcttccatcagtgatcagtcaccatgattagcaccaggaagaagccgataatagggtctccgactccagctccagatgtgcgtgacatggacgtattgctatctgctgctttgccttttttttctcactactttttgttcactcgcgtagccatcaatacatcacgaagtggttgcgagccactggagtgccaacttgctttctttatctgttggccaagccacactgagcttgtgcaattggtcagtttattaaagagaaaatttgcatatggccgatatgatattttgtactattgtaataccattgtctagctaccatctaaaaacttgcgtttggtgggcatgacatttcaatattccatatttcacataagctcgtgaaatgggacaaaaaccaatttcaatttactgatgaagagaaaaaaataccaagtactggtgtatggaacttggaagaaacacttttggttttgcaaactacaggttcagggaatatggaatttctaattattatttttctaggctaatcactctacgatagtcttgagttcctcaacaaaagcttcctgtccaaagcaaaagccaaaaccatgaaaaagaacatgtgaatttgccacaacaagagcctaaggttagtagtaacaaagctttaaaattaagctcacatgcatgcacaatcagtatcaactgagacggctgctgctgcccgcaaagggcgtactgttagtgccaaatgtacaactctggattcattgttcgttgaagaaccacttgtgtgtgtcgcgaggacaagttctttttttcatctcagagatactgttcatgtatcctcgctcggttttcttcccaccatagcctggcatgcatctcgctgaacctctctcggctgcaagcaagagagaataattaagtctctttccatgatcatctgctagtagctagcaattcagttgcttccaaattcttcgatcatggagattcaagcaattagcattaggctgttcttgaaatcagattactgaccttttctactttgtcaatttacggattaccaacaagacaatcctatttacaaagaaagacgttacaagaaggatgggagacaaacctgaatcgaacacgccggagttctctgataccaccaggcaaagcccggatggtaatatatacaccaggctcgtcttcctcgacccactcccgctcttggtcacttgcattgctgatggacaccgagagctcaccagatctgtcgacctcttcaggagatgagctcgtcctcattgatgcgtccattgacgaggtttctgtcttggctccacttatacttgacagcttcggtgttgagaccagccccactgaatcatagcactggtgtccatggtggtggtggccaccattacagtagtggtttgaatgatgctcaagagaatctgatgaagatgaacccactgcaccaccacctgacaatggtctatggaacgaacgaggtaaccgttccttccccagtggtggtgtcaccgggctgtcctcctttgagctctgtaggaaaagaaaaaatagacatggaatcatgtcaaagtcacattactaactgcaataactagaatggtaacttgggggagtgctagtgtcgtcacctcgtcttcagattttggagtagcaggaagaggaacagcttgatggttaaatctctgtacattgtaaagctccataactttgtcataattttcagcccaccatctttgtgcttgccacttgttgaacatctcacggctataataaaacaattttattcaccaaacagaatcagcaaggtaatgttacagctacaaacaatttatatatgatttttttttcagatatgataagaaagcattcatacgcaaatatagattgccttgcttacatttggattcacatactaattagttatacattatctcatttagactagtttcctgcaagccacgctattatacgaagtaaataaatgatgatgtatattgtgaggactgatgacattctgtgcgcataatcaaacaatgagttaagagataaacagcatggcataacttaaaactactaaagtacatgatcagtcaacaagtagctggaaggttaaaattgtacgaaaatcaaatcagagaaatttatacacaatcagcctacaacatacatcaacgaaacaatgattaccatgaccacttgcattagtttcaccaagaacttatgcagagaataatttacaaggaacgagctttgaatggcctgaatagaaaaaggaagatgatatttaaaaatcaattaggtgaatcagatgaattcattttcaatagtacagtccaaaatcgatgacattccacgcttcagttttctggctcataatcatgatttaagcctgccttacagtttcctaagttacatcttgctctacagatttctaattggtcatgtataatttacttggtactgtggtgactatgacagattcaactcagactaatagttgcaacagaaatccgcaatcaactgcacaagtggctatgcccaagaggtaaattggtagtctaaaagcacattaatcaactgaccaaacgtctatgacaacattagcagccaaaccaatgttaccaaacccaaccatggatccactcattaacaaattttaaaatgtccctacttgccttagatctagaactaataataaagtaaataacaagaacactgcactcatcttaagatccagcttgtgttccatcaataaagtagtattctatatctaataccagtgggggctgatcaacgtagctggccatgaggaactccctccaagaatattattttaacagtataccctgcttatagacaaatcttaaaacaaccattctaaactcaatctgaacactacaaatttataatgggcatattttcacatgcacaattttcttttatagtgtccagattaagtctgcagtggtagtttttaagatctcattacaagtgcagcagcataagaaccaaaagt

SEQ ID NO: 52983 - DNA, 5060 bp, Oryza sativa
  unsure (1)..(5060): unsure at all n locations
atgaggtccattgtcatagagttgacaatcaaggtatcactttctaatgtaatctccattaaccctacaccagattgttcccattatgagcataaccagccgtaaaatctaaaataataagggatttactatttagcgaatacgtaacggctatgaggttgcataggagtgagggaaaaagtgaagttaatatacagggtagcatatccaatggtacgggtgtgctttttatccaccctcgagtaaaaataggattccagttaagtaagaaattggggtgtacaagaattttaaaactcacacccctccatccagtgtttaaaattgacttacggcaatcagtataagctacctcttaatgaaattttccttttcaatagataaaacaaataatacaaatagaatgccacaaagtgtgaccagtagtaaactagaccacgaaaaattattgcaaaaggtaaagaaggaatagcaatgttgacagagcaatcggaaaaaaaaaactaaaacatggctagttgaagtatgaagatttaacaatctattgtgctgttctccataaattgccagtgccccgaggcaatgatcaatgaaaatttactacctcatccataggggcttgggagaaattactgcctcatccataggggcttgtttgattttaactggctatcaaaagtcaaaactactcgcttttgtccagtttgcttcttgactaaagaagcaggttcagaacaaagctcctaagcatgacatttcgcccccatttacaccgcaaagttactatctcaattcaatatactttgatctaatttatatttagcacgaccagaattcaatcattcatacgagcgcaaactaaactttcaatcatatatgctaaggactaatgccaattagttgaattttcagtctttcactgatcaaagaacccaattatgcactggaaatgcagaatttaactcgagcatgctcaagaacacacctgaaccggatgcgtttgaggtcgttgccgccctgtggcagcgagacgaaggttatcagcacgccgggctccacctgcgccacccactcctttgcgtcctcctccttgccgccgccgccgccgccggcgacaccatctcgtcgtcgtcgtcttcctcctcatcctcctcgtcgccgatggggaagtcggagcgggcgctcatggacggcgtagcgtccccgttcgacagcgcggccgccgccgccgccgccgcggaagcgcggcgtcaaggccgccgagctcgtggcgcggcggtacgcgtagtggaaccggtcggagcccgaggccgcgtcggggtcgacgaagccgccgccgccgccgcggtggtggtacgggtggtgccggcgcaaggcccccgccgccgacgacgagccggcgcagggcttgcagtgccggtacgcgcccgacgccttcaacgcaatgtccttgatctgaaacgaaaccccaaaacaaaaacctcccgtcaaaatcaagcccgatctggttgattacgacctacccgaaccaaagattcaaacattcaaagagcttgaacatcccaaaaaaaaattatataccacgatcaaaacgaagcaaaatctgaacagaaaagcaggaacccttcagaaccaaaaccatcatcttctcttttcttttctttttcattgaattaatcaacaggataagaaaagaagagcttcaagcacacacagtgacagtctcgactctcgagagtgaagtaccgagaaccccacctgcgcagtgagcgccttgatggccagccgcgtgctgggcgtcgccccgccgccgccgccgccgccatcgacggcgtcctcgtcctccggcggctcgtgcagcggctccccgccgccgccgccgggctgcttcgagcacgcgatgcacgtgagcatcccctccgcctctccggtgacagcaacagcaaggtcacaggtggcagagccgcccgggcgagcgccgcgcgtgagcttataatggcaggggagggaggcggcggagccgtactactcctacgcctcttcttcctcctgngaaaaggagagggaggtgaagggcaaaaagggcggaataggatnnggggnnnaanggcaggaagaggggnaggancncnantnnnnnnggggggggggggggtttatttatgagcggcgcagcggctgctcacagacgttactgctgcctccattaaacagcggtcgatcgatccatcgatgcagagttctctgacacatctcatctcggatgcgtggtggggctcacgtgcgcgcccgtgtggactgtcaaacaggaagttgtgtgcgggttgtgacagtaagaaacctttttgtgtttgcaggtctcttgcacgttagtgaaaaaggaaagaggaagggagagaaattggtggtggtactagattttggtttatatggattgagtcactgtaacaatatttatctccttttggagaagtagatcctctaatgtgatcatagacatgtggttatgtggatgatagggttcacgtgttaacgatcacgtctctccgatatgagaatgtcactgcatccccatccatttcatgtttggcctaataacgtgaaagaaaatagagataacgatgaagaggatgattctagcaaaggcaaaacttgaagatagcatcttcgttgctgcacacatctctaacatctttgctgctaagcacgtaataatcgcacggtttatcatggtttttaaaaaccgcacgtaataatcgcacggttccgatggaatagttaatatggagtagaagcatcagccgccccgtaaacttcagaaatactactccagtccggagacggcctaccgggcggctggccaccgcaactctgacgtctcgaccaacaggattccttcggcaacgtccctaactcccaagcggccaagccctcaatcttacgaccttttttcttttatctcgtatcccgtgtgcccgccgcccgcgcgtgggtggtcgtcctccatgctcatcccatcatcagccccgtgcgcccgcgcgcccgccgtccgcgcacgcaccgtgtcgccgccgactcacactacccgtcgccgcggcagcgcggcagccagccgtcacgcacgctaccggccatcggccccctcgaaaaccgaccgaaataacgcgcgtcgcgtggtcgcagcccacagctaagcgcgcgcggctccgccgcgcggccccatcgcctcgtctcgcccacacgcggctgacaccgtaatcctggccctttttcctggccgcgcgcgcgcacgcacgcacacggtgggaggcgaatgatcgacggcgggcacatgcgcgcgggccgggaggcggctcgtgccaacagcagggtgggctcggtctgtctcccctccccagcttgcgcttgatcaggagcagcggctgccgctgctctagtggtgacaaactgatgctccaagcgatcatcgctaatgatagcgctccaaagctacacgctgtgagttgttaacgggttcttttccgggtggggttaggtcgctgattgaaggctaatgcagctctaacaactatgctcattgctcgctgcctttctcgtcttatttggaaattattttttcgctcatcttgtctgcggctaggcgtgcacgcagacttcttaactaaaagagtgatactgcgacactgcgcgtgtttgaattattgattggaacgaaggtcatcgatcgattgatccaacgaaaaggagagtttggtccgttctggagtagtagtttttagctgggcatgtaccgtgtgcaggcaactttggagttgtggaggattcggcccatcatcgcatgagcacagccgccgaaaggccgaaacaaacatcgctagtctttgggctgaatttctctcctgtctggattagccatgatggcagcgctctctcagtctctcgttctctctctcgatctcgacatgctacgattaatctaccagttaattaatgaaactatacgattaatctactagaagaaaatgctctagtttgattttttttcctttctggaaagaagacataatgccctgaaagacttttcttttttcataaaaactctttcatgtaaccatattcgagtaactagtatattctagtcaaaatgtcggggagatcatccattccaaacttctagtactagaagaaaagctaaacattataggcaaaataaaatatgacttagcaattagtaatcctcaagcaaatagaataatagataacatgtctaacacaaactatttacatatattcatttagacagcaacctgatcacgccaaaccacacatttccagaaggttgcttacccataccacacatttttagcgaggatgaaatatccaggaaactatcagaaatgtgaccaaatactgcgtcataaaaaagaatctgcaggcagataaatggaaacgaaaaaaaacttccatcagctcaattgtaaaaagaacttattccagacagtggtgtcagtgttcccctaaaataacctaatcatgttggaactaggatcaatgctacaaggccggcccactgccgacgcctttgtaaatgcagacatgctaacacttaacacctttcccgtgtggaacaggcaacaacttaaaaaaaaaaagaaaggtctttttcacgtcgcaaccatggcttcaaattttgctccctagaaaacgatttgtgtacagtgcatgacagggacagccaagatatgagcattaaaatgtggaatcgactggctcacaaatcgtgtttatgctctgaaactgtcaataaaatcacgaaaattttcaggctaataatgtaacgtcagtgcttaggagaaaaaactactgtacttttcgggtcagattctttcgctgacggaatcgccattattatttcccccaagccaaccaacgctgcccccaccgcctctgactgacaacctggccccacgaccccagtcaccccatccgatcccaggtcccccctgtcccctgcaccgagtctttctgcaccgccccctcactttccacctccgggccca

SEQ ID NO: 52984 - DNA, 3006 bp, Oryza sativa
ccagtgcgcagaggggctcttccgcaagcgcctctggggcggcacgttcggcgacgtgtacaagaggttgccttccctctcctccgcatcttctctctctctctctctccccctcaatctgtctctcttgaattaccacgatcatttagtgcccgtaaaaattaatttatgcaagtaacgttggaggttttttatccgagttatggagcattgatctttagttagtttgtcattggttgtgtctatatcggtttagatgttgctttcatcattcgtgctctactttctgcttttgtttgttcgtcagtgttagttttagaaatttaatgctgtgatgctttaatttgagaagtgtctgttacttttttgggtgcctttgttgtgtgacttgtgatttacgatttcgggaatgagattagcttatttcaatcattcttggttgcaaaatactacactttctaagtgttacttttaagtgttgtatttcgtaatatctttgagctgaggaataagtatttgtcccaattttgttgaaatatgactatgttgaatgagttgggtgctaaatacaaagaatgagtattcatcttcctggtcagctttgtactaattgcttgagatatctcaaattttctcgaccaagaaaaaaattgaaatgttggcgtagctgtttctttcatagtttcatttgtcttcaaatgttgtaaataatcagtatcaggaaagtaggatggtgaataggcaagaggtaaacttgtgaaactggatcatattcttgcttttctttcaccatttgatttcactgtttactattaccagcaaactcaaagtggtgatgatttgaccagatatagaaacagaattgatcaagagaaacaatatgcttctatattgcgtgctttcagggtttttagaagagaactgcaatttgcatgaaaaaaagaacttttggtatggtttcttacaggcacgccttataggtttcaactgagggaatctgactgttccgttatttaattattcttttcttgaaagacccatgttgcctactgtctgttgaacaacttgggatttctgaacaattttcctcctagtccttgcttctaagccttgtgttgttgagctagagctgtccatgtatatatattgacagttagtgaagttgataatttacatattaaaaacaagacctaaatgtttatactttacggcgtagcttcggcctaaaagaatccatacaaagaatagacaatataggacaacacactgcaatatttagcgtaataacacgacttgactccttcatgtggtattacttttgtaattattttttattgtcataacagcaattttcgttgctttgatgtttttgttgatggttacaaaactacaatgatatatgggtaagtgattatgcatcatggtgtgtttaccttgtttgatacagtattacagtcaccagtacagcctgttaattctgaagattgtttcttttagatttttagtttgtctttccgcagcccgtttctcaagaaaacctctagctaggaatggcatgtctcattgttaggcttgcatgctaggcctaattgaagtgtcccttggccaaagtggtgtgattatgccatcgtgatagtcgcaccacaaggacgaggagagaagggagaaataagtacttttgtttatttcttgcttgccggtaatgatcacagtagactcatagtgggccttttttcctaatatatatagatatcgatttggttaataccctgtctagctaagagataatataccaaataaccagatagacatattcctaagtaataaatatgtccctaatccttgcatggtgatcacttaaacatggtacattaacaccaaccttaggaaggcatgattactattctattgctccatcacatgggccttaataggttgcacacggcattgattagttcactgttgctctttatgtttcatcctttagtcattgaaccattgttctttagtctagaagttgggatgccataatgacctattcttcttttgttagtgtaatgcacttttgctacgtgtgctgcacactaatacttgggctgcgtatactcccactttctcattagttctcttgaaatattttcaggcctttatgctgggttgaacatatgtcactggacaatgaaactggattagataaaccaggaataagagttcggccagtcacaggcctagtggcagcagactattttgttcctgggtattttgtttgggctgttttgattgcaaatttagctcgtattggatatgaagaaaagaccatgtacatggctgcatatgattggaggttatctttccagaacactgaggtagccatatttaatgcacttagatacatggatttcctttgatgcttggctatgttctcctcagaggtttagactgagttaaatgatgcttgtctgtaatgtaaattaccacctgcaggttcgtgatcaaactttgagcaggataaaaagtaacattgaactcctggtagcaactaatggtggaaatagggtggtggtgatcccacattctatgggggttctctattttctgcattttatgaagtgggttgaggctcctcctcccatgggtggtggtggtggtccaaattggtgtgcaaagcacatcaaatctgtaatgaatattggcggacctttcttaggagttcctaaggctgttgcaggacttttctcatctgaagccaaagatgttgctgttgctaggtaattgaaatcaaaagtctgcaattctactgtacaattgttagtattatttgaggttttactatgttgaaaccaaattagttcataatgcagttgtttataggattacgtacttgtcaattcaatttataactgttatgtgtaacaacatcctctagcttgaatataagtttgattaatgctctgaggactatcagttcacaacaggatttggcacctctgcttgtggcaatccagt

SEQ ID NO: 52985 - DNA, 4830 bp, Oryza sativa
  unsure (1)..(4830): unsure at all n locations
attctctttattattacatgaaaaacacgtgtgagcacatatcactacactacacacccttaagataaacttaaagagatggtttcaattcaaaatgtactcgtatccgcatatgtgtagtattcatggtaccaagatttgaatcctggtagtaactagagtcatgcatcccaccgccacactaccggtgtttctttataaatatatttatttgatttttaaacaatattattatgacaaagaaaacatttaaggtaatttcatgcaaacttttcatttacattttaaagtaaaataaaaatcaattaaatttatatagttgctaaatatttgtcaagggaaagtgggggagggataaaatttgccatgcgcgcatgggaatcgaacccccaacgtcccattcacatgccatcctcgctaatcacatgtgccctcatgtgttttttataattatttgaaatttttgtataagttatttcattacaattgcactcaagttttggatggattttccatcaaaagttgtatagctggtcccttagttttattattatttttcatcgttttcatcactgccttcacaccatactctccactgcatgacccacttatcctccatttatattcctttggcgctcccattatataggacgtgcatgtacattttgcatgtaaaatttaagctgataattaagtttaccatcaccaaagaaataaaaggatgaattagggtcaatcaaattcagcttaggataactcattaaaataatttgtcatgtaggtgttcgtagttaattgccagatgcaaaactaattgcattaaatgaaaaaacaatcctaaactgtgcatatttgaggaatgcaccttgacccctttctacaataaaataattttaactgtttttaaatttattttttcatgtttatttacaataatacagatcaattacaatgtgcggcattgctgtgtgtaatatttgttatatcatactttaatttagcgctaaaatgtgtttttagttggaaaccgaatatttaggctgggactttcacaacaatggcctagtaaatatccaagaggatatgtggaagactcttgaagactcttgacttttcaccactcctttatagttttaccgggacttctctagatctaacgacaggtagtagccacgtactatatgttttgttgcatcctatgatccatatttttctgatgatgtggcctaacgaagttgcaatttaggtttcacttttcacgtatagagatacaaattatttcgggtttaattcaaaactagattctgcaaattgcgtggtgctaaattttaaaagaaatatatttgatatacaacacttcaattctatttacataaatacaattgtatttcctaaccaatagagttttaaaatatgattggatttcatatacaattgctagcctttgtttctatagctacaattttattttgtatctatgccattataatatagatccatcacgatctagggcgtcatcgtttggcatattcatatgcttatcagccaaaatttgaattttcaacgttaaatttggagctgattttggggttttttcatcgaagtttatttttcagcctttgcttttagatcgctaagaacatatatataaaagttttattcacaaattgattttcgtttgcaaatatgccatttggcatattcagaaaatatgccaaacgatgaggctgctaatggtgcaaatatttttatttcttagtgactaatgtgggaatttcttacatccaaaacaaacatgataactttttccgtgctatcttaataatataataatatgttgtaaaacaaattaacatgctccatttgaaacatgtctaatttttaattgtgccctacaaaatatttacggggctatgaagtgagcgcgccaacaatccaacatgcacatcatttcctagtatgattttatggagaaagagagatataccattctggtcggagtcgtagaggactcctgtagtatccattcggaatgaagtgtaccagtcgttaagcatttcagcttgcgactctggggtttctcctgacacactgcagaagaggcaggcatatacatgagttagcgatcgatctcagctgaacatatatgtttgtgaaaatgagtgctgaaaggggaagttgatgtgtactcgatgcggtaggttgattgcacggaagcctcgccttcgggagagacgttctgcaccaggacgtgatccggcttcccgtcctcgccggcgtgcaggacgacgactgccttccggtgatctgctcaacagcgaccaaggtggattagcacttcgcacgtacaacgtacgttgatcgaacatggataagaagcaaaaggtaagcaagaccaggaacaaggatcgattcaacaaacatgcatggcgagcgagatggatttatctcacttcgcacgtacaccatgagaaggattagaagcaaaagggcaagccggaccaagatccaaaggatcgatcgattcaagaaacatggcgagggagatagatcgatttcgtcgcgtattggctatatagggatcgacgacgtcgatcgaacttaccgttgacatggatcagcacgcgtagctgcctgcatctcttcctcaggcactcgatggatcccacgggaaccatcgggagcttcccggatccggcgccaccgccggcggcagcaccaccgctcgggacgttggacgacgacgacgatccgccggttgccatcgtcgatctcagcgtggtgagggccggagagagaacgaacaaagctaggggaatgatcgatctgagagcgcggacggacgactggcttgtgtgtgtggtggctgtgtggaggaatttggggaggatagacacgccggccgaggggcttaaatagctggggggggggggggggggattaancngntggcngnngggtcnnntgaacgcgtcccgctcaggcagccgtccgctcggcccgcaggtgtgtcggcgcgtccccaaatttttcatcgagcgcgcgaccggcacccgttcgaacgacgccgcaacaaaggctacgtacgtcgattgcccgttcgttgggccagaaaatacaccaggtgccatggacttgtcagcccaaaaagaattctcgactcttttgggtgctgcgaacagaaggccctgggttactaattggcccacgccgagacacacggtctgacatcgatcagtatcgatcagtatgcggcctaagggctaaggccatttccgatgggatttcattttgtagttttcaaaagtaccctataatctaataaagagatgtttaggttaatgaataatacaagtatcttcaatgcacaattttcgtttcatggtttcatatgctattaatagcaattaatgattgaatgatgttatgaatctaatttgatcacagtggggttccatttccgttgcaagggcatatgatgaaatgataatggcgacgaagcttggcaacaataacatctacagtttctctctagggacgtgggtgttgccagtgcaggttttggcgtttcaggggctttggctgatgtctaaagtgtgagcttggtgttgctttgctcgttttggcagtgcctccaataatgtcgtgattgccgtagagttggagctgctgggtcgctaggtggcaagctcggcaacgatgacacgtgccttgtgatgtcaacgttgtgtgccgcttcttcagcatcttgacgtcgatgttcgccgttggattccgccattttttctttttttttttagcttgtctagatatttactcccgcttaatgaaatataattggcagttctcctgccggtttagtttcaaaaaataatatgatggaatgattcagtctcagtgagttttattctttttttcaaggcataggcaagtgtgtaaactaagttttatcaaaactaaacttattccttctctcttaataaatttactgatatgctattagtttaccctatacaacatatcatttaatgagattgaaattcttattaaactcactgggaatggtctaaccagttatgccactgtcttccatagaccacaccctagtggacggggagaggagacctaaccatcaaaacggcacgcgctgtagatgaggaaaatatgtggttgaaaccgcacgtgcagtgaaaatcaacaaactattataaaataaaaactcgacgtatgatatttattcctatcatcatgtgtaaaatttttactcgtgattaaatttaaatataaaagttatttacaatgacgtatacaaatattagagtactggttttcaccaagtattttcatctgtacgagcgtccattgaggcacgtttgttctctcgacgcatgtgtactgtggtggcgccccggcgtacgtgaaagcgtcacgcgacccaccccaccggaccaccactccatctaggggtgaaaacggatcggattcggacggatagcagtcatgccatatcctataccatattttttaatcggattcagaggcggtgcggataatgtgcagatgcggatgcggagcggattatttcggatgtcggaaatggtgcagagtcggtgcggactcgggtcggaaacggatgaaaataatcggatgtgacatgtatatacaatcgatacaacatctgattatctgtacaatgagcaacaatgagataccaatatcacaattcacatgatcacatcataatataatgtcaagttgttaacgattgacttgtcttctgtccaaaagcatctaatcgacacatatagtattgacatcacgatggcagga

SEQ ID NO: 52986 - DNA, 3592 bp, Oryza sativa
  unsure (1)..(3592): unsure at all n locations
atagtctgatgagatgatgatcgcgatagaataattgggctaggcccaacttataatattaaatctcaaagggcccataataagtattgaggataataataccacctcaggatttaagcgaggaatatctcaacctaaatagggagttattggaggctccctgttgaccagttgaggtgggggtcggaatgccacacacgcgcgcgcgccgggccgagggcgtgggcgtggctggcggcgtgcgtcacgtcactatccttttgcagccactaacccacgttcccacgattccctccacaacagcgcgtccacgttctttctcctgatagataaggaggcccggagtccgatccggtttcatcgcttctttcccggtgttagtttctccttctccgcgcctaagttgctctcgcttcctcgcttcttatctcttgcgcgcacgagagattggaaggagcagtgcctccgaaaccacaccttcgcctgagatctgcaccgggtaggcgggtgatcaggtttttggggagtgcctcccgcacgactgctcatcaccatgtctggagttgccgccgccgctgctggaggagatggcggaggtggtgcgccgccgacaggagccggagctggtgcgccaggaggtgccgtgaacgacaacaacaacggaggcaattctgcctcaccatccagcggagagccattctcggggtataatcttctcctcctgttcctgttgttagcgctatttctgttcccattgttagcgctatcgctatactatgtgcgctatgttcttgttcctgttcttcatgatgcctctagcatgttattgcgttactgttatgttcctgttcctgacattcatgatgcgcatagtatgctactggttatgttaagatcaccctacactgcttatgccatgattattgctttaacatttttggattaaaatatgccgattaattactatatttccaacattccaaaaacctgataggacattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagttgtatgtcatggagcagttctatgactataaaatggtcgatgaccgttctgtagtagaacaagctcatgagattcagatgctggctaaggaacttgagaacaacaactgtgaattgccggacaagtttgtggcgggtggcattattgccaaactaccaccttcttggtcggactttgccacttttttaaagcccaagagacaagagttcagtgtttctgatctcattggctctttgggtgttgaggagaaggcgagggcaaaagacgtccggggcaaaaaggttgagggaggttctagtgccaatatggtacagaagaagaaccctcatgcatcccacaacaacaagaaagtcaagcttgatgtcaaacccaaggctgcaaccaattttaagaagaaaggcaagggaaaggcaaagggagactgctttgtgtgtggcaagtctgagcattgggccaaggactgtccagagcgcaaagacaggaagtctgccaacatggtcattagcgagggcggaggaacatcggggtatggtaaaatattacctacagttctctctgtttttcattcacctgattggtgggtggacactggtgctaatattcatgtatgtgctgacatttctctattttcttcttatcaggtcgggagaggttcctccttgttgatgggaaatgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcacgactctgtcatatgaatttcggttgtatgacgcgcttagctaacatgagtttaattccaaaattcactttggtcaaaggttccaagtgccatacttgcgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcaaagagtttggaattattcatgagaggacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagtataaggaagtaacaccattcgaggaatgggaaaggaagaaattaaatctctcatacctacgaacatggggctgtttggccaaggtaaatatacctatagccaaaaagcggaaacttggaccaaatactgttgattgtgtgtcccttggttatgctatccacagtgtgggttatagattcttaatagtaaactctggagtacccgacatgcatgttggtacaattcttgagtccagagatgctacattctttgagaatgaatttcctatgaaacatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacactccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagannnnnnnnnnnnnnnnnnnnnnnnnnnnnnnnnnnnnnnnnnnnnnnnnnnnnnnnnnnnnnnnnnnnnnnnn

SEQ ID NO: 52987 - DNA, 771 bp, Oryza sativa
tcctgcagcccacaacgggttatggcgcactgtccttcatggacggctcatcaggttataaccagatcaagatggatccccttgatgccttcgacacggcgtttagaacccctaaagggaacttctactacactgtcatgctgttcgggttgaagaacgccggtgccacataccagcgtgccatgcagttcgtcctcgacgatttaatccatcattcagtggaatgttatgtcgatgacatggtagtcaagaccaaagatcgcgaacatcatcaaaaagaccttcgcattgtctttgaccgactacgtcgacaccaacttaagatgaaccctctcaagtgcgcctttgccgtccaatccgttgtcttcctcggcttcatcatccgtcatcgagggatcgagatcgagccaaagaagatcaaggcgatacttaacatgccgccccctcgagaactcaaggatctgaggaaactacaagggaagctggcgtacatccgacgcttcatttccaacctctcgggccggatccaacccttctcaaagctcatgaagaagggcacaccctttgtgtgggatgaagaatgccaaaatggcttcgataatatcaagagctacttgcttaatcctccagtactggcagctcctgttaaagggcgcccccttattctctacattgcaacgcagcctgcctcgataagcgctctcctcgctcaacataatgatgaagggaaggaggtggcttgctactatttaagtcgcaccatggtcggtg

SEQ ID NO: 52988 - DNA, 3999 bp, Oryza sativa
ggcggaatatgaggctctcatctttggtcttctcttggcgctctctatggaggtacgttccttaagaacccatggggattctcagctcattattagacaaatcaacaatatttatgaggttcgtaaaccagaactggtgccatattacacagtggcccggaggcttatggacaagtttgaacacatcgaggtcatccatgtgccacgaagcaaaaatgcgccagctaacgctctggcaaaactggctgcagcgttggtctttcaaggagacaatcctgcgcaagttgttgttgaagaaaggtggctccttccagctgtcctagagctcatccccgaagaagtcaacatcatcacgactaattctgctaaagaggaagactggcgtcaacccttcctcgattacttcaagcacggctctctacctgaagatcctgtcgagagacgccaactacagtgatgacttccctcatacatctacaaggccggtgtcctctacaagcggtcttacgggcaagaggtcttacttcggtgcgttgatcggaatgaagccaatcaagttctccaagaagtccaccatggagtatgcggtgggcatcaaagcggaccaaaaatgtaccatagcatccgactggcagggtactattggccaggcattatggcggattgcctgaagacagctaaaacctgtcatggctgccagatccatgacaatttcaagcaccaaccgccggctctgcttcacccgacggtcccttcttggccgttcgatgcctggggaatcgacgtcatcggcctcatcgatccaccttcttcaagggggcatcgcttcatcctcgctgcaacagactacttctccaagtgggcggaagctgtgcctctgcgtgaagtgaagagcagtgacgtcatcaacttcctcgaacgacacaacatctaccgcttcggggtaccacatcgcattacctccgacaacgccaaagcctttaagtcccagaagatctataggtttatggagaaatacaagatcaaatggaactactccaccggttattaccctcaagcaaatgggatggccgaagccttcaacaagaccctcggcaagatcttaaagaagacggtagacaagcatcgaagggattggcatgatcgtctttatgaagcactatgggcgtaccgagtcacagttcgtaccccgacacaagccaccccatactctctcgtctatgggagtgaagctgtgttgccattggagattcagctaccatctctacgagtagcaatccacgatgaacttactaaagacgaacatattcgcctccgatttcaggagcttgatgccgtggaggaagagcgcctaggcacccttcaaaatttggagttgtatcgccaaaacatggtgagagcctatgataagctcgtcaagcaacgagtcttcaagaagggcgagctcgtactcgttctgcgacatcccatcgtcgttacacacaagacgaagggaaagttcgagccaaaatgggaggggccatacgtcattgagcaagcatatgacggaggtgcttaccagctgattgatcatcaaggatcacgaccaatgccgccaatcaacgggaggttcttaaaaaaatattttgtataaaaccctgcgcctcttgttttcttgttttctttaaaaaaaacactgtgagcttgccaacatgcattgaccattgcattgtctggtgctccacgttttgttttacaaaatggatgccacatcccacaaaaaaaaattaaaatggctttccacatatcacactgagctggtagaagaagacaaggcaaccttagaacacctctacaggattcaatggatgaccatgacagactgtgcttacaactaaacatccttcacgccaacacacaagtactacgggtgcatatttccgaggaatagcaaaaagacttgattgggttacttcctagtaacaaggtccccacgccttcatgtccttcggtgtgcttcagacctatggagataccaagccccagggaagactataggagaagagtaagaaagggctacctacctcaacacaagttgtggttcagtgtgcagccacttgccatccctgtgaggcatgtcaacaagggactttacaaaagaaatgggcctgcgaggattacatggcccacaaaggggaatggttgtcctccaagttctaaggatgccaagatcccagatcaatctcaacaaagtcgtgatgatcttaactcaagaaaacaatccaatatcaatctcaatgaagccgtggtgtcatgaagccgcgaagcaaaaaaaaaaagaagaaacaaaaagatccaagcaatcagtgatctccactgcattctgtcagaaataggaggatagccattcatcatcctcggcaaaaggaaaaggccactctcacagccgttcccctataaccctatcttaattcagccatacctaattctctcggttcgatgaagcacaataccaggggcatgggactcgtggtggtacctagtgaactgaaaggctagagcatggattttcgctgccttctgaaagtatcaccatgtatgctactcctatacacaagcacactaggaagttaggttgacagggagcaatcgtcatggtcattcggtgattcccgcgacacgttcttcggcaatcttatctgacgctaccacatagccagtgttcagtgggaaagccaatattttaaaagaaaaatcaacaaaatcattttcttgctgggtttctttctatcaactcacctggtttgctcgactctagcaaccatactctagtttttttttctcttttcctctctcgttttccttttcgtgatgcagggttttcgcttcacgtcatttggaggcaacataacactctgaagtcgccatcgggctatacacctttcaacctgacgggtcggcatcacaacagtcaagtggtcgcgtccggattgataagatatttctttcttgggagcggggcggcgtaccaacgcgtcagcgccaagccgtgaaacccttcatgctgatgaggcaggcaccgtgatatatcaacggtttcaatcggtctgataaaatgtcttcaattgtggcatgggtctttttcgctgcgagtaggagacgatttcaagttattttgttggctggcacctatacttggtcccgacaaaattcctttaattattatttgaaggcatggatcttcgcctcgagacctcaggaggacagcttatacctgaagtcatttttattcttcacctattctcaaagcgccagactttctgaacggtgctactaccccacatgggttgatctattatatgaagcaacttgtacagaaggcaaaccaggaattgatggaagagatcatgcatgcagctgcatgagtacagaatttgtgtatggcactgtagcatggtgatgatgcgtcgtcctctgattgctcggccacattgccacaggatgggtttgttaaaaaggaattatcttaacaatgcaaactgctggctggccttggctcaatatgttgccgccgtgataatcaacagaagttcatatgtattcatgcacttataaattacagccatatattcccatatatcagctctcgggtcccggcaggatcttcagcgggttctatatgcgacggtggccgcatgcgagcagtgccaagtattcggatacagaagggataatacatattagcaagttaaaaaaaacgaagaggacaaaacacaagcactccatatatatcgatgaagacaataagacagactcaaataataaaacaagtactcctaattaatgggtgcatgataatgccccaactttattcaaagattaaaaactagctagctgatcatctaaattaagagcgcttctaatgtgctttacatgactcgaaaataaaatcctaattaaggtaaaccaaggagaagcatatggaggctattctgattcttcgacgtactaccccaaggc

SEQ ID NO: 52989 - DNA, 2710 bp, Oryza sativa
cggcaattcgtcagtcgccgaactcacagagttaagttggagatagcgaccgcccgtcccgaactcagcaaggtaacgggacgtcttctccatcaactcgttcatctggcaagctgtgtcggatggattgcctgaagtttctacaatgggtatagtacacttttctcagaaaaagcaaagaaagaagaaaatacatcaagagaaagcagaggagaatatgacctctattaggagtctaatcatccttaccttcctgatgcttttgagtcgagggtcccggagttgaagcggcatcagccgtcggcatcacccgagaagagcggacaggagcattagcagccagcacaactgaaggtacatcgtcaataggtaccggagcaacatcggaagaggcagtagctttaagtccacccaaagcagttgcctgctctatcgtatcctgagttgcaagtatgttctaagagacaggttatcaaaccagtatgacatagaattttaagagaaaaaaaaagaataggggaaacacggataccttgccagtgccatcagaagaagaagaagaggaggaggagtcgctcaactggacagcatcaagctccatgtcgggcaccacagagcggcggcggcggcgacgatcatcgcttgaagactccgtggatgacaccctctcgtaaactacggggttttttcctcgcttctcacgcatggtgcggtccagctcggggtgtggagaatcttcaatacgcagaccctttttagaagatttcggcaatggaagtctgtcaggacgagcagttctctccttcttatgacgccagtcacgcaggaattcgattgactcgccgtggcgtttgtatcctcctcgatcatctctacggaccgggatcttcgcgatatgctgggaagggttgtcacccttggtctccttctgttgcttgccaccggatcctcccgggcgcttatcttcgacagtgtgtctatctcctgccgagcgcctatcccatgttactcgcctgtcccccgttctccgcccgtctcgcgggacacgctctccgctgccccggtcgctggcgccacgctcgcctgcacccctggatgctccgtcttccctggccatctcaagatggttgcctgatgaaaaagtacaggatgatcaagaagcgtcctaattccgacggctaaagaatcgacaatggatatatacctgtgatggagttaaacacctgaggcgccgtattgcataatcaatgcacaggcatgaccagcaatatataggcttcatccaaattactcgtaactgcaaaggatttggagtcttagccgatgacggtctagctttgtttttctttcgccgcacggccggagataagcttcagcatgggagtcctttcgtcgcatgactaaactctaccggacatgtatcgcatgagccaacacgacaccaagttaatttcgctcgctccacgatcaaaatttacttggtgggggcatctgtttgatggtattttggtgattatatgtgtacacaagacttactcatgatggacaaagcaaacaagcagtttgtaagttggctagcttatcatttctacgcaatgctcggccatgtatatacacgcaaatacatgcatgcacaggcagctgggaatatatatactgggaatatatatacttggattagtatatgtgcatgtataattaaccaataactagccgtgtgaagattggctggtgaggcaatcacgcgcatgcatgcatgtactacagtagacggtcgtatgtgtgtgcacgcctgggtgattaagcaacctatgcatatccgagtgattaatcataggctcgacccatggccaaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagcagagaaacaaagcgaattacaaatcagatatttgacgccaggagaagcttaagagataaaatcaaataaggatatgaccaaataccaacttgatcgatcaaaccttatctgcaacgaacttgacgcggaggaaacgacgcgcggacgcggtgagcaccgaccccagacccctatataaggcgtcgacccctcggcagccaggggcattcacgaactcatccacacattcattcaccaatgcatctagcatccacaagccacctatcatcaatgcatctacccatccagcatcaacacatccatccatcaactctcatcggcgatccatccatcaactctcatcggcgatccatccatcgacgacacgcaccggcggcggcgagctacttcggccggagtcccggcgtccggcaggagagggcgcgcacggtgatccgatcatcagcaagcgcaggagaggagcttgatggctagtccaggtaaaagctagcaagattgttttgttttctttcatatacagcacgcacacatccatgcatagggatccatctgcacgtatcgtcgtcgccggggaagtcgcggtggccgattcatctacgcatcacagaagcctcatcgatgccggtgtctgttcaagccgacgtagtgctacttgtccctggactcgacgctgctaa

SEQ ID NO: 52990 - DNA, 7769 bp, Oryza sativa
ccaatcggaggatgacatgtcatcgctgctacagttccatgcacaaaccaatgcgtgggctaaagaagtgctgttggtttttcttatttgtcccaaatgagatgccgagctttgattaaatccggccgccatctacatcaaccatcttcaataattcctccctaattcttctctaatcgaatctcgatgcaactgctgtgacgtcaagtcgttcaagttacgtaactccatgcatgtcttcaccaacaatctacatcgacacgttattcaagaccgacgaggctagacgacggagggtgggcgaccaacaccggcgcacggaccgacgaggccatggatcgctgtcggcgctcacacacacacacacatctacatcatcatcacaaccatgcatggagaacgcgaagcgaagacgacgagacgaccacaagcagcttaatcggaggttctcttgcaggcctagacctgcggaggtaattaactgggagcttcttgaggccccaggaaccagaagaccacatcgcacaagtcagatctgtccaatgtcagattatggagcgcgcatacatatatattacattgggaatttgtatttatgatcttttaagattaataaagagcatgttccctatgttttgtttacactgtgtatttaggtacactggcacgcccgcatatatatgtatctctaaacaaacgagatctcagatgttattttccaccctaaacataaactttaacaagataaattaatatatgatagactactttacaaatatacaagatcaaatttctacaagctgtaacgaaaaaaaaattaaccatgaatatacgttaactatatatatttaaatttgtttttttataacttgtagaagttgaattttaacttgcatatttgtagagtgatatattacatattaatatattaatatatgttcttaagtttttaaaatttctttagctagctcagtttgtttgtatcgatgggcttagtaattagccggatattgctcctgcgagatggggcaaagtatcgacctgggatccgcccaaagtgggtgcacgccgccgtcagcgggtccaagtcgatcgggtcggcgtcgaggaggccaactcgtggggtgtcttcgccatcgcagtggataccggcgatcctggccgaagttgacggcactgcacggcaccacgcccaggcgctcactcatcgatcggcaggtaactgtcaaaaactccaacctgcagcttctcctgctgcttactgatcgatgcatgggccgatgtgtaagagtacgcgccacatcgagatagctagctaactagagcttgggccctgaattttcaggtggttgaatgaatcggttggcgaagacgacgatggcatcaaaggcagaactacctctgtcttgaaaagtatatgttcccggtttagatatggtacttcatctgtcccaatataaatgcatctaggagaggaggtggtatattttataactacgaatctagactggataagcagctatctagctaaatttgtagttcttggatatgttacatctatactttgacggaaggaatagtaactactacaccggccggccagccgcaggagaagatcgacctcgtcgctgcagaatcctcctgagattctgatggaataatttcgtacacagttcaagattgttcatatatacagtacggtgcaaacggttcaagctagctgctgcctttgatggaagtgaacatacaaatgtggttggtcgttggtaattaagctgttgccttcttttaatactactccagctgcggtcagtctcactcagtcctgtacattcatttggcggccagcacaggctgtaacaacataaatagtcaagcacggaagtaattgaacggcgaaaatattgcgaccgatgttgaaagattgtgtccattaacaaaccggctaagtacatactataccgtatgagataatgaaagtcctgacctatttgtagtaggaaagtaacatgagctgcaagctttgaagggaagtgggagtacacataccttaaactttttcttttattatcgtacagtataaaacactgcacaaagccgaccagagtggagcttttgcatattgcaggtagtacgaaccaatggttttcagatgaaaacaaccactcaatatacatctctacagtgttttgcagcgtttgccacatctcaatcgctttgattgggacaccactccaactggcctgtaggcatagtagcatacacctgaaagttttacattttaaccctctttaaaaacataattttgttataaacctcaattaaggatacagacccctctggaggctcatatgtgccgaggttaaatgtctttgcgccaaataagttggtgccaaaatccagccctcgaagctagtgggtttaggtcacctgcgaaacaactttcctttctcttcccatctctctttgaattgtttgctgtccaattttgagaaaactgacaaatcaatgtgtcctattcatttttgctattttttttataattacacagtataacgcagatactcacaatacacgcacactcatccctctgaatgcacgcacgcaaaccctacccctatgagtatcttcgaaaactggactggcaaatccatcttggagatcaggtacgtcgcctaccattgaaagcacaaggccgttcaattctagaaaatttgcttctatgggagtcgaatctagtacctaaggtgctaccgaggctcttgtaaccactaggctgtatgctctttcgcctagtttgattttattgatagaaaacttaatctaagaggaggatgtggttccctccctcctccacgcccttgttccaattatccgcggctaaattttgaaaaagagttgacaaatcaatgtattataattcatttatgataatttatttttatttataggggtaagacttgaatttgggataatatagtaagaagtcagtgaaagaggctggcaccatggaactggtgccaaggctcaatcccagagactgagagttttgcattgagatgtctaacatcagcgacaatcgccgagagttaggtccatttctgtaataagttttttaatacgtctgcatatgaaatatgtttttgaaaaaaaagtccagtatagagcacagcaacaaagaatcaaatgtgtactactactctataccgtcatatcgtactactccctccgtcccaaaataagcgcagccatgagtttccgtgtctaactttgatcgtctgtcttatttgaattttttttataattagtattttattgttattagattataaaatataaatagtactttatgtgaccgatgctttttagatttctcaaaagaaaattaaataagacgaacggttaagttggacacggaaactcatggctgcgtttattttgggacggagggagtacttgagattcagtggcactgtttcctctcctttttgcgacacagccattcatatccttggcgtgaacgagcaaagcatggcttctgaatttgtcagtagtttatagtgcaacaacgtcgtccttcatctggatctgatccctgaacccatcaatcatactctcacgcccccgtagtacatgccaccactgtggtctaggagtactgttcatcctttactactccagcttataattatcatgcagttcatgatcagttcatagacaggacgtgtgtacaggtacagcaacagtggcgagattttagccggagaaaagctctatatcgagagaggcaaactgtggccatcgaccatggatggatcgtcgacgtgacgacagtaacgagagaacacacacacgagctgctgctgctgctaggatcgatcgaatggtagggatcgggcactaactgaggtaggtgaatcaggtttaaggattcacatgagcgttgctgccgccataactgtccattctcctttgtagatgcacggtcccgttcgtcgtcctgtggccgtcagcgacaccggcatggcgcattcaaggcctaaagcatggcgctagctgagggagctagctaccacagctagaattcgatcgcataaatgttcaggaaatgatccagtggttggggacaaaagcatgcatatactagccgctgcatttgtctagctctacctgccctcatcttagtttcgttcccattagttaattattagattcgtttatcaatattcagattagttcgggtagcaatgggccctggtgtttttctgggaccatatatattccaaaccccaatcaactgaatgctgaaactggcttaatggcgccaagccgattctaatttgtgaacacagtagtatgcacatatcacatgctaaaattttggcatgcaattgggtaaattagccttcaaacatagcagtgctaactgggatggattttacattcaagagggtgttctctcgttttttttacatgtcatttaaatagttatatatatattttaaaaaagacaaatagattaatatgtaatatatcacttgataaacatgtaatttaaaatttcacatctgcaagttgcaataaataaacaaattaaactattgcaacttgtagaagttaaatttgacttttttttttgtgaagtgatcggtcactattaatctatttcatcgattttttttataactattttaatgatatgtaaacaatgagggactggttgcttgaaagtttaaaatagtttctcctatgctagctcatccaaggtggttggagaatgttttgtctttcttgtcttaaaaaaatattaggtagttgaattcaacgtggatcctatttagcacagctgtgtcttcggcacacactttgtttatgaaaaaaaaaccttttattgaaaagttaattttcatctgaaaatttccatcttagactttaatttggcatgggttttataggccaaaagtgtagtatgcagcgaggcacgactgtgataattagccatctaaaattgattgttctagtcaaattctgcatacccatgattgcaattcctatacatcaacgaataccagaagtagtagttccaagaaagacaatctgagatctactagctaagctcgatcacgtgcagcggttgcccaaaaagcctagcagttgagacagccacaactgcaaggaccttatcgtcctagctactgcatatgcaaagctgatggctacgtaagcgcgacctgcatatacgttggcgcctgcctcatcatcatcagcaattaatcagctcgcctatttgtggcaagctcggatggtcagagatcggtcgagtggtacaagcgcgcacgcggcacgcatgtacgaacggcccctccttgccttcaaagcgatggctccatggcacccgtccacgacacgagctcgatcagctcgcccccatgcaggtcgcggatggcgaccttgatatcacctgtgctcggaattaatcgttcaacatcccgctataatgttactaccattaccattacttatatgtgatcaatcccaccattctaattctaacatgtatatataatagtagtattatggtagaggatatgaacccctctcctgtgaccctgcctccggttgcctcctccatctatctctcccttcatgcacgcacggcacgatcgatcgatgaactcgagatcttaagatctcactggtgaaatgcctggtcccggcgaagaaaaatctcgagcttttgagattgtgttaatctccctcgatcgcactgtatcctctcatcggatctctgagcagccaatcggaagcgtgggggcatcgggacgcatatatatatatatatatagacgaataatatgatcgatgtaccggcactctttgaattgaattttggctctgctaatttaactgaagtcgtagattcgagggatatatatatgcacatacacgtacgaatatacgatcgagcgtgcatgtgatcgtaattgtaacctggtcctcccgtttttatggcaatggccaggtttgcattttttgtgccattcattgcgctggtggctgccatcgatcgatcggatcgaacgaatgcgagttcatcatgtgtacggttgagcttttgcttcccctctgtccggtctctctctagcgatttttttttcgcgaaaatacaaaataattgcacgttaatatattagaagaaaattaaaaaattttgttgcatgacgcaatcaaccagattagcctatgctaagaaaagagaaaaaaaaaacacaaccaagaaaaatggaagagactactacaatgactaaacgcaactccaatcagctaggaggggggcagagccacgctacgctcccaagaaatccaaaaaaagcttctctctcgcgatggttcagccccgaccgcgccattcaaatcaacggatcgatgcgcgtacggacgtgtccgtccatccatcggttggtcagggcaggagcacgtcctcgtctcgtcgtcggatcaacggcgatcgatcgatcgatcgagcgcccgggcgagggaggaatggcggaggatgtggtgagccaggtggacttaattcggttttttgctgtatagctagcgttaatggaagacgtgtgacctgtaactctaactcgcggtgtatttggttgattgatgggattgaaagctagctagctagcgaagcgatcgatcgattgcaatgttgctcgctaggtaaccagacaaatatggggcctgctttgttagcttgtccggtttacagtcgtacggtgtacacgacgattttaatagtgtttcgatcaacaatattatactagtactatctccgtcccatattacttatctttttgagtttttgtttgtcaatgtttgatcattcgtcttattcaaaaaaaatctagaattattatttattttgtttatcatttgctttattatcaaaagtactttacatatgacttatctttttttatatttgcactaatttttcaaataaaacgaatggtcaaacgttgcaaataaaaagtcaaaaacgtcacctattatgagacggagggagtagctagcaaccccgtattgaacacatactagtgctatgaccttagatacatgatatgcatgttcagattcgtagtactagtatgtgtcttatattttgggatggatgaataattaaattacttgcttttgtatttaaatatatgatgctgttagctttattcagtcaaatttgtcgaactttaattttgcacttagaaccatcaataattctaacaataattggtctgaaaatataatccaagtaaatttacagtaattttattatttattaccgttgttctaaacttctaatcgaaaaatgatgatcagagaatcagagttacacaacaaagaacgaataaaggtaaccgtgccatctcgttcctagtagtaataatgcacagtaattaaatccatcatgccacaggcctagcagcctagctatatgatcgatcagattaaggatcactggtgtctcttgtgttaaagttactgttttatctctggggggagctaggtatagggagataatatcgctagttagatcgaggaccacgtacgagtatacgtaaatagactgcatgcatcgatcattcaaagatgggcacgaatgcatgccaatggcgtggtgcgcggcttctgaaatctgaatacatagtaagtctgagctctgaccaagacatgcgcaagagtcagcgtgctcagcgcggggggggggggggggg

SEQ ID NO: 52991 - DNA, 1129 bp, Oryza sativa
gagacggcgcgggaccatgcggcgtgcgtgcgtacgcgatggaccgcgtggtgtgcgcgcgtgctgcgtccgtcgatggatgcaaaccatggctgactccaccgccggtatcgttggttagttgcagttcagcagctgggcgctttttacatggcacacatgcgcacgcgtgccctgcgacgacgctacacgggccgtgtaacacggcacccacgcacgcacgcacgcagcaggccagggcacggcctcgtcgggcccgggcgtcagctagcggttgggtgggctgaaatccagcgcgtccacgcatatggatttcatatgggcttcggtgttagcgggttggttttccccccggaggccgtgaagtgtgttgactgacttgaacttgagaggggaaaatgtacaccgaaggtccctcaacttgtcattgggataaaaaacgtcctcaaaccgcaaaaccatatacgcgaggccccttaactatacaaaaccgatcacccgatgtccttaggtggtttcgaccccggttttgtcctacgtgactgctgagtcagtgcgggactcacgtgggccccacctgtcagcctgtccaggtcagccactctctcttctctcccatttctctctctctctctctcacttctctcctcttgggcaagccagggcaggtggggaggaggtcgccggggcgcagcggcgggagcacaaggcgacgcggcggcgggctgaggcggctcgtcggcggcggcagaggaggaggaggcaacaatggggaagacgaaggggaagcagcgacaggataagttctaccacctcgccaagaagcagagctaccagagtcgcgcggccttcaagctgctccagctcgacgcgtggttccgcttcctgccgacggcgcgcacggtgctcgacctctgcgcggcgcccgggggatgggtccaggtggccgtcaaccacgtgcctgtgggggccttcgtcgtcggcgtcgacctcgtccccatccgcggcgcgcactctctgacggaggacatcaccaccaccaagtgtcgcgccgcagtgcggaggctcatggactccaacggcgtcgtcgtgttcgacgtcgtgctccacgacgggtcacccaacgttg

SEQ ID NO: 52992 - DNA, 9965 bp, Oryza sativa
gaaatttcaatccggatacatgtaaaaaaatcaaaaaatgtttaataggcctataattaccagattattgagcggattttttttttcagattatatacatgatataaacaaaccttaaaagtaactcgaaacaaatggtctaagcaaatataataataagaaaaattgagaaaaaatatttttattgtgtgaagcaaataatccattacaacggtacgatagataatctgaaaataaccggatcactggtttctcctgtgtgccctctgcatgcagagtcaaattgaattgttctcgttgagtatttaaattaattaatttagttagtatccaggcgagccaattaagctaagctatcagcaaaaaattaattaaacgagacacacacatgatgagtccatgcatgacgcacaagctaccttagccgctgcgtactagctccctcctactaatcgtcaacatttctagaacaaaataaaccccggacgcaatcctgaattgacacgactcatgaagactcccagcctctcacgtgtgacgatcagagaatgatacataagggcataaggcgatgcgacacatctaggccaaccagctctggctaagcacaaagctgattcccggccgtttcaacgacgaagtttacaggctgaccgcgaaaatccgtctgaattcaccgaattgcagtggaaatttccacggcgggttcacgggaaggcggaagactactgtgcgtgttttaattctggattctggaagcccctgttctggatatattgtagcagtaccgtgtatccgtgtctccatgactcgattttacattggtacatgaattgatttggctagccgatcacttgatttgtgcgacatgtctcttttaggtttgagaaagtgaagcgtctattcaggtgcattcagttgtttgtatactattactatcggcaaaaaaaaaatacccctacatatcatatcagatatatatttaaagtattaaatttagtctaataataaaataaattacagattccgccaggaaactacaagacggatttattaagcataattaatccatcattagcaaatatttattgtagcaccacattgttaaattatggcgtaattaggcttaaaagattcgtctcgcaatttcctgacgaactatataattggtttttttatctaaatttaataatccattcatatatccaaatattcgatgtgatagcgtgaaaaattttgtttaggaattaaacaggccctaatactagtgtatgtgtcatgtatatgataggaagatgttctgactgctctgctattatagctttaagatgcaatagtctatcttagggcggtttacattgcacccaaaataaatcttaccaaattataacaatgccaaaattttggtaaggttgtaatattaccaaaatttttaccaaattatgacaatgccaaaattttggtaatattattttggtaagtttataatattatcaaaattttggcaggatttcttatgtatttatcaaagtttgacaataaatatagacactttttagcaactttgataaaaaatgatatggttgaaaatgacatcaatctgaatagcctcttattgaaaaggtagtcttgcaacgttgatatcacagggatactgttcttgttgggaatttttcaaacatttaccagtgtaaacgcctccataaagaggcatttctcgacgtttctatctcgatcagcaagaacaaagcaaaagcaaaaaaaaaaaaaaaagtcgattcgagaatagaccacggaaagaacgaacagttggggaaaaaagaaaccgtggtcttttgtatctcagcttttgcagagcctggacgcacaggagcgagctagctacgcagccgccctctgggagcagcaggtacaatatcatactattatctaacaataaatatagtttaatgagataaaagatacgagagaaaagcagcggcctacagcagcacagattccaagacgcagtatgtttatgacatgtgggatcatatactaatagtgtagtaagcaactattgtatgaattagctattagattggctataggtgaattggagttagtagtgggctatactattgaacttgctctgagattaattaacacccagtgatgacgagtgatgcttgctttatctaccggccgctgtcgctaagggcacccgcaatagttatctataggctctctataagatatccatgtcagcatattttactacttgaaagagattaaatgaagagagagagtaaagctatctactaacccgtagatagtctatagagaaaagcgaggcaatggatgagagagttatagatacccatgtagacatactattaatgtggtttactattaatctagtctattgctgagatgtatatgttttatagagaacatcttactttaccattgcgggtgctcttaagtgcgctgtcaccaacttcacctggccttttctagatcgagttgtacaggccaggccagtttcgatcgctgtatatgccccagtctcgtcgatttcctgtcactgtttccccgaccaaattaacgaccggtttagtcccttcttttattctttcccggcggcttgagaaaaccgtgaataatctagctagggtgcatgcatgcatgcgctaaattacctcgctgaggtgtggctatgcgtgagcctcttattgtcagttctagtacctccggtttagtcagagcaaagtaatctaaactgattgattagctgggagatgatgccacttaacatatattcctccatcgtgctgacttctgaccgatcggctgagttgcctgtcgttgcaagttaactagcattcttgcataacaaggaagtaaaattaactcgcgtttcatcttatcagctccatccttagctccatataagatgggcaaaattattcttgttctttttttctaaaatagtatattaattggcagattacgttccggaagctctggcaggggctgggcagtggcggccacaaggtcagcgctaagcttcgccacctcagcaccagtttatttggcgctgaccttgaaacaccttctccgcgagagcctaagtccacgatcttagcgccaaatcacctagcgcttaggccgagcatgtcagtgccagtacggtcattatcgaaccttgccacgcgtgccgatggttggagacgactgtcaaggcctcggcggtcggcgctaaggtgttcaatcttagcgccatcgggtgtggcactgagcacaggtccattttataagatagtttttagtaagaaactaatttgaaataagttttgaaaaaggacaaaaaaaaatgtgaaattttcgccgatatcgatggcccctcctagaaacatgtgtcaaatgtcaatatatccactgtacaacttccgttatatacccgtcaatccccgaccacaggcacacccgccagtttgcgggtcagaatatattcggaaatgtcccggcctggcggcgcggaacgaccagacaggtcacaggtcagaattgagaagccacggcgcgggccgcgggaccaaaggaacgtgatgtgatccggtgaactccgcgaaccgcgatgatgatggtgcacgatgatatgttgtgccatctcactcagcagctttcgtagccgccgcccgcccggctgcgcgcgcgtgcgtgcgtgcgcggttgctgcgacaccgcaggaggggaggaggaaagctaagcgatcgagagaaaaaccacgggcgcgggcgcagtgtggtgtggtgcggagcgcgcggtttgattgaatcgtccgtgctctctctcgccggagtacgtctaccgctgctcgatcgaccacctggctagcgttggatgtaggcggcaccggcaaaatcatccgtgcagccgtgctccgcaagacgggccggggtgggggtaagctgaggcttccaggagttcaagttgttcaaagtcgtaacgggaactaaagtggggaggcgaatatgcctttcctactgcctacactacacaagccatgcatgccacggtctctcgtcattttttttttctctctctaaggaaaagataaacactttgacaaaaccaaaaccgctgagtgtagccggagaaaatggaactgattccgaggaaacttctatagatcactgccttctaaacgaagccgtgtaaacttcaatctaattattcggacgacaatgacatccacaccgtttgctcttcagcttaattatcgcagccagtatttaaattttatatcctaattttaaaattgattttgatggtttttttattctatctattttatttttcgccaagaacacaatataaaaaatacacataaattattatctaatcgcgaatgagggttacggaatcagttgtagacaaaacgataggaccgaaaataatcttattaagagggtattatcctgatgtatacttgtagacgcatgaaacaaccatgaaaatgtccaattcagtcattcagaaaacaagcgaattagtacgagctaaccatgttcaacggcgagagaaaacatcaagtaaacaaaacaaaatgagaaacaaactacaccccgaaactgagctttcagcagcaacgtacacacacatcactgctgatgaatcaacccaacctcgtccgatcatttacattgtgtacaacacaatacggaaacttttcaaaccttccaaacctcagaaccctctagactctccccccctccaaaccttcttaaaacccctcattcccatcacctcagcacgtacgaacgagagtgatcgatcgctagctcgccgagatcaccagcctcctcgtcttcttcttcttcttcctctcgatctcgaggagggtgccatgggtaccatggttggccatgtcgcgccgggcgccggcttcatcctcatcggcatgtggcagctgttcaaccacatccggctgttcgcgctgcggccgagctcgtacgcggcgccggtgtggttcccggtgcgcggggtgcgccacctggagctcatactggtgatcgtcggcgcggctatctccatcctgatggagctcgtgatcgggccggcgaggcaccagccgttcgacgacgacgggaccatcccctccaaccacctccacaacttcgagcacgcgtccatctcgctcgcgctgctggtctacgccgcggtgactatccacatggacagggccagggcgcccatgcgcgacgccgtgtcgcagctggtcgccgccgcggcgttcgcgcagcagctgctcatcttccacctccactccgcggaccacatgggcgtggaggggcagttccactggctgctgcagacggtgatcgccgtcacgctcgccaccacggtgctcgggatcccctgccccaggagcttcgccgtcagcctcgtccggtcggcgagcctcgtgttccagggcgtctggttcgtcgtcatgggcgtcatgctctggaccccggcgctcatccccaagggctgcttcctcaacctcgaggaaggccacgacgtcgtccggtgccgcaccgatgaggcgctccaccgcgccaagtcgctcgtcaacctccagttcagctggtacctcaccgccaccgtggtgttcgtcgtcgtgttctacctccacctgacgaagctgtacccggaggagccgaggtacttgccgctggtcaagggcggcggcggcggcggcgacggtgacagcgacggcggcaggttcagcatcggagacgacgaggacgacctcgaggccgcgaaaggtggcttcggacacgtggcgggtggcgggaacgccgttgaaatcgagcggtaatttactccgcgattccgtgtcagaggaagaaacaaatgtcaggatggctatgtgattagattgaaaaacgagggcctatgtgtaaataatagtatttctttttaaaaaatatttttagtagtactatagggaattagtgatttgtgtgtgagtgaacaagctgatcgacccataaatttgggtaaatctcatgcttggatcgcttcaatttgtttagtcaagagtgtctgatatcacaagggttaaattgatccatggatgtcgcatttggttggttatgtctgtactctagccatatgagtggagattttgcacacaacggaaaaccttttcatcctctgaatctcttctgttccgtgcaaagacgatgaaccaatatgccttcagagttcagagacgtgccaagccaatcaagactgcatttcaggtcattttctgaatgggaccgcgactgctgtgttgcagtcaattcagatagcttgaccagcttgccttcttccaaacatttttgtaaaaaaagatggattggttcgaaatacttaattaattatcaggtgattacgggagatcgatcgcctgctaagcgtaagcaaatgaatggaccaagccaacagcaggattggcatgtactaaacagggcgtatcatctgctaatgtcagccatatcttagggggggggggggggggggcgaagatgtcagacaattctgataatctgcagaggagaagaacatacttgtctctcgttttgatgttgacggtaattaaatttggtacgacaggacggcagcaaaaggcttgcacgttggtttttgctgggatctagtagagctgttgtgctcaaagaagtttctgcgtgtctttgtttcaactcatatgatggattatggctagtagctcattcactttcaggaaattctcatggaaatgaaacccgatttcaagcattaccctttctaaacatttaaagccctgtttttcgccaggccggtgggaggacgctagccaaatttattatgattcgaaggagaacgttcactaaaaaaaaattcagccagcaaggatttgtttctgcatgcgggcagtatgaaaatccgtttgtataaatgacgagaggttttgtggtctaaaatcacatgttaaaataaccatattttcacgggacaaccgcttctaaaaatcaatttttacatataattgtgaaattgcatgtaaaaattaacaattttcacgtaccttttgatagaggtggttgcccaaaacatatttataaatcgatgttaggtagcctcatgttaaaaccgcttcgtagtagtgattgcagtacgaaacaacaaggttgttgagctaaggagtgtggatgtaccctcatttcctgttcttttttttacaaggagacggaccctcatttcaaatattctattatgtccttttcgaatcatttggttttacaatttatgcaagtgaatataatggtgaaacccatcttcttagcctcaaaacgcaaatcgagaacggggcacaacgcccttgcccacaacaattggattagggacatcgatctgctgcgcatcactggagcggaccacccgcgccaatacatccatctttggacgttgatccatctggtcagcccgctttccgatcagagggactccaacatttggaaactgatggctaatggattctactttactagttcggcgtacagactataattcgttggtgcggctagaacaatctacaactagaccatttggaaatgttgggctccacctaaatgcaaaatcttctcctagatcatcattcaaaacagagtttggacgacggatagactacaaaagtgagggtgggccaatcaacgcctctgtccactatgttgtgccgtgccggagtcggcgctacttctacttgcaggacagggatagatctccagctgcaagagtggggggattgtgaaacgatcgaagtctggtggtacaaaatatggcgcacggcgaatcgctcaagaaaagccctaaaatcaattatcatcctgattgcctgggaaccatggggtgagtgaaatgctagaattttcagacaagtagcttccacgcccgccaccatcatcaccaagatcaaggaggaggcgcgaacttagatcacagcgggagcggaaaaactaactgagattataccggcgggagagtagacatttttgtttgcaatgggcacaatgttctcgggccctgtaaataactttttttactccttctctattaatatagaggtggcaaagcttttgtccttccttaagaaaaatacgggtgaaatttgtactgtactatctccattcaatgattcaatcataatagatttgggccgacgatcagcctggcgaacaaatctactggtgaaatttaatcgtgacggtcaatgaccataagagaattggaaatgtaggtacgtgtacatttcagttagatttctctcatatttggaactcataattaaaaaaaaaacaattctagggatgaatcaaattgagttcattcactcgttccaaaacaggcccatatcacacgttatgggctcccaatttcttcagttgcccaactgtactccatacagacttcaatgtgatcgtgcttacagacttcaatgtgatcgtgcttacgagaaatgccaggtacagtccgccgacgagtcaattgacagcaaccaattgaagcgtgcacgtttcagcgatcaaatcaaaggagagaacgttgcgattgtccatgtccatgccgttcgtacgttaatcgttataggcgattgtgccccaattctgggacaggaattaattttgatcagtctgaattttggcggggtgccatcatcagtccacaccatctgcaggcactgtagtgtagtctgtagctcatttagtcaagtctatactgcattgtaatacagtatggtgcagcactgcaacatatgttgatctggaggcagacgctacatttaagatatttgtcacatgccttgcttggctgcactttgcactgcaaacgaatcgcagtggcagtgtctgatatttgtacagttcattcaaggagagattaaaattgttctggcccaggttcacgaataaaatagggatagacgaggaaatattctttcctccgctattttggaggtgaggtgaagttaaaatctgttaatgatgggctcttaccgtcaagcgtcactgtatcagtaaaaatgttgcaggatcaatatatttagatgacttcagcgtcactaacgccagcttatagaagtagttggagtgatcccgacatctataagaatactcttaccgggtaccgtagctatatcaagtttcttctttatcgttcgtgtaccactcgtttttctaatgcaagctcaaacactacttgtccaatcacatatttcgtctaggacatctcgatcgatttcccctcagtaacatgctggaaaacccgagaagtattgatctttagtgaaaacatgattgttgaaagctcgaagctgtgtcgtggctgaatagaagatgcggcgcctgatccctgctataatagaagtcctgaaatagagggttgatcgatctggcgaagtaattcgaggggacaaaatgaattacaatgatacatatacagccacatatacacatgttgttacttttgtataattaaatgccattttaggggtgattgactttgtgccggagtctcggtgcctgtttggataactacatcggatgttacggcactaattagaagtattaaacacatattaataacaaaactcattccataactctagactaattcgtgagactaatctattaagtctaatcaatccatgattagctcatgtgatcttacaataaatatgtgctaattatgtattaattaggcttagaaaatttgtcaaacgaattagcactcatttatgcaagtagttttgtaagtggtctatatttaatactttaaattagtattcaaatatccaatgtgataagtactaaagttagtccgtggatccaaatactccctcatagtccaatcagtataagctagtataaaggagttaaagagatggatcaaggaagcccactgaaacgagc

SEQ ID NO: 52993 - DNA, 2184 bp, Oryza sativa
cttgtctattcttcttttccccagggacgatgttggctaaccaccgaggatattgtatctccttgataaaacccaagttgatgagtcgatcgacttcggcgatgacttggtcttggaactctggccttaagcgccttggtggttgcttcactggccgaaattggggatcaatcgccagcttatgggtggcgacacgagggtcaagtcctggcatctccttgtatgtccaagcgaagcaatctcggaattccatcaagaagcttcgatagtcttctcgctcttctttcgtcagcatgccactaacgaaaatagggtgtggatcatccttagttcctaaattcatctccaccaactcgtcaatggttggttggccaccgtcgtcaagttgtttaagagcccctgcaacatcaagctcctcttctaccccaacagctgcaacctcaaaggggtgttgttggagtaaagcatcacctattgtagtggtacttatggtgcagcaatgaaatatatcgtcttcaaatacttcatcttcatcatcgggttcatccacgttgatatagccgagaccgtactttggcgttctttacatctcctcttgataaactcttccgcttatgcccaccagtcctcacatactgctggaggtggtggcaacctgttgtttcgctgtaggttgatgcccgccttctccaataggcgagccattctaggctcagccttcatggtcgtgcacgcttcttctgtatcagaatgaggcttagggaattcgattatagaatcacactcttgtacctgtgggaccttgtagagaatggtccgggatgtagaagaagatggatctggaattgcccattcctctaacggggtagaaactgaagtgtagagggctgggggctgcatgcactgagcacccgcttttacctcctctatctctgcaactctcttcttgaccactccctgttgtgcaagcgcggcttccttgcttggaatccatcttgcctgtaaggtgatggtagttggcacatcgccgttgcttttgggcggtttctcgcttcctcgagaggttgcccccaaggtgatcggtgttgaggtagagcgtcttactttgagcaatattggtgtaatagatggggcagacgtgctggtttcagcgggagatggaagcttggtgctgaggttggttgctgaagaagaatttccccgcctactattcttgcgattccttgacgaagattcgctaatgattggggagcacggcataatgaggcgtctcacctcaggggttgtctcggtgccgggttcaataatgatgtcggctgccggtgctgttcgcccaagttgttgcttgttttcttcaacagggaagtaatacttggcgtcggcatgatatgattcttgaatagtgtatggtgagaagttgccaatgatgcgctgttgcactccattgccgtcaaggaattttaggcattgatggagagtagacggcacgacacggtacttgtgaatccacggtcgtcccaagagagcagagtatgatgtgttggcttcaataacaaagaaccgcaccttgaagctgaatgtagacatttggatcttgatagtaatggcgcctaatgttggcttgccctggttgtcaaagccacagatcaccacgtctgttggctccaagtcttttgttgtgaaacctactcgagttagacttcgaacaggtagaatgttcacagcagatcctgggtcaatgagaatccatcgaagatgagcagaaccaatgtttccttcaatgtagaggggacgattgtgatcgcccccttcgatgatgttatcttcatcagcgaaggtaatctcattcacaaacaaggggttgtcgtagagtcgatgcttagccatatcaacttcgtaaacttccggagcctgcaacgcctttataagagcttcacgcagatcaggcacattcataagagcatcatagacactcaatagtgctgggatccgtttgagatgcgcaagaacgttgtagtcgacagcaggcttctctttgcttccagtttttgtttttggagcttctggagcttctccaggaggagaggcctccttggtaggcttgtctacatttggagctttggacttgtgtggatccggcaaggtcttcccccctcgcaggcttatgttgacctcttctacctt

SEQ ID NO: 52994 - DNA, 1998 bp, Oryza sativa
caaaatagtatattttgtctcttaatatagcaaccttagtataggacatgacactattataaatttggataagcctcttatttagatttatagtattacaatgtttcatgtctcgtattggattgttatattatgggacaggagagtaacatatggtggcgcgcacacctttaaaatacaaattgagcggcaattctagaatacagatggagacatctaataaggggctaaactgtactcgctggctcatggcactggcgtgccggtgcaccgcacaaacatcgagcaagttaacacctaagattaacaaatgaacaatgtcagagtcaaatatgcgagggagtgagcttagttatgaagatgagacaacaatggatgctagcttcagccttcatgtgtagaattagggataaaaatggttgaacacaaaatcatttatttaaaaaaaatacaggcatttgggaattttcatatttaaagaaatccactttacttgactggactattccattggattaactctaaaatatttttttcttatttcatccctaaactaaaaatggttcgttgttactacttaacaacatttgtcttctttatttttctctatacgaatcgtattataagtagaatttttttaagccataaatgacatcattatcaaatttcaaaacatttttaaattagtgcttccaacctatataagcactgatattttttcaaataaaatgttaagaggtaggttataatggatctaccaatcaaaaaaaatcagtgcaaatacaaatttatggagagataaaaaaataagcaatattgctagggaataaggtgaaccactttaaatagctcggctgctcgggggtgcaaaatgagcccaaaaaaaattagagtgttatgtgctctgcccaactaattcaagggagtaaaatgaactttatttatatgaaaaaatttgctgcaagacacccaaagtttatgctatttactgaaggatacagcaagaacacacttttgttagagagctccgcaaaaaagtggtatttggatgttggacacccgtaatattgttttattatatctagaagaaatggagagagaaacatccgcgaaagtacggatataccctctctccatctgttaacgatcacagttaattcacatctctacataatccacaccacagttaatccacatctgaatctatatcacggttaatccacagccattcatcagtcgagttgaaagcagttggcccatagagaaacttgtctttaatgaatatttctttatccatttcttttggatataataaataataccgtaggtgtttcataagccaattaccatttttttaaggtgcccttcaatagaaatgtattttccggtgtcctctagcaaagagcgtaaactttgggtgtcctatcaccaaatttacctttttatatttataattaaccaattcaactattcagtgtatactataatatggtgctaaaggcatagcaaaaggtcaaacttaatgttcggtcaaaatggcaccattatatagaactaatatttatttggtcacgaatttccagaaatgtttccataagtagatctgatggtttgatagtaggctgatggcaaatgtactcgatataggactaggaataaggtctgggggtgtgagagtctgaccctcacaacatacggacttatcttccaaaatatagcaacctggtatggtgctaggttgcaatattttgtggcggagggaataacaaataaacatcatcatatgaaaatattttcaaacactaaataatgttagtacatacatgacaccaaacacatatttttaagtttaataatcagttgaagttttcaaatgttaactttgtggaaggcaaggagaccttacattttaaaacagatggagtttctttttaagaaattagatgggtggaaaacaattttgtaagaaattggcgatggaatttaaattagtataat

SEQ ID NO: 52995 - DNA, 2558 bp, Oryza sativa
ttagaaaaatgtttgtacaaaacattttattagtgacggcagtatatattaaaatggacttgaaattggcattgtcgcataaatcatgtaatgttaaataaaggatatcatgtttctaactataatctaaaatcatagcacaattgcatataatagattcctgtagtattcaaatgaacagatatggtggttctaattacaaataagcaataagaaatagatagcccatgataagtatttccccaacacgcttaggattacaaattaagtagatagatagctcctccacgatttcccttgcgtgtttagttctcatcactgttctcatcatcgttatcctccatcacctcatcgttgtcttcgtcgtcttcaatgtcgatgccatcgtccgcttccggtaggctatgcacaatctcgtctatgccttgcaattgctccagcatacttgacattattttttttggtaaaattgttccttttccttgcggagcttgaaagctttagtaactccctgaactttgccaagattccactcagtgatccgtttcttcaaattgttgttgaacttgttctccaatctagcgatctgaagacataagcaaaaatgttataagcttttgaactagcatgtggttcgaaccttacaagaaatgcaattgtatataaattgaaaaatatgtagaattcaaatgcatatgcatcatataacctatctatatggccatatattcaagtcattagccttgcagaggttttgcagagcagttgtgccaacactcagaccaatatgagcagcacttttttgttttatgtgaaagtaggattccaagtccttcttcgtcaatgtcttaactcgtttgcgctgttaaactaaaacatgttagcacaagaaaaaaaactgaaggaaaccatgcatgatctgtactatattttccctggctaacacagtagacctgatcagggaaagtaaacatcttcctcttgtcagtagctgctgtttggtcagtttgcacaagagaagtggctcatttaccaaggaagaattactttccactgtaggagctttgccatgttgatttttcttgggagcaggtggtaaaatggccaaagatctaggcacatctcccccaggatgtcctttgggcacaccatatatgactactcacaaatgaaagtatcattgcatgtatacatgtgattagtttgataaacaaatgttaatatccatagaaaatataaacgaaaatacccatataattttatggagaaagagagaaagagagatcgatcaattaatcgataccattttggccggagtcatagaagactcctcgccattggaagttctcctttaatagaatgaccagcttaacatatctctttattaattggaaatgaatgggcagcaacatagaacccatcccaagaaccctcaaaccagtatttaccccgaagaacatggttccacaacgtatttagtagcggatccacttttccttatctattaatgagactatagctttcttttgcctatgagctagctaaagatccatcgttatcccttccaacaagggaggcggaatcaatggtcatgtcaggtttcatattcaaagagagatgtcaagcaagcgccgaatccgtgtactcaacttgcccgacccgcttcttccactagacctcgtctttcaaagagcagcagccctgcaagcctaatagaaccttgtttcctgggccaagtcagcctataagtaagtaagtagggctgaagactatctgtttgttagtttttcaatcttcttccttctatgcttagagtaagtggaaatgacatccttgatcagcaagtaagcaagcggtagtttagtctccgacaagtgaggccgaactagcccctagatcagttctcatagtgggggaatcagagtcaagttaggcacagaagagggggttgacatcattcgtcgtgattggatcaatcaaactactccacaagaaatgccaagggactccctttctcatcgcccatttcttcctcatctgttgctgccttgagtgcataaagtaggctcaacttctttggtttctaaagatcttgtagtagccgaaggcaaaccagtctgcttgttagattgaattgaattttatataacctatgcagctaaagaaaaaaaaatcataatggtctaagtggacctctcaaaggtataaataattaactaaataagtatacattagtcttactagttcggtctttttctttttctttttgttatgatgcccacatttcatacttctcaattcttatttagtaggtatacatgtgattagtttgatagataaacgttaataaccatagataatataaaggaaaatacccatatgattttatggagaaagagatatcgatcgattaattgataccattctggtcggagtcttagaggactcctgttgtatccattcggaaccaaatggtcccagcattgagcatttcagcttgcaactatggggtttcttctgacacactgcatgcattcatgcatgcgtacgtgcatatg

SEQ ID NO: 52996 - DNA, 24009 bp, Oryza sativa
  unsure (1)..(24009): unsure at all n locations
nnnnnnnnnnnnnnnnnnnnnnnnnnnnnnnnnnnnnnnnnnntatcaggcgtctgagcattacatcagcaaagcgcctctttccttctttgtttggcggacatagtctattgaacagcgctttgtctgattgtgaagcctcatggaaaatccttgtatcgatagcagcagcaagaagattgtttgcagctgtaattgcatggatatctcctgtaagatgaagattgaactcatccatgggtatgacttggctgtagccacctccagcagcaccccccttgattccaaaagtaggcccttgtgatggttgacggaggcaagtgacaacctataatagcaacattaatattgagtaaagtagtaaagcatatcaataacataatatatactctataaaaaaataaacataatatgtacatcgatatgtcaatcgtttcaatatgctctggaatgcataatatactctatgtatcagtatcaacattcgccacttatactacgttcatgatggttagagacatataaagaaccatgcagtctatcatgactgttacaagaaacaaataaagtcctgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagaataaagtcatcccagacccccagaacagagcattgtatcaagtatttaaacattaggattttgtttttcctgaaaattgcttggtgagagagaatttatcaacatgactcttgcaggcaaatataaataaacacagagagttcagttctaccatggagttctgacaatgcaccaatgaagatttgatattaataagtttgacaaataaatcaaaccaaactgacagaattcttgattccactagaccactgcagaatttaaaaaggacagtgcctgcatccaatatacaggtgctagtgtgctactacgacagcataaaaagacttaaatctaatcaacaaagctcacaggctgatactattgtgccaagcaaactgattgtttacctcaacaccaatcacaaactttatctataaccaataagtaaccaagataccctgtcgattatagaacaagcgaaagtggcatggaaagcctctcacctttttatcaagaaacgcacccagcgcctggcacagcccaacggtggtggtcgacttgccctccccgagcggcgtcggcgtgatgccgccgaccaccacgtagtacccatcctgctgccctttcaactcatcaagaacagacagcaacacctgcaaaaaagaacaagcgaaaaaaaaaatcatcaacaaatcgcatcgcatcgcgcgacaacccaatccgcatctttggaagcggcgcacgcaccttggccttgtacttgccgtagagatcgaagtgctcggggcgcaggccgagctccgcggcgatgtcggcgatggggagcggcgagacggcgttggcgatgtcgatgtccgccggcaccggcgacgccacgtccagcctccggatcgtcgggctcggcttcggcgtcgtcatcggcaccaccagcggcggcggcagcggcggcgcgacggcggcgctggatctcacacgcagcgagcggtggtggtggttcgagtgcgagagcggcggatgcgagacgactgaatggcaattgtttattgccgcacgacgacgatggcatttgataatcgaggataaagatttcggataattggttggtgggacagacacatccatgacgcaaacacctcccccaaataatacagccacaaaacccctcaaatatcccacctttttcacttcaagattaccaagaaccctcaaattcctaacctttttcactgcaagatatttggggccaacaccaagaaacacttctcactgtactgagctttatacccttcctgtgcagccccaattcttcgggagttgtggatctgggttttgggaggatggcaggggttttggctgctcttatcttggattggttggatggaaaatggactgcaatccacaggagaagataagggttttttgtgtggagatgcggatgtgagcgatgatgatgttgttgctgggttgcaaacggtgatgcgtgcacaagattggggcttttgaaagagccaagtgtgtgctctttttataggtgattttgcttgagattttgggaacagttcatgaacattgcatgtgaaaaaactctactggcgtgcacgtaatgcagtgggtgaaaagaaaaaaaaaaggaacttttttccctttctcttcttgtcttcgttgaacattgctgtaagcctgtaactgcattggagttgatatgatcagtgagctgtaggacacatcatctctggattttgctgtgacaaaaagaggatctcatgtcccaaccacactcaagaaaaagcaagtaatgggacgaacaatctggtagagagtggtccaaaccacgtccgttttgcttggtttgtaagcgtgattcccttggattttgaggttttggggaggtcaattcccctgggttttgaagggtttaggggttcattcacgagggcattgaggcagataagaaatgctagccaaccatgctccatgcatagggagacgccttctttttctaatcctggattagggatgccatggtccatggcatgcattaccagacgagttggtcaactcatgccgtttgatccgggcgatttggatcttgggacaatgaggcccgttggtttactctgaattttttccttggtgaagcccaactgaaaagttaggcctaacagtttgatctgacgttcgatgggctgttctacttctatcccaccgataagggctaagaaacataaagaaccatttatttaaatttgttaataaaattcaaaatagaagtttcagaaatatcattgtactatctgagaattaagcctcacgaatcaacaacatacggcaatctttttttttatctcccaacgttctcgatggtactgagcaaattgagccaatgtaaaatgttacagtaccattaacaaaaataacaaccaaaattcactatgtagtattgacatgcatacaaatcaaacgaaatgaatcggatcaaagaatggtgaacatccagcaagcaacaggagcaatatatcatccattttagctccgcgtacttgtcgcaacaaatcaattcaaacactggcacctctcctctctcaatccttcttccggccatcgacgacggccaccacgggcgacggctccccgccggcgggcatgtcggagagcgcggcgagcatgcggcggacggcgctgacggagcgcgccggccgccgcggggcgccgccgccctgcaggctctgggccctggagaagacgtccgacgactgcgcgaggatgaggtacaccagcgcctgcaccagcacgaacacccacatcttcaccagcgcctcgtgcgagctcgccgccgcctccattgccggacacactcttcttctcgagctccggtgacacaaacgtacgcaacaagtgcgagagcagatcaatcaacttatcaaccgaatcttcgatcttcttctgctgctgctgctgctgatgcttgtgtgattgatttgtgtgggggaggatcggattgaagctttatatatatagacgtcgatcgacgacgtacggtcgccgggtttgaccgtggccggaggccggaggcgagcgttcagagtgtgcagagatgcttccaaggcgatggcgagttgaagtgttcgacgtgcgcacgagttcgcattggtgcgcgtcgtcgtcacgcgttcggtgaaaaagtatatcgagtttggcgcggccgtcacgggtgaactcgctacgtgagccggtggtggttgtttcgcgggtcaatggtcctccctgtcactgggattagaatgcaggggaaaaatactactccatccgtaatatttgacgccgttgattttttaaacatgtttgatcgttcattttattaatttttttattaattctttttctatcctttgattcattgttaaatatatttttatgtatacatatatttttacatatttaaagagaaatttgaataagacgaacggtcaaacatatttaaaaaagttaactacgtcgaatatttagagacggaggaagtacctttttggcatatatgtttattttttaaatttgtttgactgttcgtataaaaaataaacaaatgtataagacatgctgaagggtacttttggtgtagtagatctaatgttactcttttcactttacttataactaagtgaataaatatttttgttaaactctgagagaaaaagtcaacaatatcgtagtttacaaaatcgtctgtaattgtccaagcaactttatatagtgcacaattgttttcacatatctatgaatgtaccccctcaatatatactcaaagagatgaaaaccacgattaaatcttgacatcactaaaatcctattgaaaaaggcgttgtggagactagataattaatagtcttttaagtggcctgctactttcttcgattggccagccactatctccaaacgttgacaacatgctaaagaaatggaaaccatagtcaaatcctagcatcattaaaatcctattgaaaaggtattgtcaagctcggacaactgatagcgattttcagtgacctgccactgtatccaaacttcattagcaatcggcagtagaaacgcaatggcaaagcctggtttgcctcctaatcaatatgggagctggcttggacatatgtgcaatatctgtagatatagatggccatgtgggctgcccggcacggcacggcctaggcccggccatgcctgggctgaggcttgtcgggccggcacggcccgaccgatgcaccgggccatgccgtaccagtccacgtgccacgcccaggcacggcccaacatgcgtcgggccgtgccaggccggcccgaaggcacgatgggtcatcgtgcttttcctcagaataagtctcattttcctccctcctatcgggctgtgacatatatatagctaaaaatagtctattttacctccctcttctttgggctgtggtatataaatagctaaataagtctatttaaggtccctattctttggacaatgacatttatatgtctatttttagtccctacactttatgtggcgggcctggcctgccggcccatcgtgccgtgtcggatcagcccagcgtgctggtagggaggcccagacacggcccgtcggtcgagccgggccggcacgggcccaacccaagtcgggccatgctgtgcttgggccagaccaaaaagccatgccgtgggccgagccttcgggtcttatggccatctatatccgtagaccgtagtcattggggtttaaaacctattggattggagtcatgcatgcacatgcatgcctccaattttataatggttgattgaggaataaataaatgggctggtaccttgtcaacttatctttggtaaacacatcttaacggggaaaaaagttattggtcatttcctaaaaactgtgaaataatttactgatcgatcaatttgtttattttagacgtacggtttgattcctcgaaccgaacttcccataagcaaatgattaagcaaaatagctttttccatttgcctctagagctcaacgtttttatttagagaggttcatccgtgctgggaattgattacgaccgttgatcgtctctaatccaatgcatcaggataaaaggtatgatggaaaaggtacttaaaaggtgaaccaggtatagaaggtaaaaggttaaaatggtaattgattttcatggtttatttgtaccattaagggcaaatacatacaaacaacttttacctacctgttcacgtccgtttcctgatccctcgatctcgggttgagtttagtagaggctgcaactgattaatcaccgattagtcggatgagattagcatgcaccggcatggtgcttaattagtttctcaacgtggctgatctgcgtaattaaatgctcaacaattagccacaaaatatcttcttcgatcatatgctagcagcttagaaattaagcgcatcaatttcgcaaggaatcaattactccaatcttttcaattccatttaacagcttcacaacaatgaatcaatgcttcagcgttctgtaatcatcagcaatggccagagtccagcagcagcagcaacaacaacattacgcaacattcaacaacaatcagatcaaccgccgtacgccctatgcaccggcgctcagcatcagcacaggatgccactggccagcggatgggtacgggggttgaggaattactaatctaccctagttaacaatattttttatttctaaattatcctttcagaatcaacggttgatattaattgacttaggaggtacccaggtacctcccaagcattgtaaaacccctcattaatttatttatcattgctgcacacagtcacttacgcggttacacgtgcagtgaaaagtaaaagctaagtacgagtaggacacaaaactttccgtgtcgttgctgagtcagctgggatctgatccaaatcaaaatagatcagaggtgtttggtagaataactttcaaagctccaaccaagacaaaatactgttagtaaatgatagtttcctttatttgtatggtcaggtttctttgaagtttgaattcgattcccgtcgaaataacttacgaaatgtttgcaagtggtagaaccaaaaatgatctaggggcagggcgttgatttaggagatccaaggtcaaagacaacattttgatgtgtacttaactcatgagatagtgataggtgcatcatatgctcgtagagtcgggcctagacgacccaaactgtgagcttaactcatgagctgcagatttacctgcgttcgagaaaaaaagctgcagatttacctgcatatcagcaatgtaggagtaacaacgaatgcttagcctcactaatcaaagaaagaatccgtatttcttgacaaatcgtaataatcccatctccaaatctgtttaatcacagactgttgactgaccttaggttgtgtttagatccaaactttgaatccaaactttcaactttttccatcacatcaacttgtcataaacacataatttttcagtcacatcgtaccaatttcaacccaaacttacaactttaaaaggaactaaacacagcctcaatatagcaattggtatttgtaatttgtgcctgtcaccagtcacgactcaatcagtgtgttgctgccgctgacggctgatttccatgtaattaagcaacctgcggcaaatcctcctgatccggcgttctcccggcagagaccgccgccggtgatcggtcgcagtcgtcgtcgtcggcggcggcgatggcacggcctcttggtcggtctccgtcggcggcgaccatggcggcgcggtctcctcagtacgcatcgggacgctgcggcggcagaccgggcaggtgtttcgcagcgacagccactgcgcgatgcagtgggcgtggtacaggtggccgcacgggagcctggacgccggcgacgcgagctggagggcgtcggtgcagacggcgcaggccgccgccgccgccgcgtcgtcggagacggtgacagtgatcaccgtggccagcgccggtcgagacgacgatgggcctgacacgaaggaggagtcgtggatggaagacgtcggtggaccaccggcgtgcggcggcgtgtcaggatcggaggagatgaagtaatccgaggagagaaacggcggcggcggaggaggaggcggcagcagcagcagctcagtggagaaggacgacgacgacgacgagggttcccgccgtagcagcggcggcggcggcggcagtagctctgtggaaaaggacgatgacgacggcgaggctacgcgccgccggagtagtggctttgccggaagcgtcggcagcggcgggggtggaggcggcggcagttccagctctgtggagacgaacgatgacgacgacgatacgcgggagagtggcagatgcggcatcgccgtggccgaggaagacggcgacgaggggtggtcgtactggccaaagaagtaatcccatgtctctaagtccgggaatggcggcggcggcggcggaggcggcggcgagcggctggccatggcggcggaggtggacatggtggttttccacttgtatatcaggggatcgatctcgttggctttggtaaactgttttagcagccagtggtccacccgtttatagtatgtcatctaaatagttataaaagatattaaaaatatataaataagatagatcaatatgtaatatatatcaatcgtaaaatttaacttctacagtaatctatagaagttgctgtagaagttgaatttgaatttgtatatttgtggagtaatatattatatattaatctatcttatcaaattttttgaaaatttttcgtaaccatctagttgacataaaataaattggtggacgtccacttgagttagaatcctctccccgttggcttttgctttgctttttctcttgcgcgttgtgctgctgctgctgacgatacgggtgactggttcgcgcccttttttttttctctcccgcgtttttgtgacttaatcacgaagaacttcgacgtgaatggccaatcaaaagttaatcccacttaattagttacgtgtacttacatggttgatgggtgcacttgtaattaacctctagaatatgatactgcccatatgaatggataatgattgtactactactacctgaatcttggagtagagttatgaaaatacagtaacacatttaacagtttaacaccggcagtgacgagttagttatctttttccgaggatcacctagaaggcaacgtataaggtgaaaactaggttcctgtgcaaacttggaaactctcaattaagaccacaggatgctcatccgatggctagggacagaggtgggctaattttacactttaccacccgccattagccagactaatcatgttttttttgcaaatcaccccacccaattttacaattaacgaccatcgcttcgtctggtcgtttcgtctggcaacgccgccgccgccgccctagtcgccgctccctcgcctggccgcgaacgcagtggcgcccagccggctcgacgccgtcgctggcccgccgagtgcgccgcacgccgtcgtttcgtgagtcaccgccgacctcacccgcgatttgccgccgccgcccgcccgcgagtcgccgacctcgccatcagccgttgcccgcccgccaccgtgatggagtccggcgcgcgcgacgccatggagtcgcatttcggcgttggcagcggcagcccttcatgccatcgttagtttctactataagactttcatcttaactttgatagaaattaatctgattgctagcgtgcctgcatgcagtggacggtgagcctgtagtcgtcgttgattctacctctgttgaggctgctgccttggatcatgtcatcatcaccgtcgacgccggagttggagcccaccttgaacatccaagcacaccacaaccaaaatcttctgtgagtatagcagtaagttgcaaagaattcagatcatatgctcatagggtatttggcatgagtggctaatgcatttattctggaacatttgaatgaaatgtgcagatacatttccttttccatagtaaacatgtcgaactagttctgcctgatttgttgatcatacaattttacacttctataggtctcttgtacaagtgacacatgcaacacacattggaaagaacatttgaagcctatggttggaatgatctttgatacactcacagatgtggagaaattttacaaatcatatgcacataaagctggtttctctgttcgtgttggtcagcactagaagcaaaatgaggaaatattattcaagcggtattattgttcaagggaagggtacagacaggagagtgtaaaaaaagttaatgatgaatccggaaaaaaaagaaagtcaccaaatgtgatggaaactagatgtggctgtgaagcacatattgttgtcaagcttggcagtgacaagaagtatagaatatcttcaatggttgaggagcacaaccatggttttgtgtcgctagataagaggcatttgctaagatccaaccgtaatgttagtgagagggcaaagagtactttgttcagttgtcataaggctagcattggcacctcacaggcatatcgacttctccatgttagtgagggtgggtttgagaatgttgggtgcacgaagagggatttgcaaaactattaccgtgaccttagaaccaaaatcaaggatgcagatgcacaaatttttgtggcacaacttgagcgaaagaaggaagtaaatcctgccttcttttatgactttatggtggatgaacaaggacgacttgttcgtgtattttgggcagatgctttatgcaggaaaaactatagtgtttttggtgatgtggtttcagtagattcaacatataccactaaccagtataacatgatttttgtgccatttactggagtcaatcatcacttgcaaagtgttttccttggggcagcattcttagcaaatgaaaagatcgagtcatatgtatggttgtttaagacctttcttaaggctatgcgtggagtagcacctcatctaatcatcacagatgaagatatgagcatgaaggctgctattgctcagattctaccagatacagctcatagactttgcatgtggcatataatggaaaaggtacctgagaaggtcgggcccaccttgaacaaggatgaaaagttttgggatagactaaacaagtgtgtttggggcttcgagaattcagatgattttgagtcgcaatggaactctatcataacagattttggactcatgggaaatgattggttttccacaaggtttgccattcgcaaatcatggattctggtatactttatggacatacctctagcaggaatcctaggactacatcatgatcggagagtgcaaattctttttttaaccgattcattcatagaaaattgacctttgttgagttttggctaagatttgacacagctttggagtgccagcgccaagaggagttgaaagccgacaatgcaagtcttcacaccactcctaaattgatgacaccatgggccatggagaagcaatgtagtgtgatatatacacatgaagttttcagtaaatttcaggaagaaatcgtagctgcaagagaccattgcattattcaaggtatttcagagtgtgaagatataaaatttgtcaccatcagcagcctatctggaaaagagcgagtggttcagatgaataagtcaaacatgtttggtaggtgctcctgtaaattatatgagtcctatggcatcccgtgtcgtcatatcatacaagtgcttagagccgagaaacaaaatgagataccatcgatttatcttataaagagatgggagaaaagatgtaaaatgtgtgtattgtattttttttttatgtggttgttttgtttccttctctattcaccaatactccaactttcctttccttttatgtttgccagggaactattatttgatgatgaaggaaacctactagatgaaaagcctaaagatcctatggaggtggcaatgcagaaaaagatttcagtttcacgcaacaagtttgaagatcttatccaaatggccaagaattctgaacaagggatggactttttacattctagtttgtccaacctagtagaacctctccaaaagatcacgcctgctacgagagttaataaacaggatgagtatgaatctttccttggtagtaaaattccaaatgaaatcaatatacatccaccaaatgatatcaaatcgaaagggagatgcaaaagaattaggaagagcaaggagaagaaggctggaagtggaagtaagggtacaagtaaacggaagtgtcgaaagtgtaagcaagtagtggatcatgatgcacgcaattgcccaaacaatgttgttggctgatatttcaagttcctgtaaccttttaagttcaattgagcaaagtaatattgtaaacactttttttactagtgacatcattcagctacctcatgttgatatgcatgtttataaccatgcaaggcgcttgactaatcaaaaattggaagcagtgttcagaattctaaccagtttgatttatatatgttatgtcatctgagatattatataggaatgaattccaaaggtaagtcatacaaaacaaggtttgtacctctggccggcgcactatttagaggatgacaaaataatgggctctaccccctctgtcgtagacaaggtgatacagctctacagctcgttgtcagttgcagatacacaaaaagaatatgaagcatggtagctatataggtggcttaccaacagcttgattttggacaatgggagatgacccagaccgtaaaagaccggtgggaagctctagcaaacatagcaggagttccaaaaaagggactgcgtactctcatcctccttaccgtttgggagatctaaaaggagaggaaccaacgaatcttcaagtataatgaggccatgtcgtgtttcctttttgccaaaatcgaggaagaggtgcggacatggataatggcaggagcaaaacacttacatgaacttttgccatacactatatagtgtatagagctttttcctttcccttgcctctaggggctgtatttttctaccactatatttaatgaaaaaggcacattctcatgctgttttccctttaaaaaaaagttgcggctatacagtttgatggtgggttaccattaaccagctgctatcgcggcaatcgcgacgctcagtaaccgtgtaaaaccagataatttcataatcacgtgacatgaaggggttagcacgtgagaaactatagagttctgaatatcagagaaaatgtagcataattcatataaatcgtagataaaatttgattttttaaaaaggaaaatgtatagaatataaaatatataaattatatttgaactgaaacaaaatttactgaacaatacgcctggtaatctttagcacacctcgggcataagcttagtcgtcgttgttaccgtgcggtaactggcgatactgtgatttgtgaaccctagctagtacttcctccgttttacaatataagtcattctaccatttctcacatttatattgatgttagtgaatctacatagatatacgagactttttatcgtccagcagagaagagcggtaccaaatttggtccgtcgatccaggatgatcggacggctgtcaagcatccggtacctagcggtagggctgaaaacggtacggaaactttccggattccggacctattttcgaaaacggaatttgtcggtcggaattttttcggaatttttgggaaacggaaacgaattcggaaatattttctcggaaacggaatcgaaaatgataagggcaatttccgtcggaactcggaatcggtcggaaactttccggaaattttttcggaattcccagaaattttgtaactaaaataccctaaataccctgggttctttttttaagcacttaatagagaataccatggtgttttgttgttattttcttgaaaatatttgttatgcaaatctaaaattacataagaatattttttttccttcattgggatttaccaacatcattactcttttaaatatagataatttattttatagattgtgttttgtgatgtactgttaatacttaataattggacttatatgattgtgttttatgatgaatcgttgacagttgagatttgagaattggattaatcagtttgaggggtttttttattccgataaattttcgttactgtatttgcgtcggttcgttttcgctccgttttcggtttcgataatattcgattccatttttcgtatccggggtttccgattccaattccaattttgaaaaaaaatatgaaaacgaaaacgataaagatggtttccgtccgtttccgtaccgttttcacccctgcctagcggtaccagggctcacccctcccggtactaaccatccgaagggtaaaaccgtaattttgtgtttagcctcaaagttgtgcccctctcgctggaatcccgattcgatgcgctcgccggaccgtgctcccctgctccttccccttctcttctcgcagccaggaggaacgaacagcctcatctcccacctcgactcgacaacaggaactcaacccgtcaccggcatcctcgccgcacggcgcttctccccgccaagccagttaacaaaacaacatgtattcatagcagtcgtatgtttgacatttcttactcgtccatgccggaagtggaaccatctgccttttttctttgctttttttttcttctcgactcatccacgatggagccatctaccattctaccttgatttttcctctcatccttcgtttcttgtcttattttttcttcaacttagttcatggcggaacaatctgcctttttttttctcatccttcttttttccctttttcttttctctactcagtccatggcggaaccatctgcactgatttttcctctcacccctttcaatcacggtatcctctcattatcacaagatttatggcctcctccatccatgctagtcggcatcgcgtagagcaacgagcagttaatcgccggcggcgacagatcgagaaataacaacacagccaccgggcactagctgaataaaggttgtggcactagtagtggtactatggaagaacacacaggtggcgctggcggcaaggagtggtgtcagagcagatgccgtcgaagaacactcacgcggcggcgtgccggcggaaattcgaggacgatggcgaatgaacaagcagttcagaagcaggggcgcagggcaaatcgattcttttttttttcccatcatgccccttttattcaacgattggattttatttggtacctagcagtaccagtatctgaagatactacttgttggaccatagaaattctctagatatatgcgtctagatttattaacattaatataaattaatataaatatgagaaatactagaatgatttacattgtgaaatggagggagtacttgcaagaagcatctctgcacacaaaaaaaaaatcacttcacggtttcaacgcgtggcagaaaagcgtttagttcaagcacgacctgctcaaaggctcaaagactcggacagtccgactcctcaaaacaacaattaaagtaggagtaagatgactcggatggttgtagtctggaatcagtaacccacaaaaaaaagggtagcaaagttggctgcattacagaaatttgacgaaaatttttagtgtacaagaaaatttgaagccagaacataaactgcagtagaaacccttgccatctggggcatctgcctttcgaaatgaggatcgatatagttagctccatttactccctccgtctcaaaatataagtattttttctataaatatggacaactatatatctagattcataaccaaaagttgttatattttaaaatagaggtagtagaaataaaaaggtatataattcagctctcaatcgaggatttgaggcaacaaagttcaagaaaaacgaaatgttaaccacactaatcgaagaacccattcttgacaaatcacacaccaggtttgatcacaaattacttgctgactggtctcaattgaaatcaccattgctgcgtcgtgtcgccgctgcatcggttcagttgacgcgggtggctcgtttccgtgtagccaagcaacctgcggcagattcttccgatccagctcgctcccggcagagaccgcggccggtggtcgtcggtcgccgtcgtctccggaccatgaggcggcggcggcgatggcgcgatctcttcttcgtcttcgtcttcgtcttcgtcggtgtaggcggcgccatgatcggggaacaacgggacgcggcggcggcagaccgggcaggagttgcgccgcgatagccactgcacgaagcagtcggcgtggtacaggtgcccgcagggtagccggcacgcggtcgccgccggcgggaggtcgtcggtgcagacggcgcaggccaccgcggtgtcggagccgacggtgacgctcctcagcccggtctgctttgcgacggtccatacggtggaggaacgcgagctgaacaacgagacgcactccaacgagtccaccggcgacggcgccgtacgcggagtccgagtcgagggcgtcgccgccggcgccggcagggagaaagagccgtcgtcgtcaccgccgccgccggcggagcggtagttcgggaggtccctctcgtcttgaacaagtacagcgggaacgggggcctctcgtacgtggccagagcgacgtgcttgcggcagaagtacgggacagccatagccgacgaagaggtggcggcgttcgtcggcggcggaggcggcagctcggacgagggcggaggcggcgccatcgtgaccgaggaagacgacgacgaggtgctccgcctcctctcggctcgcgctatatctatgcgtcgcgagcaatggacgccggagcagcactgcctcttgctggcttccatttgtatttgtaatctctcactctcgttgcttgctttgcttagtgtggctgactctaggccacctttttattactggtgtttcgctttagtccacccttcaaccaatattttcaatttgaaccggataagtttaccattatgtcattttggactacccctcaactctctcatccatctgccatgtttagttctaaaataattcttcaaacttccaacttttctatcacatcaaaactttcttacacacacaaacttccaacttttttatcacatcgttccaatttcaatcaaacttctaattttggtgtgaattaggtttattgatgaatatgaactggcgtactcgaggtcgttcgtatgcatgagaagagagtcggggtagtccaaagtgaaacaaatgtaagattacccggttcaatgttaaaacattagttaaggatggcccaaagtgaaacaccggtaataaaagatgatccaaagtgaaatttacttttttttaatcttttccgcgtcggataacgaacgtcctcgcgcgcttttgtgacttaaccgtgaaaaatttcggcgtgagtggacgaataaaagtaaagcctcttggttacgtgagtactacacctgtaattaacctcttggatatcggaaatgctgatgggcgatcgatcgctagggggattgggtagcgatcaattcgccccccccctccctccacctggtttccttttttggcaccgcattataagtcaaaagtttatatacccgttttaaatttgaatttgaattatatctgattcaaatttgaatttgaattcaaatattttctatatatagtatttctatacatctaaagtttatacacctaaagtttatagatccaaagtttataagtcaaaagtttacatacccgattcaaatttgaatttgaattcaaattttttatatatagtatttgtatacataaatttttctaacttttgtttttttaaaaaaaatttgtagtatactgtagtaggaagagaagaaggggaggaggaagggggagaagagggaggggagtgcgggtgatcactgggagcgatcacccgcgcattagcagtcccccttggatatggtacaacctatgcatgactgttcctaataagagagaagagacaagacagatattgtgcgtagtcttactaaccgctaccttcgtcctataaaaaaacaaatttctaataccgtgacatctcatcagattcacactattgtaatatgtcgtataatgtactaggtttatcttttatgggatagatggaatatgcaaattcactcataaaaaagaggagatgagatagaaatattgatgttaagtctaccgatgattgttcgaataaacacaatacagatgtagacactcacaatgcacgcatacttacccctataaacacctccgaaagattgttcggtatatcttgatattgacgaagttaacacagacgcctcacagtcaacatgtacatgctcacaacatatgcgtataccaaactttataagcacctctgaaaaattggtccagcatatattaagattgatgaatccggtcccgttcttttctccaacaagagttagatgaagattaagattttcgtggcacgcttttcaaactgctaaacgctatgttttgtgcgaaaactttatatatgaaagttgctctaaaatatcatattaacctattttccaagtttgtaataattaaaactcaatcaatcatacgttaataccacctcgttttgcgtaaaaaaacttaatttttatcttcatcttcagaagaaaagaacaccattgaagtcaccatggacatctcgatgtcaacgtgcaagagctcacaacgcacgcatactcacatctataagcacctctgagaaactggttaggcatatcttgagattaatgaactcactacggacgccttattgtcgatgggtacaatcatctatcattgaaagaataattagctgtaaatacgaacacatatgttaaatctagaatttaaacttgggtgagcaaatttcagcataaaaaccctaatcagttaagttatactccctccgtcccataatataagggattttgagtttttacttgcaatgtttaaccactcgtctcattcaaaaaatttgtgcaaatataaaaaactaaaagttatgcttaaagtactttggataataaagtaagtcacaaagaaaataaataataattctaaatttttttgaataagacgaatggtcaaacagtataagaaaaactcaaaatcctttatatgacaggacggaaaaaactcaaaatcctttataggatgggactgaggaagtacttacttggcatctatcaagggttgttagtgtttataaaaggagaatttgttgtatgagaatgaggaaaaagaaaaaaagacaatgaaacaaatatttgtgtttattaatggctgcggcctttgttgtttgaagagtagtacgaaaatagtactagtctctaaccgacctgtattgcctagatccctctgccttttaacactcaggaactgaactgaaaatacaggtaacacatacatttaacaccggtggtgctgggtccgtactctttttggaggactacatggaagcttgacggcgtagcatgcacgagctttcatcagggatgactcatacacgattgacccatgtcttttattcgaaaaaatagatcaagagatgtcaccatgcacagatgcactctccagcaccaacggaagaaacgggatcaaagttaatggaatccgtggacgagaaagtttctgctttttttttatttgtttggaagaccagaaagaaagtttctgcctcctcagccacaatacgttcacccgatggcaaagaacaagtgatccctcaaaaaaaaaaaaagaacaagcgatgaaaaccgccacgcttcgaacacgtggcagaagtgcagaacaagtgtttccgtccatccgcgacgcacctgcctcgaaccgaaaagaaaaaaagatcgggctccacaggttatcaggcaagagaacgtagaactatatctgatgtacaagccggcagccaggtgcacaacatgagcaacccacaaaagacagcaaagtaggttgaattactagtacaaacttgaagaaagagttgcaaccgtaatgcaagcaggtaaactgcagtcgaagccattcaaatgagctgtggtttcttcacatgatgaatatttgtgtaactgaactcccaatgtagaaaattttgagcgaaagaaccgagtctatgtctccttatgaaattaagattggcagaaggttcccacaccatgtgcaatcagcactcttatattggactcgaataactcacattatgtgcagacttttcgcacagccattttgagattggaaacgaatgatacggttcatacaaacaaacgaattataggcatcctgaattacttaacaacaattttgatgaccagataaagaacagcaactagcaaaatgagatttttcattctcctgtaaccgaagaatacaaactggtaaggagaagcccccacacaatgcaactctaaaaaatcagggtggaaaatgtgtgcatgaaatgtacaccagttcatctaaaagtgaaaaccaaagtaaacttacatcaattttgtacactatagttgttcagaatgcatggcagcaagcctccaacttcatggcatgcgtgggcaaactctgcagaaaaaccaaataatcaacataaacacttctaccatcgggaaacacatataaaatgaggatagttgtattggccctagaagttaccttaaagggtgaattcaacaggaggttcaggacaaatgaaagtggcagaccatgcctttcaaatgaccaaatatcaatcagcagggctaaggtgtacaaaagaatgcctcacaaaccccaaaccaaagagtaaatctaactccctactttttccacatcaggaacacatcttcatttgttagacgaaacacgactgtagtattcagtgaagtctaagcggaagagtaggaatttcaaatcaacatgctgttgcataggtaactgagcgataaatgcatcaagtgaagaagtataatctttcgcgatgctatccaaatcttcacccattttccggaaaagttccccagccagctgaatcatggctttcctcccaccatccacccatgaatccacttccttggatttagcttttgcttttgattttggcttaccctttcccctgcagtaaaaaaaagaagaggtaaatcaaacagcatatatgtaataagatggagagagatggcattggttaattatgcaacaatctaacctcagttgcaactcatatatccgctcaaaccaccgatcagcatggctccggaattgcaaaatgatgtcaaaaagtgcaaaaagattcctcagaattccatgtgatctctcaccaaggagagacttctccacaatcgatgtgagatacttatcatgtgccaacagaagatcatctaaatcctttgctgaatccatttcttctgagaaacgagcccaggaaacttccaggacctcaaacataatgtagtactggaagttggtcacaaagtggttcatttcattaaatagaacttggcatttgcgaagaactgaaacaaactgagacctgatgtttgttccctccttgtaaaatggagatgaaacaatgcagttaggcttcattgtcttccagattccagtcaatgaatggtctacacgcttaagcttccacaggaagttaaaaatcttgaggtacctcttcatgacagaagctgtgaataccgtatccagaggaaccctagcatcatactccaaggaaaacacatcccagccacgatcaccatctccatgatccatcatctttacctttatgcgatccaagatgtcacggtcatcatattgagcgttagatgctcggatcgcagtctcaagcaacccagccaaatggaaggagctaatcctatttgctggctctgacaactcagggccaacaacatccatcagatactggacgaagtcaccctgcccaagaagcaaatacctcttaatcgcaagacaatgatctttgaatcgataccgcttatggatcacatccatcaaatgccgatcaatcctcttggctgcttcaaccactagtgcctccaaagcatcaatctgcccataaccaagcccacctcgactagttgtggtgccaacacagacagcagcctcagtagcagcatctgcccaaccattatcatcacagcaaactttaagaaagttgattgacttcccggttctaagaatcctttgcgccagtactggagaaatgaaagctggaagcatatcagactgaagaagatagccctcctgccacagagactcagccttgactggctgcccaacaatgaagaattctgcaaacacatcctccaactccccttctaacacccagcttcggaccatttcaaacagcggtgagcacacccgccgcagcaagcggcccataaaatcctggaaggtgggatccccatgctgtgcgtgcccatggatcgcaccagccattgcgccacctctcaaaccccggcatccatcaaccaaaaccgccattaggcgcatcctcaccgcaggctcagctagccaaactgcaagacgccgcagagagaggtaattaccagacacccctgaatcagatccaggcgtaggaatcggattcagcgagtaagactcgagaacggcgaggagcttatagtaatcagagagctcctcctgtagagcggagcagaaggcctgagcaacggtgccgacctcggtggcagcatcggagggagagcgactgatgttgtcggagatgaacccccgcaccttgcggaacagccaccccagctcgcatagcttgcgcaccagggtgcgcgtggagcgcggcacgcggacgccgtcggggaggtcgtacgcgtcgctgcccttgtcgaaccgcacgtaccggccggcgatcccctggcacgcgtacaacacgtcgcgcacgagcgccgcctccgacacctccgtctcgtcgagcaccagctcggggtactcccgcagcgcgatct

SEQ ID NO: 52997 - DNA, 2436 bp, Oryza sativa
ggcccgacgcggcgaggcggcgcttgacggactccgcgagcgcgtgctcgtcgggaggacggctggcgcgaggcggctcgagagcagccggtcgcgaaccgcagcgcgccccccgcatccctcccgccgccgccggattcggcggagatgaggcggtggacgagctccttgacgagatcctgggtttggtggtcgtccattggaggggctagggttcgagcaaccgattccaccgagcggggggggggggggggtttggtttgggggattttgcggagggaggcgaagtggtttcgtttcgtttctctctcctcgttttgtaatttttcggttttggatttgtgctgaatttggtcgtaattttgggcggggagaggaatcttttttgaaaaagggtgagggttgtgtgactgctaggtgggaccgggagtttcgaggtggggatgcgattttttttggtgtggcccactgtaggtggcgtgaatcgcagagaaagcgaagcccgggaccaccaccaggtgggacattggttcctctttttgtgagttgtactgctgatgagtgatgagcagaaatttaaaatcgtccgtgcacagaataagctcggtttggattagagatgatcgggatcaacaaataaagttgcatttcagccctacaaatttctctccaacattttatcaaatacggaggaggatagacttcaagcggaattaggaaaacagaaaaacagacttcaagtggaatttggaaaacaattttaaaaaatttgattataaattaaaataaaactcctgcaaagaaaaagctggaacgggatacacacgccatacacctgacaagacctctcctacttcgagcaagttagcagcatgtgtacaacttctcctatttctcaacccgttcatgagaaaagagatatgcacgaaacaagtatgggctccttcgattgctagcccatgaatcaattacagcctcgacaagctttcacaatcatcttaatcaaagaaatcctgcttataccaccaatccgtgttggagccatcctctttggtttggactatatcatatgtgaatggttacaactagttggtgttgttactggttgcgcctccaataggctcgcggatgtgggcgactttatggtgcaaggtggattgtatccaatccggtcgggggcaacttcgttagcatggctggcaccttcttgcgaaggtagccgcactagtcgatgttagggataacctcgtcgacatgcaatgttgcagtaaaggagtcgttttacgagcgcatgtggttcttgtccttcaccactagtcccaatgtgcaacaggatgcttgccaacaagctcaatgctgcacggcattaaccaacatgcagtgtcttggttggcttcatacttgtcttgtgctgatatcggtagacatgcttcttcaccgtggttcgatgataagggaacttgtttccgtcgtccaagaatggtagcaaaagaccggggcatgctttttacaaaatggatgcatcgaggcatcgatgaactagcgatgctcagtcatatgtatcttgcttggtacctcaatatcaatcagattcggtactttttatgcatatagtataagacttgatatttatcgtgttgtttcggaatggtatcccgtacaacagcgtaaaagcgaaagaaaaattaaagtaccagtataagaattgctataaatcaaattctatatcacaatataagaatttcttttactaatttatcatgtttcacaacacttaaattttaagtgaaaccaggtcaatttgatgcttcaaaagggaatctgatccgttcaaaatcttaaaactaacaactgaagtgacttaaaagatacggagtactaaatattttgatctaattttaatactactaaataaacaaattaaaagaccttcatatttatatcttcaaactgagagtttagatggagaggtagaagtagactctgcagaaaggggaaaaaaacagaaaccttccagaccggagtggagcctctctgtcccgtggcggccatgtcagccggaagcgaaagagcccacgccgccttcgcgagcccctcgccggtgtcgggggccttcttctccgcctccggctcaatcctctccggctcaatcctctccggctcaatcctctcctcctcctccgccgctgtcaccaccaccaccagcgcgggtaggaccccgtcctcctcctccggagcgcccacgaaaaagaagaagaagccgccgttccgccccgtcgccgacgacaccaagcccgtcctccgcgacccggttcgctcccctccccatctcagaacccatggggtgatttggttccttcccattaatctgttcggtgttgtgatttctgcagatatctcggtcggacccggtggagaccgagcaggccgtgctgc

SEQ ID NO: 52998 - DNA, 1804 bp, Oryza sativa
taaaccctgtagacgaaaaatcactctcttaaatattcattgcctcataggttcatctattccgtcctgttttgtctgatatgtgtgcgagatttggaacaatgttttgcctctggaccctgatgtcatagactataagcagcaaattattaaatgccacgtcttaaaagtggcaaatagttaaatgccccttttctccagccaccgaatgctacaaagtggttcttggtgacatttggtacagagaaccgatgtttttttttttagaaaaaaaaaagtcagtaagaccctctttggtatagctcttgtttttttttgggagccggtattcccaactctacaaattcatggatctaaatccacgattacgtcgataacatttggataaattattttgtttgaatagatgaaatttaagattttaaaccactatattttaacataaaaacttcaaatctaccgtggaattgagaactggaattgtaccaaacaggtttaaattaaccctttttatgaaaattggcagtttgactaatttatgggaagaacaatgttcaattccctccgatttttttgtttctcgggcaaatgctacttgtctatgaaggatgagaatagcatgtacaccgataaatcgatcattcaagcataatattattgcatcgataaatcgataattcatgcataaaaatagtgtactctatttcatgttataaattgttgacttttttcttagtcaaacatttttaggtttaaccaatcttatagaaaaatatagtaccattttcaacataatgaaactaatttagtatgatagatattgctaaacttttccataaaacttggttaaacctaaaaaaaatgattatgaaaaaaattcaaaatgattataatatggaaatgaagggagtacatcattaggggcattgattgaggtctccttttttctccaacaatagttggatgattaagattttcgtggcacgcttttcaaactgctaaatggtgcattttatgcgaaaactttctatatgaaagttgatctaaaatagcatattaatctatttttcaagtttataataattaaaactcaatcaattatacgttaatatcacatcactttgcgtaaaaaatttaatcttcagaggaaaagaacactacctgagtatacaagtatacaacacattgatgcattcattatgcttcggtgcctgccgtcctgcagtcgcaccaaggtatcatccaagttccaacaaatgccccagcactgatgaccgcaccagctactatcgatgccgtcttcctgagcaacgcggcgacgccggactcatcagcgtcagctccggcgaaccaccgatgcctgagcgcggcggcggcggtcagcctctcgccgggatcgaacgtgagaagccccctcaggacgtcgaacccgtcccgcgacagcaacttctccgggaagagctcgggcagccagccgcgcgcctcctgctccggctgcggccgccgcagcgcttgccatcgccggacctcgtaggctaggagctcggacttggacttgaaggcctcgcgtgtcttgttccccgggacgccgagcatgtcgaagatctggtacagctggtcgctcgtgccttctccccggaacggcgcctcgccggagaggagcttcgccatgacgcagccgagcgaccacgtgtcgacgcggccgtcgtagtcgggcatgccgagcagcacctccggcgccatgtacccgtcggtcccgaccgggcggtacggcgccgccgcctcggccggggacatgtccagc

SEQ ID NO: 52999 - DNA, 12754 bp, Oryza sativa
gccatcatctcgctcgtcggccatggtgcacacgtcgccgcctcccatggtggctatgcagaagagagacgttgcttgcaactggccttggacataatcaggccaagagaataagaaggctttaggatactgatccgattcgagttcaaaaggcgtttagtttttccgcattgtgttcggatttttttcaatctgtttcgttcaagtaaatttaatccgatttgtagcctttttggcttgcattaacaaaaccatgcattaacttatcaagatgaacatgttagcaaccaaatcaccaaacaacaagaatttcaccacgaacaactatccagtcaacagtgctgtttttggaggtggaagacgaggaaatacaggggttctggaaggttctagaagctagggaaatgggaggtggaggagggaatagatactcgacgaggatctagcccggatccaagccgccgccgctgccgccgatcgccaagccgctcaggctggtcgccgtcctgcccctttctgtgtttttcctcccctgaaagaaccgatgctgttgcttttgttctttaccttgggtttgcttgggccagcttgaatgaatggttgtacaggcccattggcagcccactcgattcctaacaatcccctcttcttaaaattcgacttgtccgcaagtcgatggcaattaaaattctgaaaatgcaaaccacccggatcccatggcacttgtagctcttggataatcaaaatgatcaagtcattcccatcactattgcccttccttgtaatgagtaatgacaatattccactccagcttagtatgccttcttcacagtgctcatattttaccacaagcttaacaattgtgcctcttgttttcagccttccaagaatagttggcatagcaacatgacatagcaaataagtgctaatatttggcttgtaaatgcagaattgcttgtcaccttccaagactgatttgatggttggaataaaaacattcttccatgctgaaattatattcttgcttgcacttggcttgatcccttgcattctccatttgctggtaccatcttctagtataactagaattcccttgcagtcccaagtatcctgaacattgttgccatccaagtggcttatatcactaataagcctgctttcaataacctcaaaatattgtgccatcatataggaggtgaatggatttttggatgccggtagcaagtcatctcttttatcatcacttgggtcttcagttaatagcaccaacaaggcaagctcatgcattctagaaatttcaacaacggtgcagctcctgtaactaacgaaatcccactgtgccttccaagcaaacagactaattgccactccaattttccaggacctgcattgcttaagtctaattggcggtggccatggtggtattagacatacacttgtccaaacggaatcaaatgcagaccatggaacatgccacacattccctcctctaaccacaccacctgaccaaggaagtggccaaggttttctcttgggaagccccgccagcagcctcttttcacttttgaggcatttcatcaaacacccgttgggcatcaccaattttatgcagaaaatggaatccagcttttctgccatgactagcatgggctccgttggtgctgcaatcatgttcagtgtgtgaaacggaaaggggaatgcaacctcggcctgaatagtaccgatgttgtctttgaggctgattgtcgtacaccttgaatgcataaccttggtgaggtcagtagtattgatgaaaatagagcaggccttgtcctcgctaaccactgtctccatggtggctgcagcagtggtactagcaaacgactcctcaagaatggcatgattcacaccggtgtcattgtcgaagcaatttaccaagcacttggtgggcgtcactgttgtagtaccaatgccatggttcaaactcacctgcaagcccatggcgactgtcggagtaggaacatcaatgttgtggcttgcacttgttgtcgtgtacgcactggcactgttggaacacgcccacgaacacttggcgagcactggagtaggcgaggtcgggggtgttgaagatgatgcagaattgaagatggaggttgtcgccttgatgatgttagttgtctcctcgaatgatttgcgcctattatagttggccatgtgggccgcccggcacggcacggcccaggcccggccgtgcctgggccgaggcttgtcgggccggcacggcccgaccgacgcaccgggccgtgccgtgccagcccacgtgccgcactcacggcccaggcacggcccaacacgcctcgggccgtgccgggccggcccaaaagcacgatgggccgtcatgcttttcctcagaataagtctaaatttcctccctcctattgggctgtgacatatgtacagccacaaaaagtctattttacctccctcttctttgggctggggtatataaatagctaaaataagtctatttaaggtccctattctttagacagttacatttatatgtctatttttagtccctatactttatgtaccgggcctggcctgccggcccatcgtgccgggccggcccgaccgtgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactatagcgcctattagcttctatctcgtccaacttctccaaaatctgatcaatcttctcattgcacctacgcttggtcttcatttgttcaagcttctccaatatctgatccagagcttcatccatcattttctcctctttgttcatgggggaattgatggggacggccttagatatcttgagatcttcttgggacacctctccttggcttgacatttcaccgaacaggttgtgggcgttggtgccatgagcagtagccttgcccaaatccaatgaccaactgcacgggacgccgcagcggtacttccccattgcctccatgcttgaaatcccatggatcagcggctctgataccatattgttagcaaccaaatcaccaaacaacaagaatttcaccacgaacaactatccagtcaacagtgctgtttttggaggtggaagacgaggaaatacaggggttctggaaggttctagaagctagggaaatgggaggtggaggagggaatagatactcgacgaggatctagcccggatccaagccgccgccgctgccgccgatcgccaagccgctcaggctggtcgccgtcctgcccctttctgtgtttttcctcccctgaaagaaccgatgctgttgcttttgttctttaccttgggtttgcttgggccagcttgaatgaatggttgtacaggcccattggcagcccactcgattcctaacagaacacaatcttgagatttgaacattaggtcaaactttgacggagacctgacctaaaacatcaagtcaacaaaagtcaaactaaacgcctcggcgtccggactccgacttggtcaagctcctaagccggcccagaatcctaaccttgccctcccaccctaaccctttcttcctcggcgactcgtcggagagctccgccgccgagtcctcccactggagctcgtcggccgccgcgctctgcctcgccttgagctccacggcgagctccgtcaccgcggcgtccgggtcgtccctgctccgcagcagcacttctcccacctcggccggcgtcatctcggcgccgccgcggacgcagcactccgccgcgtccagcatctcgtggtcctcgacgccgacgtagcggccgaccagctcgcgcatggcgtgcgcgccgcaggcgcccaggcgcacgtgcacgtccatcctccccgggcggagcagcgccgggtcgatgccgtcgacgtggttcgtcgtgaacacgatgatgcgctcctcgccgcagcacgaccacaggccgtcggtgaagttgagcagcccggacagcgtcaccttggagcggtggttgtcgccgccgtcggagtcggagtccgacgagtcgtcgtcggaggcggcggtggcgtggaggagccggcgtcttttgttccgtctgctcttgcggtcgccggtgaggtggagggagcagtcgatgtcctcgatgacgatgagcaggcggttggtggtctggatgaggagcgcgcggaggtcggcgttggtggcgacgcgggtgagctcgaggtcgaacacgtcgtaccggaggtggttcgccatggcggcgatgagcgaggacttgcagagccgggcgggccgtggagaaggtacccgcgcttccacggccgccccgtccggcggtagaactcgctgccgtcggcgaatgccgtgaggtcggcgaggaggcgcgccttgagctccgggtcgagcgcgagcgtgtcgaacgtggacgggtggcagaacggcaccgacgaccacgccgcggcgccgcgcggggatgccgcgttcgtgtgcagcctccgcgcgcgcgacgaccgctccaggtggtccgccgcggcggcgaggtgcgccaggtacgccgggagcaccgccgcggcgtgccgcttgggcagccgcagcgagaacgaccgccgctcctcgagcgagtcctggagcgtgtcggcgtggtgcgtccacacggcgcggtgcccgtcgaagctgtcagccaccgagtggttcggggagagcgacacggacggcgtcgccgccgccgctgccgctcccgcgtcatgcccacctccgccgccggagacggcgacggagcgcggcagcgacagcgtgaggcggggaggcggcggcgaggagaggaggagtgagcggtggaggtagagctggacatggcggtacaacgcgttgggctcgacggcggcggagccgaggaactccggcacgtcgaagtaggagtacggcgtgagcgagtcctgcagcgactgccacagcgagtggaggagggagagtagctgcgtcgggagcacgttctgcaggatggtgaggaggcccagcagcgaccacatctgcgacaagaactccattgccgtcgaatttggagctcagctagcttcttgctcagctactgcttgagctgctaagctggagggcagtgtagtgtggttttgggtttggcttgtcttgccgttgcatggagggaacgccggatataaagaggggaggaagataaaggaggtggccactgttacagattgtttattagccttgatgacggcatcagcatgcatgctttgctgcataaaaaggagataatgtggataattagaatattagttgacaagcataacggtgttggtcacaaaccataatcatcgaattgaagcatgaatttgacaatagacataggtacaaggatcacttccatgcatctattttcatttttcaggtttcatgcttttacttgtttaactgtaggttccattcagacaagcatgccaaacagtgaaaacaacacgtgtccttgatgcggacatacagtgaaagagtgcaactgcagatggtttaggtttactgatctctaacggtgaactgatactaataagaatcatcagacacatcagactgagtcttgacagacattttgttcccctgttgatatatatcatcaaaccatcaatccatatgccaagaaaggccacaaggctgcattgttagtgcataaacaatagtttccgcaggctcaaatgacattgtgtcccccttatgtctgcagcatcaactcacaaaagcagggccagtctaatttcttttcttcttttttcatatgctgcagcatcactgctggtccatctgcaatagttcttcagctcaagaagaagaatatttcggctgcgtctgctcagctttgcacgcagggggtaggaaagaaaaaaaaaggacctgaaaggaaggaggagagggtaaggtgcggctcctcttttgcacacgttctccggctcttttctcatcttttatgacagggtggacggtggcgcgtgcctcggaagccgggaccggcgtggtggcgccgccggccggcccgtgcgcgtggaaagaggaactatgagcagcagccacggggaaggatgatccacctcgccgcacatggaatgttctcttgcggctagtggcggagccagcatcaccatgaagcccgaactactagtttttgggtgaccgactgatttttatacccgtcgacagataacggcaatggaaatggcagcgacggagcccggacgcccacccgacctgtccaggagctgcctccaccgctgcttgcggcatcgctgacctgaccaacacaatgtgttatgtgtcctcccttcttctcactggcctggtaactggtacacagtaactggaaatctggaattttctcttgcactgcttgttaagatgatacacacctcactccagctgaagaactccctgacaaatgtacagcaggcataattctattaggattttttttactacactttggtttttacagtatggacatccacacctaatgagttgatgtcactgcactcgagtgcattactgtgcagataaacctgtaaaacagtactattactgtacctactaccttctatacatgataaacttttggtttacatgtggcagtctcatgggaatcaatcttgaacgaagaaccgaagaagcataggattctcccatccagacaaaagaccagtttttgctagcaacagctgatagctagcattcccccatctttttcgcaccaaagcaggggctgattagttttaccaaaggctgggattaaaggccctaattgtcctttgtagctcagctgagagtgagagtgagagtgagagagtgactgagtgttaggctgcctcttgtcgggaatatatgcacccatcattgcgtgacgggcctttcccctgcgtgcaagtgcgtgcgagccttctctttcgtgacatgggccgaaaatgaggtgagctcggtggttgacatccatgtgaaagaaccggagcttttttatgtttacatgttctcttgtaatcatttcttctttgtccaagtttttcagttcagttgaaatttgttcttgaattcagtgtgtaaagtaaggtattattcagtttagcggttagtgctcgtgaagatctgatttgcattgcaaagcatctgaatttttttttcctgcgggaaaaagcatctgaattctgaattctagcttgtgaccgcacgaagaaatagtcagtactagtaattatactctcttcggttttaaaatatattacattgttatgttttggaaataatgtttaatcatttgtcttatttgaaaaaaagtttcaaatatgagaaatataggtatacaaaattacatttaatagtataacaagtaacaacaagatgctactccctccgtttcacaatgcaagtcattctaacatttcccacattcatattgatattaatgaatctagacatatatatctatatagattcattacatcaatatgaatgtgaaaaatactaaaatgacttacattgtgaaacggatgaagtagtacttatataagagtttttcttagaaataacacgaatgatcaaatattatatccaaaagttaacaatgctatgtatttttattttgaacattgaggtagtaataatcatggtcgttttgtttaacaatactccagacgatagggtttctagctgtatatctaaaatgctagtagacctaggatgctttattttactttgcttgaaaaagaataacaagcattgtacttttgtacaaagcggttttcctacatttggcatctactacctctgtattctctctacacatggccgggaatctgattttgagtccccaaaaaacaccacttttctaagcgtgcaaactttacttggagagggagccttttatctttattttgcatttcgtctttcgtggaggcttttccttttttcctttatttcacgtgcatttcgtcacgttactttcgaccaagacaaattcaacacgacgctttccaatttcaacgtataggtcgcagactcgtagagtcgtagtccccatttcaggccttgttgggcctcacgtccctcgcgatcatgctcgattgatgggccttattgggctatacgtctctcgcgatcatgttcgaccaatgggcctcattgggccctacttattattgggccattatttgtgggcccattcggcctgtcgtggatcgtgcacggagcagagagaacagagcagcagctgattcgcacgagctagcccaaataattgattcgtttgttcccattgaatttggcaatcgacagagtggcagacatgtatttttcaaggcgataaattacacttttacatggacaaaaggagcagaaacaaaacaaaaaaaaaaccatcaagaacaccactcgatcgcatcatcgtgtcgctggcaatgtcatactactgcaattatcagaagtatgtttgcaactttgcctcaatctctcatggcatccatggcggcgttggtcggccggtcaccggctgacgagggggaaccacctgtcgcggaagttggactggtaggacaccatgacgacgagcagcgcgaggagcaccccgacgccccacggcgagccgccggcgcggtggatggagtcccgctcgggcatcggcagcgacagctgccgcagctggtccaccccgcgccgctctccgtcgccgccgcccgacagcagccgcacggcgagcagcagcgcgagcggcgacgccatcagcagcagccgcgcctggtcggcgaaccgctccgccgccgacccgtagctcgtgtaccacgagaatccgaggaagacgagcagcaccaccaggaagaagcacaggtgaagcggcagctccggcgcctgcacataccccgcggccgccgccggcgagccgccgttgctgtacgagttccccatcggatcgttggaatcgaactttctcgcttgcgaggtgaagaagaagaggaaggagaagaagctggcaatggaggtgatcgagcacgactcggcgctcatttatagagccgagcatcgctgccacgtggcagtcacccatcgggcggcgtcgcgtctccggccaatcggagggcgccacggcgcggccgaccacgccgccatgggccccactgcatggatagccgacacgtaggcacgtgcacgcgtggggcgcacgtgggtacggctccgcgcgaggagggggcgcgcgcgctttgcttagcccgagcagagcccatcgcttcggcgctaaacaaagcgcgccggccaggtggtgggccccacctgccagtgggtgattaggcgtgcgatgtgggccccctattcctgagctggccggtgtgtggtgtggtgtgatgcgctgctgctgctgccgccttggtcaggcagctggatctgtactcttcctttgggatttgcagcctttttaagcccaaacatagcaagcaagatctgcagcctctgcttacttaacgcctaaaatgtctaattaacaggagacaggatagcaaatgtgtgtgtcatttagtggtttgtagaatcggtgtcacggcgcctgaagagataagggttctgtttggtgagtttacgacggctgaagcttcttctagaatcttcatccgctagaacctttctcaaactatacaattttatttaaattttaaaaagctgtaattataaaatttagaaaataaacaagaaattaatactacagatttttcagtttctttagattctcacaagctaattggaatgttacttctcaaataagaccaagatctagtaggacagtggcaaatgtggcacactgcgaactggctcaagactcgtttgatgaccagtgttttaatttaccgaggttgtgatcacgtggaatgtcgtcaaccccatcttgtaaattaccttctcttttaccgctaattgtccgtggttagttgaaacctttaattcattccagaacgataaaagtaaactgcgcgagcagtgtgtgtgcagataattaagcaagtacagcttctaaaacgcctattctatgttagcacattactacacaaataattttcccaaacgactacaatgcattttcgcatatgggtatagcacctgtggtgtatgtagaaataggaattttaccaagtggattgtacaaccgcatgtaaaagagattttcgcatatgactgactgcaaaaacaattttcggcaaaaaaaaacaaaagaaaaatcctaggaacctagctcgggagtggccatccactgccgccctccctgctacctgatccacacttcccaaggcccatcaccattgtcgccgtagggggaaaggccgctagaacaacccttctcatcgtcgtcgtaggcaaatccacgcacaagggatggagagaggcctctggttccacatgggaaggggagatgccgccggatccacccctcccgtcactgctgatgacagatctacatgcgtgaggggagatgcctctagatccgcctctcctgtcaccaccgccgatagatccacgtgctagggaggggaagaggcttgcggcggactgcacctcctaagggcgtcgctacttgatccgccaccattgaggccatcgctgttgtcgttgttgtcatcatcattcccccttctcgtcgtgatctggggtgtccaccactacccctcccaaccacttcgccgccaccaaatccacgagggataggaaggcaagggagggcggtcgctaccgaggtcactgtcgacacacgctgcattgctgactcgcgtcttgtgacatcctggctcaattaggatttgacatatgtgacccataagagctatgtgcgcatgcttagtaccacaattgctagttagcatggtagaaccaacttataagggtttgtccctctaaacataccacctctgttttaaccattttacatgaagcgaggacaaaagtgtaagtgaggtagtatgtgtaagtgtgttcactcgtcgaatggactgggctggctgttacaaatggtattagagccgggtctcacggttgcacgtacttgtcaatgcgtaggcatatggcgcttgtgggctctgtgtaaagtatacatggcatgccatatggagctgacactggacgtacggacatgtgttaagagagggcgtgctcctaaatatttgcctatatacgtgtgtggtccatgagagccatgtgcgcatgcttaataccacatttctagtttagcacaaacggaaccaacaaataagggcttgttcctccaaccatagtaccatcgggttaaccattttacatgaagcgagtacaaatgtgtaagtgggatgacatatgtaagtgagctcgctcatcggatgggctggattggcggttctggagaacgggctattacacgtccacgtgccatgagcgagagagagagagaaggcgagatgataagaatgaagtggagctacgagatggtgagtagataaggataagggagagaagatttagtaaattttaagatgaagaaaggaaggaaaggaggggtggtcggccttgtaggtgggcttcttaaacaggccctcctatgacctattttcatctacgggtttatacccggtacctctgaaatctttttacatacgggttttcttttagtccgtgtgtaaaaaaagatatgtttgtaaaaagtagtggcaacctgtataacccatataaaacttaagctacaatgcatcatttttataatatatgacatagacttgcaaagtgactaaatgaggagagcgtgtgaagatgttatttcttcgttactgtgaaagcgggaatgtccttccgtcccctcccccatcgtccgctcgagtctccctcattcgcccttgcctttaatctcaatccacctaggtagccaattctcaatcatatggaccgactcattacaaatcacaggagatgttactagttacacaaaatatctgagcctcccttcccaagtccaacactactcccatacgtcaaatcatttcgttgatgataatcaaatcatgcgaatagcagctactactaacttacaactaggaaccattaccacatactacctccgtctcaaaataagtgcagtcgtggatatctgtacccaacgtttgactgtccatcttatttaaaaaatttatgaaaaaattaaaaatatttagtcacacataaagtactattcatattttatcatctaatagcaataaaaaatactaatcataaaaaattttcaaataagacgaacggtcaaacgttgaacgtgaatagtgcaaaactgtacttattttgggacggagggagtaaaaaacaacaataatttgcttgtgaccattttgaccctggttcacgtgtgctaagcggcttgttgtgattgtgaagacgatgtacttaaaaaaaagagagaataaatcaagtgttcatgctgcaaatacagaataaaaatgggaagagaagcaaagctgatgatatagcgatactactgtcgatcaaacctaatgggccaccattttgtgtcaaggtttgacgcatcaaatcatgggccggcctataaaaaagggctgccaacttcaattttatcaagcctgcacgtcactaatcagggtgaccacaagaaagagccacgtttct

SEQ ID NO: 53000 - DNA, 2360 bp, Oryza sativa
catatgcaatagtactattcatatatgttgggttgtcttttttatttctcaacttgtgagttaagttttaacttgatttttttgagtagtttgtgtgtgtgtgtgtgtggagagagagagagagagagagagagagagagagagagagagagagtttgaatgttgttattttttagaatttttaacaattatttgggtgacatttgaacaaataggaaacatctcctcgagagtttaaaatacttaatccaatagtgcaccctaactttaactgtccaaaatagcagctccttccgtccacaatgggtgtaatggatcatatggatgttagaatcttttggaaagattaaggatgtagagaaaaaatagtatccacttattaaaagaggggtggttgagaattggaggacgattgaggtaagatgagaaagaaattgaataatgggtgattgatgggataataccctaattttattatatttgtggacaaattgtgacctccaaaatccactatatttgtggacttggggagtaggtttaaaatgaaagctaatacaagattcactccgtcccaaaatataacaacttctccacatgaattctcttatcaaccaatcataattcttttctatttaattttctaacctactttctctttctcttgtcaactaattagaaacttctcctatttcatttcatatactttcttaatatttatgtctaataaaaaagtaggagaaagtataaaagatttcagaatttgcagaataccaattgggaagaagcagtcatatgctttagcactgtttaactttttttccccctaaccgtagcactgttaattttcaccatatcttgagtccaacatgccatgcatcttgggaaggtcagaattcagatgtgtcaaatacagaaatttgacatgtcagtccaagtggtggatgaatagcatcatgggacatagacaccttaggaagaaaatgaaataatgatacttgtaattatttggttcgacttgacagatgctggccatcgacagaacttgacaacagacaaatattccaatggaacagaagaagcatcggttcatattccaataaatcagaataaaataattaatactacctctattctaaaataagtgcagccatgattttctgcgcccaactttgaccgttcgtcttatttgaaaatttttttgaaaaaaattaaaaacataagtcacgagtagagtactattcatgttttattatcccataacaacaaaaatgctaattataaaaaaatttcaaataagacggacgatcaaagttgagcgcgaaaactcatggctacacttattttgggacggaagtagtaatgaattaatttatggtagtagaaaattagggagatagtaattaattatgagaccacaatctttcatgctccatacgtcttgtccttgaatttatctctatttctaacaaagaaatctaatgtgatgaacagaagttacaagttacagaacgaggttggaatattgaatgagtgcagcggcgaaaaaggactgcaaaaaaggcactgaagaaaaagaaaatccctctcttgtgagcatctctagctaaacgaattcacgaactaaagaaaaagaattatttttttctcttaattcgcacttaccaagaaggcaagaacccgctaattaatcgcgcacgcatctctcaattctcatggagaattacaaggtgagatccaagctcacattctcccggttaatctctgccaggtctcccaggcggcggcgctcgtggtgatgctgcgaagacgacgacgccgacgacgacgaggacgacgaccgcgacagccgcgagccgggttgcagttgcaccaccgcggcggcggcgccgcctaccccgttccctctccttacctccaccattgcgtcctcctcctcgcgtccaccggccagcgacagcggcggctgccgttcttggcgcgccagcggcgcggcggccgccgccacggcgatggcggcggcggggacacgccacagcgcagcggcggccggcaccaccgggctgccgttgatcgggtgcgagacggagcctggcggcgccgggccgtagtacctcgccgccaccatgggcgcgggaccgccgggcgggaggtggtggtggttggaccacgaggggtacggcggcggcggcggcggcgccatgtgcggcggcgaggggccgaagcggtgcgagccgtactagctgggtaggcagggtaggccgggtagtgcgcgtgcatggccatggcgctctggaactgcgcgcgcttcaagtgctgccgctcccgcttgtgcgcgttctggtgccctcccaacgcctgcg

SEQ ID NO: 53001 - DNA, 7869 bp, Oryza sativa
gggcgcacgaacggcagctgcgagaacgactagatgcccgcggccgccggcacgtctccgacgtgtttcgcgtcgtgctcgctcatcgccggccagccggccaccgcctagctcgccggcaaggtagctagggcaagctagctagatagctactgaactacaggagattagctcgctagctaggtaggttcaaggtgatctgatggccatgtgtgttggcaatggtggtggtggctctagctaagaacaaatgggttgggttaagttcggagtgggggagtggaacgaacgggaccagtttggggatggtagggttgacaacgagtgtgtttaatgcagtgtgtgcaatttctcttggctcttataatcttgatgcgttttaagctttgcattttgtgctctatatgtgtttggtgcatctgtcatggtacgatcaggaaacaatgttaagttttgttgggtgcaggtctctctcttgaatgttggcaaatagatggttgtgttatggagaacgggaacaaaaggtcaaaaaaaaaaaaacaatgaaaacgcggttgtagtcacattcgcatggtcggggtcaaactaaaacttttatcgagatcaaaactattatcgtaaccacttgaaccgcatgcaaaataagaattgtgatatagcgtatttgctattgggacaacacatgacatcaactgtacacaatcaacaccgtccacttttcaactcagtagtgtaaatcggccgctaccttgttatgtatgccttttcctattggaaccaagtacaataattttgttacaacgccaagaaaaatctcggtgttccattttaaatcttgtaatggtagtgagacaactagtacttaatttgttagcacactagccgccacacaataattggattcgtaataggacacatacatactccttgggatttcaacatataaatatgtaacatgttgctaaccccgggttttggattctttataatttgctattcttatggagaatgtaattttcgctctcatgacatataagatcatctgagtcatcactaaatataggttagaatggtaaattatatgccgctcatatgttaaggatatataacatattatcaaatgtcccgtgggtttctgatcctaacacaaaaggtgcaaacccgctacataatatcataatgtgcacattgctcatgtcctgaagacacgaaagccaattcaactatgttttcaaaagaaatgcaattagtattatattcttctgatggtgatgtttggaaaacttcaacacaaaatttggattttgacacaacgaaaagctacttgtttggacttatgaattagtggtgggacaaaataagaaattaagaaaagaatagggacttgatttccacatatcagtgctgatggacaataatcttgagttcttaattttgattgaacataacgagaatgaaggctaggatttggccgataaccagggaagctagagcctagctcatgtgaactaacttaagattttggtccaaaacctattgtattctcaatccagtggactcactgagagaaaactgaagaactatgtgcaaattaagtgaaaaccgaatccatattctgcagttttgtgatgcgtacggatcaattacatcaaaagagaaccaactcaactacactagctaccagtgctgttcaactagatgttgttagttcttcaactgaaaacgaactagcatgccggcatgttattgttagtggttgtggcacaagacatgcatgccgggcatgttagtagttgtggcacaagagagatctaaagccaagataaatgtggctatctatctatcagggcagcatatatgggatccgtaccatttaaattaaaacctcttggtatatgcgattatcaggctattaaataccgttcgcgaactgttgcatcacacagccggacgatcgtacgtctagctagcagtgcaggcattagctactctcaccagccggccgcgaaggcaacagcctgattgacgacgacgatggatcgaacgcgaaaagcacactttcccatttaaatggcgacctgctttaaattccatcacgaaaaatggccacagaccacaaaaagaactgaagcttttcgcagttttgccgctgttattttcgtggcataaatagatagacaacgtagttaaaggtagctacattttattttacctttattttgtgatggagaagaacgaggtagttcttgaaatggcatacatgtagcggaaaccatcctaaactctcgaggagacattccctcgttgttcacgaaatagttatgacaaactgtttgatggtattttggcgattatatgtgtacacaagacttactcatgatggacaaagcaaacaagcagtttgtaagttggctagcttatcatttctacgcaatgcccggccatgtatatacacgcaaatacatgcatgcacaggcagctgggaatatatatacttggattagtatatatgcatgtataattaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcatgggctcggcccatggccgaagacggtagctgcctacgcgccaagatttcagaagttaatatgcggaagagataaaaccagatgaattaagagataaccaacaaaccaattgattttatctctataacaaacttgatttagttagttacttcgcgcgagcgctggtgaggcgcttatcaccagaccgtggcccagcagcagagaaacaaagcaaattacaaatcagatatttgacgccaggagaagctaagagataaaatcaaataaggatatgaacaaataacaaactgatcgatcaagccttatctgcaacgaacttgacgcggaggaaacggcgcgcggacgcggcgagcaccgaccccagacccctatataaggcgtcgacccctcggcagccaggggcattcacgaactcatccacacattcattcaccaatgcatctagcatccacaagccacctatcatcaatgcatctacccatccagcatcaacacatccatccatcaactctcatcggcgatccatccatcaactctcatcggcgatccatccatcgacgacacgcaccggcggcggcgagctacttcggccggagtcccggcgtccggcaggagagggcgcgcacggtgatccgatcatcagcaagcgcaggagaggagcttgatggctagtccaggtaaaagctagcaagattgttttgttttctttcatatacagcacgcacacatccatgcatagggatccatctgcacgtatcgtcgtcgccggggaagtcgcggtggccgattcatctacgcatcacagaagcctcatcgatgccggtgtctgttcaagccgacgtagtgctacttgtccctggactcgacgctgctaattcaagccgttggtgatgcatctacccgaagctgcgacctcgccgagataccagacatccttgatttgcaagcttcaccgcactagagcgggctaaccatggaggaggtcatcgggaagccgccctgccggagcgcgccgaggatcaccggagctgccgccgactgccaagacttctatcagttctcatgccggaggtcaagcatcacgcatggcgtcgaaaccagcggatgacgatggaggcaagtatggctgcagtacagaggaaggacgacgggaggatggcgagccagtgctgttggatggcaacaagctagctaatgcatgttgattaagttaattattgtggcaacgtggccaaccaatcggaggacgacatgtcatcgctgctacagtgccatgcacaaaccaatgcgtgggctgaagaagtcctgttggtttttcttatttgtcccaaatgagatgccgagctttgattaaatccggccgccgtctacatcaaccatcttcaataactcctccctaattcttctctaatataatctcgacgcaactgttgtgacgtcaagtcgttcaagctatgcaactccatgcatgtcttcaccaacaatctacatcgacacgttattcaagaccgacgaggctagacgacggagggtgggcgaccaacacaggcgcacggaccgacgaggccatggatcgctgtcggcgctcacacacacacacacacacacacacacacacacacatctatatcatcatcacaaccatgcatgaagaacgcgaagcgaagacgacgagacgaccacaagcagcttaatcggaggttctcttgcaggcctagacctgcggaggtaattaactgggagcttctcgaggccccaggaaccaggagaccacatcgcacaagtcagatctgtccaatgacagattatggagcgcgcatacatatatattacattgggaatttgtatttatgatcttttaagattaataaagagcatgttccctatgttttgtttacattgtgtatttaggtacactggcacgcccgcacatatatgtatctctaaacaaacgagatcttagatgttattttccaccctaaacaaattggcacgcccagtgggacctggttctcctcccatcttcgctatgctgtggtcgtcaagctcgtcttcgctgttcatccaaccaacaccaacatgctgcatgatgatcttcaacgtggagtgtacctgaccaaggctccttcttgcagggggactttccatcatcgagaacaccctgacgccctttgtgattcagtttggatcactaccaccggtgacattcttcgagtatggctccaaggtctacatgcaacaagctcaagatgtgacccaattccaggaggcccagtctaagaagcaatgcaagcgtgcttctgccaagacgaagaaggagcggcgaaccctcatgcttgaagcccggaccctcttgaaggagtccgttgtagctgagattaagggagacatccaagctgcacagaagctgcgtgtcaaagcttccaataggcgctcaagtactgcatccctgcgtgcccctgatccagccgctactccaaagcggcctaccccaactgtgcaacacacagaggtggagctgcttgaggctctagaagctgtctccgacaatcttcgtcgacacatttcgcatgctcgacgggcaaacagtcctcatcccctgcgcaactataggaggaagtatcgcaaggtgcagcgtctacaccaactcgttagctcgcgcatcgcccagagctccgtcccagaggaagactggtctcttgacacatctgtcctcatcaagaaggtgttcaagttcccaagcattctagagccaccttacgacttgttccctgacgaatgggcatgtgagccaactaagatcaaggagaaagtcagacgagccatcatgaaggagtattggaagcggcgtgatagggagcacctcgtccttccaggctcaactatctccttcgactacaacacgtacacccctcgccagcagagcacgtgggagtcatgcctccacctatttgcggtaggagggtcgtctgactacaacaacaacaggttcgctgtcctgcggtctgaggcacccgctcctcgaggcgaagacttacgacaagaacttcgtaagctgcaagaccgaatggcccaacttggaagacgactctaggatcatgaagcaccacaatcatcatcaacacaagctgggggcagatcaagacgataccagccaagttatcgtcctcaacatgatcgccgcacgctggctcctcgacgtacgcttccatcaactcaagtgatgcaccagagacaaacagcgttgcctccacgctggaaccggtggtcaagacgccaagattatcccacatcttcacatcccgctcaagaatggtgagttcgagaagctccatcttctcaagtgccgcctcatgttccatcttctccaagacgagaggtctatacacaaaggcaacatgaaaccaacgcacctaccccagctacacggcaggtggcaccacttcttctcccgacgccgtcaattccgccaagacgtcagcatgcacctactgagaatcaacgcaagcgagagcgacgtcgtaacaaccgctacgctctctacagagagcttgaagacctagtgctaaaacacactcaagttcgtgttcgtctagatggagaagtgcatcaagaagatgaaaggatcgtgttccgtatctcccccagtttggagagggatgcgaggtataactaccttatagctcgtctaactccaaaaccccggagaacacaagacgttgctgacaagaatagggagcagacgttaactcaatctcgccacgtaaccatcctgcagcgagggaaggggcaagttcaagctaccttgggcacgtcgccatcaacattagtaagacagtccaagaagaaccaatctactccgatggagggagtcgagcagacaccagtagagcaagtcgacaaggcgtctcgacaagaagaagctatcattaaccctatggttgatgttctaccttagcaggaatcatcctctatgcctccagccagagttgaacaggtggcgggaagcaagaacatagaagatccaaaggaaagcattgtcatgtgcagcgcactagccgcacaccacgaaaccaagcccaatgccgcatgggttcccccgccgattactcacgacttcacctacccttctgatgaagagatcgtgccaaatccaagggcaaatttttccaagacgttcctcccttagttggatcaagtccacccacgattcagctcggagggttcaagacgaagcacatcttgctctcaagaagcaactagagcttcggccccttgtcttcctatcggtacaggagaaggatcgttatttgataggggcaaagcactccagtcagatgtctcccctcgtcgctacatcgacattacgacacgcctaccccatgaccaaagcgagctactttaggttgcaagtcgacctggtgctaacactcgcatgaaggctatcgctatcaagaatgttgagacaactccttctcaagcaagaaaagacctggaagaacatgttgaagttgaagatcttgatgagttagagtctacctcatcgtcatcgctggaagtgaatctcgatctccctcgctataatgaactcaacccatccctgccttcagacggagagggttatcctaataactttgatagtgcacctgcccatgtgacagcagaaatcgatcgtaggcaacatgctagacaacacgctccacgtggtgagaatccgtccattgggaacatagcaagtacatcaagataacctctaagtttagaggaacaagtccaagaacaaagacaagtggtagaccaattagcagcaaagcttgatcgcttcattgatatcatgacgggtcctgatccgaaccagaaccaaaaccatgatgctctggtcatcgaggatccacagattgaagaagtggaagccatagcacatcacccaacgcaaacccatgatgttcagcgacggtcgacgtcaagcgttcgccctcaattccttaacattcctattgcctctgctccacttcccaccacattgaaagactatcatgacatggttgaagacctggtgaacaagcggctgaagcaaatctccatcgagcaaacaccccgaccaatggagagtgagcttgagaagctatatgaagcttggcacgatttagtacctttcccggcagggtggcacccacccaagttccgtcaattcgatggaaccggagatgca

SEQ ID NO: 53002 - DNA, 15416 bp, Oryza sativa
tataacgttgaccatcaataactttaaaaatatttagtttaaagaaactagaaaaacatatatagatttgtctttcaaaacactataataaaaataaacaagtatttatttattgtatatattataatagaaaaatagggtcaaaggtatattttgtagagcgtgtcattgtccaaagcgtcaattaaaataaaactggagggagtagtacactatttgcatgcccgtaagcaattgtttttaacctctcgtccttttctacatgatatacaagtaaaagtttgactttagagcttgtttggtttgataccaatttattaccctactaaaattttgttaacttcaataatagcaagtgcatgtttggtttgctaccaaatttacccacaatagtttaaattgaatactactcctactcaatttggtagtatcgaaatttgccaacattttagtactaccaaaattttggtagggcaaaaattggctcagaaccaagcaagccctttttgtgtgtgtgtgtgtgtgttgggccatgcccaacaaattaattaattgcatgctactagtacttagtagctacactctcaaaaaaaacttttaactacgaacttagatataaactatgtccagattagcatactctccatccttaaaacacgcttataatcttctcattcaaaaagacctaacctatattgaaatgtaaaatttcagaatgttgtactgccacatctgattttaatgtaggttttttttttagagaaaatctattctataccactgagtttgttcgagttcaacaatttgtcatcggcattgtctctttctataatatactgacgactttatcaattggtccacaatacattgttgggctggaccttcttttcaaaaatacccgaaatacccttagagagatataagattaacaattgatttatctcataaaaagtttcaaaaaaatataaaaattttatgtggcctccttacacaatatggaagtttatatacaagttttaagttttttttttatatttattttttagaaaaaaaatatttttatggggtatatgagagagaatttgcttatacaagacataatagcacaaaaatatcttatgtagtgttatgaaagatgatttatattaaaaacaacaataaaaaggtattttatatagcatataacaaataagttatatcttttataaaaaatagaataaaaaagttgaaacttctatacaaatttccatgttgtgtaaggaggccacataaaagttttcatattttttgaaacaacaaattaggtaaatcaattgttaacactgtatgtccataagggtattttgggtatttttcaaaagaaggcctagcccaatagtgtattgtaaaacaattgataaagtcaacggtatattatagaaaacgacaatattgatggcaaatcgttgaactcgaaaaaactcagtggtataaaatagattctctctcttttttttacggaggaagtacatcataccagtcaaatagcaaaatataactacaacattatgattttttttaacggcgcgtagtcccttctactcgaggagcacaacatggttaggcagtgcatgatcttcgcataacactatggttagactatcatacttcaagctacaaacgtggagcggtttctttcggatgtcggagtcggtgaagacccagttcaaaaacagattataattgttggatgttacatgtatatataatcaatataacattaatttagcaatacaataggcaacactatattaattaatggataatatatcgtaataactatatacttaaatgttaaataacatgaatacatagtctccataatataaaaacgtagctacacaagtgtgagatgagacgataagagcctcagactaaggagtctaggttaattgataaatgatgtgatggctcgtgttgtatgtaaccagatctagcggttacgtgggttgacaattttaaattatccggcatatggcctatcggataacccggtagaaatatctaataatctggatcactggatctagagatactatattcgtattcctattcacaccattctatttgcatccgcattcatatccatcagatttctatacaactatactatatccgtgtttcagacatatttgaagggggagcggagcagatatttcttttagattttgacctttattcctagttatctccctaacattttttttcttttgcccgcgattgatcatcagagagtgataagtgactcaataataaaaaagattgatttggtttgctacatataccctattcccaaaaaaaaaagttctgcctacaaatatgaacataggttatgtccagatttatggttagaagttaggctttttctcttgacggggaagtaggaaatattagtaggtaggtaaggattatttgagtagagcagatagcaatcataccaaacttttgcgcttagcaaatggaataatgtcgaatcaactcaatttggtgatacatccaactaacacactctaccaagttctggtaatgcaaaaaactattcaagtatggacacttcaaagatttgatagcaacgcgatcgagttaaaccaaactaaaccttttgacatgtgcaaagtactagaataacattatatgtgttttggaacggagagaaactaattaccaaatcttttaacgacaattcattatttgcttaacaaattggcctagctccttattggccccaagtgaaacattgctttctacatgcgtgcaccctgattccaattattaacgggaccaatagactgttactcagttcatcttttcaaggcattttcatctattcctgagcaagtactatgattatagtaaatatatacacactcatcgatgcaagttagagggatacgtgtctctgacacgtgcacccatgagagtgggtcctacctaacagggatggatgtccctttaactttacgtaaaaagaactacttccatttacattatgagtgttggtagccctaaaattttaaaaataattttaggggcggagtttagaatggagcagtggagtggtccaaactctactctatcattctagtttattttaagattactctagcttgttccacttcgcttttagatgaaattaaaattgtttggttcagttttagctagaggagagatgaagctaaaggagaagctttgccaaataaatcctataggatgggaagaccccaagaagtacaatggcaaagtttggttccttgccaatatttttgacatcaaaccaaatggacccattactactttgccattaccaatttttcctttttgttgttaaggttgagaatggatgcaatccacaagcccccctaatcccaggtccccgcaagtgcacctttgatttggcggagaatgatttggttggttggagtgctgtctcagactcaaattctcagtgcttggcgctgacagtgaaggaaacatcatccagatgtttgttggttggcttttttggtttactatatatactttggtcactttggtgagtactagtggcaaagaccagaaaagtgcctcatttttttctttcccgaatttattttaccttttaaatattaaaaataaacatatcaaattttatttttaaaaatatgaacattttgccacactatcctgacgtggcaaaataacacgtgtcagttttatgctgactacttcagtgtgaaaaaaaaagtcagatttaaaaataagtattttgggggaatttgttttttaaactagttgaaaccccgcgcgttgctgcggggataataataagtaaaaataatgtgtcaaatagctaaacaacataagattatgtaagttaacatggtttatgataatttaagtttaaataatatatagaatgataattcaaatgtaaaagtaagatgctatgattttatgaaagtagaaaaatgttgagatagtttggacagtatattaatcatctaaaggctaaaattaattaaggtgatatggattaatgagagaagaaaatgagagataagttggaccatagattaatcttttaagcactaaaaataattgatatgatatatgacttaatcagagaaaaaagaaataacattaactaagagaggatgaactatataggtacatagcatattataaaaataatgaagatatatattgaaatataatatgaattatgtgggatgatgatttaacacgcttgcattttgaaagctctaaaaatttaataaattataaaattatagataatatagcatgtttgcatgatgtttaaatttaatgattgttagtggatagtgatatgacatctttgcatattaatatttagtagttagtgggttacaactttataataagagatgataaataattattagaaagtttgaacaaataaataaaaaaatcgctgccatgtgaacaacacactagggctcccatcggatgacctattcagccaaagaaaaagcaaaaatttaaatttttaaacttaattttgacattgattttgagatatttttaacgtaatttctttttcagcattgacttttaagtcaccaagaacacatatataaaagttttacctataaatttatttttattctttaataagtcgttttggcttaatacgaaaaaagccaaagaggcccctaggagagtggcaccactggcaaagcagagtggagctgtggaggatcagcagcagcagctttcccttagctcgcgagctcatcagtcatcacagggcggatcgagagatcatcgatgggcgaggcggagctgagcctggcggcggtgcgcgacgcgctggtgcgggaggaggactccatcgtcttcgccctcatcgagcgcgccaggcgcccgcgcaacgcgccggcatacgcggccgccgccgccgccggcggccgatccctcgccgagttcttcgtccgggaagccgaggttctgcacgccaaggtaagcccgccacctctcgttgttcttgagtcttgactccccattgattcatgattcagtatcctgcccaactagatccccttacgttttctttaccaaaatcgatcctttttataccatgttgtagtgtagcatagccatgatgaacttgtacaggaagatttttttttgcctggtgaaatttctgaggccaatctttctattcagtcaccttagtgattagtaaactcatggctgaggaattcgtatgtgaaattcagtcacacagatcttacaggctaggcttgtatttcgttaccacattgtttttttggcagtagtttatctaccttggtctccactgtaccatgatgaattgaaagatagcatcggagggtaagatgctgatatgtccattctggtaatcatgcggcattgcggcttatgttggcttgacgaattcattttgagtacctcgaacggacacacagtatcggatgagatttatattaacaaaagaatggctatgctacatgtgtaggtaaatcatgtgttttaaaggcacttccatttacggatcattcaacaagtgaaagtgatcagaagggaaaaatagtgacgatggagaaaaaaagtttgaaccgtaccatcccctattaataatagaaaacataaatgatttactattatttttcttgtactttactaaatgggaaattttgttatgctatttttcaacttgtatatcttatccagcatcctattaaaactgtcaaaatcaatcaacataaaatacagcattggtatagctatgttgacagtcagatattagcatattaccatttccaagcatccctctacagaatctaattacatctgtgaaatctgataggccggacaataccaaaagccagaagatgttccattctttccccaagatctcccttcacctctatttcctaccaaagattacccaaaggtaaatactaagctttacaatattagttacaatgaactgatgactaatgattgttgaggttctgagtttttattgctttgttgttaggttttgcactcttttgcatcatcagtcagtgtgaatgatgcaatatggaagatgtatttcaacgagttgcttccactattcactgtggatggagatgatggtaactatgcagaaacagttgcattagattttgcatgtctgaaggtacatgttctgtgtttattgtttcttttagatattccatcaatttggtcgttctttaaaaaaaacataaatctagttgctactaggatatgttctttcaatctttcagcacgcgaaagcaaaatttgcacaaattattgcaaattaatggtaaattgtttccaatcagtgtatatctgtgaaatgtattgatcatttctttgtaggccctgtcaagaagaattcatattggtaaatatgttgctgaggtgaagttcaaagatgcttcccaagattatagtccactaatccgtgcaaaggttgtttttagttaacatctcatactcactacaccaaattttcttaaacatcttgcaataaacggttgatttatagaaattgtgaatactccttggtcttattctgattagcttcattcttatctagcttctacttagtttcatgtgttagatgtttaactcctgcatacactccatttcttggtaggaactgcctgctaggctgctagcattgggcctttaaatctttaatttattttttgaagctgatctttaatttattatatccctctcttttcaacaggataccaaggctctgatgaatctgctaacattcaaggcggttgaagagaaggtgaaaaggagagtagagaagaaggccaggatatttggtcagaatgtcactttggaggacaatgctgacaagcaagaaggcaatgcaggtgacagtgagtgcaaagttaatcctgaagtgctatctaagctatatgatctgtgggtaatgcctttgacgaaggatgttgaagttgagtatcttctccgccgtcttgactgattcgccaaaatattttcagctgcaaatatgatgaacacaattatgtaagcacatataaatagacttattgaatgtggcatgaggaaatccatcaagaacagctaacagcggtgacttgctgtagaatttccggtactgtatcttggatctttcttcatctccgttttcggagctgagacatatagggcctgtttggtacagctctaactcctaaatttagctccaagagttgggtctggagtggagttgtggagctgcctaaacccagctccacaactctagttcattttgtgagagagctccacccagctccactcccagttttggtggagctgaaactgtttggctgagctccagctccaggaggggtagagctggagctggagctgtgccaaacaggcccatagattgatggcaatgatctgcaacccaaaaggttcatcctacctaactgtggtggctgatactgagggcctggtgaattcccagcaaagatgctgcaactccagtttctgtaacaatctgtaactcctgttattatatcaccatagttttgtgctacttcttggtagtagcatttctgttcaagcttcccttaacatcaactaagtttttcttgaataaatatttcaacttgttcatctgagttgtgtacaaggcaattgaatttgcttctgatttgatatgcatatccaattatccattccatcctcctgcatgatgtggacagcaaattgaaatgccaaaaagttttttcttcctccttaaattgggccgtactcttgttgggcctgggcctccatgtctccccccttcttctccgaccagcaacggccatggcagcggcggcggtcgaagcttggatcgcaccggggatgcaggtcttcgctgcggaagacgccgccgccggagaggagcccggagggtggagaggagagcagcgacgccaccggcaatgccaagcccagcatccaggtccgtttcccctcctctctgctccaagatttcacctctcgtagaggtgacttctctcatgtggttttctcatgtgattccatgggtggccttcctgccctggtctaactgatgaatataaatgcaaatgaaaattgcacacagttgattatttattttttttgaacgaatcgacgaggctgccaatttcattgaatagaggagacgaaaactgtacaaaaaggataaggtacaggaaaaaaaaaacagggccgtggccctaactataggcagttacattgtcaaccaggcggcgagattttttccgcccgccaacccccatgtttttcttcctcctttatcttggctagcagagttagcgccggcaactccttgtgctggaaagtcctccggttacttttgttccatatctcatagctaaagcacacagttgattagaggttagctcatgtggactatcgtcctgcctcctgatggagacttatattgtcgttaaatgccctgcgatatgaatatcagcatcaaatgtgcttcttgtttactgttcaacttggtttaaacatgttgaatgctgactggacaggactagatatgaggcattccaaacttagttgacaggcattgcttttgacagcgtaggtggtttatgaaataatttatccttttcctaatgttgactgccactgaactattttcattcttttcttaatgttgactgccactgatctaatttcatcgctccacgttgtgtcaagacagatgaagtgggatgtgacaggaggggagttgttttggtggtgagtttgagtaccagtggtatatatttttgcattattgtgagtagtcttctctagtaaattactgtttcagaaaatagtttatttatctgtttgggcataatttacaatgtcttgggactaaacattatcatccactgtataatatttctttaatgatgacttggtgccaccttggcaccttctcattttcctgattctttccagcaaatctactatttttcctagtcatttgctttcttaacttcagtacattcctcatgcaccagcaaggccaattaaagggtattgttgttgcatcttcttttttgtctaacttttctaataagatcttttcttctttgctcaagtggatcactagctgattggacgtttttttttatctctggcaaattgtagtttttagaaatctagaattcagcgcatagtttcatgcaggcagattggaatgattatgcgtattccatgtccacattgcggtcttcattaggcttaggtatggtgtcaggacctagtcataagttattctcagtctgcatatgagagccaacaacaaatatgcttttgtgtctttaatttgtagcctcctatttatgttagttctttagaccaaaaaatatcaaagaatgttctttgaatagtttgaataaattttacatgacatctgacataaacaattgcacttttgtcttgatacaaacagaatatcttttattctgttctgatgtcactaagaaaatgatttatatgcacctcaatgttgacttttaaacttgtccttttgtctctactaatactcccttatgtccttttgtcgctactaatactcccttactcccggtgaaaaaaaaatgtcatgtagttccccttagaccatcgcatttcctcgcttgtttgatatcgtattcctaaccatttaaacatcatattgttatctagtatctttcatacaggttatttcatttcctccaaactatctcttgtttttctttgctattcttggctacactctgtggacgatgctagaggaatcaatctgtcagtggtcatgactttgcttcttatgatcttatccaggttttagaggaaaaataggaggacactaggttatgaacataattatttgttcttttgtttgtatgttgtttgtatctggtattattgtctgaagaaaatccaagttatgattaggtttatgagggccttgtccagggcctactgattagaatttgagttccttttcatgccatatggggttggtacgatgtgatcctaaaatggatatttttcttctatggacttagtttaactggccccatcaaattgatgtctgaaagtttctttttttttaaaaaaaaatcctgggatgtatgaatttaatatatcatatgtgatcttgtgcaagatgaaaaaattgctacaatataagtaatcacacccattttttattatcctttgctttctgaaactttactcattcagtcaatgatagttctttttttttttcagaccagagaattcttcagatgtaattgttccctttgaattttctgattgatgacagcaagagaggacccaagcacaggctgtctgaatctgtgatttgcacatgtgttatttttctcttgttacacagttaatctggtccattttgatgatggaatcttcagggtttagacttagtaggaggcaagtgctaattgaacttactacactattggggtgtaatttttttttatctatattccaagctgcaaatttgcaatgaatttctttttttttttttgcatccatttgcaaagcttgcagctcacacacgtcatgtatggtgatgtatttacaacgtcgtcagaataccaaaactgaatggagtttcagaattcccgagggtccacgaacaggacggacgacggcggcgccgtcgtccagtcgtcgtcgtcgccggcggcgggggcggcattgccgttggcggcgacggacgtgattttcttgatgcaccagacgtcctcgtcgcatgagaagcgtcgccagtgcggcacggcggcggcggccgggtcgtcgggcgcgacgtcggcggcgacgacggcgcacgccgggttgttgcgcgccacgttgtgggcgtggcggcagagcgtgcggaggagcgcggcgcccgccgggccggacatgtggaggccgtagaggaggtaggcgccgaaggggcggaagacgtcggggacggaagggacgcgcagccacggcgcgcggcggtcgagcgcgcgcgccgcggcgagcgacgcgcggagcagcggcggcgcgccgccgacgcggaagctgagggagcgcgtggcgtcgtacacgctgagcaccgcaaacgacgacggcgcgccggcgccggggctccgctcgacggcgaggtacgtgccgcgggtgagcttgtgcgcgaggagcgccgggaggtcggcggggacgaactcgggcgccgccgccgccgcggggagcagcgcggcgtaggccgccgcggcgagcggcggcggcagctgcagcacgcggtgcgcgcgcgggacgcgcgcccggtgccggtgcacggggtggccgaggaaccgcggcttccggaacagcgcgtacttgaaccggccctggaacagcgcgagcgacgccgcgttcgacgccgtcgtcgccatggtcgcgtacgccgcgcccctcgccgcgcaccactcctccgctctccgcaccagctccgtcgcgatcccgagcctcctgcaaaagaccgaacacctcgtcgtcgtcagcaccagctagctcgatcgccatcgccatggcacgtactacaaagcttagcttggacacgcatgcatggtcgtccatggcggcgtggatgatcgatcacctgtgagacggcgacaccctgaggccaagaagacacgccgccttgacaaacttgttcgtcttcgtcttcgtcttcctcaagctgctgctgctgcctctggtcaccatcctgacacacgccttgatcactcccacgacctcgtctccacactcagcgacctatacacagatcaaagcagccaatgacagcgcattaattacgcacgcccaagcaactaatcacatcaagaacatcactgtaagattaacacagtgcatgcaacaacacagtgtcaggctgcctgtcgagattcgctgtactaggacatatttcatctggtcctaaatttttatattttggaacggatggagtagctaattaccaggatgacgtggtccggagcatggcgaacccgggcgaacgggtcgccgatctgctcggcgtagagcgacatgcctctcttcttcttcttgccgccgccgccgccggcgccgttgtcgccggagaggccggcctggcagaggcgctcgagctcctccaccgccggtaagtccttctccatgatgaactccctcactctcaccatcttcttcccagctgccatgatcttctcctcctcacccatctcagtatatacttctagctaattgtcttgtggttttgtgactaatcaagcttgtagctagcttattagctagctgatcctgactgatcttgctgggtgatgaattctctgctgctgctgctttcttctcagatgggagggaaggagctgggaatttatacacataggttggcaggttagggatgagagtggcaggttgtgtgtattacatgtgggggccatgggaggagaaacaattaagtaattaagtaattggttaatgggtgatatgcaaagtaagcatcagaaggaaacaatggtggccttttgtataatagcttgtgtgagagcttgatttgatcattaggaggattaacaagtgtgtgtgtgtgcgcttgtgtatgatggcatgcaaagctagccctggcataaaatatatatctttgtgcttatctaataatgtaggacctagctaatgctatctctcacatctctctgcagtcatccatgtcctatcattagcttgcatctctcctagcaaatgtgttaacctagatggagattaatggggcctaattaattacaagtttacaactagttagtgatccatgttagcttttagctagatgcatgcatggtagaggcatgcatgcatccttgaattatggattatgttgtgtcaagttcatgacaccattgcaattaatttagctaccaagctacaatgacatataccatgatataggaacactactctttaaataaatgagattctaaatgtgtaactttgcgttttctatatagactagctaagatcacctagcttcgatcctgtatatcaaatcaaattaattagaacatttttttagggtgagaaaagtggcataaattaattagatagaacataggccaaaacctatcaattctagggcatcaatccaacaaatattctggacaaagcaagcatttgtgattatgtactcaggatataatcttagggcatataatatatgtctctcctacacaagtgagatatatatatacatggaagaacaaaaataataatcaatccagggaaaaaaaacactttgctaactagagaaactttagatgtgatctaatttattttggcaattggcatctttattagatcatggcagcgtaatgattgtgtgcattctctcgttaatgcagagacaagaagttgtactttcattatatctttaaggggaaacataagagattaactttggatgtgtttttctctttcctcataaaaccaatgtgctctggaggatgatgatatatgttggatggtttctttttcgtgagggatacatgcatatagatgaaattaaagattcaaattaattagtggatttgtcagttgtcacaatcaaacttaatttttttctcctaatttcatttcaattataagagagaagaagtctcaatcggttgatgtgtcattctgtcatatatataggcactatttgggacagaatctccacaggaaatctcaaggagaaaacacgctgttttcctgaaaaattccctgttcttgcgtctttccaaatgcagtggtgatgtggtgattgttacataagtcttgtatattctgatgtgtttttttagacaatataatactaattaaaaaataatctgatcagtatatgctcaagctatttcgtactggtcagttaaataattagtatgtagctgcaggtctctattaaccccaattagttaagaataattactagtacttcacttgtggacttgtcgctgtgcgtgttcaacaacttttggtcgattgatgcttccttgatcctctagtaaattgcacatgtcttcttcaatcatatatagcttaaattgtactagtgttaagatataattaattaccgggaacttgctaatgacttgctgagtgttttcttgtccaatcctaggaaagtttctgccctatataatactacatgcttgggttacagagtaattaagcttatcgatgacgaaaggttaatttattctatacacgcagtcaagtgaattctgaattaaacaggggacaatgtacctttcgtaaaatcttgtttaggtgatatcatacaaactaatatatacaatcattacacattcgtgcacatttagcgtaaatttatgtgccttcccacaatctataggatatgatcggaatatttgatgtatttggaattttcgagcttgtgtagagaagaccatatatggcgttcacgaaaaaagatgtgttcgggaaagaccatatatggttgtagatgtagtaaatatgcgcgttatacttatttgtcgaaagatgtggtctgcctattaatttttctagaattaacgacaaattaccatttaacaaaaagatttaacaacttgacgttaaaatgctttctctatcgacagacatctgacgcgaaatctggatcatggtgtaatcaacgtaagcataaatttgagatcaaattaagttaaatcgatcagagagtgtatttcaagatatgtatttacagtcgcgttgaaatatttacagttgatggagcatatttatactactttgagctagggacgtatttacagtacagtagatcagagatccagtgggcgagggtgcaattatcgcctctgttttagtaatatggtagcgtaagttagaaaaattaatggtcgattagccaatgaaatcttgatcaagatatagtgaaaagacgatgaaaaagaaaatattggagaggagtatatttgtacaacttgtgtagcttattagctaatgaactaccaataatgctaattagatattgagcatatatgaaagcacatattgactaagctagtggcgtgttaataattaaggttgacatcgtcttgaccaggcgagcataccgggttcatttccaattaattagtgtgacatgtctacaagtgtagtaccattaacatatatacaatctcccctcgaggaaaaaaaactttataatctatacattagaggaggtcaaaaatagttgtgttcacattgagtgaagtctatatacaaaattagttagcctgtgtacaatgcattctgaattttattgcctccaggagtgctatttaatttagctcactgtctgtttgtatgct

SEQ ID NO: 53003 - DNA, 11032 bp, Oryza sativa
acctgcaattttttatatacacttgttatatcattcattactgttttgtactgttttgcacgcagctgaagtgcattattcgtattctctagccacagttaaaagtacttttcttctgacttacctagtgttcctgacataaataacaagattgtatgatgaacagggactgcatgtcaagccaacagctggtggatttcatccacgagcatatacagaaggtaagttaattttccttttctaattccaaataccaacagtgaactttggaggaggctgtagtacttaccaattcagtacttgccgtgtgaaaaaacaaaatgcaggagagcagtctttctgcagtgtgcgaaagagtgctcgacagatgcctagctccatcaacaattggtggagagggatgtgacaacatgaccatggttctggtgcagttcaaaaagcctattactcagaataaaaaagccgacgtaggggagcaatctgtgaaaggtgtggaagaggctgagatcaagtgagtagaccttcatgccaccatatctttctttcatcaatcattttatgtaaccccttgtcagtgcactaactcgaaagctttgtgaccagtgctgctgaggagaatggttcttgacgccgatgattatgcagacatttgctttcataagcaggccgagtggagcagcagtcactgtgtgtgtgtgtgtgtgtgtgtgtatatatatatatatatatatatatatatatatatatatatatatatatagatatatatatatatatatatatatatatatatcaattgtttgtcaaatgatgtatctgcacacattctgctcaagaactcggagataaatggcactgaatggagcaactgtgaaaacctaatgcgcagtttttgtgcgccatccaccattcgttgtcatgccaaaaagttgaccgtcctgattgtggatatgatcacaattgtcgacaattagaactgatcaagttgctgttttctgttctttgcatacgctgtaaacgtgggcgagttttttgttctgctgtttttttttgggtgtgtgcgtgtgatagatatgtcaattgcaattcatgccccatttgggttattgcttcagatcatgtccaatctgaatccagtttatcatgtgatatctgttggttagttcagtgccgtgctgctgcggtgctgccctggtgtggtgaaaatgtatgcctgttatgcatatggaagtatggaacaatttggggattttgcaaaaaggaggcaatgcaattacatttcatattataaaatttgtctcaaacccagtatgtgaaagcataatatctgacaaaaaaaatagattatggcatgatgtgaggctttaggccgtcaattagattatttataatgtgacaaaggaaggacaagatctacacggatgcaatagggaatgaccctccagtgtacacatgtagtctgataagacagtctatttcaagggacattcgcctgaatttcatctaaattcgaccgaatatctataactaaagataataatcatcacatggttcaaacactaccgcgaaaacaaaaggctagtcagccatctctacattgacaaaaaccacggcaatcgagacaaataacagttgatttcacctaggattagcagagctgtgagacttctgtttcgccttctctatcaggggcttcaactgctgcctctcctcaagaatcttgaggaaattgaacaagaatggcacatagttgtgcttcctcctgatgttctctgtcttccacttcttccacttctcttcctccattatgatcttctctgttacagcctcaatatgagcagcaacctccgcaagagagtgctcaacagatggcgcgtgcctattggcggaaggatcacccatctgtgccaggaggttctccctcttcctctgaagctccttgagttctaaagtgaacttctccctccggttctttaggatagccatgacgctgaaccttatctcattctgagagaaccgatcgatgcgttcctgaatgacaggctgcaccatcctcagccaacctatgtcgccaacgccacctgggcatttccccaggcttattggcccttcctttagcccatcaagctcatacaggacaccgtccacaggaacatagctaatgaaatggtagacatcatcatccttgacagatgatttctgctcctcggggacttccggccttgcaaatgaattactggccaaacggatgctctcagaattgactatagccaatcctttgagatctggtggcaagtcctttgcaaactcctttagctttttgagctcctcactaagggtgatacccggagagtttaatagaacagaaacgatagcttgggtggcacatgcattgttaattatctgtaagtgaagcattgagttgatcataaaaggatgcagaggagtgaaggctacacaaaaataaacatataaacagctctgacctgcttagcaaagaaaaggtttgggattgggtccttgataggacgctcatctttttctggaggttgccatttgtacagcacaatgagcccataaactggcctggaaagcaccaagttaagttggtttagaaaagaatgaaatttatgatactgctagcaggtattaggattacatactgaagatcattgagggcatccagatcgagtgaatagagttcatcaacctgttaaggaggaataacatagaatgtcatatattaccattcaaggtcataaaaaaaattctagtgtcacagatataagcaaaagtagaacaagatctccaaaaacatatgccagtacattgcatgcatgttttgccatatgttttaccaacaaaatttggcaacaaggttgtatttgaaaagcatagtttttattattcgtgagctaagctaaaaatagagtttcaagaaacaacatcacacacaaagtgttcaatacctgaaggcaaaaacatatattttcagcaaactttagagcataacaaagaatggacttaagtaaatgggttacatgattacttacttgaagacccttcagttgcatctgttgcaacagttcagtaaaaatgcctacagaagatatacaaaagaagggttattgcctacttcattggggaaaaaaaaagccaagtggccaacatttacaggggaagcaaggaatttaacactgaataagaaggtgtaacatggcagatagacctagccttttccaattccaatgaaatttgagttatcttccataacagctaattgactgcgcctcctgttcaatgtgtcccttaggactactggactagaaattaccagagaaaagctgtgaaacaggcgtatctgcccacatctcaatccgctattaccatcgaacactaaacagttaaaccggcagctcagaacaccaaggtccaacagcaagcttggtaatctcatatgctacttaaaccatagatgatgtttctttagggtagtcagaaaaatggcccataacttcaggaggagttctctccaatcttgtgatgagtaaagtggtactacttactactggtagtagttgtttattaaaacacaaaacaaattctaaacaacaaaacaatgtatagagtcgagtcgccgaaaattcagaatttgaatgaaagtcacaaatggaaggtagcgaaactcctccacggatgcgcagagaaagcctagttgaattgttcatatactacaatccatctcttcttttgtatttctactccataaaggtaattgaattttaccaggatcattctcgattgcagcccaagacatgtcgaagaagaaaccctgcgcaccctcctgcaggtctgcagatataatttcgcgtatcaaattaaattgaagcatcaaagaagttatggagaaacaagagctgcctgctgctgcaagaaaccaaatcttgagctaaaccaaattagacgaaagaagaaacaaatccaaccaaagggcttcttcccctaccaacgagagaaaccgacggtccgacccggcagaagctcctcctcctcctcctccttcacgaaccgcgcgcgtcgggccagcgtcgacggaggtggcgcgcggcgcggcggagggagcgaagcggattcggcggcggcggcgcgttggtggactgcgtgcgtgggtcgtcggcgatgggtgagattggactggagagagaagagagagagagagagagagagagagacggagatggttgggcctcacgggagggagtagggcacgggcccatgaaagaaaaaaagtccgttttcaatccctcaacttcacgtcaagtttaattgacgtcccaagtcgtaatcccataaatcttcaccctttatctttgcaaaaccattcacaaaaccattcaagttatgaagtactaagtcctaagccaatatgaatgtgtggttttgactgacgtggcattagaaaaaaaaaacatatggggctcaagtgtagtagacttccacctctcgctgcctatcccctttcttccccatctctcccttctcttatccaacagtagagagaaggccacaaggggactcgacttactcaccataaaaatttaaacactaaaagtagctatattttaggaattgggatgtaacggatgaagtagcaatgagaactttggcacccctttagtaaaaattgagtttattccaagcaattttgttcgaggatggatgaatttatagtagaatttcagtttgaaaggcagcctcaattttccttatgtgaagttgatgccatgtgctcatgcgtgattgatttgtgagggtttgcatttttgaaatggaggaataaagcgaaaaacagtagtactttctatatctttgtcgacgtttgatgtcgcgattcctgtatttgcatagtatggggatcgttggtactaggatatattcgagattgtagtaaaagaagatggagacaaaaattttatacaggttcgggcccctgaattgtcaggtaatagccctatatcctgttggccgaagccggttgttgctcttattcaccataatcacaccagtacaatatttagggtagcctatctatctgttatcgatatagcggactgaagtatcatcgcgtagtcgacaacagagtaatcttcctcctcgaatccgtgccctgcgagattagagacagcgctagattcctctctttggttcccgtaggtaccatatggggctttgctaggcttatctctgatgtcgatatctggcagcttgtcttggcgtatgtaggtttgtattggcttgtggctttgtggcgtctatgttgtccgtgtcccctctcctcttagggggccttgtatttatacccataggtgtctccttatccaagtagaactaggaaaaccaatatagatacaatccgagtagtccatgtcgtttccatgtagaactctagtcatccttccttatgcggaactcctcatatatcccaatgttgtttccgtataagacatggtatgtggtgggtcctaccaagatttagtcaactactattaggtatgtggtatctataaccatcacaatcttatatagtcacgattagcataaagataaaaagaaatattattggatcaattcaataaatataatgtgattaaagatatcaagggtgaaggattaaaaaaactcccttaaaaaggatttaaaaaaacaaatttaaaggagagaggtgctggttaattacattcacgtatatgtaaaattataagcttttttgttataacaaatttggccatgttatttttgttacacaaatctaaacaatagatatggtcaaagctaacatataaatcttggctgcccagattctgaaatgatactacctctattttatattttaacttattttgatttttttgtcaattttttttaagtttgactaaatgtatagaaaaatttagcaacatctacaatatcaaattagtttgattagatgtaacattgaatatatttttgataatatatttgttatgtgtaaatatattgctacatttttactccataaacttagtcaaacttaaaaaacagagtacatttcacaaaactacaggtattttgcacaatttatcacgaaactacagatttaagagcttgtttcacaaaactaaagatttagtgtgttcggttatcacaaaactacaggtactttgtacaatctatcacaaaactacagatttaagaacttgttttacaaaaatatagatttagtgtattcgtttatcacagtgctacacatttagtgtcttcatttatcacaaaactacagatttaatgtctccattctcacaaaactacaggttttagcattgttaaaacgtgtagttttatgagaatggagacactaaatctgtagttttgtgataaatgaagatattaaacctgtggttttgtgaaacaagtttttaaatctgtagttttgtgatatattgttcaaagtacatgtagttttgtgataaacaaagatattgaatctgtagttttgtgaaactagttctaaaatatgtagttttgtgatagattgtgcaaagtatatgtagttttataaaatttactctaaaaaaatattaactatgaaaaaaaataaaactaggattgagtactactcatgtgtactttgcattatgaaacataaaaaaattactatcatgtctcatattttgagatgagaagaatgccaaaaaaaaaaatgtatcctcagattattcaatttgtcatttacccatctctctctctaccttttctcttcaacgatatcctctatcccaaaaatcgagccttttcctccccccttcctcctccaccgccgcccatctcgccgccgccgccgccgccgatggctccctccaccgccctctctccggtggccttcaagtcctccttctcgccgctcctcttcaacccgacccgtaagccatcctctccctccatccttctctctccgcgcggcggagtcagccgtagccgggcgctttccgtcgtcgggcgccgctgccagcgcgcgcgcgcgcgcggaggaatcctccacggcggtattcttcggagcccaattcgatcggggtggcctcgtctccgatgccgccgcggcccaccgctttgcctggcgttcgtattatcgggtggcctcttaactctaattagtgcggatgcgagttgggttgctgtgcttgcggttagggtttcactgggcgttaaaagagagaaaaagaaattcattaagtctcaatttagttgaatgtttttgcggcggtgtgtggggggagattgttgcgtttgtgctgttctaggtgacggccggaaatatttggtttgtttttaggtttgacaataatcttttcgtcggttttcggggtccttgtacaattctatcatttcaaccatgtacaaagatgttccttttttatgttaggaattggtttcatttagttctagtggacatacgattctggcatgtaggtaatttatttcattatggtaagttttctgttgtagtagtatctgtttattcagggaattgtataaaatggagcattacacattagcttagtccttgggcttccgttctccccttttcttttgatcggtggagctttgatctttgttgaccagtgcgtccttgttgattatttttcttatgttatagcaacacctgaacattttgcacctgttgtttctttgttgttcaggttctaagataaatgtcgaaggtgcattctgtttgccatgttacaataggaaaaaggctagcaatagatcctttcgcgtgtacagtttatttgggggaaaaaaggacaaagacgagaatggtgaagaagcaccatcaaaggtaagaaaattagatgccttctttcaatttgaacttctgttgtactcccaataactaaaagagtatcttcatggatgcctgaaatgaaaacaattgcaaattcacaggtggatgtctaccttaatcagttcaatactatgtgctattcatatctttatacttttatctgaatagtaatatgctcaagataatgccttgctcattgcaaattctgttgaagtcttaaactcctgtagaaaatagttaagagtgtaactcatcatgttgatatttcagttcgtgctgaaattaaattctgcatataattttaagggaatataaaatattttaactaatatgtacttttgttatcacctctactttatagcttctatgttcagttttcttctctttccaatgaatgatgccacttctaaaatgataaacttttactttatttgggtatttgtatagttgactaagatgcatgagctgtattcactatgttcccttgtttgtgcacaaatacctagtatagtaggcatttttatttttgtttgtaaacatcttgtagttctcatttttgtacttacttttaggcaggaattttcggaaatatgcaaaatctttatgaaactgtgaagaaggcccagatggttgtccaagttgaggctgtccgggtgcaaaaggagcttgcagcgtatgcatttggatatctgagtaatatttgatatgttatcgctaaatagcacagcagtgtgacttttttcctcttgttttaggactgagatcgatggttactgtgaaggggaactaatcaaggtatgctttggattagttgattaatgttgttgttaactgaattcttgctagctgtatgtttcattgtgccttgaacattgaagggtttctttgttaaatgactgacattttagcattgttgaaaaagcctgttgaacttgagccaggctataaagatcacatattatcactgacaaacattgatctttgtttcactgagaaagggcggtcatttcctacagtaaaaccaaatatattcccttatatgttcttatactgaagaatggcatgtattttttatgatcttaattaggttgatcgctatatgaagtaattaaaatcatttggtatctcttttagctttggcttagataaagttatgttgaaaaggtaccatcttggcacaagaacactgtcaaatctgtgggcagggaggtggttataagtcatcaaatgatttatggtggcataggttgttaccgtttgaaaaggtcactgtcttaactcttaaagccatttgaaaatgtgcatgttaataatgtcttagcttttcaaatgacaaaaataacgttgcaataccttgacattttctcccatgagctaagtgctatgctggtatattttgtagagccatatgctgtcaaagtttgctaaatcttatttgtttcttataagtttagcaggactatccgattattacattcctttgcttttctcgaaagtagaaaatcacatgcatatacttccggtgcaagtatttgacctgattcattaaccaggtaacactttctgggaaccagcagcctgtaagagttgaaatcaccgaagctgcaatggaagtgggtgctgaagtatgtattttatctaccattttaatcattttctttgacgatttcttgcatgttcgcatgatttttggcatgagtcaaccatttcaatgttcacacatgaatttgataaataccttatgtatgtacccgttagcagaccaaaacaaaaccaaattgttcaaagtgtgatatatatagtatcctttcagaaactttctgagctggtgaacgacgcctacaaggatgcacatcagaggagtgtccaggtgcgaatcctgctattactttttgcgtagaaattgaaacttgcgttctatactaacacggtactgtacttaaaacctgcaggcaatgaaggagaggatggctgatctggcacagagcttaggaatgccagcaggccttggtgatggactcaagtgatagtgtggtacatgaatgcttttcaataaaaaaaaaagtgtatctcaattttgtatactagctgtattgagtcatcagtttaaaattcgtggcgagtactgttagctgtgtaagaactgtaatcgagaacatctgatcctgttttccttaatcattggcacaccataatgcattgacgcaagtgtgctgttttacaactgctgttgatgtgcagaatgaaatctgttccaaacagagaaatgggtggatgtggggaggctaattcatggggcacttggcacttggctgagctttatatagtttcagaggccttaatagtatataatggctttgtttggcccaattaaggccattgttggggtcaatagtatataatggctttggttggagatgtgccaaacaaggtcatgttaggcccaacttagcagttgttatttctgtgagtgttagcatgagatgaaactgtctactgtcttaggctgtgtttggcacccttttcccaacctctcttcctcgttttccgtacgcacacttttcaaactgctaaacggcgcgtttattggcaaaaagtttctatatgaaaattgctaaaaaaatcaaattaatctttttttaaaagctaatacttaatttatcacacgttaatggaccgctccgttttccgtacgtactgtttctggaacaagaaatggcaaacacagcctaaagtactagctcgctccgttttccgtgcgtactgttcctagaacaataaatggcgaacacagcctaaagtactaggctcgctctttcatgaacttccatggaagatggaaccttctagttcgagtctacactctacacatatagtccaacggtaagcaaaaaattagaagaaaagaaaagaagatgtatcactcacctttttatcagatctcaaaagggtgaaattaaccacacttccactgaaagctcacacaaaccttttaatcaaatctactttcccaaaatttaattaaccacattcttttccaccgcctgctagattttgtagctgtggtaatagggcacgtaagcctaatcttagtggcagttaaatataaacacaacaaacaaaagaaacccacagtgatgggtgcaggaa

SEQ ID NO: 53004 - DNA, 9355 bp, Oryza sativa
cttgacaaatagctgtacttttcacctttgctatactttcacaaattctctttctaaaatcatgttaaccaagaaactatatagaacgttcagttaatcataaagcttacactcgactgcctgcaatgatttaatggaaattctgacttatactagcatgattgcacaagaggaatccaaatacggagtattacaaaactaaggctcctttcatccttgccatgccataggttttcacaagcatgcacatttttcaacttctggacgaaaatagttcagatcatcttgttttggagaaataacagcagaaacgttgatgaaaatatggaattagtaaaaactccataaatctaactaaataaagttagttagttagttagataatggtttcagaggagagagagaaagaggattactaaaaacaaccctacttcctccaccccaaaatgttacgtagcatttttttaggtgggcacgggtattaaggaagtaggtagaaatgattgaaggaagtttgtgattggttgagaagagaaagtaggtgaagaaataaatggagaatggttgtgattggttgagagggtgtggtagaaatagctacatttcaggacggatgtagtactaaatataccagttgctcagcacatgtaaatcataatattctaagacctcttttaagattctaaaagttatagtcagcttcactgataactgaaacttcttcccgaaggaacgaagtatgatgaatttggaaatgcttttaagaaaacatataacatgagccatcattatccttatatgtcagacaagtaaaagtcatcccaaaattatttacacttcactagatggaaatatggctatctgtgtgcttttccatacagtccacaagcaattagtcaagcaaaattatttacttactggaataattattgaatgcgtttgaatgcgttttgtcaagcagaaatttgtacaaccctcgtgtctatcaaacgcattcaatagttggtatcaactttgtagatacataagcagacaattcacaaaaccatgatgctagcgaaaagtaaaatggtgaaaaaatatagcatgaatcatttaatgctcgtggttggcctctggattccgattatattggccatatggccatctaagatgaagcagcggtaccacaagataccctcttctagaaatcaagtattttttttcgtttacctactgcccttctttggaacagaccccccatctttggactttccacctgccattgccgaatgaataaaaaggccggtctcttgattaattggagcaatagaagaaacaatgtatatatccatcatgattttcaatctacaaagagtaaagccaactacaacaaggtatatgaaaatgtaaaccatatcactaaccttcggaatcaatcctcagcttggcattgggatcaatcacacctcctcggacaaacttcgacccagatgtgctatcacccttgaatgactccacaaattcctcgtacacacgtgccgcttcatcttgctctctctacacagatcagaagcagttaaaatcagatatggatagaatgtgcgtgcaaaaaagtataagtagaggtgtctccagaaagagatttgaaaacccttaccttcttcctcgcctcttcgttctccttatgtcggtggaatggaaccttcttcgaactcatcctaatcctaacataaaattatcaacagatcatcagaatatgagtagcaagcacttgaaaatcttattactctaccaccctgcatgccatgggcggatctaacatgggacatgggggttcattcagttcaacccccaaactttttgggaacaaacaaactgttattagtagtattaaggttaaggcaaatttctagaacaggagctagggttaacgcaaattcgataaaaaaaaaaagtgcgtgggtcgagagagatgggaaagaggatgtgctaaccaggatgctcgcttgcgggatggatggggatcggcgcaggcggcggcggcggtggcggcggaagcagcaggatgagcgacggcggcgcctctgctcgctcgagggacggattggggatcggagcaaggccctgccctgggacgacctactgatttttgttgcctctctaaacccgaccgacctgtgttccaaccggtgaattatagaggtgtctcccggcccggcacgaggtcagtcgagccggcacggcccgaccgtgccttgccagcccacaggctgcacccacggcccaggcacggcccaataaaaacgggccggcccgagggcacggcagcccatcgtgcttctctatagaataagtctatttgtactccctcaactctttgggctgtgtcttacatggctgcctggctggaaaaaatctattttgtattcctcatttttttttggccttgccttatatggttgattaagtctaatttgatccctctactatattttcttcgaccgcgccatgctggatcggcccaccgtgccgaagcatcgacctaggcatgacccaactatcgggtcgtgccgtgcttggaccgggccaaatggtcgtgccttgggccgggccatcaggcctcgaaccttatggctataataatgttatactatattttatttactctatgctttgaaaaaatattttgtataaatatttttatatgtcacttgttatgttgatatatgttaagtttattttaaatttgttctaatgccaagtagatactcaatctgctcaataaactgtttcatattaagtattagactttcttcgttttctagtggataggcagtagcttatcccagcaacacagcagaacgtagccttaatcagccaaatgagtatcttagcttcatggtgactaacttgtggttttacacgctcgttgaattgccctacctcacatagcctattcatatgcctcgcagtttaacatagtaataaaaacatggttaaaaacacatgcatctataaattactggtgaaagtctcttcggttttcacgatagtgttgacattggactagcctgatttatatggaatatacatgtggcttttttgccttttttttctcttactcctagcctactagtaaaaaatgcggagtttaaggctttaggcgacaacatgatgacttcttctgcatgcacaaactaactactatcttgttacttgatgatggaagtaaattgataattttattttgaattggtcactctatttttttacttgaatatattggacgcgttcgctagttattgctacagttgtgttacatgttgtgtgtggcggcggcaatacagtgcatgcgcaatacaaccaatcaaacatgttcatatattagaatcaaactcattggtaatgatatgatatttatattttttgtatagtaaataaataatataacaacaaaattcataaagtcacatcgaaaataattatagtttagagaaaattggacactcacgtgaaaaaaccggaggggaagaaatccacggtattctattccctacgccgcttacccttccaccggaagcaacactctcctctcctccaataattaactccaacgtaaattctgtaatctacaaggacccattcgcaaaaacatccccgcagcaattctgtatactactcccgcacggtaagctaagcctagtccacttttctattcaacccctcgacatctccctttatttactttgcctccttccccttctcgtcctcctcttcctcatcctcctctctctctcacccctcggtctcgctggttcttgctaacgccacgcacgctcgctgctgaatccgtcttcccggcgaagaaggaggaggaggagggatcccggcgaggcggttgttcgcgcgtgacccgctcggtgaggtgaccctctcggcggaggagtcggattgcgtcttggagaccggttccgtcttgtggatggtcttggtgatcgagaagaaatccgtggcgggttggtgaaccggagacggggaggaattgggggaagggaaggggggaggaggaggaggagctgtgtgttcttgggtgggcgcgccgcgcgttcttgcgagattgggtggttggttttgattgtggtggtatggtagaaaaactgcagatttaatctgaactgcgttggggggagtggaagaggaggaagaaagatcgggtttcgaggcgggggggggggagatgagttccgggtcggcggtgacgggcggcggcggcggcggggcggaggacgcggcggcggtggcgctggggcagaagctgccggtgcacgtggcggagaacggccacaccttcgagttcaagtgcggcggcgagacccccgtggaggcaatccagcgcaccatcgagggcctctgcggcatcccgccggccgaccagctcctcctctgcgggaacacctcgctcgacggcgcccaccatctcgcctactaccagctgccccgcgacgaccgggaggtgttcctgtacaacaaggcccggctccacgacggcgcgccgcgccccgcgccggagtcgatcgaaatcccccagccgtcgatcccgccgccgccccggccacaggattccccgccgctggatgtgtcctccgacccggcgctgaaggccctggtgtcctacgagaccacgttcagataccacttccaggtggggaatgccgtgtatcagtctagcgtggcgaagcacgaggtgtgctgccggctgctgcgggaggggcaggtgcaggagcgggcactcgacaccgcccggagcaacctggagcacacggcccggaagctcacgcagcggtattcggatttcgtcaagtgcttctcgcagcagcatcgtggccatgccgagatgctggcgaatttcgagagggatgtggagaggctgcgcgccgtgaggcttcacccggcgctgcaatgcgaggggaggcgctccttgattgacctcgttaaggagaatgacctgaggaagctggcagatgggtgcttcagctcacataaacagtttgatgttaaggtctcacagcacaaggccaaattcatggaattgaagaagaggcttgaaaatttgtttaatattatgagctcgactgggtgcaaggatcttgaggcgatgataaaggaacacgagaaattcatcggtgaccagaaaatcatcatgcagtctctaaggttagacctaggctttgaacatgttttttacctagttatcttgctgttatgttacatgccctccctgaactactattactagtgaattccctgaatcatctaaatttaataattactagtgaattccctgaatcatctaaatttaataatttacgctatgcctttgttctatggcttcactaaactacttaggagaaatttggaaaattgtgcttctattgtgtcactacacgttaagtgtcaccttccactcggaactacttttactaatgattgatctggatcataggtgcggcgtgttttgtgctgtagatcttcatgaaactacttaggatgaggaaatgtttcagcatggttagttgatggttttgcaaaaggaataggaaatctttcagcgtggttacttgatgtctgcaaaaggaatatagcttgtcatcgtacttacttcatttgtttaattatttcatgcactacggttttctacactaattgcaatgtgctcagtatgaccaagtgttttgatgcttatatgattatatgttatatcccactctaagctggaatatcttgtgtcctgcagtaaagatgtgactacttcaaaaaagcttgttgatgactgctcaaactgccagctttctgcatctctccgccctcatgatgcggtttctgcagttggccgcatctatgaagtacatgaaaaggacaacttgcccagtgtccataatatcgatcgcttgttcacaaagttgctggagaaatgcaaagccaagaagaatgaaatgaataccttggtacatgttagcatgcaaagggtcaaatctgctcagattgttatcaaggaaatgatgaacgaactccatgcattccaagaggtgatgggtcatcaagataaaattttcgatagcctaaaacttgccagtggcatgggtcatgcgtacagggcttgtcttgctgaggtcgtacgaagaaagtcttcttttaagctttatactggcttggcagggcagcttgctgaaaagctagccactgagcgtgaagctgaggtaagaaggcgagaggccttctttaggacatggagtaagtacattccagaagatatcatgggttccatgggactttttgattccccaagccagtgcgatgtaacagttgctccatttgattgcaatcttctctcaattgatgttgatgatgtggaaaaacttgcaccccaatctttggtcgggtcttttctgaaatctgagagatcacaactgccaaagtcctccttgagcaattctggtaccagtggaaatttgagtaaatccgagcaatatccgccgaatgctgatgataagatggatttccaagactttctggggggttttgacagtgtggatattgctggaactagtaaattggaagttgaaaatgccagattaaaagcagaacttgcttctgcaattgcagttctctgcagttttggcgccgaatatggatatgaatctattgatgaagggcaaattgataatgtactgaaagatgcaagggaaaaaacagctgcagcactttctgcaaaggatgagtatgctaatcacctgcaggcaatgcttacagcaaagcagaatcaaaatttgtcctatgagaagcgcatccaggagcttgaggagcaattagcaaaccagtacatacaagggcacgtgatttctggaagcaaagatgcatctgattccctcctttctgcatttaaagctaatgactgcaacttgcacatatctggagggaggcaaacccaagtacgcgatgaatcaagtgtggccatggatgaggcctcttcaacatctgagcagccatctaaacaaacagaaggtggggatgagaatatgaccgacatttcaggtgcactgaacttgcaattgctcgatccaatagcacgcactaatttggatgctttcatggcagaattgccacctgatagtgaacataaaattgttgattctgataaggaagggcaagtattgacacagtttactacgactgatacttctggggttcctatagaagatcctcttggcatcttaaactccagaactaacgagcatcatacctcagagctgagaaacaaagagctgcttgtgtcagagttgcaaagtactctggaagacaaatcaaaaaggttagatgaaactgaaagcaagcttaatgccttggtggatgaggtcaactctctgaagaaagaacttgaacacacccagggtctgcttgatgagtctcaggtaagtcaagtgggaggtagaatattcagcaatagttttttttttcatgctcaattgaaattgctgcttactttcttttacaaattttaatatagatgaactgtgtgcaactggagaactgcttacacgaggcaagagaagaggcccgcacaaacaaatgttcagctgacagaagggctgttgagtatgatgccctgcgttcatctgctctgaggatacatggtctgtttgagagactaaataactgtgtcactgcaccaggcatgtctggttttgcggactcactgcgtgctttagctctctcattagcaaggtatcttactgctctcattcgcttaaactcatgtgtagtcagttctgcatttcatttacaaaccacccacccccaagttcgttgtgctgttgggcttgatccatgccaagtctatggaactgataaaataaacaagaaaaataggatcgaaggaacttctaagatttgctgtatcttggttcaacatatccaagttattagtgatttgtgagttggcagtcagtgagaccgacaaaataaacagcagaatagaattcatggtagcttccaggaagtatgtccagattttctgtatcttggctcattgttgagatttagagaggcgctggatgttattttagcgagacatttttgcataatttgtagtaaacagagctaggaagatgttagatgttatttaaccttggcatgctttctacagtgagtagtaaactgttcttatattttgggagatgttcttatattttgggacggagggagtagtaaactgtattttgtgcttacagtgaaatattggtcgtcaaaataattttgtgttccttcagatgattgtatgtttttggtctttttgctcagagtagtttcctttgcatagagttctgttactttataaaagtattagcattttcttcctttggatcccctactgctgtagagttatcgaaacagcagatttactggctgagtaatacttttttattgaaacagtgcaaagaaggatgaaggtgatacaaccattcagtttcagcaatgcatcaagatcctggcagacaaagttggttttctatcacgacagagtgctgagctgctagaacgctactcaaggattgtaagagtgttggaggagaagaaagagtcgattaaaaatttgtacagtaagcttcaactggaaaaacaggtacgagtcgtaacttcttaagccactgtttttattaaaataaatgaattcataagaagccaattactttgaaattgttttagtttaaattccgcgctaatcaataataagcacatattactctatgggttaggttgagtctgttaaattttgttgattgaaataacaagacagtatcctcggttgtcaatactgttcaacaggctagtaaggagaagatatcattcggccgtttcgaagttcatgagctcgcggtctttgttcggaaccctgctgggcattacgaagcaatcaaccggaactgctcaaactactacctatcagaggaatcagtggccctattcacggagcagcatccacggcacccagcttacataatcgggcagattgtgcacatcgaacggcgcatagcaaagctgccctcgcacggtgaccagatggaagcttcacgccttgatagcggtggccgccggtcgcccgcttccatgctgaacccgtacaatctgcctgtgggatgtgagtacttcctggtgacggtcgcgatgatacctgacaatattcgttgaaaacgccttcctgatcatgcctatggctgctgaaatgaagggagaaactctcaactgtaaatatactgaaactgaaatttatagacttccttggttgcttgtggcttcttcatcctgggctgcagga

SEQ ID NO: 53005 - DNA, 6511 bp, Oryza sativa
tcgcttgggaggggagggagcgatcacccgcccattaggagtacccgatctgatgcgtatattagagttctgtgacgctaatgcatactcctcggtcctaaaataaaccaatttttaagatttaaaattattttaaaataaatcaatttatacctttttacctaccattggttggcaaatcaagaattgtcttttcaatgcccctcaccaaccccctcatcaatataagtttactattaattaagggcattttggtcatttgtctctttttttttcttgtatctatcttgggaagtttgtgggagtatgcaaggatattattttaacttaatcaaatgaccacgtgctctagtattttaaataattactcgtagtaatatctgcggccattattaatttgttggagctgtggaaagggacgaaattgcaacatctagcgtgaagcaaacgagtagcaaagcataatagttgttggcattatattgagcacatgacccttggctgccaaattcaatttataattctactatagcaattgattaacacgctaaataagcaagtactactactacaacaatcctaaaatataacctctctttatgttttctatctagctatataaaaacattgattcttctaatttcttttaatatataattattgttgatactgaataattgaattagccatttccaaacagatgctactctttcataaaatacactcccttccttctaaacagattatgacggatccttgtgataattttgaacggagaaatatataagatacaaattagtactacgaatgtagacataccccttataaatatcagtttatccagattcatgtagataggtgatgcctaatccaatattgtttgctataatataatattatgatactaccgaggaagtactgttttggcccgtttccttccgttttcatgctggtctcgagtgagagtcggtcggtcagaattcacactctgaaacacacgccggtcgccgtcgtcaacgttggtcttgggcacctcgcgtttcacacttttcttctgtaccatttcgccgagctttaccccgcggctcgtatataaatcctctcgatctgacgcggattctgctcattccaaatcgaatccaccaacatcccccccccccccggcattgatctcgccttcatcctcgcgcgattcttgcgaggaattcgattcccggcgatggccgccgccgtcgtctgcgtcaccggcgccggcgggttcatcgggtcgtggatcgtcaagctcctcctcgcccgcggctacgccgtccgcggcacatcccgccgcgccggtatgggtttttttctttttgattctccgccgcctcgccgtcgccggcggcggcgtggattgggaggtgacgagctcttggattcttgcgcagatgacccgaagaacgcgcacctgtgggcgctcgacggcgcggcagagcggctgacgatggtgagcgtcgacctgctcgaccgtggcagcctccgcgccgccttcgccggctgccacggcgtcatccacaccgcctcgccgatgcacgacgacccggtaaaccaccaatcccccccctctctctctcccccaaagaaatggtgacgtcatggtggtggcgcaggaggagatcatcgagccggtgatcaccgggacgctgaacgtggtggaggtggccgccgacgccggcgtgcggcgggtggtgctctcctccaccatcggcaccatgtacatggaccctcgccgcgaccccgactcccccctcgacgactccttctggagcgatctcgactactgcaagaacaccaaggtctgcaccccaacgctacattttttatcccctttctctcgcaatgaatacatttatttttttcaatccccatttcttgcaaagatttatttattttttgttaatccccaatacctgcaaagatgggattttttttttttttttgcaatccccatacttccattgattgattttttttttcaatccccatttttttctctcatacaagttgtgcaatggaatgaaatggcagaagactctgaatttttattttcaatccccattcctcgcaaagattggggttttctaatccccatttcttgcattgcaaagattgagatttggatactttaaatccccatttctcgatcacctgcgaatcaacaaatgtgcaaattgcgatgatggaatggcagaattggtattgctacgcgaagacgatagcggagaggaaggcgtgggaggtggcgaggggtcggggggtggacatggcggtggtgatcccggtggtggtgctcggcgagctgctgcagccagggatgaacaccagcaccaagcacattctcaagtacctcaccggcgaggccaagacgtacgtcaacgagtcccacgcctacgtgcacgtcgtggacgccgccgaggcccacgtcagggtgctggaggcgccgggggccggcggacgccggtacatctgcgccgagcgcaccctgcaccgcggcgagctctgccggatcctcgccggcctcttcccggagtatccgatccctacaaggtacttttgttttctttgataatggattaaaccggcctctacatccaaactggtactaacagcaattctgattgatctttctgtttcataccaaggctgtattcataaggaattttgtgattgttgatcaattttttttagctatgttcggttgctcgatttttagcaattgcagaatgtcaacttgtcaagtagccaaatatgcactcatgctgacagctatgtactaccaaaggcagtagggactagagagtttgagaactagtatttcccatggtttgcaatttgctttgtcagaaagccagtagtcaactaatctggattgcacaattaggatgtgtttggttgggtgtatgatagttttccttctatctagaaaaaagaaaagggaagacatgggtctttctccaaaactctacctctgcattatatgatagtattctgaaattcttaatatcgaaactgaagaactactgcactagtgacttgccatgaggtacttgaatctcaggttagtcagtggcttgaagatcattttagaatgccatggttagtactttggataactcaaactatgaatcgcagtggaaattattctttccttttactgtgcgcctgtgcgtaataaagccctcctatatttccttgtgatggcaatttattgttgtggacaaaatagaaagtggtatatgaattctgaagacacaacaatagctttcctttgcttgaaagacaataacacgattgttttcaagatataacatatgtgatgtctgaactccgcaattccttgtagattactaaacaatgtttttatacttagtggaatacattctggttgatgcccaatctaatctgttacatgttacttctacaggtgcagggatgagataaatccaccaaagaagggctacaagttcacaaaccaacctctgaaggatctaggcatcaagttcacacctgtgcatgaatacctgtatgaagcagtgaagtccctggaagacaaaggattcatcaagaagacctccaataccaaggtaaaaatccaatcgcttatcgattaacttcttctacatcttaagcaaaaggaaaaggtgaaattggaaaaaaacaaccatatgatagcatagatactcatatttatgatcattagcagaatgaggaaggaacattctgaaaaatccatatcaaatataaatagctggatgaaacaactttttttttccgattctgacaaaaatgatcacatacatatccctgatggtatcttgattattgcaggagcttcacaggcaaagttctccccctcaaaattcacccgcgagcatgctgatgtcgaagctttgataggtttctgaagaaatcccttttgaccgacggcttatctcagagtttacatagctcactaatttgattcagttcgatatctctggcaaattgccaatttctgggagttcatcctaaaagcagataataagaacaaccaatgtgtatatcatcagggatatgagttgaattattaaaggatgcttcagataaggttatgtggaaaaacttggtatacattgttgatagatatatacaacatatacactattgtgatcatgaggcaatccttatacatacagaaatcaaaacaaattaaataaaaaagcataactgtacattggaggatacagagaaaagattttgtagagacaggaagaacataaacacgatatctggaggctaacaacatgcatccatctagaactcgtgtatactagtataatctgtgcttcgagccttcgatcagttccaatttattcaacagtgtccgtctccagccgcgccaagattgaggccctgttaagatcatagaactttcacattactcaagtatcgtagtaaaatttatgtcttgaattttgcagctgcgtataatctgaaagagagaacgatgtaatgtgatgtactaatgtcgatgaagaccgttgtcacacatatatataccgttatatcccaacactttgacaacacagtttttttttatgtcacatggaaaatgatagttctaaatcctgctagattaattggtcaacaaaatactcaccactgaatttttaacatattttacttaattaaaacgacaatgatcagaagtgacagtggtgaccgtagcaatgcctacaataatatgacagctaaaaagtaacaaaataccatcctaaggcatttcaagggggttttttttttaacacaaattaaggttgagttgaaattagggacatactgatgaagtttacttgattcggaaaaataacgtctgatggtgtaaaccaaattatgaatgaaatttaaacgctaaaaatatttatatttgtgaatggagggagggagtatccggcccattatcatccacccaaaaaaaaccaccccttacattttaaggcacttttaaaaggagaaaaagttattacaaaatgaaaagaaaaattactattggtgaatcgatagataagggtattaaagtaataaaacttcttagtttgtgaattcgcacgagcagaaagggcacggaaaaataaaggccctgtttggagagcttaagattataagaagcagctggtttggtagccagcttctcagaatctgaaaaaactgggtttctcaactacagcttctcagaatctggaccaaaagctgaactgtttaggggagcttctgactctggaagaagctgcagctgctagaagctacctcaaacaggcccaaagaagcgtggaggagcagaagccaagctcattcccttcgcttcttggacccagagcagctctttgtttcaagtgagcagccagcccccctattaatacggttgcttttttcaccgggttgcttagcttctaaaatccgaaaggttgatcgtgaagggaaatagaaaaaagtattacttttgactcacgctggacaaattttttttctagagggaaaatgaatttgcagtactttttaaggaatgggtattgcgggtttcaagaatggttcctccgcacaaagccaatcccattccttttcacttgtgaccatcttttgcctacctatttaaccccttagaccttagaccttagtaatcccaagtccaagtacaaagctaaaagagcaaaaatcaatttactgtggaatagggtatgaaccgtagaaattactcttcgtcctaaaatataacaatttttagcacttaggatttgtctcaaaatctaacaatttctccactaatattcccttcctaaccaatcacaaccctccattcactttttccacatacctcgacatttctcaaccaatcagaacatctccttatttaattttacctactttcttaataatcgtttcttatattctgggacggatgttgtaagttattcttattttaggacaaagggactagctgtgtatagcaacttaatattggattagacacatcttacttcaataaatttagacagatgatataaaatgtatataatccagtcatatattgctatattttaggacaaaggataaaaatgaaaatgtatgctggtatggtactattacctctattctgaactataggatgaagtagatatgaattacctgtgtcctaaaatatatagtttttttttagaatttaggatgttattccatactactcgtacgaatctagatgtaaattgcaatttaagaaatgcctaattataaagtgatctacccgtgcacctacagctggatatccatcatgcattgaaggatccattgatgcagcatggctcactttcttaggtgatccagtcggtatactctttggacgggtttgattccccaaatcccaaagggtatttggatattaaatttaatgttaacaggaacatatatactccatagtaagtatctttgagggctgcaggaa

SEQ ID NO: 53006 - DNA, 1077 bp, Oryza sativa
  unsure (1)..(1077): unsure at all n locations
tctgtattttcaaaagagaacgaacttagaacttgactcaaatacagatctacatttccaaaagcaaacgaacttaaaaaccgactcatatatggatgacttaccaaagtaccggcaaaaaaacaacttcaattttttataatagtagagatataatatatatataataggtaaagaaatacaaatattacatattcaactggtgaatctgtcaacgggtgatacccgtagaccgaatatagaggatatcggggtatgttggtacaagggtctacgtaatcngacatccagcaaacaaaagacgaagattatactagttcaggccccttgataagtaatagccctaatccagttgatgtgggatatatgacggaaaacacaggttacaaagggaacgatggaactcgatggatccggcgagatcgtagtcgagttggttcgactagatccccggcgatttggctcctgcaggctccgacttcgtaggctgtgggggttgtgttggctctgagattcgatcccttaggtcctccccggggggtcccttttatatcgcaggtcaagcggttttcaagtaaaactcggagacatcagaccctacacgatacattgacgacccagtcttgtccgagtaggactcttttcgtccgtaaactccgtaaaggatttccttagtgtatgtagagagtatccgtatgcgcgtgggtatgccataccgatatgtgacgtatatcgaaaggtaaagggtatacctaacccgtaaccccgaatacaaatattacatattcaactggtgaatcaacgaaagaaaaacaatgaatacagtaaaagtggcttagtgaaaagatgcacaacacaaacgtacatgaaaaacgcatgagttgataaaattatcaaattcatcataaatcatgtataatatcttatcccatttatttataccaacataaagatgagaattcaacagaaaaaataataattaactatttagctgggcaggagcagaaccagccaagacaggaaggagcccaagaggcctacggcgatggacagatggctcaactggtaaaaaaaaat

SEQ ID NO: 53007 - DNA, 1153 bp, Oryza sativa
catgtggtactgaccgttaagcaccggttctgctaatttgggaaaatcctttttgttgatcttggggatggcctaaaattatgcatcaaattaatggccaaagaataactcgtaacaaagcatgtaagagccataatggaagcaggtaacatatcagctgttatgtctcctttgtaacagttgtatcttccaattttgcttaatattcaaggtacacaaagataatagatttcccccaaaggatataagttgaatgtgggggagtaaaataaaccctggatgaagctagaatctaaaatcgatctttactggctacttctctcatgacataatatgtaagactaaaaaaatcgcgactgccatgatgagacgaaataaaaataacagaagcacacccgtctaagatgatcaaatagttgaagtaattatataaagatagtgttatgtgctctttcatgagcagacttgtgcatgcaggagaagcaaataacacaattaagttaaaacaggaagaaatggcttacccattcaacaatatttcgctcaggcttagctcgactgtcatctataaccttttgtcctgtgatgacctccaacatgaccacaccaaagctgtaaatatctgactggacggtcagtttaccactctcaagataatcaggagcacaatatccaagtgtgcccatcactctagtcgaaatatgagtgtcatcaccagttggacccatctttgccaagccaaagtcagaaagctttggatgatatccatctccaagcaaaatgttttcagatttcacgtcgcggtttatgacgggagggtcaacattgacatgcaagtgctgcaggcctttagctgccccgacaagtatcttgatccttgtgttccagtcaagaggcttcttatcaggggaaagatctggaaaaattaagacccagttctgattagacaaacttctaattatttagaagcagtgtaatgaaggagggaactatatatgttactagtttgtaacatactaacataccatggagatgacttttcagggaacccaaaggcatgtattcataaactaaaagcctctgatcaccatcctgacaacagccaataagcttgacaagatttgtgtgatgtagtttactcaacactgaagct

SEQ ID NO: 53008 - DNA, 1185 bp, Oryza sativa
gacccgtaatgttcacccagatacattagcaacaaaacatcatcttactttggtactacatacaaaccttaatcaactaaagaatttgcaaaacacatgttgcatgtacccacctgggagttatccagcacgcccctatacacctggccaaacccgccctctcctagaaagcgatcgtcactgaagccccctgtcgccgcatacagctccccgtaggtgaatgactggccatgaataagcctctccataccatggttcgagatggaatcagcatttgtggtatttaaattcacatccatctctgcagaaacaatgataacagatgagcatgaggcacactaatgcaatggtgtcagctatttaaattcaccaagagaaagaagacaaattaaaccaaaccattgtaagattgcagaacataaggtaataacattaacatatataagacaaagtaaaagtatttctactagtattgttatcaaaacaaccgaaagcaatacagacaaaaaagtaaaacacgcgtattttgtgatattactccccccgttccaagaaaagccagtgaaagctgacaagaaacacccaagcggagaccttactcaggagatcaggacaaaatcatgccaatgcccaaacaccatttctttacgaaatcaatactccactggcaagaaatcaagtaaagagtttcaacacctttcaaagaaaatcagaacagcacaggcaaaccataatatgaaagaaagggcaattcaatgcccagaatcacgttccacgacattagtacaccatcggcaagaaaattaaacggactatctaaatttccaaaaaaaaaatctgattacttgcgacatagcacggattagaaaatagaaaaatcatggtgccttctgaactgttttttagaaggttcaaagcatcccaagttccaacttccagaaataaaaagaattcaggtccatgccttgatgctaacgagcaaaaatctcaatatacgtttaagaacatcacaagtcataaccgatgaagcaaagataaggggaggaatccaaaaccacggtgatcgcgcgagagccagcaaccatcgcccgcccggtgaatccaagaagggagtcaagaaccctcgcataggaagtcagaaaaccacgaagctcgaccagtcatcgcccataaacgggtcgaaac

SEQ ID NO: 53009 - DNA, 863 bp, Oryza sativa
tgtgctcggtaggagtttcaacttcgactctgtgtttttttttccgcacgccttccgagccattaaaggatgcattgttttttcttaaaaaaaatatgtcgaaagttacttaaaaaatcaaaaatcatattgattcatttttcaagtattttgagctaaactctctccgattttattactcttgacattttgaacaatgttttatatacctttgactatcaatactttaaagatatttagttaaagtcactagagcaatagatttacctacaaagtactataataaaagtaaaattttatttatttaatttacatattataataaaaaacatagtgaaagatatatttggagaccgtatagttgtctaaaacatgaagaattatagaaccggagggagtacttaattacttatgcgctaatgaattactccgttttatgtacgcgggaaagaagttcccaacccttaccttcgacacatcctaaacattggaaaggaaaatgaaccacattgtaacaaaccgaatcgacataccaagctaaattgtccaaggaagaatggaccatcaccgaacttcgacagggcagcttctatcttgtccagagcagcaactgatgatgatacataatttcagtaaatcagcatgtatgcaaatgaattttctcgaacagcatgcaaatgaattaaaactgcaaatctccttatctacaaacatggcatagatgctgcaatgctagattgacacaactacttcctccgttccacagtataagtcattctagtattttccatattcatattgatgctaatgaaattagatagatatatatggttagattcattagcatcaatatgaatatgaga

SEQ ID NO: 53010 - DNA, 792 bp, Oryza sativa
ccactgccactggactgaattacaaatagacaaattatattcagattagtcacataaaaaatattcagacaaagaagttagaatcaaaatactatgagttacacggagagttggggacttgatcccacattaaaggtaggccaacaaaaaaaaacaaacttacactgtggcatcgtctccaaacatgctgccaaaggttcttaagttcattcttacgtataggcttcactagaaagtcaactgctccttttgacaaacacttaaagactgtacccattgagtcattcgaagacatcactgcatgaaaatgacatcagcatcagtcaaacatattcagactaaaaggttatgtagaaatgtgtcacagtatataagtgaaaaatgtggttgagcaagaatgctacttactaatcacgggaatatccttgcaaattttgtggcttgtgatcttactaagcagaccaatgccagacagacgtggcattacgacctcggtcaatacaaggtcaatgtggttttgcagatcttcaagacattgccatgcatgtagcccattttcagcagggataactagaatgaaagagatacagtagatgccaaatcaataaactaacataatgcaaaacatagttttagataaaccttcagtgctaagagaaacaagcatgcataattctagtaagacatataacatacaataaacatactttccaggttaacaaaccaatcatgatgcaattaacatgtttacgatccatagaattcacttcaagatgtatttaattattcctc

SEQ ID NO: 53011 - DNA, 901 bp, Oryza sativa
  unsure (1)..(901): unsure at all n locations
accagcttgttcttgaggaagttgtacgagaaagatgcccaaaacttggttggtgtttcaatgatattattactacacttgtccttttgtagcattctgcatttcacattatcttaaaaaaaacatggtcctggtcatgcttttgtattcagttgaaatgttgagatgactttatttgtttgaacacataatgtatcaactttgtggtgtatcactctgtacttacatcaattacaaccctctttcagcaaagcatatggatttcctgggagttcaggtggcatgggtgactggaccatggtttctttcaattttcatcaatatgcttccatgggaaagtggtcaggttttatgcaatagcttggtgctttcattaagatatatactcatacttatacatttgatgttcggtaccagtcccttaaattgaacgaaacatgcataccaaattgttaggataatgagaatcccgttctattattttttgaatgttccatattcttgtcatgtatgttaataatttgttaggtttaacatcatctgattgaaacttttgcattctcttagttcttcgtgtttgggatgtgatcctttttgaaggaaatcgaacgatgttgttccggacaacgcttgctttgctcgacttatatggtataacttaatccctgaaaaagctattgtttcctattatttgttcttttctaataagcattgatgtgtaagtgtaatctacactgttgtctttgtatgttgatttgtagggcctgccctggtgaccacaaaggatgctggagatgcaattacattattgcaatctcttgctggctctacttttgacagcagtcaacttgtgttgacagcttgtatgggtnnnnnnnnnnnnnnnnnnnnnnnnnnnnnn

SEQ ID NO: 53012 - DNA, 1352 bp, Oryza sativa
aaaatttaatgttcatgtatgtagaaaagttttgatatgataaaaaagttaaaagtttgaagaaaaagttaagaactaaacaagcatctagtgtggtggcgttttgggattgacgcaaaacccactatgccactgtgccacaaatgaaacggtcgacgttgttttgataccgggccggcagcatggtgttttcgcttttgcagtgcatcaataatctcgtgccgagctagaagggcaacaggtcaccgacgttccagcctcggcaccaaagcaagatgaaattagtacttctacagcttttgcaacaccaatgtccaatgagctagcatgtggtggtggatatagttcgcatgtttgtggttttgcaagtgaatggttttcacatttcgacgtgtgaatccaaatgacccgatggacacacataactgtccgattagagaagctcatatgatggactggataccacgttggcgtgaataatctcttttgaagttttggtccttcctcacaaataaactccgatgaaaactttttcatggaccatcctatgtatacctacatgaccacaaatattatgttcctgtttgaaagggttccaccttttttagaaaaaagttcttctactatagtatataaaacaaagttttcaaagagggccaaccggtggaaagtactaggaaaaaattttcaaatatgatttgtacatctcaaccacaaaaccgggtataatgactcctcaatcaatcaagaccagcgtaaaatgactccctcgatgggtttgagggtggttttgattgatgtgatatctatgtggcaaccagtcttaaaagaaaataataaaaaaagatgtaggacccacttgtcaataacactatatatctcctttcttcctctctctgctctcattgggcgtttggggtgatgcaatggcggaagaatgccagttcctatatctcgctccgaacgaaggatggagcggcggtggtccaaactcagcagagtgagaaagcggatcaaccgagaaaggcggcagagtgtgagtcaacggcacactccttgacagccaacctcgacactctcatggagccgctagacgagccaccattgttggtgattgaagagaccgagttccccctcccacaaccttccatggcgctatccctccctatggcacttgcccacgttgcggacaagaccatgcggcaggggcttatccccatgcccggcgacagcgagtgtcagagaggaggggtcatcgcgacgtcattgagcaagaagctgcagcgggaggaagaagctccggctgagggcatcaatgaggcctttacggtgccgtggtgtaggatgggttg

SEQ ID NO: 53013 - DNA, 926 bp, Oryza sativa
  unsure (1)..(926): unsure at all n locations
nnnnnnnnnnnnnnnnnnnnnnnnnnnnnnnnnnnnnnnnnnnnnnnnnnnnnnncgcgttggttatcttgggattttgatgagccgtagtcggatggcacatgaacaggttcatcatccctgctacatgggagcgttccatgtgttctgcatcagtaatacaggttgttaaattgttaagtacaaagttagcatttgacattttccaagggattaaaaaatagtccaatttgaaggatcaagttggcgtttaagcaagcgcaactgctctatttttaacaccggagtcaattgtgcacatgtttatgctataatttttggcagctacacgtagtcagttcttcgtacagttgagttactaacattcaccaaagtgaaaaatttcaggtgggcttggtccaatttgtgtggcgtacaacaccgacaatccgtccatctccttgctatcctaaacacaatcattctggttgtggagacacaaagggtacaggttgtttcctcaatacctaacaataatcgtgaaatatgcctgtggagctagccgccatgaaccgaaaaacaaaacgtaggaggagggaatttatgtcctaaatcttgcgagacataaggcaacatagaaacctaaaatgcagaaatacctatgcgagattgtttagttcctaccgaaattacggtaatcctagaaacattaagcaggttatttaacttttgaccaataataaaacacctcttgtaatccgcatgcttacctctctgagtcatggtcaccagcctcctccccagagccgcagttcttagcattttagggtccaagccattctcctcctcctccttgcaatgaacagatggtgattgctcggacacaacagagcaccagctcccttcctgggaggagttcacctgagtgcatgaaccagccgaggagc

SEQ ID NO: 53014 - DNA, 730 bp, Oryza sativa
cgcttgtttgtcattgaacctaagaatacgggtaattacattgttatggctaatttatactcaaatgctggcaaatgggaagaagctgaaaccataaggagcatgctgtggggagttggattggagaaggttcctgggtgtacttggaattgagggagaacaatcgcttgcaagttttattcctgtgtttgccttaaagccgaaagctacacacattgatttggttgttgaggggttaaatgggttgaatgatagaaaagatcttgacatcaacctaagagttggatgaagacaagttatgtcgatagcattcaatagagctaaaagttgaaatgtgattatcatgcctgaaagcacatcggcattttggaattatttggaccatcggattccatacgccattatgtggtcaattatattgatctgaccaattatcaaaccctaggatgacaaaggaaaatgagaactggaaacaataagagctttgctaccacaatcttcaaacctttcgaagtgtatgatcttgagctctaatttttaataaggccaccagttactacagcaacaggaaagtcaatgattacaaaaatgatgaaagcagttgcattctgatttgaattttcaggaagtgcctccacaagttaaatctcagtgtttgatgaaacaccaaaagagcagcatacaaaagttagttcagttcatcaaaagtagttgttctagcttcagtgtt

SEQ ID NO: 53015 - DNA, 1413 bp, Oryza sativa
tacacatcctcctcggcctaccatgcacagtgcttgcgggcgccaaacacaagtctcaactccttgttctagaaaatctgggcgccggggaaatgcaaattccatgcatagctcatcatccagaatagagtttggacgtctgaccggcttgcgaaaggagttgacaaaacaacagccattgccctctctgtcgttgtaaagccgagacggccttgcatctcgtcaccatgtgaggatatacaaagataatctgacacctcgttgctagatgggtgggatatcaacaattggtgccggctcagtgggaggaagctcggtcagtccatcaatggtgggagagcctagcaaatacgctcaacgtcctaaaaaagggtcttcgatccctcatcttgttagtcgtctgggaaatctggaaggtgagaaatcgacggattttcgaccacaaagaggtggcaacaagctttctcctaacaaaaatcaaagaagaggctagcctttgggctttagcaggggctaaaagattgcacgagttcgtcccgcaacttgtatagtgtatagcttacggtgacctctctctttttcgctttaccctagaggttgattttcttctactctattaaatgaaaaggcacttttgtgctattttccgttaaaaggaaagataacgtcacgaaacattctattaatagcacaaactcctaacttgttgctaaacgttctagtgaagggtgttatgttttcatatcattcaagtgtgccaaatggcttcataaaaaaataagaccaagtctatgtaatattataggcaccagaatcatcgtatgtatggtcatatataccaatgatttcaccgaaacactcacactaatggtgctttgaaaggacttatgatgtgactcaacaattcaaaaaccttatttcccttttaaaaaacatatttctctgtttatattataatatgttttaactttttaatcagacaaactttcttaggtttgactatatttataggaaaaaaaacataacactatctacaacattaaattagtttcgttaaatctaacatttacatagtattatatttgttttgtgttaaaaatattactaccctattctacaaactttgttaagttagaggtctgcttataataagtcaaaacgtcttattaatatgaaactgtagggataataaatactagtaaataagtttgacaacaaaagattattttcaatgacatgaaagtatatttaagaccaacgacattgagtaacatagaattacaccagtattttattactcaaacatgacttttacaccacatgtcaacttcggtttattggaagcaaaagctgcaaaacatgtactaaaaaaaagagtagcaagaaaagaggattgattttttgtgtgtgtgt

SEQ ID NO: 53016 - DNA, 771 bp, Oryza sativa
actaaatgaagtgtctcctttgttaaactaattttctgcctctcctagctttgcatcagatatgttgcccaaacaacttatttcagttactaactctcatcttgtttacaaggtttgggactggatcttcaaatgaaaaggcggaggaacaaaagaggaagtccagggctgagaggtgtgttaataccactatttgcactctgctattgtagatttttcttattccccgtaatgccgaactgatacatagttggatgaattgtcactttgtcagatttggccttgcctcatcttctgctgacgaagacgctaagaaaaaagctcgtttagagcgatttggtcagagtacaaatgttcacaagggggaagaagaaaaaagaaaggcacgagctcttaggtacgaatgtggcagtgctatatcattcttgctaatagaatcttaacctagctatcagctatagctgacatctcttcactactttcccaggtttgcagaaacatctagtggaccatctcaagaaaatggcaaagacagctccaagccggtaagtttatcatggtattgtgtgtaacttttgcttcttttgtgtgtttttgtatccgacccatatgtgtgttgcaaacgcaggacgcggccactgtggcaggcacggcataatgggagcactccctgccttttgtgaggttatatattgctgctatcatcctacaatatttcccattgccaagggcttgttgcttgacatgcaaagtatcactccattcttgcag

SEQ ID NO: 53017 - DNA, 1492 bp, Oryza sativa
  unsure (1)..(1492): unsure at all n locations
aaaatctacatttggaagttccatataatttgagctaaaagtcgtatgattttgagttgaagttgaaagttttatatgagaatgctactaagaaggagaaaaatatgtacactgaaaatgtacgtgcgctaattagcgatcccctttggtccttttctgagagcggcgcctatgttgttactgctgatacattagtggtacacggaagatgatctttggcttactttcctttgtttttgagacactgacatatagacccgctggatagagggttcacatgtcaaagaaaagtaagttacagagtctcaatccggtggtacactggtacgcgcttggagattgtccaacgagacaaacggaccgtccgatcaagcgagcagctgtgatcgaagccgtctgctcaccttgccagcggccaaacgggcatattgaaggagcagagatatcgaacacgtttaagaaaagggaaaaaaagtaggactattgagttcgtgaaacaccaacgagtaggaagaacctggaccaggaagtgtcatgtgctcatgctaggtcgccggtgccatcacacaaagcagctgtgcaagaatctgctccttttcaagagtgtttggcaacttgctaacattccttcatcagtcaagtggtaaaccccgcatcgaagttaggtgaaaaaacaggtgtgagctttcgaagccaatcaggcgctcacatggtggtgcccagctttatcaacacaagaacagaatcaggcttacattatcttacatataatagtaatattcacataaagtaaatttagacctaattaaggaacgtaaaatgcatcacccaattcaaaaggaccaacacagcaacagttcgctcatgaagggaaaacttgtttaggtttatctgtttggagatacagcactgcaggaataaagtagtgcatgcaaggcattaatatgtttggacccacaaagtanagaaaatattcatcagtgtcactgagatgcaatgatgtgttgaatacaactctgatgttagttagatgtcaaaagaattgcacattnttttagacctcaagcaaatgcacatttgcacgatggaaatcccctccagttatataatgaggctgtagcagtgtatttacctttacacatcattcagggctaaatttactggacaagaaggtatgttattatacatcatgaaataactatgatttcaaattgtgtctaagcatgccattgcaagcaattttccaattaatgtaaaagcttaaaggcaaccaagatcatgttgttgagttccattgaagaattcagagattgaggaaagcacttatccagatgatcttttatttcacaaccgtttggtggcagtgcacgtattccactttagcttgcaatagatcctaagcagccaaatcacaatatgttgctagagacatatgtatcttttatgtatcttttataaccaaccaacacgatcttcaggaatggaccaaaga

SEQ ID NO: 53018 - DNA, 1062 bp, Oryza sativa
ttcttgcggcggcttaaggtggagctgaagctgccggtgctggcattggtggactccaacccatatgggctggagatcttgtcagtgtacatgtgtggtccaagaacatgtcatatgacagggccaacctgacaacaccggatattaagtggctcggagtgcggccaagcgatctggacaagtatcgggtgccggaacagtgccggcttccgatgactgatcacgatatcaaggtggggaaagagctgcttgaggaggactttgtcaaacagaatgaaggatgggtgaaggagctggagacgatgttgcggacgaggcagaaggctgagatacaggctctcagttcatttggtttccagtatctcactgaggtctatctacctctcaagctgcagcaacaggactggatttgaggaccctttctatgctagatgaataggtgaattttcatgcatttatttgactactgcgctgtgcactagatttatttatttaaaataaggtatttttgagaatcagtattcccatgggccatggctagtcgaagtcaaaaggtagctccaaaatgttcagtcaaaatgcatggttaactaatttctatgttagattaggttctttatgttaggttctttaggaagtattgcacacccctgactgagagtttgtaggatcaaattgataagggtgaccaagattgcctcgtagtaccgtcagatgtggaaatcttcttctagcattatgtatttgaacagcagctgctgtgtgtattcactaatttttaagaacatggaaatgcttacttcagcatgtattcagagcaggtatagtgacaggaaattcaaatgttactgtgatattactcatgtatcctgagcatgtattcaaaacaatgtattccagcatttatgtgccaactccatgtttggatcaatgtagaattggagctgttcacatgtgtaactgagcacatcatggcatgtttttaagaggcacaacaatacagccatgggcatcttggacatttgttttgcaatcaggtttcaaatcttgagcgaacaaact

SEQ ID NO: 53019 - DNA, 2427 bp, Oryza sativa
gctggatatttagaagagtccatggcgagtaatcacactgaagacaatggaagttcaacatactacagaaccggtgactttgctcgacgcttaaagagtggtgaatttattttccttgggagaaaggaccgtactgtaaaaatttatgggcagcgtttttcactgcaggaagtggaatctaccttaaatgaacatccagatgtcagtgctgctgctgttacttttcaaaataatgaatttctggattttagggcatacctggtgcttaagagtagcgccgcatctgtggaagactgtcagcggcgtaaaagatacaaatcttttgaagttatcatgccatcaattcgaagttggctcataatgaagcttccaccagccatgattccaaggtttttccttcccatggaatcattacctctgacttcttcaggaaagattgattatatgaagctatcaagcttgaagtgtgccttggagtcctgtgaaactgaaactgaaagaattacagttaatccacatttgcaagttatcaaaaaggtctgttcaagcactctcttgtttttaccgtctactctactgttaattttgtttctgtttgtttctctttggagctattgtattctttgagtattcattattataatgatcattttttactgatgtcatctcttatctactgtaggcattttctgatgccttacttgttgatgaagtttccgagtttgatgatttcttcaccttgggtggtaattcaatttctgctgcgcacgtagcccacaagctggagattgacatgaggatgctttatatatattccaccccttctaagctcttggatgctttatttacaaagcacggttgtttactttcttctagtcatgagcctcaccctaagaagggattggacatatcttccagcatacatagctcatttaatccgatcgctacaagtgtagatgataactttcctgaagtaaaagcacatataaatggagatggagagtgtgcacatgatgccatttcagggaattatgcaaatgaagtagatggccagcttaacagaaatgtgcctttatctaatgatagataccagacaaaatccctcttgttggatacatgctcaaatgacagaaacagtgtcgatgtcagtccatggatcttgaatttttgtttagtaaagaaatggtctattggacgttgcaatagatttatgcatggatacgaagataagctgcaaattgaagatgtttgctcatatgttccctacaacaaaagaggttatcttcaggccctttggaacattcctctcggttcatgtgttgacgcgtcacctttgcttgtctccaacaatggcatgctgagtatatttatcgggtcccattcacacagatttctctgcattgatggctgtaggtgagttttccttgttgcaaggagttttttttttatcttaactagtcattgtttcttttgcttttcctgatttactttgaagttgaatctagaacaatctaatgtgccacatacgctctaatgttcttatgaaatggcatgttgtgtatttaatataaagtaatttattattgatttgtttcattttaatttgattcaatgaagtatttaggttctgacctttgcatactaactgttgtttgaacttgctcccaacataatatgaagtggttctgtgaggtggagtgtcaaattggaaggacgtgtagagtgttctgctgctataacaggtgacttttcagaggtaactcaacaataaacaccagcacgaattcacttagcattcttgcagccagttcatggtagtacatcttttgggcaggttgtagttggatgttataaagggaaaatctacttccttgatctgttaactggaaaacaagcttggaccattcagactgatggagaggtacagctgctgcaattttctcattcaagacatcttttaagccttatagtgacatagaagttgtactttcatttcagaataataccgaaatgacgctgaactgattattataaattatagatatactcctagtaaatttagggtttcggctataatccctgttatattttcatattattgaagtggctatactgtaactccctaattgctaatggtaaataataagataaggggacatttatgtagattgtagaagttcctcccattaagcatcagctggaaagatatatagtggcaggtgtctatctcttcttaaagaaagagcatccaaaaaggtgccttcatttaattgatttattacggacagtactttatttttcgtgaaatcaagggtttgtactgcctaataagtcttaatgtcttgctatattgaggcttatgagtcctttttattgagtttatttcagttttttcctactattaactagcaacatgctattgggtgt

SEQ ID NO: 53020 - DNA, 2305 bp, Oryza sativa
tttcatccatagtacattagtactcgttatcctttgcactttatactttttctctggtctgatcaaagcatgtttgttccaataatagcctctctactttcaactagaatgtggtagtcatgtaagggggcttatggcattctagtcttagtctagtgttttgtcatggcaatacatatgtttgtctttgacctcttaccatacatccaattggtggtgtctcgactaactttacaggatgatgagaggaaccaataccaatagtctctcatcctatgtcctattcgatcatacagatgcatacccttacacaaaagatgagattcagcttgtagttttttattaattctatgtggtttataatctgcaggtgtggctcttatgaccaccatttatatgcgttaaattacaaagatcgttgctgcacttacaaaatttcttgtggtggaagcatttatggttctcctgctatagacatggtattcttcctcacagtatggttatttatttcatctaggctatccacaaatactttgtcatctatattgctccttgcagacacacaacatgatatatgttgcatctacgagtggccttgtgactgcaatatcacttgaggtgagttttagtgtgataactttaatttagggaaaaaatacagccttttccttctcatcggtatttctttccttctttgggttccatgggagatgtctttgtgaacttggtgatatcaacgaaaacatcattagcagcttaatgtttgaagtattcactggtttgtggtttctttgtggtaacaggtatcgtcatttaagataatttggcaatatgaagccggggcaccaattttcggttctcttgctatacatcatcatggtggaaaaggtagtcctcaaacatgttgcaatgtgcattgatatccttcaatatgcacttacttgtgtttttattatatttcctcacaaaaaaagatttaaagaaatgcaatatgtacagcgtaccacaggatcagtgaaaactatatcatatgtatagtttggtagtatatgtgtgtacacggatcaaacatacttttatgattcgatcaaatatatacttttatggcatgcagtttttgctgatgattgtagttgcaatttacagttatctgctgcctggtgaatggtctggtgattgcattgaactcacatggctctgtcgtttggaaggtgcaacagctttatacagtacagttttgcaattgaatgacacatcatggatgtagttgttgatcatctgtaaaatactagtggaaattcattattcgtatttggtcaaacttataagcaggtgtcattagagcacatataaactgagtacctcttatgatagctatggcagtatgccactattaattctgctggtgccagcaagtggtgggttggataaatgggttagaaaatggctcccatgttaggcaaatggggttgggcttgggtctagtgccatgtgagcaggaattggtgtaatgccagatgatagtttggttggttaggcttataaaaaaaatcaagcttagattaccaaagtaaatccagttttattgtggtgtgccctggtgctttctaaacacattgatgttgctttcaacaatgtagtaactaatttttaaaaccacaggcatctgttggtggtcctatttttgctggtgcatgtttgtcatctggccttcctactcaggtatggtatcaatttatgtgtcttttcattgactaatgatcaaaagttacatctgtagcttatggagttccatgtgaagtgtagtgaaaatcttttacatatatgtcatttgcaggtgttgataccttcccgtgacggaagattatactcttttgatactgtaagttttgatctcctgaattttgaacctcttatgtgagcagaactttagcatagagtaatgaattatgcatggtattgcatgaatgctgcaccatacaataactctgtatttaaacaacagtttcaaaatatatttggtgctcgtgttttcaaacacaacacacccgaattacaattactgatcattggacacctctcactgccatgctcctgtacttgtttcctgatgctaatttagccatttcagggagtcctcaacgtaagggtggtcaatgaaactaattttagaaagggattatctgttaattaaaacagaactcttcaatcgttgaactgtgtcataatgtgtttctaaataaccagaaaaacaaaagggtatcttcacaattgattggtacctagcaatttattacaattctga

SEQ ID NO: 53021 - DNA, 4922 bp, Oryza sativa
  unsure (1)..(4922): unsure at all n locations
ccgaggaggaggccccatatgtcagcgatataggtggtggtggcagattcacttccgccaccactactaccttttaaagtagtgtagaatacaggtagtggagtgatttttttttcttacagacatctggtgctcttctttggaaatatgaagttggagaccctattaccgcatctgcttttgtcgatgaagtgttaacagcaacctcacctggagcatctgaaaggtatttcatatattgataacatagttacgcagtgatcatgtatcaagaaaatgaccacaccttttcttatatatagattcgcttgtatctgcacgagttcgggacaggtccatgtcattaggattagagctgatgctaaggaagagaaagttaatggaagtatttgtaatgacttggtgcaaggatttgctgcaatagatcttcctggggacatcttctcatcgcccttgatggttggtggacgcatctttgttggatgcagagatgatcaactacactgtctcacaatcagctcatagcttcaagccgaataattggagggcagatagtttgcttcgcattgctgtaccgagagctcagctagtcagcatcatatccatcctgctatgattatacaacgagaacattttccctcctggtaagacgcacatcatttactgttctgagtgcaatgtttacttttgaagtagtcttctgaactagccaacaatggaagaattgcagaagctgctggtcttcctgcaaattagcaacagtgaagaagtgcaaaatgaaacaggacgacgtatggactccggtaactaggcacaaggttttgaacgtcaaaaattcaatttcacaacatgagtgttttccccatatgtaaaaccacttccgttactctgcagggctatcaagcagccgctgcttacttcagttatgcattcttaaggctgtgatttgaccaaacaaactacacactcaactggggtcttgttcagctttgccttacccgggcagcttggtttagggatgcaaatggcccgtattaattaaggcctgttgggtttagaggaatttcgcgggaattttgaaggaattgaattgtttgctgtgtaaatcatgtaaaaatttctgcttttcgaaggagcccttatcgggggaatccttgctgcacgggaccgaagtcaccgaacctctgctgtattggtggtgactgagatgttgtgcagtatgccaattcgtccttgtgattcagattaaccgtaagctctccagttcaaatggtcttctcgtgggcctctgtttcaacagcattttgggtagtctctactcaaatccgagtaccatttgcgacaacgcgctgtgagttcgttaagttgctcccaaaaatccaagggtagggtccgaatgatactcaatgtgagtaccatttacgacaaaaaggaaaagttaagttgcacccgaaatctaaatgtttatgtagtagtatagtatacactagtaacttgctaaccaactcgttcgcaattcacaaagtgctaaagggtagcacaaagagagagtagaagcaagcgaatgcaaaagaattaaagaagcctttataagaagagaaggccaagcttgtgttgggttggctaaggtagcagcagtccaaggcccaccaaagcccacaccaaatagaatagcagcctctctccatctctctcacacactcaactcaactcgactcaaccaagccaggttgaggcggcgcggcgaccaaacccccacacccgcaaccacccaccacccgccgccgatgcccggcgggccctcccgcgccgccgatgcggacgacgacgacgacgacgagctctcgcgcctcctctccctggccgaggccgacctcgaggccggccgcctccgcgccgcgcacaagcacgcccgccgcgccgcccgcctcgacccggactccacccgcgcctggctcctcctcaccgcggtctcggtcctagccgccgaagactcctcccaccgggccaccctcctcttcccggactccccccactccaaggcctggcccctctcaccttccgccctcggccgccactacaaatccctctcggaatccgtccgttccgccccgccctcctcttcccccgcggtctcttccgccgtcaagaaggcgctccgccgcgccgcngacgcatacgccgcgctcgccaaccaggccgccgcccccgtcccgcccaccttttgaacggcgtgcgccggctcccgcctcctccatgagttcgaccgcaagtacgtcggattccgcctcatgtgcccctcctgccgccgcactttcctcgcctccgaagtgccccctccgccggaggctgaggcgaaggcggagccagacccgctgccgccggctaagaagaagcccaaaacccagaagcgtgagatgacgctcgccgagatgcagctccagctctccaagaaaagagcaaccaacaactcatccagactcgacgaggatgacgacgatgacaatgacgatgacgatgacgatgatgagggagaggagcagcagcagaacaacgactctgagatgatggatgtggaggactcagacttctacaacttcgacgccgaccgctgcgagaagtgcttcaagagaggccaggtgtgggcattgtacggtgatgatgacggtatgcctcgtcactatgcgctggtggagatgattacaccagggggccgattccgtgcacagataaggtggcttgatctccagccagatggaggggaggggacgccatgtggggagttcaaggtcgggagaacggttaccgtgcattcagtgaacatcttctcgcatcaggtcgcctatgagagggtggcgagggaggtgtaccggatttaccccaagaagggctcggtttgggcgctccatggcggaaaggatgccgattcggggaggccaaagtatgagtttgtggtgttcctcagtgggtacagtgacctttatggtgccagcttcggctacctggagaaggtggaaggtttcaggagcatctttacccgccaggatgtcggtcgcgatgctgtccagacccttcacaagggagatatggggaaactctcgcatcagattccggcgaggagagcgcccaagggtgaaggctcaaccctgcctcctactgattgctgggagcttgaccctgcatcattgccttctgagttgctgcatgacaatcagcagaaatagccgatgtggtaacttcgagaaagtatcttagctgataggattgttcatactgtagaatttgtcggaggtcataggtctgtggtggtctgcctagtgaaatgatccggtgatgcatttgcttcacctgctttggatgtatgttcctccatgcttatggctcctcgtcaaggtagagatttagatagcgggatacttgtacctgatgctgtgttcaattccaccatcaacaactttcagtgcatgaaatgaatcatcttttggtattgatggtagacacttctctgttataacttatatgaatgatattgaggaaattactctgcaatgtccatactatctgttgcatttcaaccaaactagtgtctatcgtggtgagttttgtgcatataaaagggtgtaaatttttatctggaagaagcaaaaagcaatggtggttgcatctagcaagtggtgccgggaaggcagtagaaactgcttggcgtagtccagtttggacagtgaaagtacaaccacgatggatgaaatgttgtgtgccggtcaatagtagcatacttttaagtgatgctttgttcaattccaccatccacaaattgcacttcatgaaataaattatcttttggtattgatggtagacactactcttatcacatgaatgatatttgaggaaattactctgtaatatccatgttttaggtagcattttaaccaaaccagagtttttcttcttctgaaaggtgcaagcgtggggtaattttcatcgagaagaagcaaaactgcaaaagcaatggtggttgctctatggtagtattgtgcaagttttgctgagagaaggcagtagaaactgcaaaagccagtttggaaagtgaaagtagaacgacaacgatggataaaatgttgtgctgatcagtagtagtagtagttgggagtactttgtactagtagatgacatgatttttcctcttttcttcagtatcgttttctttcagttgtgacgtgtttttgaaagctcacaccgctgtacggtatagttgacccagccagtatggcgtcagtcaattacaagtagtcacacccagaaaaagaggcgaatactccttcagacaataatgattctccaaaaatatccacgtcagaagtcacaactgaaagcaatgctagctaaaagcaacactcgaacaaacacagcaagaattggtctttgccttgcaggcagcacaagctctgaccgtgtcatgcaacactttctctgctactacaccgtcagagaaatttccgtgttgaaaaatactaagccattcttacctgctcgtaacgaccaagtgtaatgaaaaggaaagcatcaagaatgatagtactactgcaaagtgaaggattaagagtaggcaaatgcaatacaagtagacagcgcagttatgcagaatggaagagctccaaagaagtgcaggagtgcaactctgaacttcctagtctccgaatttttgcaattgattgatgttcaggtccaaacagaacctcttctcattttggcacaaaaacgaacaaaagaactagtatcatgcatgattcataatagtatcatcttcgacccaaaaaaaaaagaaaaacctaagtaaacataggtaaagaatttacttgtccaacagcaaggacaactgctactgggaccactcttataattcatcatacaaaaggttcatg

SEQ ID NO: 53022 - DNA, 34958 bp, Oryza sativa
ccagcaatcaccttgagaagaccctgaagaacagcagcaaggtgggcgctagttcctccgattagccagaactgctcattcctccaccattcctccaagctgatgcctgaccacttgatctcgagcaccgcaagcatgcacattgtcagagtgataacgagcagataggtcaggaaggtcacatttagcgtccgcacaatgaactgtcccgagaagagggacagggctggcaggaagcagtagacaatgaggaagattgatgtgaaggggtaaatgccaacgttcaggtatgcaatcctctgaagaaacttcatctttcggcttgcaagtagtgcattgttgcgggagaagaagatttccactgaaccagtagcccaccggagcacctgatgaagacggtcagtaaggttgattggtgcagtgccacggaaagcatcacgtttggtgacacagtaaactgatttccatccacggttgtgcatcctgtaaccagtgaccacatcctctgtgactgaaccatagatccatccaacacgctgaccccactcagtcttatcttcataccagcatgagatgacactgatagcctcagcaactgtggaagcatcgagaaggtcgcgagggacggtgagagcaccaagaggacgtccatttttgactccaggatggtcagcaagaggtcgcccttggaattcagcaattgggatagagttgatgaggaagtttgaattaccgaacttcttgggaaattgtgacatgttcatttcctcatcatcaaaatctgccattctcaaagcctgcctctcttcaaatgcaactgtggaagttttaaccttgcgcctctgggggaagcaacagctgcagcaaccactatgttccttggagcgcggtgggtcaaatccatacaaagcgatgcgacggaaaagacatccagtgccgacgtagactggtcccatgataccatcaagtgcacgcatgttgacatcgaagaagacagtgttgtggttagcatatcgatctgatggatcaatgccctcaaaccgttgagggaactggacatagccaatacggtcaccaccacgatccatcatgaagcacatgccttcacggaaagcttgtgagttgtaaacatagtgatcacaatcaaggttgaggatgaaaggtccatttgacatgacagcagatgagcggaccaacgcattcatcgcaccagccttcttgttgtgatcataaccaggacgcttctctcgggacacatagaccaacattggcaaacggatgtcaacctcagtgaaatcaagaggtctgccttcttcaccgctggttccatacaagggatcatcactaggaggtttcagcattacctgaacacaatacggcaatgatcaaacaggtggcattttcctggttcactactacaagatagatagaggcaagccccatagagatactgctagatattaaaacggtaaaaaggatgcacatgcttctgctcaagggaaaaaacaaaaatgaacagtaatcatttgtgcaaacgtgcaatactgtttatatgcagctagctaatatatttcgattgcaagccatatatgaaaagcaaggagaaaggtgatgtaagaatgtgaaaagccatatatgaaaagcaaggagaaaggtgatgtaagaatgtctacctgaattattccagcatggtcaccccgagcatgctcagcagagggctgaatccaggtaccaggccaatgcgtgccatcagccatccaggtagctttagggattttaacagcctccaccacgtcatcgagagcagcctctcgttgccgcttcatggccttgatttcctccctggcatgatatgcatcggagcggcgacggattgaatcaggcaagctattgatcctgaccttgaactcgtcgtactccctcttcacccttcttctgtccttgacaaaatcagaacggaccttgttcttgtatgggtccctcttcagattaaagtagctctctgggttgcgaggctcaatgtcatgtttgcgacagaaaggaacccacatgtttgcaaagctagcggcttcagccattgcttcaaatgtcaggagagcgcctccatcatcagaaacatagcaagaaagcttctcaacaggataatcagcagcaaggatggacagaatagtatttgctgtgaccaatgggggttctttttctggatcagcagtagacacaaatatatcgagccccggcaggtcagatcttccgttaggatttgatggcgtcggggtctcaaacttatctttcaggacagcaaggtcagttgctcggttaacagggcacaactttggcagctgatccaagagccaagagaggccaaaccagagttcgcaaacaacagacatgccccatagccacattgcatcctcattcttgtgcttaattctccatgcaaggaatagaccaagaacagccatacgaataagaataagaagcctgcatggaacaaccaaactaaggttagcatctataaactgaattataagattagctataatattgtgtatttgtttggaagctggagagatcagaggaaatagaacagatctaacaagtcagctaacatatttatctattgagcagagatctaacagctgggagtatatatctacaaatccaggtttgttttttagtttcatttccaacactaaacaaatcaaatgcatctcaaaacaatatagtactttttaccagatcaacggatccaatcagtcaaatgtgagcacatggatggacatgtgagccattcacctgtatgggctaaggacacccgcaggaatcttgagcttgcgagtgagcggcctccatggcttgctcgtgaactctgccggctggccgtcgcctccacccagcccgccgcctccgccaccgccaccgccattgtcgacctcgttctccttgggccaaatggcattgccatacccgtatgtccccttggtctcgaacagccaccgattgtgatcccaatcgccggtctggctcctggtcatggccttctgcgaccgcattatcgacagccgcctctccatcctcgacgccggcaagccaccgggcggcggaggcagcgacagcgtcggcctcgcaccgaccacgtcgtcgagctcggtggccttgtaggggtccttgcagccggggcaggcgccgccgttcttgacggcgtcggcgaagcagtcggcgcagatcttgaagtcgcactcgcaggggaggatgtcgtcgccgcgctcgtcgctcatgaccttggcgtcgcagccgttgatggcgcaggaggagcccttggcgccggccatctgcgggtggctggcctccgactcgatcaccttgtccatgaggtgcgcccgcgtgacgctgttgaagccgccggtgaagagcgagttggagacgtactgctcctccacgcgcgccgagatggccgggtccatcggctggttgtccggcgtcgccgggatcgtcacgtggtagttgaggaactcctgcccagactccggcgacatgtcgccgctgttgccgagctcgctgtcgaggtcgtcgcgggagtagctcacgtagcgccccgagtgggtgcggcgggcgaacgtcaccatcggccggtcgccgccgccgccgggggcctgagcgcggccgtcctcgccggagtaggacatgcgcgagaggcggctgctgttgctgtgacgcaggccgccgccgccgctggaagccatggatcgatcgcctcactttctgatctgcgaatcgaaggaaccaaatcagcatcgcgaggtggggatcggaaaattaaagagctagtctttatcgcgtacgaggataaaaatggcagatttgtgctcgaagattcccgtctttggaaagaaatcagaatcagacaggcagcgagagaataggctgaaatcccgggacccaaacccaagattcaaactttggaaagcaaaagggaagaacaaatctgagcagcaaaaccttgtcgccgtcgcccacagaacacgaagcaagaagcataaaaaaaatcgaatggaatccgaagagataaattcagtgttcactcaaccctaaatccaacaccgccggcaaacgcagactgaccgattcaaaaaccagagaacagcccacagattcatcagatcagatggatggaaatggttttcttaccatgcgatgcgaccactcgaatcaatcaaactcgaggaggagtaagagagatgggagtaatggcgtgtggtgtacttgttcttcttcttgggccacaacaacacaacaccgtatgaatggaaagacaatgagcaatggaaggggaagggatgcgagttaatgatgatagactactcgtgttagcaattgatgaggaagatttgggaagcgaagagtgagtacaagtactagtggtttggtgaaagctaagctcggagaagacgacgacgaagtctcacaggaagcaagcggctgctgcagcgaggaagaaatgagtaggaggaggagttgtaggcagaggaaatggaaaaaggcagcacagcacaaagacgcgtgctcacatggggatgggggagacttgggaatggggagccaaaatatttcaaacaaacggagagatttccttttcttttttttttttgaacatagacatgtaaaccctatccctatgagtatctttaaagactgggccggcaaatctgaagattgacgaaatcaccacatgcgtttcgctgtcgacggatacgttgcataccattgaaaggacaaagccgttaaattctgaaaaaatcgctcctataaagagtcgaacccttatgagagaaattcttcgtttgtttctttctttgtttatttatttattgttgtggttttttcttaatcttaaagcttctttttaattggcggctgctggcctgctgctgcgtgcatatgcaggaggggaagagctgtaccaggaaggaagcgcgtattacagggtaggatgcagctggccaggtgaccaacaaacacctgccagtgacggtgaattctgcacaaatttattttttttgaatatctgaatgattcacgcgttttttaaaattttaatgccaggctctaggcatcaattactaccaaatctgccgtgagtccccaccagggttttgcaaaatcacgcagctaacacgtgtagtaaatcttcttatttattaaaaccgtgataactatacggttttcatggttatcacaataaacatcatatcttggaatggcgataattttatttaaaatagtttggtaaacccgggtcccactatattagggtgatatgaaaatctcactatcaaaagcacaggtttaagcttaacaacgagcggagcgtgtctgactgagcacgcacggttattagatcaatcaaacacaccaaacccactttgccgtaacaatctgcatgcaggtcatttttaagtttcactttatttatttacaaatggattgaaagtttaatactcaagatagtgtcaggagatgatggtgtgaacgggagcggagggttcagatttcagaatgcacatttctcatttcgcacatgcacggatgcacctgggtccatctgaaaaacaaaattgccaaaccgcattcataaacaccaccaccgccatcatcatcatcatcattcatatcagccacaccgctgtatatgaagagtacaccgtaccatctgtctaaacaagaatcaacttctgtttcaaaacatttatctgtattaacttcagaagttgattgaagggagtatgagttaacaaataatacgacatgtgtttaacttggacggcacataagggtgacataaacaatttggggtgattgagatcactggcaaatttttttccccgtctattcgaacgtttgaaaacatgtacggagtattaaatattgataaaaaaactaattatacagtttgcgtgtaaattgcgagacgaatcttttaagcctaattgcgccatgatctgacaatgttgtgctacagtaaatatttgctaataacggattaattaggtttaataaattaatctcgcagtttacatatgaattatgtaatttattttgttattagcatacgtttaatacttcaaatgtgtgtcagtatatccgatatgacacaccaaaactttacacccatgcatctaaacacacccttaatttcgtttggtttgaggagttgtgtaagtatgttggtgttcggtgttccctggccccaagctggcagcatactagtactcctattgaaatggccaaattaatactggtgttcaagatattgcttcatggaccacaagttttgcattgtagactagttgcatatccattccttgcattgcatctgctaagctatggccgggctgtgtgtcaaccccacagcttcttcttcttctttcttggcctacaaaaatcagcaccaacggttgtgttgggtttggggtttccatgtgtcccaagttattgtggggatgcaccgacttgttcttgtctttggagtttggaacggttcaactaattaattaattaatcatgcagacaccaagtgctcttgttgtttgcttccaaaggtgtactagtacatgtacaacggctagtgttatcctcatcaccggccggttctttcagtttcagctgaatggatagatggacgatggcttatctcattttgtgataatatttatgtcttacatagttgaaaatatgttttaaaaattactatataaggccctgtttagattctaacttttttcttcaaacttccaactttcccgtcacattaaactttcctacacacaaacttccaatttttccgtcacatcgtttcaatttcttcaaacttccaattttagcgatgaactaaacacagcctaaaaaaagggcatttaactatttgccacgtttaatatgtggcaattaagaatttgtcacctacagtctatggcacgtgggtcctcatgtgtctattacacgtgggttcagtggaaaaccttaatcattaattataagagtggcaaatagataattatctctaattcataagaactatactggcctgaattcacaactctctaattcacaataagaagaaaacaacgggcctgaatttggtagagagaggccggccggcgttgagaactatactggccttcaacaacatcagttcagggcacttctgatgctgaataatgctctgtgaagtgagtatactgcaggttgtctgtttgtagatatgaacattttgaattgatccgaagattggttcgtggtagggtcgcaatcacatgcattaattatgtggagattaactagctagtgttgagctggaatgaattcagattggtgagcagtttaatgaaatcactggtgtccatatggcacatatgaatatgatccgccatgtgcacatatgcgtcatccgggccatggattatggagtactactattatttggatgcttaattactttgttgaatggatcggcgaagaagagagcagagcagagcaaacacggcagctaccaagaatttgccattttatttatgatcaattgatctcaacaaggccaagttataggagcatatatactccatgtttaattaaccagccagctgattgcatgcagcctatcacaattcagaggatcgagatgacacgtaaacgtacgaaatacttcttctgatttttaattcataataacacagttaacttttaacacaatgttaaccatttatcttattatagaaaattatataaatatcatttatcttgttgtaatttattttattattaaataacttcaggtatgacttatactttaacatatttatattaaattttttaataaaatgaatggccaaacattattataaaattaatggtgttatccattaaaacatgaaggtagtatatatataagtcattgattaattgttgtgttttgtttagaaattgttgtgtaattgaaatcacagagctatacgtacgtactgtatatcacgaaaattgaagcagcaacagcaagtagtagcataatatagagaaacggtctatgtacttcgtatatacttatgtatgggatgggttgtgttggaattagtctcaagactaaaattaagtgcagtactagcgaaaggtggtgatgattaattcaattgttggacacgatacgtgtacgtacgtactttaggctagtaataataagattagcttatgttccggctattcgcgccggacgatataaaaacgatgaacgcggtggagaccaagtctaaatatggttgaccacgtaaaattcatagaaatgaaatgggcatacatattttttttttgaaactagagcacgagggcccccctttccattactggaacggcataaaccaagtcattacaagcagaaactggagagagaaaaacaaaagatgttaagagaggggaaaaatgtccagcaaagctgaaaccaagtcatcttcgcagaggccagcgcagaagggctggggagagaagactgaactgaaggccttgccatcgttctagcagaagactagagaaacagaggaagagaagacagagagggagcagcaagagagacaacattgtctacacacaaaagcacaccattagcagcttcattccagccttttaacacaaggtctccaaccgtatcttgaattgaaaacatcacttgccacctgctttaccactctggctcccagctccaacttttttccgtttgcctccaaattctgcaaaacagcacaggattcaatcaaatgacagatcataaaaatcacctcaatggggtctttaggaaggatattatcaaaacaagctttgttcctagtcttgcatatggcccaaatagttacagaaacccccaccagcaacaagtttttcatgtttttgttaaaaccagaagcccaggaactaaacagctgagttttatccaaaataggtttcaggtcaagagcacaggtaaccacattccaaattaattttgcgaaggggcaatcaaaaaataagtgctggatagactcttccctgcaacagaactggcaaattttgtctccctttcgccaaccccttttataaagattgtccttggttagaattttatttttgagaaacagccacaagaaaatcctgatttttagcggcactttgatattccaaatttttttaaaaggacaagcagtctgttgcagtttcagagctctgtacagagatttgactgtaaaaaggccatttttttgtcaagttccaccaaagcctgtcttttttgtccacctgcagttgaaacccttcacaatgttgttttataaaattccaatcagcaagtttgtcaccatgaaggacccttctgaatttgattttatcccaaccccccagaagcacttcatgaacagaaatctgctttgtgtttgttaggttatacagggtggggtactgcaaggctaaaggtctacctccaatccaattatcttcccaaaaaagagtttgttttccattccctatttttttggtgcaaaacctatagaaaatgtccctaacctccatcagcccttgccaaaagtgagaatctccagccttaatgggcatacatatgttcatatgttttgatgctaatcgttgctagatattttctccatccgaaaatgtaagcatttataaattaaagttatatacaaacattaagaaattagataaaaatgattgtactagctaatacgatggatatatgtgggtgtactctctcttaaaaagaaacaattcgaattatctgttcagatttatttttagaatttagttttttctttaaagcgtacggagtaaagaagcatcatatgaatgctccatcgatgtcatgtgagctgatgattgtgttcatgttattgttgcagagtgcagacacagggcaggcaggaaccaatcgatcaattgaccaacaaaacgcggtggagtttggttggtactcttttttttctttttttttgtttggttttgttaggcaccgatcgattttgcaccttataattatactgttgcaggtgcagccctgcactagcacacctccgtgtcttgtgttgcacatgcgcaaaataaacatcttgttctatctcactctcatattatttgagtaattttattatccttggagagatacttcgaaggtctcatattctctattgtaaaatttgatacctctagttattaagtatcttaaagtatccaaaattttattataaaatttggatatctcaatgtattttcttaaatactgtaaaattcctcgtattatttgggttttagtctcgcccacaaattttaccattttccttcccttgctacaaatgaaaataaatggatcaaccttggaaaataaatggatcaacctaccaagtagtaccaaagcaccaacattacaacattatacatctttctctatctactcccctgccccttttacatatgactctcaattcttttcataccataacattatcatcatgtaagtgtaaaccaaagtaaagtgcggggatcgataagaaggtgggaattgggggcattaggaaaggacacaacggttgtttagcacatatcaccaccaaagctccatgcatcggtcttctcccccaaggatggcactcgtccctttgtactagtattgcatcttggctgtgtttaattcacaccaaaattaaaagtttgtttaaaattagaataatgtgacggaaaagttagaagtttgtgtgtgtagaaaagttttgatgtgatggaaaagttggaaatttgaataataactttgaaactaaacacagcgcgtgttgctcatcttactctgagttcaggatgaagaaacctcccaccgtcccacattacatacgagccagcttaggctgtgtttaaataacatgtgtgaaaagttttggcgtgtcacatcggatatacggacacacatttgaacaaaacaaattacagatttcgcctgtaaattgtgagatgaatttattaagcctaattaatttgtcattagcaaatatttactgttgtaccacattgtcaaatcatggagcaattagacttaaaagtttcgtctcgcaatttacaagcaatctgtgtaattagtttttttcgtctatatttaatactccatacatgtatccaaacatttgatgtgacagggtgaaaagtttttgcgtgggacaaatagggccttattcaacatgttatatatcgacatcgtcatatttcccatgtcagtttatatgcccccatcatgtttacaaataatctatgttatcttaaaaaaatgtttacagataatccgacatattttctttgaatgtcatgctgctcactatgtacgtacgtagaatcttttgtacaatacgtatgtactattgatgagttgatcattaaaagatgaaatgaatactgtcttcagtcaagtaatgtagctcaccaatcttctcctgttgtacacaatgcttgcttctagctagcttctcctcttctctcatacccatacatatcacatatgagactcttcgtcttcaccagctagaggagtgatcagcaatataatgcaatgcaagctccatggcctattccatgcatgcatttacccaagctaaccgaagttcatatagtgtcttgaatcatccctactagctagcagagtacatggggaaagaaacaagcattgctccgtggaggtagcagccattgataggttctactgtcaagagtccatgataaacttgtcaatcttttgatgccctaccttccctttgtcctcacatgagctgaagacatgtactctgcctctaaattaagatccttggttgacgcaggagatgccattcgagcgcaaagacgccttttggcttgccctctttgcaaaattaataatggatttgtacgtgtagaccgacttgttttttccctttcagcgtgtaattttgagagacagatggcattggttaagaattagtccatgcatgagtgtaaaatatgttaacttcttttttttaagaaaagagagagagagcgcgcgcgcagcgcatcgatatgtgtattgatccattctctctttttattttttgaaacttgtgcattgatccattctaatcaaccaagtaattattacggagtactctttccgtttcacaatataagtcattttagcatttttcacatttatattgttgtcaatgaatctagatacagaggcagtataagatacaaacatcgtcgttattttgttattttcattcgctaatgtgtacacaatgagccaggcccaaacaattaacagtacgtgctcgttcggcccacgtccattttctctctgaaaatgttgctttggcccttgtccattggtgaaactttgtcaaaaatataaatttactcaaatataattaatgaaacaacctaccaatataatgctcctcggcctctatatagtatcatcaattgtccctcttatgcatgtatatatggccttcaattcctctatattataattatacttatagtgccgtctaattaaaaaaaagaataaaaatgtgtggagatcgatcgatgggaggagaggggaagggatcggaatgggaggcatcaggaaattaaggaacaccaattgctgtacctcagttcatctcgcagccgaaagatcagacatatcctttctctacaagatgtcccgtgatgtacattccagttaatcgatcaatgcatgcattcatcttgttcatcagattactgcacttgtcgatcgatgtccttccgttatcgccaccgtaccatcatcatatttgacatactatttcatgtatatgctaatagaaacctctgtatatacctgattaaacatgtatttgcaccaagagaaatcgcagcttaaacctgatctagacataacaacttagtactaacggcacaagctgataatgctacctaattctgaactgtagagggtatatattcactcaaggaatgcatatattgtttgaaaaacctgctcaatattaatgcatttcttcctagctcaaccagtttacaattaatcgtccttgatccgatatataaacaattattcataatgttatatttacactttctttaactaaaatgttatatttacattgatataacacgcactcaaaacgtgtactcctagtactagctagtgctctcaattttggttgttcaattctaaccatgtcatgtatattaccgtgcagatcaatgagagtcggcagcggaaataggattcttctaaatctagagctcagctaatataatttacatagcttttcctttaatattctactttttaaagttttaaagtacaattctaatggatatttagactcagtaatagagctgcagccctagccgtcctactcctgtctccgccccattgagagagaatagtgaagcataagggaagaataaactgttctaccatacacctcgaacccttcaacgatggtttagtaaaatgagaaaacaaaaatatattgcttctgtttcgtttgacttttttcttagtcaatgttttttagatttgactaagtttatagaaacaatggcaatatttaaaacactaaataagtttattaaattcaacattaaatatattttgataatatatttgttttatattgaaagtatcagtgtatttttctataaatttagtcaatttaaagatgtttgactagaataaaagtcaaacgacttacaatataaatcggagggagtacttttttttaaggacgtgactacacagctagtgatagctggtttgtctaaaccagctaccactccatctatgagagactctatccacctatacttcaaataaaattttctcttaaactactcatccgatctacgatctgattacaccgttgtgttcgtaacaactaaatctttataacaagatctcacatgattatattttgatgaaaaattataaattacttttataatatatctaaattacttttagatttcactaaattacttcttcgacatgtaaaagtaaattaaataaagcttaaaagtaatttacatatattatagaagtaacttataacaaaaagaaaagtaactttaatgcataccttttttcattggacgtgactgctggtttgtactccaatagtatgtatcttttttaatctttttaataacttatgtcttttaaatcacatattgtttttaagatatatttgcatcattgtactccactcaaaatatgtgacaaaacgatattcatattgaatatattctcattttatttaatttaaaagtaatttattacatgttagaaagtaactattacatcttatacatggttaattcttattatttattctatcaatgttatttacaatccatcaaaggttttatcttcttttctcattctacataaaaaacaaaaataaaaggaaaaaaacaatcggtgattaaacagatttatagagttacttctgaaccatgcaaaagttacttccaattaatattgaagttacttttaaaaattgttaaacttacgtgtgttgatctgtgctgactaaatttaatgtctagataaagtcatatttttatccctactatgaatttacttctaatgtcgtgacaaagttacttccgttttgttttaagatacttttataatatatgtaaattacttttagacttcattgaatttacttttattgtctaagaagtaacttagtcaaatctaaaagtaacttatatatatgataaaagtaatttacgtatataataaaagtaatttacaaatataaatattttttcatcgtcatataatcatataagatcttgttgtgaagatttaattataacgaatgcaatggtgtaatcgaattgtagatcggataaataatttgagagaaaactttatgagaaggaagaaaaagacatgcatgtctaagagtaaaaatagcatgtacgtcagcacctgtaacagtacctcttctcacaattggttcgtcgctggttaacactaaatagagaggcttctcggtttagattttgcctttttttaagtatgttttgctcaattcattttacaacaaatcaaatcttttttctaatttttgtccaagtgagaaatagctactactcctataagagatagtaacaaagaaagaaacaaaaagggcgcgcgtagcgagtgccagtggcggttgcatgtagagccgcagaccgcagtcgagatggtgtgctccgtggctgccaccgcctcgctcctcccctctcctcctcccaaacccaccgccctcgccgccgacgaccaccacgcccgcctcagggcggcggccgcgcgctccgacctgccggccgcgctggccgccttcgtcgccatgtcctccgccggggcgccacccgtcctccgcaccttcacctccctcctcaagctctgcgccgcccgcggcgacctcgccaccggccgcgccgtccacgcgcagctcgccgcccgggggatagactccgaggccctcgccgccaccgcgctggccaacatgtacgccaagtgccgccgccccgccgacgcacgcagggtgttcgaccgaatgcctgtccgggaccgcgtcgcgtggaacgcgctcgtggccggctacgcgcggaacggcctcgcccggatggccatggagatggtcgtcaggatgcaggaggaggaaggggagcggcctgactcgatcacgctcgtgtccgtgcttccggcctgcgcgaacgccagggcgcttgctgcctgccgagaggcgcacgcgttcgcgatccgttctgggctggaagagcttgttaatgtcgctacggccatccttgacgcctactgcaagtgtggggacatccgggcagcaagggtggtcttcgactggatgccaaccaagaactccgtgtcctggaatgccatgatcgatggatatgcacagaatggggattcaagggaggctctggctcttttcaataggatggtcgaggagggtgtcgatgtgacggatgtctctgtcctggcagcactgcaagcgtgtggggagcttggctgtcttgatgaagggatgcgtgtccatgaactgcttgtgcggattggcttagactccaacgtgtcagtgatgaatgcactcatcaccatgtattccaaatgcaagagagttgacctggcatctcatgtgtttgatgagttggacagaaggacgcaggtatcgtggaatgccatgatccttggatgcgcgcagaatggatgctccgaggatgcggtgaggctttttactaggatgcagttggagaatgtgaaacctgattcattcactcttgtcagtgttattccagctcttgcggatatttcagatcctctgcaggcaagatggatccatggatattctatcaggttacacctagatcaggatgtatatgttctgaccgcccttattgatatgtatgcaaaatgtggccgtgttaacatagctagaattctgttcaattctgcaagggagaggcatgttatcacatggaacgctatgatccatggttatggatcacatggttttggcaaagctgcagttgagctatttgaagagatgaagagcattggcatagtgcctaatgagacaacattcctttcagtcctctctgcatgcagtcatgctggtttggttgatgaaggacgggaatattttaccagcatgaaggaggactatgggcttgaacctgggatggagcactatggtaccatggtggatcttcttggccgagccgggaagctagatgaagcatgggctttcattcaaaagatgcctatggaccctggccttagtgtttacggtgcgatgttaggtgcttgcaagttgcacaagaatgtggagttggcagaagaatcggctcagaagatttttgagctagggccacaggagggagtgtatcatgtcctcttggcaaacatttatgcaaacgcttccatgtggaaggatgttgcaagggtgagaactgctatggagaagaatggcctccaaaaaactcctggatggagtatcattcaactcaagaatgagatccataccttctactctggaagcacaaatcaccagcaagcaaaggagatatattcaaggttggctaagttgatagaagagatcaaagcagtgggctatgtgccagacactgattcaatacatgatgtggaagatgatgtcaaagcacagctgctcaacacccacagcgagaagcttgccattgcttttgggctcattcgcacagcccctggcacaacaatccagataaagaagaacctccgagtttgtaatgactgccataatgcaaccaagctaatatctttagtgacaggacgggaaataatcatgagagatattcagcgattccaccattttaaggatggcaaatgctcatgtggagactactggtagtgaagtgttgagacagtttgaatctgcacccggagatgagggagcttcagaaagatcagagtatcagatctgacaattaggtgaaactaattggcaaagttcttaaggtaattgcttagttttatacgtggtacatgctatgcgataataggattctacatatatggttttctattgccaacgcccttgccaatgagttttaccttgttttattgtagggctgtgcagctgcctcttatatcaacactaaatggctaaacttgtgaagtatctgaaaattgttatagccacttcaccttttcaggaaacatactgcaaattccagtcagtcattgtaaaattgaaatgcttctatttacattaagatactagtgcatagggaacctgttcttcatagcaaccatgactttctcatgtcttatctttggcctgagattagattcacatgttcggtcgaactgtcaataactgaaagttatcattttcttcttaccttttgatcatggattaaaaaaccgcactgatgtaatttgttttttttcgtaaaaagcaacatcatctgctattccatttgcaataaaatgatcgcacatgcatgcttacaagtttcaacaaaataattcaacactaatatcctttatgggagaggacatgcacttgaagctcaggaaagcatcttattttgaatgcagctactgctgtaaaatgttattccagggcattattggatcagcatggatgtgatctttttccttcagttattagcacttcctgctgacattgttgacttctgtttcccgactgtagcaataaactccactgccactttgagtgcattaatagatgccaggttcatcaggcttgttgacgaccatgttggctcccctccagccaaatcaaaaactccccggaatacaatcacaggtatgccaggagatgttgttgtctgttaaaattagaatatgttctgttaattatataaatctatcttaaccttcatgattgcatgaaaaatgatgtgtaaatattggcacatatttaagtggaaaccatgagagataaaatacaaaactcatccatcaccactgctgcactctcctcatctactgttgatacaccaaattctctgaaaaggaacttcctatattctgcattgtctagaaacatatcagctgacgatccttttagcccacagactacttttggagttgttggcaagcagaaagtgtcgttacatctttcaagtgaaacctataaaaatttcacaattagtacaatttttcgggcattaatggtcaagcataagctggcatttattatgctatatctcaccttaagtccttctgcgattttgaaccatgctgaatctacaggtaaccagaaaacttctttcataggcttacccactgagtatagctcctcatttctgaatttcagagctcctagaagattctctcctccatttgggacagtaaaatctccaaagctaagttctgtatccgactcttttggtgatttgaacttctaaaataatcaaaaacaagaagtcatataaagagttagtttgaaacgtgagacagttggtactaaaatactccctccatcccaaaatatttgacaccgttgacttttttaaaaatgtttaaccgttcgttttattcaaaaaaattaagtaattattaattcttttcctatcatttgatttattgttaaatatacttttatgtatacatatagttttacacatttcacaaaagtttttgaataagacgaacggtcaaacatgtttaaaaaagtcaacggcgtcaaacatttagggaaggagggagtatgttctaattatcctgtagttgtgcttataaactgtcctctactttcactccaggctcgatgtgtgtttacctactaggctactactaaatgtgattttgatttttagtataccatagtatttaaaactaacatgcttatataagcattgctagtttaattttctctagtcagaactaaatttattaatagattagctgaatgttcattcatttgctaaagattaaaaatgagccactcatgtcctaacattatgcagcaaatggaatttttttttattgaacacatcaaagcagtcagtagaagatgtagtagagagaaggctgggtggtagactcaccaaagcattcttttaaaagtacagtagtgtatatattttgacacgatgtaactaatttaatgattcaaagcaactataatactggatttacagataatcatattccattcttttaaggggaataatcagattccagttgctttgaatctttacttctttgaggttggaaacggaatcagatcacagttggagggtaccttccatgtccaagcacttgtataagcaacaaatttggggacactgacatcgccaaatgacattgaatcattagaacttcctgctgtgccataatgaacaatgccagacacagtaaagacgtcgatgagagtctgtacagtcacagccgcatttaactggaagaacaaaggcatagtaacaatgcataagcatagcgcagtttgtattaaaatcctgcatgtaaatagcatctcacagcagtttcttttggcattacttgtgatatatgaaaatggttttctccatgtatcacaaggcagataatgtaaacgcaaataacttatgaatttaataccctgcgttgtcctgtcagtgcatatataacattgacacctctaatactcccgatgtgataccttcgtcctgaaatttgaagagttcagcattttattcttgagagtccattataagatgtaaaagaattaaggactacatgagatgttctgaatcgaaattgaatgggaatataatatatcagcggaatataaaatttcattaaacctgtaaaatgaatatttgatacaatgaaaatgtggtatattattgtattttttccttttgtgttctccttatggcaaagttttctattttatagtgcatctatcaacatgatgtgaaatcttggtttacggctttacagttcctgtacagctgtaccccgttctttgatgtgttcatccaacaataagtaaatgggacgatgtgccaaaccacattatgaaattgctaattgacaggctaaaccatcacatgttgaattcttcaggtcttgattgagcgcagatcatttaaatttgcagagcaagctggcttcatcacatatgacaaattcaggtatatctaaaacttgtattcgatgtccttaaatgttgaaactactgtccttcgggaaaaaaaatgctgaaactaccactgacttcaatagtagcattatgtatccatatgtgcatttgttctgtttttggtattttggttcacttagcagttttagcagtagttattggatgttggaaatgccaatgaaagacgccaagacttatccattcaagcatgtgggttggaaatggaaggcccagagttaccgtagaggtcaacgaaggggaggacatgccaaggtctgaagtagccggaggattcaagagcagtggcctcatcgatgtacgacatgacgagcccgatggaatggccccgccggttgaccttgtcgacctgccatctcaccctgtccattgcaggatgcactggcaaagccatggaggaggatcctgccagcaggaagagcaggagcagtggcagatggcacctcgtcaggttagagagctccatggccattgatggatgtctggagctcgattactggatcggtgtgagcttagagcagctgagtagcaagctttaaagtccaattaaggagttggtaattggtacggttgatgcagaacgtgatcagcgtgctccaatttagtataatatatatagtatatgagtacggcgatcaaagagggccgccaagtggtggtactaaactactagtaatattgagattgttggatgtgtctgtcatcagtgtcggtttttatcaaagaagcttgagctgaatgcaagagagaagaaatcaagcctgcatatgcaaagatttacctccatctccatcccaaagcattgaccatgtacagtaccagtaaaacattgccaaatctaaaggtaaggatttcagctggcccatacaagttcgctgcttttctgactataactgcggagttagcatgacaggatttggttgctcattgctttgtttacttgcagaggtcagaaggaaaagggctgcctgcaattgcaaagcaaccctcggtagttgaagtcacagcgaccgtacaacctcctgcaactgcacctctgcatcagtggtagtagactcgtcgtagatggatcatggatggattgagttgaagcagagagagccttgcctttcaacttctcaccttgccagtatgccacatggggtgaaaactgaaaagtaaaggtactaactgttgactgcggaggcgctgatttttacaactacgatgaccactacagtacatgctctgaagtctcatcaatcatgggccaatggagtgccaaatcattcttatcatatcctggaccctcttgcctgcctgattgtcgtgttcatttgctcccttgtgcacggggccccacctggcagtgacacgtacggctgcacgtcgtcgtctcatccctgtgtgtgtgtgtggacggttggcacagctgcacgtggccctctgacgagtcgctttcgtcgctagctttgctgttccagctggttaaaataaagtttacggccctgctttcggtgcaaagtaaaatggcataagtaacatatgttatttttattacttacagttacaaagttaattagtcccaggtttttcttgtgcaagctcactattagctcccattcaacgacattaaagaaaaactcactcttatgcgcaggtcatcacagcttctactcactagccagtagccagaaaaacaggaatgattaaagagaggatctgtacgtgataaaagccctcatcatgggatcaaacacctattgtcgatcataaggtaatcattatatattttactgcttgctacaatctctctctctctctctgaatctgtttacacacgctactcttgcactcttactccttgttggttgggtcaatatcagacacatggtaaaaaggtgattaggagatcacctccatcaacttgcttcttgcttggtttgttctacagcctgccccagttgcattcacagtagtgactagctacaaaagctgaaagatggcatgcacattggcagtgcttcttgttcccaatataaaagctctataagataaaagaagggagtactatgtactatatatcattcacacgcccatctggctctagtacatatcgataccttttcgtcatctagctagcttcatgtttaatgcaaatccccattcttacatgcatgttgatataggttttcaccgcacacatgtagtagatctcttgccttgtgggcattacgtacagcaaagaaatagttaactagagaaaagaaatcagaactagtgcatatatatattgagtatatatactggtactctcaggagtgatgttttatttcaccaactcacatataggaaattacctcaaaaaaaattatatatagaaactagctagctctagcctctaggtactcgatctcttgtacaatgtacacacattatacaacattaattaagctttcataaacatgttttcaaataaatgacatctctcactgcatgcattgtatgctcagtctccattcatgaaaacaagttaggactgcattcagtaaagatcatccttcatgcacaaattttcttgctttgtggggctctgaaaagctgactctaattgggaactgcacgtgcgtgatgcagcatttccttctttgttagcagtaaaagatgagcccttgcctgtcacgtttgctgcactccatgcatgaacatagctttagacaacatatgactttttcatatagagccagatcatatgctacgtactaacctactttgtctgtctcacacacacacatacagacaagactatattgtatatctatatggtagtgctggcatctcaaatagaatctctttatttctccacaatgccctttatcagaacaaggcatgtgtaagaaactagctaaaatacagtgtctctcctctttttttttaaatctttttgtgccttcacacttcacagtcttattggcttcttatctagccaagctagtcatttcgggcaaatgacactatatactactaactgggtcaagctagctatagcacaccgaaatcaatcaacttagttatgcatgcttggacttcgcggttctgatgtatcattgtgaagccttcccaatcccaagtgtgaactcaaggttcggccgacctggtaacctcaacatagatgtctctaagtccacgctcagttttgtattctgcaacaagaagctaggtaagatcaactgaaattttgtgctatatatatatctgtcacttttgtgctttttgtgatgccttcattaatacatagcacaatataattctatatgaaagaaattaaatagagtcacatacatatgggcataaaagtgggtaaaggttacatattgcttaggtattattttgttaccttgagatatcttctgtaaatttcattagctggttctctgatgggtaagcctaccttgctgcaaatagtccatcaggcaaaatagaaaatatgccagacagtagaggtgttagaatacggtctattcattggtatatgcatttagttttgcaaatatatatatccagtaaatcaaatatatattaaacgaatttgggacagttgttaactatatgcttgcaaatgatgcttaggcagtaggaaattagctttgcctaataacacattaacacaggcaggagtcattaacaaattaaagactaacaatgttagcttagctagagaaaatgaattggctagcttccatgcaaagaagtttcaatttaatttaattaatttgccgtgcttttatttatatatcccatattaatttaactcctagtttgagtttctcaaaagacaatatcgttgacttatataataatccaaacaatgtgtattttcaacagttgttcagatataccttttcccgaaacacatagacttgtctttcctagaaacgatgtgagaactaactcacgtctttagtcatagaaagatcatgcatgcatatatacggtacagttggaactctatccatgaaatcattgcatcatcatgagtttcaaaaaccttggaacacttactactgcaaaatggtccttggttcgacagagctaaaggtctagggtattgcacacgctgcatcttttcaggttgcagcgtgcagacctgatatctctctttctgtgcattgtagtactgtgctagctagtagctagtgtagctagtgtgttgctgctgacattttgaaacacattgtggtacgtgcatgcatgaaattttaatttcaatagacatgcatgcattgatggtttcatcagtagttcagagtactggcactactggctactttactactccctccgtcccataatataagggattttgagtttttgtttataatgtttgaccattcgtcttattcaatttttttttaaattattatttattttatttgtgacttactttattattcacagtactgtaagcacaacttttcgttttttatatttgtaaaaaaaaattaaataagacgagtggtcaaacgttatcagtataaactcaaaatcccttatattatgggatggagggagtactatcgagcaggatacacacttcgctaccattgttcgatcgagtaagattgaaagaagtaccctgacgagttattgctccataaaccactgtaaatattggtgtcgttctgttcagatgctagcatacttttgttttgcctcagaggaccgtcagtaaaactgtcgtcggagatatctccagccgatgcattgtcaaacccatcgttattttgtcctgaaatttaatagatgaaacatacacgcatggagggtgaaattaaaattgtactccctccgttttaaaatgtttgacaccgttgactttttaagtacgtgtttgaccattcgtcttattcaaaaaatttaagtaattatttattcttttcatatcatttgattcattgttaaatatactttcatgtacacatatagttttacatatttcacaaatttttttaataagacgaacggtcaaacatgtgctaaaaagtcaatggtgtcaaacattttaaaatggagggagtatttaaatatggatgtagaatataattctcttcagttcttatgaatctgtctggttgtaaatttccgcggctagcatgggttgggtgtggtcctatggtggagtactataatacaatacatgaattgacaatgtactggaaattaatcattgtgaagatagtacactttaaattagataagtttttatatgactgtttggctttggcatataatctactaccggccagctcgtgattaatggtcgtttgcctatataaatttctcctctgaacacatatatatagacgcatggtctgaaactctctgaaatcaaagctttaactcatcgcgagttcctcacccacccacacacatgtacaccaaataaagggaggaaaaaggaaagaataatcaagagagacaaacaaaagaaggatcgatctagcgatcgagctagtagtggtagagagcaaaaactgcacaacacacatcacctcactttggttggatgcgctagtagcttttagctttcactagtcctgtgtccaacttatttttctgaaagcgaaagatgactattttgttcagatgatcagtgcatgtttgtttgcaagctctcttcctccagccttcttttctcactctctctttctttctctcctttctcactgttacacacttacaccccacatgatatgatgcttgcattgccttcgttctccatctccttttgcaattggtccctttgcattctctgtagcattcatgcattgcagcaaaagtatcaagcaacacacatacagatatgatacagctagctggttagggcagtcctaaccctccacctaagatggtgtttatggcattaactacattgccatataggacttttaacttatgtggcactatattaattaagagagagagagagagtgaagagaggaagaaactatgtctcatgcaagacatagcttcaacacgagaacctatgcactagacactgtcaagttttgcattgggagataatagtgtcttcataatagatgaagaataaatctgattggtagagaagagagatgatgtatttattaatgatccactttaagaaaccatgggttgtagagtgtagtttctattggagaaaatcccctatgtactcataaaagttcacctaatcccttctatacccctgaattttgctcaatcccttacatacccctgaattttagtttggatcccttccatgccctttccgctagttgaccgttaaattcttttgaaaaagtccattttgccctttgctataaagaaacataataaattaatgaagtatattgttggaatgtaaaaatttattggataagactattatatttatgagtatgtgatgcaccatattatttgtgacaaatttacttttacatatgatataaaaagttgatacgtatttattagttattaaaagttcttttatgtagcatatgtgttttcatagtaatacaacagatttgtttattacttcagaacacatatgctaaaaaaaatcttttaataactaataaattagtattaattttttatgtcatatctaaaagtatatttatcgcaaataatatggtgcataactatctaataaacataatagtctcatataataaatttctatgctccaacaatatactctgttaatttatctgttaatttatatgcttctttataccaaagggcaaaatggactttttcataagaatttaacggtcaactaacggtcaactagcggaaagggcatggaagggatccaaactaaaattcaggggtatgtaagggattgagcaaaattcagggtatagaagggattaggtgaactttcaagggtacacaggggattttctctttctgctgtgatgtcttattgacatggcataatagacactacttatagacattatgggttgggactgcacttatacgttagtacagagctttgattgatcgtcatccgatccatgtcttgtcactgtactactgtagctactagtatgtaggtttgctgccctaccgcttgcttgttttctcactttaactaattgcttctaaaacgcattgaaatcgaattgatcttcttggttactggatgaacgtattatataatatgtttgagttaaatgtctctactttcaaaattttgtaagaacaatctgattcttcgtactgtaaaactggaacacgtcaatgcatacagaattagtagtacaaacttgactgaagaaatagtgtagctgaaggttttgatggcaattatatatattctgaaatgtcagatatagatattaatttgtctttttcattcagtgcctgcatgcatgtgtctccggcatttcatttcgtccaggctagcaatctactccagctaataagctagcaagatggtcagataactgactgtctggctcccactaactaattatgcatccacagtccataactgtagcacaagtactcagcaaaacactcatgttgcgcgcggtcaatgctattgctacctagtacctacaggatacttgtaattggttgggctactgagaggagaggaggaagaagagctagcagggtgaagaagaaatactatactccattagttcatttttatagtgtttgtttattttaaaatctattttcaaaacaataccgcgcttatattcacgttcgtacactcacttctaaactcatacacatacactttatctctatgagtatgcacttttaaagactggatcaacgtatcttaaaattgaagaagtcaccgtagacatgaatgtgagcatttgtgctaagtctaggaattgaacttgagtgagcaggtcccatactcccatcccaagggatcttttgagctcagtttcattctttgagaataaattttaaccatccatttgaatttatcatgacatatgtttctaatggatataaaactaatgttggttggaaatactttgaactgtgagtctgatagtgtaagttctatatactaactatactaccttaattaattattgatcaaaatcttttgagtttaactttcggaaatcaaagtacgtcatgtaaaagtaaacgtaaacggaggaagtagaataatttgacaatcaaagaagagagcccaatacaaatacaaaccaaaccggcctcataacgtgaattcacatttgggcttacctgataagcccataagtttgagaggcccatgttggtctatccggtcgaagtcggacggaataagttcactttggatccctctatttgtcggccagtctgattttcatcccttgatcgcaaaaccgggtacgataggtcccccaacttacgaaaccgtttaaataagatccctcggcagtatttgaccccggttttggccgaggtggcccctacgtggctaatttgactcggtcttcatccgacgtggcattgacgtggcgcttacgtggcaattcaatccaaaaaataataaaacctatgggacccacatgtcagtttcacacacacaataaaaaaaaatggtggggcctacgtggaccccacctgtcatcctcactacagctctctctatcccccctctctctatcctctctccttcctctcctctctatcccgctctctctctcctgagaatggcgagcggcggcgggcggcgctgaggggtggcgacggagctgacaggcggcaggcggcttgtggagtagcggcgagcagcggcacacgcgcgcgtggcgtgggcgctggcacggtggaggccccgacacacccgctcccccacccccacacacctggcgctcgcggcggccactgacgcggcggccgcaagcaccgcaccgacgtttacagcttcggatggttctcctcgagcttgtgcgcggccgcaagaaccacagcgagcacgtgagcgatggcgccggcgccggcggtagcggcggcgccgccaccggcaaagctcatcgcgtggcacacagagcgactacttcccactcatggcgctggaggggctcgaggcagggtagtacgccgagctgggcgacctgcggctggaggggaaggtggtcgccggcgaggtggagagggtgataaaggtggggctctgctgcctccatgaggaccctcagctgcggccgagcatggcgatggtggtcggcatgcttgagggcaccatggaggtgtgggagccgtgggtgcagtcactcgggttcctccggctctatggccgtcgtacaagtcgtcgtcgcagctctctccggtccaagatagattatacggttgcattgatcattttggttgatttgtaaacagagggattaatttgtgcatcgtgaggtctatacaaattttgatctgttttcccatcggcacacgaaccttatattctcggcgctgttcgcggcgtcgctggcgtacctaatgtggtggtggtgggagaagatctggtcgtcgacgctgctccacgtggtggggctcgctgagatgctcgccatcttcggcctcgtcgtcgtctcttgccgagatgctcgccatcaccgagtagtcgctccgtgcgccgcgtgacgagctgcccattgtcctgttcgaggagttggagtcgtcgccggtggcggcgccgacgccgtcgctcacgtgctcgctgcggttcttgcggccatgcacaagctcgaggagaaccatcccgaagctgtaaacgtcggtgcggttcttgcggccaccgcgccggtggccgccgcgagcgcgaggtgtgtgggggtgggggagcgggtgcttctgggcctccaccgcgccagcgccgatgccacgcgcgtgcgtgccgccgctccacaagctgcctgccgcctctcagctgcgtcgccgcccctctgcgccgcccgccgccgctcaccattctcaggggggagagagggggatagagagaagaggaaggaaagaggatagagagaggggacagagagagctgtagggaggatgacaggtggggtccatgtaggccccaccatttttttattattgtgtgtgtgaaactgacatgtgggtcccatagtttttattattttttgattgaattgccacgtaagcgccacgtcaataccacgtcggatgaagaccgagtcaaattagcaacgtaggtgccacctcagccaaaaccggggtcaaatactgccgagggaccttatttaaacggtttcgtaagttgggggacctgtcgtatccggttttgcgatcaagggacggaaatcagactgggcgacgaatagagggacccaaagtgaacttattccatgtcggaccatgaccgagagagagagtaaaaaaaaagtaacaaattgattatacttttcactcagtaaaaagaaaaaaacgacttttttttacattagtcacataagcctgcattgcaacaagatttaggaggtaagaaacgtagtttaatctgatattttcttctacaacgttttttataggtgagggtgggaggtgttttatatataagaggatatcttttaatacgtggaggttaggaccggataaaagaaaaaaaatgcttttaaagtgatacagataattctcataaaactattttaaagacttatatctacctccgtcccaaaataagtgcagccgtggatatccgtatccaacctgacttatttaaaaattttatgaaatttttttaaaaaatcagttatgtgaacttatattttatcatttaataaaaaatactaatcataaaaaagttctaataagatgaacagtaaaaaaaatttagatgtgaacaaagtaaaacatcatttattttgggacggaggtattacttagctttagatccatggagtagtttctctaaattttccacatgatcaatgtgaatacagacggagatcatacatacagtttttaaagttaagcattacccatctctaaaaacattgatagacgtgtgagaagtgacaaaagagggggcagtatttaaaatgaaatccggcaattagcagtgacagccggcgctaatcatgccgtcaagctgccctctatctgacgacccacacccaccgcctttctctcctcccccaccacgcggcggcggcagcagcagcagctagggtttagagagcagcccccaatcccatggccccgccctccgactccgacgactcggccccgatccccgccggcgccatctccaagctcctcatcgtcataggtactctcaatcctcatcccctcctgcgcttctgcttcttgttgctaatcccgttgctgttgtttggttggtttggcttcagcgatgcagacggaggcgctcccgctcgtcaacaagttccacctcgtcgaggcggaggaatccatgttagtagtgttctcccgtttctccccccttgttccttttcaccaaccatttcctatccttccatgccatgctgcacttactgctgttgggtggttataagttaaatccctggaattaggattttttttaaaaaaaaagaaaagaaaaaagaacaagttatttttgtggatggtgatgttctgctttactaggcaagtttagtggcaaccttcgtttaatctgtctcatgaaaatgtcaatgtcagctgtcctcgaaacttttggaaataattatatccaacttacagggatagtctgatacgatccgttttcactattcctgttcctgtgtccttcatacataaattaagctttaaccttgtgtcatcaccctgttttgctcatataacctgtccgatactctcagctctgaagctaactcctacctttgtggcacacgcctaacagatttcctaaaggtgccccatggattagataccatggcaactacaaaggccttcacgttgaccttgtatggcctggaaaagatcctgttctcggtaagttgtcatctataatatgctgctcaccagcttgttgtcaagaatcaagcaatattttgataggtttcttcatcatgtaattctaacaatttatccacaaactaaccttatttctttcagaagttaactgtgttggcacggtatcagcagcacttgtcacttatgcttctattcagtcattgaagccagatctgatcatcaatgctggcactgctggtgggtttaaggtaatgtttcaagatatcacatgtttgatgccatgctgtcgttttattgtacctgggttctgatgttgtttcccttctggtctttcaggccaaaggagcaagacattggagatgtctacttagcatccgatgttgcattccacgataggagaatacctatccctgtgagtgttctgttatgtcttgtagtatttttttttgtggacctagtcccatttttctgcagtgtgaccttattcagttcattgatgtgctacattattagaattcagaaagtcatacatgtcttgaacaaaacattgctagtttttatctgtttatttcataatccagtccgtttcatggttttctaattctaccttcctgcaccgtgacaactaattatttataaacttatagtctgctttactcacttgtgcttctggtgacatctgctcctttgccatttattctcaagatattatatttgcatcgccatattttctacaagttctttttagataatctatacacgtttaattgagatgttgacatggaccttcttggcttatccacaggtcttcgacatgtatggaattggaacacgaaaaacatttgctacccctaatatattgaaggaactcaatttgaaggtaagctacagagctatgctagttgatgccaaactgctggaatgaatactgtgtgagtcgtgcttacatgcatatatcttactgtctcctttagcatggtgttgtttctgaaacgaatttgtggattttattggtaaactgtagcactgtatagactcaacaagatgagtcgatcacatgctagtgttcaacattccggaagtcattgtgccttatttgcttcaggttgggaagctctcaactggcgattctctagatatgtctccccatgacgagtcagcaatattgaacaatgatgctacagtcaaggatatggaggtatctatttacttctgctcaagcattcagcttaagaacataggcacacaacagggaaatggaggtcttcaaccataggttcctcttggaagttggaatgagttcatcctttatgaactttaggacaacttttacacatcttgcattttgtgggtcgttatggcattgaagtaggcaaatgtctataggaatatatttttatccaactaattatttgctgatctcttcagtttttttgttaatgcctgagttcaagttaaatcgactagcatgaataagatactttgtgtgcactggtattcatacgaagttatctgctgctctgctttgttttcagttgtaatttgtaggctcaaactggcttcgttattcttgtttttccagggagccgcggtggcatatgttgctgacatgttttcaacaccggcaatctttgtgaaagctgtgactgatattgttgatggggagaaaccaacagccgaggagtttctgcagaacctggttgctgtgacagcagctctggacaaggcagttacagaagtggttgatttcatcagtgggaaatgcatatcggatctttgaatgatgaagcttagaaacctgttcatcaaatccaagctctgctgcttcaatgcactatactatactacatcactgctgtatgatttttcatggggatgcgtatacaatttttaggttcccctgaggccctgatcccccgtatgtacaaaattcttggcaattacttggatcaatagcgtggaattttgtagaatattctgcaaaatgtgcagtgtaatgaaactaaataaggtgatattctgtcaaactaagataagtggtgggcggtggagttattttcttaatagagcattgagaccatcttcattgtttgctctacgattggtaaactgtgaaaaaaaaaacccgaagaagcaataaacatagtttacgtgtagaccttttatgtttgtattcttagtgattaaaaaactcatgctagagaataaatacgatgctataaaattcaaacagtggtgaagaaaaaaaagaaaagaaaaacaata

SEQ ID NO: 53023 - DNA, 1632 bp, Oryza sativa
gtagaggagcaattaagcctcgtgttgtgattggttggctggttggttagttggcgcttttatcgtggtgcctgttggcatgcctgaacctgaagagtataaattgactcctggtagttttgccattggtagatacagcccttgactctgctgcctcttcagttcaggtactgccctctcctcttcctttactctgctctctttttctttatttttttaggacccttctgcagtagtactacatgtttgtccagctgctgctgctgctgctatcagtttcttgtccttgtgatacataattctggtgtgaatcttgctctctacaaattattgtgcacatgaatcttgctcttcagttcctatgttgcaaattctagcacattgcaaaaggttttcgtcatggcatgaacagaaatagttttgcagtacataattttgtcaagtttgctgaagaagctctgaaaattccttgcacattttactaggacaatcgatttccctattttgtttacaatgaatggcagattgatcttgtcagatggagctggacactgatcctaccaagctgaaggccaagcccatcatcaaaccaaaagtagaaccctgcgacgacgatgacgagttgccgccgccgccgccgccggcttcaggatccggcgaggattgggaggccaccacccctctcgccgccggcaaccccttcttcaccgccctcatcgccaagtctcatctccaccccaagttccagatggtaagcatcacggatttatcgctggtatcttctttttcgaaaagtttggacacccagaaatgatttagcaccaatgaagttaaaaaagaagcaataagatattttatcctagcacatcaaacatggtgaaattttgattaagagactcgaacctaggctgatagtgcttgccatcctagccactgcacaatgagctcatctcgacatttttttcttttcgagtgtacttcctctgtctaaaaaaaagacaacatttatgatgatttgacaacatgtccagatttattatccagatttattattttagatagtatcaaatccccacataggttatcttttatttgggatggagggagtacgtgtattaaaaagggaacacacttatggtgtgtgcatgcgtggtggtgatgaacatgcatgtgcattcttcatttaataaaaatgttacttatatcttcgactatcaatttttaaaaattattgtagtttaacatataccttattgtatcattaagattcactactagaaatactttcataatatataattcacatattgttaaactagataaatttgtaaaagtgatgtgctaagatagagcttaggacaaatgtaataattggaaatggagggagtaattaaacggttttcttttaagttaaagagtactctctccatccctaaataagtgaggttttagctatttaaagacatattaagaaatatgttaaaagactactactatgtccttaattgatatggtgagaaaacgaggatagaatactattggttcagttacttaaaaatgagaagaaaaccactctaaaaatacattcatgtaaagataaatttttagcctaaagttgcactgggtaccgag

SEQ ID NO: 53024 - DNA, 15195 bp, Oryza sativa
gcaatggctactgtagggattgtagtttgctactatatctgtttgcaggacggatccccgaacaaaaaaataattagggggactcaattacgcaatttcttcaacctccagccatttaggaacttttagtttatcatttatggtgaaaaaattgaagggggtgctctagtagtattttgggtgaaggggggacttgagtcccatgcacccacgttggatccgttcctggctgtttgttgccatatactccctccgtcctataatatagcaacataataccggataagatatttcgtagtacaatgaatctgaacattttatagttatacccaacaaaccccgatagaaacatacatccttatatggtttattaggcatctccatgcaagtgaatatattatttagttgcaacagaaccgaacaatagagtagtttgctaaaaatgtactagtgatcatcatacccagctcaacggaagttatcttaatccttgtttgcttaacaacacatcttagttaagtttgagatgtaaagcttaagaaaatgaacgaggcaaaccgaaaacaaataatctgaagatgcccctagctttgttctcaaacaaaagttgggattaagctagagaacaatgtaaaaatatctgaatgtaattatttgggtcgatggtactgtcaagtgtcaactgtcaagtactccagtataccaacttgtgagttggttaccatctggtgtactactagtaaaaccggaagatgcttttgcagaattcaaattcaaattctccgtatttttgacttgaaacttgcagcgttgacttaccgatctactaaataaataaatggatcagatcgagaaaacagagagaattaggcccagcagaaagcccaagaagcccaagagcgaaatcagcagcgcaatacgcgtagtctagtctcctctctttctttcttcttctcctccgccgacgccgtcgttttctccgcagttcgccgctgcttccactccgcctccacctccgccgccgccgctgctcctcctcctcgcgcttacagtttcctctacttccccctccttggtcttggtctgcctcctcctcgccatggacgtcaagccggtaagcgtccgtcgatccccctcccgcacttaccctttccttaaggcttaaggtttagcttctgcggtctgcggagaaggcgacgtgttgcggcgaatccggtgctgcggcgattcagatcggaatcgcggtttttttgtttttctttttgccggcgaatccggtgcccaatcggtcaaccgtctagtcatacatagcttaatcggtggtgggcaaatgattttagatttaacaagaagaggggagtgtttacgcagatctagtcatggaagatcgtctggagttaggggagagattatgggtgtagcgtagagatcatcaacacttcctactcctccctcctttcctttccttttaataagcgacctaattgatcccgtctgcatagtgactctgaattagggcaaaattaggcaggcggtttgtttgtggctctgtgcttgggattattagtctataaataagctttattacttccataaacaggctctagccgttctgcgcaagtttttcagtgctgtaagccccattttgtcattttggtcgatggtgctagtttgtaactgcacataatattatattgaccttttctggtacgctcagaaaatacatctttacatagtttaggcttcttcatgcgagtgaagtattattatttacttcattcatcattttaggctgtgaattatttatacagatgaaaatctcaagcttagacttggttagaagttggtcaagggtagccccacttgcatgctctctctataaactttcaaaagaaaaaaaacctttcttatatgtgtacagatgctgatctcagtaattgtgtgctgttgcctttgattttttttttcatataccctgttttctatatccctacatacttgattcgaaaattatagtgataatgttttattcgttacaggtgaggactgtgaaggtcaccaatgtctccctgagtgcaactgtgcaagacattaaggagttcttttcattttcaggagacattgaacatgtggagatgcaaaggttcattttttttaaaaaaaattgcaacatgtacccaaccaaggagatttgatttgccctttactagcattctcatcattttgtttgccttccattggcagtggcgatgagtggtctcaagttgcatatgtgactttcaaagatccccaaggagcagaaactgcacttcttctttcagtaagtaattgaaggacttcgtagcattgagtacacttgttgcatattctgtactccattttcgctgttccttattccttaaccttcattgaactcttgtttccttcatcgctacatgtgtatgtgtgtgaagctttgatgtctgatgtttctgattgccttgtcttgtcttaccttatcatgcttttttttaaataaaaaaaatagacttattatctcaatgaaagcaccttgttacctacaagtttggcatgcttgatgtttcctcaatacctgaagtttagcttttgttgctacttatcagttgtgaattaatacccgttttacccatttttttttgctgatgataggctcgtggtcaatcactatggaacttctagtgcatgcattgccaaaaaaaaggaagcagaagcaaaaacaatatctttagttgcatttccatttcctatagtaggatttgatgtccctgtaacaattgtttgttctgctagagcaaaagctgagatgtcgttctatttcattgaaacagggcgcaacgatagttgatctttctgtcatcatcgcacctgctccagaatatcaaccaccccctacttcatctgctcctccaatggtacacaattcctcagttttgatttaatatgctcatattttgatttttcaatatgtgacccaagtgagatgttatcatcaactgaatatggcagttttgtctgcacaataattctcacccatgttcttgattgcactggattttctgctttcttagcttaaatgaaaccttgtctcatgtgcttttacatattccattttcataaccataagtgcaatctataatttcaaattataggtgcaaatataatttagagtagctcccggtgctaacatgggcatatttgcaacattctgttgatcttatggaatatgaatagcttgaattgaatattgtgttctgttctcagtatagtgcaaccagtgtccctgtcagtgaagacaacaatgttgtccataaggctgaggatgttgtcagcaccatgcttgctaaggggttcaccctggggaaagatgccgttggcaaggcaaaagcttttgatgagaagcatgggttcacatccactgctggcgccaaggtggcctccattgacaggaagattggtcttagcgagaagttcactattggtacttccatagtgaacgagaaggtcaaggagatggatcagaagttccaggtgtcggacaagaccaagtctgcattcgctgctgctgaacagaaggtgagcactgctggatctgctatcatgaagaataggtatgtcttcaccggggcttcgtgggtcaccaacgcattcaacaaagttgccaaggctgccactgatgttggtacaatgacaaaggagaagatggcagctgaagaccagcataagggctcgggtccttctggagggcactcgtacacacccatccagtgatgactccacgctctctcatgtgccgcattgtgttgtattgatggatgtaaaacatagatatagaacagaaaaagtcccctcctggcataccacatacttctatcagtgaacttttcgcattgcaggaattttgtttccagtagaataggaaatatgatggtgatcacaatgtattccgctggtttataaggcgtatgttcaaactgtttctggttgtagtaacttgcatgaaccttggcaaaagttgtggaaagctcctttaataatgtcatgttgatgttggttcatggttttgtatgtgattaccgtgtccattgaaaacatattatggcttgctcagtcataatctgcagttgtttgaccgtacaagaaatgtcccaattttatggggtgcaatcgattgtcagcaacaaagtcgttgtagtatagtggtgagtattcccgcctgtcacgcgggtgacccgggttcgatccccggcaacggcgatttcactatttttttgccagtttcactttttttttgtattcttgttgatattctaaagcttttgtttgtattgttttgttacttcttccgtttgttacttcttcctttcattctactcttgtcggtgctttttcagatactacttttttaatcttttggtattcttgttcatactcttcactctaaagcttttgtttatgttttctaatacttcttcctttcattctgctcctaatgaattagctctatgtttttttatacttcttcctttcattccattcctgttcattctaaatcctttatgtattctgattctacttcctttcattctacccttaaaaaaacgctccatgtttcttgatacttcttccttcacattgcttctttcttattatgggtcatcttagcagattcatgagatcttaaatatccatagagcatccaaaaaggtgggcattcacttgttataaaataatatcaagctacaagtgacatgtacagtatgttatatattgatgtatatattgctatattattggtgtggtgacaggaagagtaacttgccactccatctggtccaccactctaatgcatgtgtcaagtgtcaacttaatctcaagctcaagctgaataaactgagaggctgaagctgaagcctcccttgccaagctacacaaaatgccatcatgtctcaagctacaattagcctggcttgtcccttccaaattagcatcatgcatgtccttgatgcggacaagcctcttgtttcttgcgctggcttcttcctcaatcaactacctttatctactactagctccatgtatgtactatagtccactgtactcttctgcttctactaactgcacacacaagattaaattaatccaacaatcaagtgcagaactgaccctaattaatccttctgtgcttgcttaagctcagcactggctggagtactttttatttttgtgccccaataggagtcaagcactgttgctagtcatccatgatgtgtgtatgctgccccttttttctttggctttctgatgcttctcaactatgcctttgaccaaggaaggattcatctacctaaaaaaaaatgaagctgccgcttgctaaattggttacatctccatgaatgtagccatctgggacagtgtaatgatatcaagggatcaagaatctcaagccacatttttcattggctgcatttcagttgataattttaacttcttgttaaactcctattaatccctcttgtgacttgtggataacggttttctttttctcctcctctgtgtcgtgtacaggtgcttgtgctgaggcacttgcgtaaatataattaattaaaatgacaaaatgcttgctatagtattattctctaggtatatatattccagaaactcccatttgtgtggatgtcaagataaaagaacaggtgaagtgagatcctcctttttaattttaagtgaaaaacaagaacactatttcctttggtgagattcaggcagcactgcatttatatggtactatttagagaattaaaatggatatgcaatctcatggtgtacatgttcttgttgcaattgatacttttggcatgttgattttgtacggattaaacaggtgcctcactaaagcacttcatccagtaccatttctttatgtccagaaagcaactataaactactggattccatccctaagcatcaatcctgtggtcacaagtacatgaactaggatctgacaaggacaatcacaggacaaaagaaatagtactaactacaaatgattcagttcatcagttggttataatccaaattatagatgcaacttgcatactagtaccgtattattttagcatctcggaatctgtgccgagagcatttcagtttcacattgctattggctggttttggatatatggtacagtagcttgtgcttgttttgaggttcagacactgacacacagattcagggttgaagcattctctgaaacaattaagaattgaagatttggagtccttccagttttatctgtaaccaactcttgatacctatagtacaggcatgctctgaaacgaaatggttcatcaattgtgcctaaaaaaagaagaaagaaacatcggttcatcaagaatggtctgtcaatctcagcagcactgttttgtttgatctacacgcacaagcatcaagttgacttttggcaggcattggaagtgagttgtacactgaaattgcgctagttaacccatccattcggagaaaatttcaggccggcttgatttgcctgaccacaaaggcaaatgttgtgtcagttgccacagacagatcacctgcttcttaattatttctagaaccgttgtgagatgatggcaaattagcaatgaacaatccaattccaaacctcgtatggaaaattaatattcttttgcaaattgatctgaatgaatatatagaccaggcccctggtttcagtaaggtaaagtcaactcgtgcatgcatgtatgcagcacggcccggctgccccggcatcccctaacaactcagtttaattagttttaagcacaaaattgtgaacaatagttaagttctttttgcacattttcaggtaaagcagttgtcggtttattacacaataccatgacaccatggagaccacacatgcactgcaagttgaaaaatctgaagatagaatgaacaaaatatgttcaaagccacaactgttcttgttttctatggcgagaaaactaaaaactgttcgatcttataatttataagtacaacatgccatgatcttttttatttatgtcgatgcatcaaagatttaccatatccaattatatatactgagatattaattattaccggcaacctgagacaattgcatgaatatttttactggcatatgacatctgatcgatcagcaagttttttttttcctttttcacgatatgtaactgatgatgtcacaggaagaagagatcaaggaccggagcagcgaactcagtctcgaaacggtcttagttgactcatacaaatttatcaaatatcatattcatttctagtttaatttctacacgtctgcattgcaacagtgtaccgttgaatcaacgctaacacccagcattttttaattaattaatgctagctacgtaccaagatcgatcgatcaatgcattaaggcatcaagtagaataagaagtgcgtactatttgggattaattaacatgtaatatgcgtggagatacacgtgaaggggtagataactaaaatcaacttagaagcttaaacacacaaaggctcaccaaattataacaactaacagtgaccttcggagtggaattagatcacgtaaagatctggtcctatttctttatcagattctgtttactaactactcgtatatttatatagtgggatgcagtctctattgcttattgcatgtaaattaatcatggccctgttgagccagatcagccgtaattcaagtcatcataccaaggaaggacgtacatgcatgaccatcatcatattcattcattcatatatattctatgttaagggtgcacatatactaattaggttaagaccctgcatcctaatcctggctaaaagatccccatggctgtgcagctgtttgaggaatcctcttgagtttctgttcatttgacttaaaccgtttggatccctgttttgttttcatatataagtaaccacatcttgcaccaactagctatttgattagtctctgcaagatgaaacattgaagctagccttaatattattgtggccaacgagaataatggtaaccgtagaagcatttggtttttatagattttttggataatggatggaatccggagtatatatatacatatgtaaaggtttcacgaatacttatattccaggtcttataactaataaacaacaaaaaaaattaaaaaagaaaacaaaaaatactagaatactcagttttggttttctgctgcctgatgagccttgttgtaccaaaaacgtatcgaataaatattgaaatgtagtcaaaactcctataccctcatcctctttcacccacctctctctggtttgttcgcaaacctacccctactattggacagatccatttgatctagatccgaaaactcccagcacttacttccttcgcttgctgacatcatcgagtggaggcaaagaagtgaagaactagtgcatttgctctcagatgccatccagcggaggtagagaagaagaaaactctttggtgcattgagttcgggcacaaacacggaaacaccttggatccatggcacttagaccctagatctagggttgtctgttgctgtcattgctaaccagcctactaccacgctgctgatattgctcctcactatagccgccctgcatactgatcaccactggcaccactaacaagcccgtcgtctttttgtttttctcactgcatccgccttttgtcagggcactggatctgaccattaggccgaagctatccaccctggatgtcgctgataccgcctacaataccatctttgttctaggttgtcgttgccaagagaacgttacatatgcacacccttttgtttagaagcattttatatctccaatcttcatgttattctctccccctaaagctcatatgcgcctttttttttttcttatttcctttttcttttgttaatcatcatcttggggcatttcagtttctgctttgttagttttgagaacatataccagaagtatgtagactggttgcacccactctggtctctaccttaatattccaaataaataacacatcttagtctttttccctatactagaaaagatgtccgtgcgttgcaacagttgaatgctatgttaatcttattattgttatacggtttggctagggtgaaattcactgtaggaatccgcttggattttttttctaaagaattatgagctgcaattaggagtccgacattcatctcaagttagcatgcaagtttttttaaagagatatattatacgactccttttgtatttctaaaagcaaatgaacttaaaattcgactcaaacatggatctatattttcaaaagcaaacgaatttaaaaatcgactcaaacacggatgacgtacgaaaataccggcaaaaaaaatatacagtttagttaagatgaaattcactgtgagaatttgcttagatatatatttttttctagaaaatcatgagttgcaattaggagtccgatcatctcaagttagcatgtaagttttttttgaaagagatttcttatacgactcctgtatttccaaaagcgaatgaacttaaaaaccgactcaaacacggatgacgtaccaaagtataccggcaaaaatatctttaatttttataatagtatagatatagatatgtacttttggttatgattttggggaaaaaaaatcaggaattgaattcccaacgatatatagcttaggccataatatatatagtaagacacctcaacataggaattattaggacacctagaatatgatatacaaaattagcaagtagttctatcgcatttctgacattgttgcttccattggtacgcattaatgatgaactgaaaatgagtgtttcattaataaacatatggcagtacatgatgtccttattggatttcttaccagaatggattactcttcagttgagcgcgagactatcaaagatctctttcatttcaaaaggactatcaaatctctcgtacaaataatagagaaggattataaataaacaaataacaagagaaatctgacggaatgttttgcctgcagtagtattcatgtattgcctgcagtagagacaaccactggtactgtatcttgtacgtcctctgaccatactccaatttaatttgtatgtactgatcactgctactatctttgtatcataatataagggattttgctcatgttgcatttagttatatgcctataatctcttatattataggacattggtagtattaattaatttgtaagacatgttaaaaccgatcagaaaactaaagcaatcttttggttcaaattttttttcttccagtagtgctaatgtaactgtgaataatgctttgaatttggcagttaaaaatagaaatttgcgtccatgccggattggtgtagtactgtgcttcaaatataaaatcacactaaaataatacattctcgtctcaattatacgagcaatagcaagacaaccatttcttgtcttttttccctagtagctagatgtctatctagatttttgtttttagatgatgagatgtcaagctagatactactcatatatctgaattctactgtgacatgcttgccaattcatccatgcattagctagattacttgcacactctaccaaaattaaaacacaatttcttcctgccatgtctactcacattatttaaaaggaaatatgctctcaattatttgcgtgaaaagataataaaagtactacaaaatacaaatactaaaggtgctctgtacgtacaaaagcaaactgatgtactgcttacttctgaacattactctgtgagtgtgtgtctagccgcaagtttttagtgaagattgtattaattgtagcaagttaaaatcagaatttcattgttaattagctggtatttgcaccaaataataatatagtctggttaaaccagagatgcaattttaaaaagaaggtagttgaaggggaagactaaccaaataggctgcttaatgctgcaacactaagggagattagtacagatgaacatagtttaatttcacactctggacagtgatagtgattgtcctgacgacgatgctgatacgaaagatctattgacatatgtacatatactattcaagaataattcgcattatatatatggtagctagtctgcatgattagttattgatacagattgaaacctgcagactacggtacaacagggcctgaaacttgtactgcaataactagatttgtaaccagcagctgcagaaagggttgtctgattaatcacttcactaaactttatgggaaggataaattggcagatgggaatatatggctatggccgtgtctagttccacagtcaaatttttttaaaagtatacggacacacatttgaagtattaaacctaaactaataacaaaataaattacagattccgcctgtaaactgcgagacgaatttattaagtctaattaattcattattaacaaatatttactgtagcactacattgtcaaatcattggcgtaattaggctcaaaagattcgtctcgcaatttacatgcaaattgtgcaattggtttttttgtccacattttaatgctccatatatgtgtccaaacatttgacgtgatagaattttcggaagtttgggaactaaacacagcctatatatgtgcagtagaccaagtgaaaaatgcattctgttcagatgttctcttcctttgtagtttcaaactttcaaaaatgcattgactaccacttctgaaactattcatcctttaatttagggacctcaaagagaaagagagagtaataattacactcgtatagtgcataaacttacatggggtgagtgaaacaatttgcaaaatgtgtttccccccttttctattttggcagagtgcatgttttagtagaacaacttaattatttagtctgtgtaaattagggctaaaattggccacacaaattaatgaactgagactattttgattggaacactcatcattccaatttataattaagttgtctaatctgggcaatttacaatccattgtgtcttggccttatatatatatttccttcatgtgggtagaaggagtactggggacagcagaggcaagctcagtgtaaggtggtcttgcaagccaacctggcatcctagctagtcagtatagaaaatcaataatttgcctcggagacatattttggccttgtttttcactgactaattacaccggaataagaattttgcatgtttttaaacgtattttcacccactgtgcaagttcaattcatacaacgtatttgtcagtatttgtcaagaatgacattagcagttatggcagaatctctcagcttggaattgaagcttccgatgaggtgtttgtacgcacggctcaaacttcagtttgcaaatttaccacagcaactcgatctcttcatgtcaaagaaggtagttgtgcgtttggtaaatgattaactgatgaccgtgtgcattgcatctcaaattaaagtcgctttggtttcttcgatcagtaccaaataagaaataaaaaactgggggaataaagaaaacaagctagtatttgatatagacagaagaagactcagacagatcgagtattattgttcatgtgcagaaattaaaaccatcagaagagtacgtgtagccatgcatacacctacctgcaaacatgcatctaactgctggactccgtgcagagaacacgaatcaaatcactttcctgcaacctatgtgtcctgcaatctctaaaccaatacatgcttgcaatttacatagtaatcaatctgtactgttatcatgtgtccatgtcaaagggtctaacattaattccaattgcacaactaattttctggtatacagttaaacaaatagtgtgcaggtacactttggtcccccttaatactatacaaaaatgcccagctagctagctgtatacgtatacacatttaagctagctgcccttaatacctaatgattcataatgtatagccttttatttcttttgtccaaatagaacactaaacaattcaagaaatgataaagggacccacacatctcctatgaaggtttctgtgtgctgaaaccacgctgtttcatctcccagctagctaggtcttctgatgatatgaatatgaatcatttggacgtggaaaccgcagataattcagcacttgacctttgttttattcttaattacgcatgcaccctgtctaatcatctttgacaggattccagtgtaaattatctgataggtgaatatcagatagctaagcatatatatgcatgttccacaaagttcagagagtttgcacgcgtcatgggtgcaaatattgcctattggccataaaggatgcatggaatcaagggatatcccaacatatagtgcatatataattaagttttaagatcgacattctcatcccaggcaacttcaattcgtctttaatcttgcaaactaattaacacacaatatacaaatttgtgttctcgaaggtacttcccataaagatcaattatacatggaaacgacacatatgactcctcacaaaatggatcaacatctgagcaatatagtgtaagtttcaaaagtcaatttgccttgtgttgtggatatgccattgtattgctaactgtaatgctcatgatctcccacaacagagcgcaaatggtgctaagtcaaccattcatgtgtatgtactatatatgtatatatagttactagctagtatacatatattcttttttgggaaaattggaactatgccattataattttgcaaaattttagatatgccatcctgacccacatgtcattgactcatgtgggtcctacatgtcattgagataccgatggtatatctcaaactttgcaaaattataatggcatatttctaaattcttttttagataatggatgaaactaatacactcatatactattaagttcgtttattagcatatgcgattataagttttaaggtcgatcaattatttttttcattaagtataaattgatgaattaattagttttctttagttcatctacttgcattctaaagcatcatctttgtgagagcaaattaactgaggttgcactatatttaattatttcccatgcatattcaaattaaattatatattcgcgaaaacaaatatcacaataaaatcaatattccatacaaaatggatcaacatataattagcttgagctaaaaaaatcagaattcattttactatatgtttgtggtgaatgctcctatatataatatataatgccaataattaatattgggtagaatttgtcactcccatcccatgcatacgcatatatatagctacgcatgcgtgcatgcagttttcacattttggtccttttaaaaaacttatttcgcaaatagacccctaaaaaaactaatcccagaaatggtcctttttagggcgccagagtggctggcgctgtcatccaatgggacggcgccagcctctctggcgccgtcctcctgccaccgtggcgcacgcgaaccgacgtggcaggaggagggcgacagcatggctggccccgccgcctccattcctgtccattcctgtttctctgtatggagttgcaacggtgtcatttttttttattttttcggatgttttttcacactcaggatcacgatacaaccaaccacaaaaaaaatttaaactcgaactaccacttagctaagtctgaaaatatctagcataccacttagtctactttgcaccttcactaaaattagactataactcttttagtaaaaccctttgatcagcatgttaaacataatgcactctaccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactcaaacggacaaaatatgtgacatgtagaattttccaaaactctaccgaaatggacaaaatatgtcatctattaaaataggcataactttctcatacggactcggaatcaggcaaataatatatgcacggacatctacagaaaa

SEQ ID NO: 53025 - DNA, 8110 bp, Oryza sativa
cctcaacatcgcccagccacgtcggcagggggacggcgccaaagaggctggcgccgtcctgttgaacaacggcgccagccactctggcgccccaaaaaggaccatttttgggataagtttttctaggggtctacttgcgaaatatgttttttaaaaggaccaaaatgtgaaaaatccagtagtaggtagctagtacacatataataatgcaattaagtttcgttaattatgtcatcattgctttacaaggaaagaccagtttagagcaatggcaagaacaaaagctatatatgcacatgaattccacatctgtagctagttgggtgggccccaacccctaacgaccatagctatagcttcttgttattgatgcaaatatatatatatatatatatatatatgtaccaaattaagtgagaggtttaccaactgcttaattgtattttgatcgtgtcatgcatgtgtgcgtgtgaaacaagggatctagctatcatatccattccatcaatcgagcaggtatagtagttccttccttcttcctggatactctagctagcttgcttaatttgctccttgattatttgttgttagatcatggcaattaacaggacacacgtgtcagaccacacgaacctaattctcctctgcctcctcaacacgtgccgtccacgcactggatctacacttcatcccatatttacatgtgtgtcatgtcaatattacctaattaaacacgcatgccctgcaggtataccggccgacatattaatgcttttgcttttgcgaaaacctacatattaatttgtacacgtaaataccaacgtatcattgtcaatagttactacgatactccctccgtcaaaaaaaatatatatttttacctatggacttcttaaagtatctgcaacgttaattctgaggaaaaatatatagtgtaaaccatatatataatgaaaaccaaaactaccgttaaataaaaaaatgaatatttgtgatttatctatgtcactaagaataaaaattctactcacagattcagtcatgagaaaaatttgctgggggtagaaattttgctttcgataacatggataaatatcacacgtccattttttaatctaataatagtttttatttttttttacgtacgtggtttatactatatatgtccctagttttagagaaggtcctaattaaggggagaaaaagggatagagcccaccctaaacactgcagctgttttttcaactgtcctcaacatagagaccggtaccagccatagtgcttgatccttaattaattaaggagagagagtattttgactatttgtcatccttcacaactttctttttttaacagcagtggatcacacccatatatatatcacctctgagagtttttatacactacaaagcttttcacaaggtgcatgctatcttcaccgtgggccccacttatgggaccttgttatgaaataaacattacacatgctcctcttagtattgggtttattaattattttcttctcgttttagtcattcaaccattagtacgcacttctctttatttttctcccctattcattttctctatgcattaatgatttagtaagaacaaatacacttacatatagatagatactccctaaataaattcacttttatgcgtgaatctcgacatatagcccatacttttatatgataatttagacatataggtgaacttacttttggggggatgtagcaattaatagaattaatatagtatgcacaccacaggtggtatatagtatattaataaagtatcattaaaaaaagaaaagaaaagaatggtgtcctttagtttgttctctcttgctaattaagtttcctggctggataattaagttgtcaagcgtacgtgtcaacgcactatattgtgtacgtaacatgacgtccaaatcatgcatgaacttacttgatcagagaggtgtttttcttgtatttttccaagtaacacgtcgccctcgtagacgcacacacagtagaaaatattactatcacatcgatgtactagtatatatgtatgctaatgtgctggcctttttcacatctatctttgtacagtatctaccatgcatgtctttatacgtagaaatatatataccattatcaccatcatccttgcatgcatccacggtacgttaataaaatcgtacgtagggcaaagttatataaggagtatatacgtacagaagtacgtatatatatatatatatatatatatatatatatatatatatatatacactgatccttatatatactagtagtaatatatatcaattcgtatgctatagtattgtgagcttatattaatataattgtgcatgagaaaaataatgtaattggggggatcctaaataaaaccccacttgcattgggccatatatgtatatgttcaaaagtcccaaataatttaaggtacagaaagtacggaggaaagaaaaacaggacacaataagcacacgacacccagagcaaatgcatatcgatctaaccttagctacctacattgacaacatgcttaagcaagctggcccctgctctctgctgctttccgttggttcgttggttgcatgagctaatggctaatcacgatggacgtaagtctttggactaattgaagtcccaaagtgagaaatcaattagtgccaggcataagagtcagagctagagacagaaaggaaggatgtttgcttgcttgagcccacaattaatctcacttagcttagctagctagctgactcgatatgatcgatcatgcatgcatgctaatgctatggtctttgtgtacttgtctagtttatttatcacttaaattaattagccccgttaaataatattagggctctctcttcctcttctcctataaaaccacccccaccatagccgtccatctaacctatcatccaaattaaacatactcttgtggccatcgtctagcttagctagcttcttcctcctagctcagctaacgaacgaggagtagtagctaggaagagagatcgagatggggagatcaccgtgttgtgagcaggacgccgacgtgaagaaagggccatggacgccggaggaagacaagcttctggtggagtacatcggcaagaacggccatggcagctggcggcgcctcccgaagctcgccggactcaaccgctgcggcaagagctgccgcctccggtggaccaactacctccgccctgacatcaagcgcggcggcttctccgacgacgaggagcgcctcatcatccacctccacgccaccctcggcaacaagtaaccactagcctcttcttcttcttcgtctacctctagctagctagctcatacatatgctaattaagggagttgctttcgtgttcgtgcagatggtcgtccatcgcgacgaagctcaaggggaggacggacaacgagatcaagaactactggaacacgcacctccgcaagaagcttctcagccaggggatagaccccgtcacgcaccgcccgcgcaccgacctcctcgccggcctccccaacctcctggccgccgccaatctcggcggcgccgcccaccagctgcccttggacttgaacgccatcaagctccaggccgacgccgccaagttccagattctgcagggcctcctccgcgtgctcgcctccaccaccgccccgccgcccaccgccgctgtgctacctggcacagacctcatgacgtccatcctcggcgccaccctcgccgccaactccgccggcatactcggacagcagcagcagctcgccggcgttgacctcagccgcctcggccagtacaacggcaactacgacaacctgccgccgttgaccaacgacagctgcacgcagcagacgcagccggccatgtcgagcatgtcccccgacagcctactcaacagaatttccagcggtatttccggggacatgctgggctcgccggagctttgccacggcggggacgggcttagctcgccggagctcggccagggcggcccgagcgcaagcaacatgacgacctcaccgatggcgccgccgccgccaatggtagctgcagatgatcatcagtgcaatactaacacccccagcggcggcggcgacggcatgtcgtgtgagcagacgccggcgtcgagcacgttcgacgggctgaacctggacgacatcgacatggaaggttgttgggcgatgacggacatattgctagcagagtgagtagctactctcatcaactttctaattaattaaaaaagtaattttatatcgagttcaattgttatccaaaaatcttttttttaaaaaaaaaaatctttccaataattcctctctgatatatagttcaccagactggtcgaggtggaacaataatgtcaggacaatatataagattctaatacatgatctaatatatactatatatattagtttagaaattcagtactactgtatgtagctagcttaggtgcccctgatcttcttttaaaaccctgcatgcagtttattgccaaattaaacagattaatggttactacttatatatacttatctcacatgatactaatttgatgcaggcaatgcccatcatggttgatcagcagcaacaacgcaagtgagatgtatatttcaaaaaacaacacaagtgagatgtgaagaactagataattaaagggatactaaatggagataatatgaacccaaaaaaaaaagaagaagagaactattggatcggttgatgtcaagtttatttgtttgttcacatcagaaaaggtggtttggtccacttttagttatgtagaaagaacacaaagaacatgcatggaacactcgatcagtagtgtttttttgtttgtttagttttatcgtttcttttttacccctttacaaggaggaaaaaatatatgtaatgattagatagctgggacatgaaattaagacattaattttcccatttttatgtccaagtgtgacttctgttcagatatgtacttgttgacacaccatttactactaatatcgtgtgtgactaagctaaattttggtcgtcacggtattgaaataattgctcgatctcggaataattaagctaggtatgcgttgtcagaacaaaaataaacaatatataaattgcttctccaacagatatctaaaactgttattgttgatgtggtcgctagcttccttttggaccatttcaaaatcccaatccctagatacacttgaaacaaaatcaatcaaatgactatatgtacatatatatatatatatatatatatatatatatatatatatatatatatatatatattttacgatttcgtacggctataatatataatccatatatagtctcaagtttactctagttaatatagtatatacgaaaccagttttaagcagaacagtaattaagccggccgttcatccccgcaaaaaaaaaagtaattaagccgttcattttcacagcaggacttcgacagagaacaatcttcttttcttttcgggcacagtattatatatgtataccctctaattaaattgccaggggatttaatatatatcattgtctagaataaatgataaaaaaaaagaaactaaaaaaagcaacggacgtatacatcagcacgcatggcccctgcatgcatatgcagcttccctagctagctttagcccgtgtctttccgaaacgaggttaattactggttagacacatcatatcactaaccagggcggttattagatgcatcagataacatgcaaacggtatatgacttaaaaagatttagttagttggagatggagagggatgggtagcttgtgaaagtagaaaaggttaatcaccggccggcccctatgttctagaactctctccacaagaatgaacctacatatattaatcagttcttaatatattggtcagtatatatagcacagtcaaataatcaagggaagttttaacacttaagctagccccgtagttaataataatgaaagtcaaatctagcaaatcctaattaatgtgtatagcataaatgcacatatatatatatttccatgtatccgatatgtgtttgggctgtttcagcagatcttgtttgcttcattgcttgtgcatgtattgttagattcgttagaaatcggatgtggaaatatcattagctacttgagtgtacttgtagttaaaatggctcctagttgtgccttttgctttccataaaaaataaatatattatttttctctggtcctgaaacacaagtcagacaattagttagccagtaggtatacctcatttcccgacaccacaagccattgactatcccacctttgcgcttgcctatgcttcatctctctcatctgctggctgcagacctctcttctcgatcaaaagctttaattattattagcatcatcctttagcagccctaactatatgtatatatatgcctgtcaaatccattttatgcatggtcataggttattacaagcttatcatctgaatttgacagagttgttgagttggaaggttttgatcgagctcattattttccacctcctgacgcagctagtaatcaaacaactaatttgctcggtgaaattattttttatgcatacaatgtaaattttgcacgttgttacaaattaattgaaacatacggccaccatttataattctattgccttaattaaatgggctatatatacgttttattgtttttatacatttagttatatctggtgtacccggaaattttcgtatatatcgctttctgatcatgcaggttttgtcatgtccatgttggggcaaagcatagacagcctatggataattgttgaacaggaagaacctactcttctctttctctctcttcctttgcacacgtttataaaggcattaatatatagctcaggtttggcggcttcagaaagcattctacagtgactttcatgtagggactagtacagtttgctgtgcaacagaattgatgtgcaagagagaacaaattaatgtacagggatcgatcagaaaggcacatgtcttggtagtacagtagcagtattttctgcacgaactggtctaacaagcggagcattcaatagcaacatggttagaaatcgaatgcagatgttatgcatcgatcattgctgtacgtaaaacttttattaagatatcctaaactgtatgcatcaggtaaatataattaacgtgtacagatcgaaaaagtaaattaagttacagaggtagcttctaccacctgaaaataatcctctcaatcgttggcatgcgatctacgcaacccagtccacagtatggtgacatacacagatttacctaaccgatgaaaaaggaatataaaatatgcatgcgatggctgcagagcatggtcaacttcacatattgactaccaatgtgtcaaacctagactttcttatgcataaagtgtgaataatttaaaacttttagaaaatttcctgaaattgtgctgcttttgaaatgttgaagaagggagacttcgagttgctatttgttaggaaatagtgcattgtgacataggctaatcaaccatacaggatacgctttgaacaaccatcattagctgtctatcaaattaagtatatatgacttgctcggtgttctcaaaagtttccaaatggtatgggttgcatttgtcactgcagattctgaaactttttgtttcacacaaactgacaagaacataattattagtttaatggaataagtaaacaacttttctttggctctacatacctgaaagaaattagtgtagagtcggttttgaatcattgagctcccgttacctgagtgccaccgtccaccaatagtccaatataatcttagtcgtaagtattcagtctactgagtaagtttgcaacagtggcctcttattccactcctgcattaaaccaccgaggagaatattactgtccaaagaaactttttttcttcttcttgtcggattagcatgcaagaaaacgtgcatattatagtttggttgtgctgaatactgtccataagcacacgatatgattaacaagtcaagaacatatcatttgacctagatat

SEQ ID NO: 53026 - DNA, 909 bp, Oryza sativa
atatatatatatatatatatatatatatatatatatatatatatatatatatatatatatatacacatccgttaaaattccccagctacatgaagtagtttctattttgtcattttcacaatctgcaactgctcgcttggaatgatacataagcaaaatctaccaaggaaggcaaggcaaggcacagcctttccatgaaactaacctctcaatggcgacatcttcaccggttacctgaaaaatggattaatccacaaactattaagacatcataaagtttgactttaatgtagctagctatagctcctatttgtcatgcaattaattgtaatgcgcaggagtgctcaagaggataacaaagtggcagtataatcacaaagcaaaaaagccttgtcccacaagggatgacaagatattagtaggtaaaccatggacctagaatggaacaaccacgtacctaccttccgcaagaataatcctgtggtccaaccgatgcttgctctgcctcactctcaacctcgttgcatcatcaatgaaggcaagggagaaatgatacatttctgaaagtgctctgctttattgatccaatgatagatgaaagtacaagttatcatctataacacagttctataattgtaagcctagtagtacatcataattcataagtaccaaggttgaagaagtaccctttcttgaatcattgtgcatgttaatttgttgaaacttggttgttccctgtagtttcgtacacatgattagtcttggaaaaaacatgatcagagtcagttgctccgtaaaattcctttagaagtacacaaatcattaagcacaagtgttatctgttatttggtgcagataaacccttcatattctcatttcttcacaataataaggtcatatttcttctag

SEQ ID NO: 53027 - DNA, 1070 bp, Oryza sativa
caattactgatcattggacacctctcactgccatgctcctgtacttgtttcctgatgctaatttagccatttcagggagtcctcaacgtaagggtggtcaatgaaactaattttagaaagggattatctgttaattaaaacagaactcttcaatcgttgaactgtgtcataatgtgtttctaaataaccagaaaaacaaaagggtatcttcacaattgattggtacctagcaatttattacaattctgattcccatcttttagcaaagactagcaaattgcatgtgcactgcaacagcaaaaaataagtcatgttgtgcacactcattctttgaagaatctgcaaactggccctttccaattccttttaactatacggattacttccctacatacttatcaggtcttaccaaacaaatattaacatcattttgcttagacatgcttcttgtgggggccgtttgaatttagtgagcacgtatgtttcaccgaggaggaggccccatatgtcagcgatataggtggtggtggcagattcacttccgccaccactactaccttttaaagtagtgtagaatacaggtagtggagtgatttttttttcttacagacatctggtgctcttctttggaaatatgaagttggagaccctattaccgcatctgcttttgtcgatgaagtgttaacagcaacctcacctggagcatctgaaaggtatttcatatattgataacatagttacgcagtgatcatgtatcaagaaaatgaccacaccttttcttatatatagattcgcttgtatctgcacgagttcgggacaggtccatgtcattaggattagagctgatgctaaggaagagaaagttaatggaagtatttgtaatgacttggtgcaaggatttgctgcaatagatcttcctggggacatcttctcatcgcccttgatggttggtggacgcatctttgttggatgcagagatgatcaactacactgtctcacaatcagctcatagcttcaagccgaataattggagggcagatagtttgcttcgcattgctgtaccgagagct

SEQ ID NO: 53028 - DNA, 1202 bp, Oryza sativa
aaacggttttcttttaagttaaagagtactctctccatccctaaataagtgagggtttagctatttaaagacatattaagaaatatgttaaaagactactactatgtccttaattgatatggcgagaaaacgaggatagaatactattggttcagttacttaaaaatgagaagaaaaccactctaaaaatacattcatgtgaagataaatttttagcctaaaggtgcacttgtttaatttactcctaataatcatcattatgtggataagtatatcatcatgcataaataaatatatatatatatgtctgcgcggaattgatttgattatttaatttgggcgcgcgcgcgcactaatattatttatatgcagaggattccacctcgggtccagcatcggctggcggagccggaggcgcgcacggaggcggtgctccactccggcggcaagttgtgggcgacgagctactgcggccaccttaaagataaaaaactggacgcgggatggtcggagttcgcggtggacaaccggctcctggtcggggacgcctgcgttttcgagctcgtcgccatgggcgccgccggaggtctggagttccaggtgcagatactccgcggcggcctgccggcggaggtcgtcacctccaagggcctcacctccgaccaacccatcctcatcgtcgactagcttagctatcgatctagccacagtactaaatcatcaaactccactattaattccactgtcactagctcgatcggtaattaaaggcaaggagctttaatttggtgtcaagcaaaaatttatccaaccaacttatgtatgatgtactgcagcagctgcaatggctactgtagggattgtagtttgctactatatctgtttgcaggacggatccaggaacaaaaaaataattagggggactcaattacgcaatttcttcaacctccagccatttaggaacttttagtttatcatttatggtgaaaaaattgaagggggtgctctagtagtattttgggtgaaggggggacttgagtcccatgcacccacgttggatccgttcctggctgtttgttgccatatactccctccgtcctataatatagcaacataataccggataagatatttcgtagtacaatgaatctgaacattttatagttatacccaacaaaccccgatagaaacatacatcctta

SEQ ID NO: 53029 - DNA, 1240 bp, Oryza sativa
aaaagcatagtttctgcctttttatctagcaaatccaacttatctaaaatccccttttttttcttttttgtacaagccactagtatgtttagaccaacccctaagatgctgtcttaaacgacgaattttcgcctgccaccgctccatggcagaattgcgttcatcaacactagaccatatctcctttaccatatcaacaaagccatcacgtaaaagccaaccaaattcaaacttgaaactatgttgagcattactcaaagaagaagtgtttgtatttaaaagtaaaggagtatgatcagaaatatctctattaagagccaccacagaagataaaggaaatttatgttcccactccgtgaacattaaaaccctatcaagtttctcatatgttggattcactaaattgtttgcccaagtaaatttcctaccagacatctgtaactcccggagacataacccatcaataatagcattaaaaaggaatggccatctatcatcataattatcattattcttttcatcagggctacgtacgtagaatattaaaatcaccaccaataagaattggtaaggtttcatgactgcacatattaactaattcagcaaggaattgatccttaaattcactttgtactggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctatgaggcttgcaatgccacaaaaattatttgccagcacacagatttttaagaacagccggactaaaatctttcttaatagtctctgacaaagcaataaaatcaaggtgatgttcctttgttaaatcagaaataaacttatgttttttcgggaccttaaacccatcacaattccagaacaaccctttcatttaaaaatattctttttttttctttccccttttagtctttttcttactattaggagaggtatctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaa

SEQ ID NO: 53030 - DNA, 721 bp, Oryza sativa
ttttttttttttaccgcgtcggattttactgcatttttaccctcctcttctcaggcctagaaaatatttcggcgcgacctgccaagaccgaagagtgtactgtagcattagtgctcgatttttacctaccttactctattggaaaaaaaattacattactggagtgcttcgtgcatacaattatttttctttgtattttttcactcgccgattggtgatggtctgattgatggacgacgccgtgggccttctcacggcgagtgttcgcgacggcgcacacgggttcgtttgtttgtttcttcttcctccttgtcccggcttgacgtcttgtcgtttcatttgtcaatatctagccgcagtaattttttcttcgtagtactaatatgttcaattaatttaaatcgtatcattatttgttattaacaaatatataacgatattacctttgttatatagagaatttagcaacatcatatttaatttatcctatcaaaacttaataatgttgtcaatttatcaaatttttgataatataaatttttgaaaatgtttatttaggcagtaatttctactgctgctgtagaaattacccttcattttttgtacggttaaaacgtctcaaggaatcgtcggttgtgggatcggtaacagctaagcgatggcaaatcattgtcaacgacatgcatggcccatcttatcgccatttatatcgccgataagg

SEQ ID NO: 53031 - DNA, 3918 bp, Oryza sativa
  unsure (1)..(3918): unsure at all n locations
taaataatttaaaattagaaactcagcgactacaatgtgttttctaaggacatatagtctgaataactatatgaagtatacaatatctgacagcttagtttctgaagaaaatgaaaatatccccatatattttgttttcctttattcttgtgttttaaaaagaatcggcacgaggttatgctatttcattaaatatagaaggagaaaaatacacccctacgcgtaagaatgaaaaaaatctatacaaatctatccgaggttggaaggagctcctggagctttttttgctcctgctagggtccatgttcttgcttcctcctttattttcgccacgaggccaggtgtcgctatcttcttgtgctcgaagacttgccggttcctctctgtcgagatttctcagacaaccaacaagattaagctacgcatgcctttcttgggtacctcctttttgttagcaagtatctcccaacaggcttggacatcgaggcaaggctcccattggtttggatccaactgttgataggccacccaagaggctaggagtctccagactcttcctttattcttgttaagccctctatgaatgccttttgaagagaaaaaaaattgaagcttttggtccattaagagtctatttggttgaagggatgaaaatagatgaaagataatcatcccatttttacatgtttttgtttcatgggcgagagtggatgggatgggatggacactgaagagaatatatattctcttaagatgttggatgagcccccatctaaattgattgatgagaccatccacttttgtcaacgcaaatgattagacatagttagttttttcgttaattaataattttcatttcaagatctattatattattaaaacaactttgaaaggaggcaccacgttcgctgtggtgactaaaaattcccacattaatcggagaaaaagaaaaggagagtccaagcagaaatacaatttaaaaatagctgaaattcggaattaaaaataagcaatattgaaataagagtccatataagaacccaataggagattaatcaaaattcagaataaaaataaaataaaatatgaaattagaaaagaaaaaggagagtccaagtagaaatacaattttaaaataattaaaattcggaattaaaaataaggaatactgagagaagagtccatataagaatctaatacgagattaattaatattcaaaaataaaagtaaaatccaaaattagcaaaaagaaaagaagaattcaattaggaatacaatttaaaattaactgaaattcggaattaaaaaataagaaatattgaaagaagaattcacataagaaccctatacgagattaattaaaatttagaataaaaaataaaataatatccaaaattagacaaaattaaaagagagttncagttgaaatacaattttaaaacaattgattntttnttaaaaaaaataaaatatttaaagaacactatgcgatataattaaaatttgaaaaaataaattctgaataagaaaatgaaaaaaagattttattttgaatacattttataaagaaaagaccatctaaaacacatgacaagatatattaagtgccaggcctataaaagagtagagtgttgacggctgatacgatatataaaaactgttaataaaacaccaaatagaatcctaataacgattaaaaggagggacgacatgcaggccgtgaagcaaatgggcagggcggttgttgggacttctagaaagttaaaaagtgaacctcattgataatcatattcgatttttaaaatctcaatgacaataaaaaggtgaagcagcgggcggggtgtataggagtatagctgcaaagccgccgacggttggcgggacttctagaaaataaaaaataaattccaacgatagttatgctcgatttttagaatcccaatgacaataaagagtaggcggcatatgggccgtagaggagtatagtggcatcgtttaacgggacttctaaaaattaaaaaaaaaatgaaacccaacgagacaataaactctaaaaactacgaggtccaatttttaaaggtttggaacttctaaaaagtaaaaaaaaaaccaataataactatgttcgattttaaaatctcaatgataataaagaatggaggcagcgggcgagccataaaggagtacaatggcaaagccgctaacggtttggcggaacccgaacgataattatgttcgatttttaaaatcccaatgacaataaagagaaaagacagtgccgggttgtagaggagtataatgacagtgtttgactggacttctagaaattataaaaacgaaacccaacgagacaataaactttaaaaattataagatccaatttttaaaggtttcaaagagaatgaataaaaatagtgataaatcgagtaagcaaataaagaaggatatgacagaagtaaggggtagcagctggtgtgacttttaaaagctatataattagaaatacgtggatgataaggttttgtctttcaaagtcttaagacaacgagatagctatttaataaattttaagtaaaatcagactggaaaatatatgattttgtttgggtgctagccgcgcaattgcgcgggccacccagctagttagtgtttattaggacaattaatctgttttattactaattattatgaaatccaataagattaatgataattactatattttgtaattagagtttcaacagagcaaattataagagtttctaaaaaaaacaatgcatgtactatttggagtttggaatgtaaggaatcaccaccaatatctattggcaacatgtaaatatacttctgcacgattttgtacactcttctctgttgtacttttatgaaagtgtagtgatatctccatgacaaacaatgtcattttgttttgtcatgacaaatcctaatacatttaatacattattttgttttgtcatatatattctctcgacgtttttttaacaactggaacaatacagtttcgctagcttcaaagatatcacttctcgccggcaggagaactgataatgcatcgacgtgatctaggcgactaacaagcgaatgcgcacggatcataagttaatccaaatatttttcaccaatcactagcaaaccagcttccctgtccctccgactttagcccacaaacaaaaaacacacaaaattattccttgttagttagcattatctgaagttcctatatagggaggcaaaagatcagaatccatgatttgaaacaaacacatttattttcactctgaaattataatgacatgacatgaaactcttccccacgatcttgccaactccttcacgaccatttttttttctcttatttcttttcttccaactacagtcctaccatccaacacaaatcactgacataataagaccagctctgctcattactctagtatgtaagtcacctaatcattagcttagtctctcactcattgcaccccaaattcaatcgccctcattgcacggacgaaatggtgttttttatgtgcgattcccggccttgtgttttttctattcgtctttgcacgaatttcagcggtttttgttagctgtctggcatcgccaactgtgcagtagttttcccaaaatgtttcgaattaaattatgaatggtcagaattgtacgctcgaacattctgttcctgaactgatgaaaaaaaaaatagtgcccctgctatataaatactaggacaggtatggccatctacgagatcatattttgttacagatttcttcgccattggagatgatggagtcctcggaggcgagctggcactcgttcgatccgtcagtcgcaatggaggactccgaggcgatggcgcagctgctcggcggtgcagtgcttcggcaatgacc

SEQ ID NO: 53032 - DNA, 2050 bp, Oryza sativa
cagcaacagtaagtacaaaaaaaatgtacaattaatgatctgattaatctttcgtaataatcggattaagattcctgacgatgtgtgcatcaggtggtgcagaagaagggtaataagaacgcgcagtcaaagaaggcgcagaagggcgcgtgcagccggagcagcaaccagaaggagagcaatggcggcggcgacggcggcaatgtgcagagctcgagcaccaactacctctctgatgacgactcgctgtcgctggagatgacttcgtgcagcaacgtgagctcggcgtccaagaagtcgtcgttgtcatcgccggcgaccgggcacggcggcgcgaaggcgagggccgggcgcggggcggcgaccgatccgcaaagcctctatgccagggtaggtagaactatgcgcgagttgctgcacatttttgttgctcatctgaatctgaatttttttttaactgtcttgcttgaacagaagaggagagaaaggatcaatgaacggctaaagatactgcagaatcttatcccaaatggaaccaaggtaagttacttaaaaaccatctgattccaaaaccgcatcaatcacaatactccacaaaagcctccacgatactgaattgctctgatcatgcgaggacttgttatttttttcaggtggacatcagcacgatgcttgaagaagcagttcactacgtcaagttcttgcagctccaaatcaaggtaaccataagacccctgattcgaatccaagagcccaagttttgcttcaattcgcgcgttggtctctaatcttccataagctaaagcaatgggattcatcgttttgcgcagcttctgagctcggatgatatgtggatgttcgcgccgatcgcgtacaacggggtcaacgtcgggctcgacctcaagatctctccaccgcagcagcaatgatccacgtactccagccatggcgccacggacgctagctcaagctatggttctttgcagctggcgcagaaatacatatttttttttcttctacttctgttgatacagtacatttttccatcctgaatccatttgattcattcccaaaggatggccaaccttaattatatacctcattgatcgagttcttttttaccatttcgctccttgcctcctcgtacagcagatcctgccatggaagaacttatttttgggcaacggaatgtgaaaactactgagaaattggcagaacaccttcgctagtcggtttactattcttaaaagaaaagcaacgagagagatgaaaggaaaaagtgagcgtgaggtctcttatcttgtcatcaagtttcaaaatcatccctaaaccgaaatactagacataacacatatctaatcttgtaaaatcagatcacattaggtcccaaggcaatattactcctcggttttgatgatgtggcggctgagtcttattccatttatcttctctctctttccatctcaacccaaacctctggggcatccgacaacaggaggggagaagagtagcggccgttgggcggcgacgccaagtagaagcctgacggtgacggccggcaatgggtgggagaaggctggcgaccggcgagaagcttgacggtggcgggtggcgggaaagaaagcggaagcgttgaggatgacgcgaccacagcgtggagtaaatggagttgacctcgaagatgatgcagtggagctgtgcgtgcgcctccgcgggggagagacaaagctcgaggacacctaaacaaatcggcttttgagcagctcagtggagatggctctgagtttggggaataagagcttgggcagcatgacgtggcggaagccccagcccctgtgtgtgcaggtgaatacattgcaattgcagttgggtgcgcagtcaggtacatgacacgagcactcccggctattgggagccacactagccggcagtctccgccgtcgagcttgtccccgccggctggcacccttctccccacccgttgtcggctgccctagaggtttgggttgatatgagaagagagtcgagagaggtggaagaaaattgatgg

SEQ ID NO: 53033 - DNA, 2140 bp, Oryza sativa
agggcgaattcgagctcggtacccagcacagaaaactgggaaatcaactcaggaaaacaaagagcttgaaccgtaggatgtaaactgtgaatattgatacgatactcatcttgatgcaattaacgagttgagctgaagaatcagatggttactatctccacgacatcctatatccccacaccttggaatttccaagtgatggatttacagtagataatgtgttctaactatagatgttaagtgtgctccagaggccagagcaatgcaaaacgaacaattgaacccttgaatcgaattgttatgtgaggagccaacagctggctagaatcagaagtgtatttttcatctgagatttctatattttcatagtattagttttgctgtagtgctagttgttcccgatgttttgctatctgagttataaattacgcggacttgtattcttatgaagtctgactttttgtataaaaaaatgcttaacataccaaagcactgtaatatcgtccttgtactttttcgcttttcttcgagcatttatgggagatatatagcattcgattgttacacatcgcaggctgtgctcagttgacaaacggaaaaaatctgagatagaaagttcttatattatatctgaataccgaatgattagtgaagttattatactgagaatgatgagttagtgttcgagaatgtataatgagttagtgttcgagaatggataatggatgagttagtgttcgagaatggatgagttagtgttcttatacctaataatgaatgagttagggagtgtttgaggagaaggggattgaggagattgggaagatacgcaaaacgaggtgagccattagctcatgattaattgagtattaactattttaaaatttaaaaatggattaatatgattttttaaagcaacttcctataaaattttttgaaaaaacacaccgtttagtagtttaaaagtgtgcgccggaaacgagagccaatctcccctatcacccctaaacgaacgatgccttagtgttcttagccgaatgattagttatagagcattgtttaaattagaaacgtttaacatcctaaacaacaccatcagagtggcgcagcggaagcgtggtgggcccataacccacaggtcccaggatcgaaacctggctctgataattaatttttgacttcttaatcgtctaattttattttatttattcatcttttttgaatcgtctaaatttattttatttattcatcttttttgaattattgcttcttaatcttctacgctagctctatgcaaccacaatctcaccaaatggcgaagtaatattagtgtctttttttgataattaatttttgctgatttatcattcatttatcgaatttgttcttaatgcatacgtacttaacctatctcatgagcacctctaaaaaaattggtccgtatatcttgagctcgatgaaaacatcacagacatataagctcactcttatataatacacacgtgtacatttggttctaatgaatacttttgaagattgagttagtaatatgttaagattgacgaggttaccggtcaccactggtgtctgtatatacctacaaattttgagttcgacgaagtcaccacaagtaatatggtacgttgtccaccactaaaaataattagctataaatacaagcacatcatagactcgctgtcaacatgtatatcgctaccagtgaaaataattactccttccggacatgtctcatgtccagattcatagtcttagatgggtctcatcccatcatagtttgctatattttgaaacggaggtagtagctgtaaatacaagtattcgtgctaaaattagaacttaaacttagattagcaggttccatcataagaaaccttactagtagctaaggtatcctcaattcgccataaatatcaggcaaaaaaggatcctcaaagtttatggtatttgttgtatgacatccaaagaatgtgtatttattacatgacaccactaaaaacatggtaattagctggtggatgctgaacgtattattttattatatcggatctaaatggagagagaaactttcaaaaaagacaactttttacctatggtgcatgtttctttttaacccaaccag

SEQ ID NO: 53034 - DNA, 4531 bp, Oryza sativa
  unsure (1)..(4531): unsure at all n locations
ccgcacgacgaggtggtcgcggccgggctcggcgggcccgacgcccaggagtcgcaggccgtcgtcgacctcctcaacgatgccctcgccgcgctcctccgcgataagccccgcgagttctggcgccagggtaaccgaaacgctcgcttgtgcattactgtgctcatgaaaccgtgtagctggaaggcgtgaattgttattttgggattgggaaatcagagctgaaagcttgaaagcgataactagttaaccacttaatgttcggtgtttactgcttgtttgcttcaattgtgtttgttgaatgcatcttctgatgcttcggtctctgtgattatctaggctacggattatgtgtaaaattctagtgtatgcttgttcaaatgtcagtttgcacttttaagcgcaagataaaatgcgtgcagttaaatttattactacatttgcagttgaagtggctagtagttgcataagcaaagcaaagcctatgcaatcatattcttatcactatcatgacctatgatcctttgaaatagttttaatgggaaggaattaatcctagtcccttcagattgacaggaacttcagattgacaggaataactaccctacaatcagaggaatatggcattttttcttatgcaaactaagcctgaacaataattgagcgagtagatgagtcaacataaaagcttgagttgaggacacgcctagatctgtgattatccattgtttcactcctagaatttaacttatgaataaatccgcgtgcatttgaactttaccaatggtttcctaatgcttatcgttaccttttcccagtggcacagaatacttccctgcatgagttcctggacagttacctacaattcaggcatcggtggtatgacttgcctcatcgtgcacccaaagggacagttgctggcttagttgtcggggagcttgagctttgccgtcgagtctttatggtcctgtaccgcatgtgagatttataccatttcgctatctttcttgtatacatatttttcataagataatgcacactgttcagattcacatgagatttgtcatgatatggctcttgtttgggtggtagatcttcaaacaaggatcctggagcattcaggggtgaatcccttagcatgaaggagcatgcaggtgagattagaactactcatatgatcactgtttgagtttacctttttttagagcagaatggatagtgaccattggttcaaatatactatattcacgttgttcggttgtagccctcctgcaggagaaaagattgcttgatttacccaagttgttggacatttgtgctatttatgggcatgacaattgcaaattgacaagttcactggttggttcctgaagtgtttattattgttgttgtttttctccttttcattttgcagacagatgctaacttaaatgcaaattctaattcattcccttagtctcagataacctttttctattcattggcatgaatacttttataattttattaataacaagtgcacattttctgtatctgtaggttgaaaacgctatcaatgtccagcnnaatatctgnnatggcataatattgtcctcnnccanttctgggcattttccacacaatgcagagagggtgcatgaaatcatacaaggttattttgtgatcttcttcataaatcactgcacatagctgttataggattctgtattcctttatctggtatgaacatccatatgatatcattataacagctgttttcactttagtctgtagtcccaatcgcatatgctaaaacttttatcgttttctgcaaaggattcaggttattcatttgtgctattgacgaatatacttgttattacttgttatatctgttattgtttcaaatactttcttcccagttcctttcaacaaccatgatacattgcttggtaggttagatagaaagtgacgattatgatgtttactattaatttgtctctgtttcttttttatcctaaattgagattgaagtatgttttctcaccacgattaaaagttgaggacctatgatattgatataaacttgatcttgtagtttcacaccttcctgatctgatgacagtttagtagtttacagaagatcttggagaactatgcataaaaagaacttaaccataataaattcattttaggcgctcacttcatctggacggaatgatagtggatatacccaacttcagaaagatttctcacaggcaagttttacctatactgcatagtttatgatatgtctgctgtcctttcatctgatttttctatattgttgtaaaaccaacttccttcaggtgttggattttgtaaacgatgcaattgtcactctggatgcctttgtcgatgcttatcaacctgctgctttattattttgtacctcttttgagacgaggtgcgcttctactcatccaacacaatatttgttcgctgttcccttaataggcaatgatgcttatctaccacttaatttgcagctatggagttgaggaactactgaacactcttccaagattgtatgactcatttgtgccatctttgcttcatgggtttcaagttatgtccagttcccaaagcaatggagagactgcatctgacattatactgagtgacatagttcttggtataaggatgctgtcaaggagaactgtcagtttcgaatggagattattggagttctgctatttgaacaatcaacttgtggagcgtgatgttaaagcttgtacaaagatgtttccagctaaagtcgaagatctatgatcaggggtgacatcatatttcaaacactcaaggatattaatagagaagccacattttcacaagatcatcctggaagacattcctccaagctcttgaaaaggagttcaagttgatgaaccggattggagatattcgcaagaaaggtaaatgataaaaaatctcaattaaatgcttggttattttcatgtttgtaaaattccacactttcttagtatcccactattattatttcagccaaaattgtctctttagtttttcatccataaacaacatatacgatctaggaactttattcagaagttgtcatacaattattctacatatatgtactgaattgcctatgattctatattctgttactatgcctgctctcgccatctatgcatgagtggttcttagaaagcttaaaacttccagcttgatccagcatattgatctcaatgaatggaaagagaaagagccaaaacagaatcttatctatatttatatctatactacctaaaatgtatacgtgggggtgtctgttctgccacaccatccttaccactgacatttgggtcccacaatctatactattacatcaccctccaacaaaggcttctatttcactgctggttcttcccaacatttgaatcacctacttgttcaataaggaaaatcataaaagtactacttggattaactatgtgcttaattgattaactagaaactcaatttgttttccgttgcaacgcatggacttttggctagtaaaaggaaaagatgctctagcttctggtgtttggtctcataaagtcaccaataatattcccgtattaccctacatttgatttatttctgctcgcgcttgatcattctggcactcttgagttgtgttcataagacatcacttttccggttttgccaagattctgttgtgaagactgaaagagtttgctaaactgtcagcattattctgttgacatatatgctgtattttcttgttatctcaagtttattgattgtgtcatagttttatattgatgccaaaacctttggttgatgtattcaatatgttcctccaatcgtaaacaggatggatacacatggatgatgagcagttccagttcattgcacgcttgtgtggatctactctgacatcttggaatagtgtgcctgatttgcctgtctcttcctatggtggtgaactacaacataagaatgaggatactgccatcactgagtccaagattactcaaataagggacctctttcctgattatgggaagggtttcctcgctgcatgcctggaagcctacaaccagaacccagaggaagttatccaaaggattttagatggaaccctccatcaagatcttctagctctggatacttcattagaagagatgccgcagctaaagcctgcagccactgttgggaaagataagggcaaaggaatacttgtggagactgagcctcaaattatgaacaaaccccataaggttaatactgagatgcatcgctatgttgaacattcttcatcttcttcagttccatcagcatcccagggaccatcctcatctgtaccatcagtcccgcaaggtagatttacaaggaagaccaatgacgacgtgcctgactctgcaactctagactcacagaaagcaaaagatgctgttagatcagctgtgcttgaatcccagtatgaatatgatgatgagtatgatgactcgttcgatgatcttggcttcagtgtggtaga

SEQ ID NO: 53035 - DNA, 1365 bp, Oryza sativa
  unsure (1)..(1365): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatagtgtgtcagctagtaatctagaaaaggaattatctcttctgagacaggaacaagaatatctcggaaatgaaaggcggaagcttgaaagccacgcagagtctgtcagcagtgagatgtttgctgaatgccaggtttgaatacaatcaccttttccctttgagttgaggcaaggtttacctcagaattgagatttagtggaagtttgaagtaaatggttttagcagtacaaaatgttaacatatgtatgtcttgtattatacaggaattgcttcaaatgtttggcttgccatatataattgcacctatggaagctgaagctcagtgtgcatacatggaaatgactaaccttgtcgatggagttgttactgatgattcagatgttttcctgtttggtgcaaggaatgtttataagaacatatttgacgataggaaatatgttgaaacatacttaatgaaggtcaattttctttctgctttcaattttactctcatttttatttcattgccagctgaagcaatgggaagtccatgtccttgctggaccttccacagctaatattgtaatacattttcaggacattgagtctgagcttggtctaacaagagaacaattaatacgtatggcaatgcttcttgggagtgactacactgaaggaattaggtgatatgctaacaagaatatgtatcctgtaactttttttgcagtttgtataaaaataagatcagaacttcatttttgggggatcctctagagtcgaattttaggcatgcaagctaatatgaactaaaaaacttgctgttccagagatcaagtgcatgctctgttttgttggacaaatttgttatgtatacagtcattaagaatacagagcattgtactttaattatgccatctcaatttcttattttgaaggggggaaaatgccatttcagtttctgttttgtccagtgtatttatttatatactgattatgcagtggcattggcattgtgaatgctattgaagttgcacacgcatttcctgaggaagatgggctccaaaagttcagggagtgggttgaatcacaagatccaaaaaactggaaaattggttggaaagtggnnnnnnnnnnnnnnnnnnnnnnnnnnnnnnnnnnnnnnnnnnnnnnnnnnnnn

SEQ ID NO: 53036 - DNA, 1864 bp, Oryza sativa
catttggattgaagtgatttcaacacaagtttggtggatctcaattgtttgggaaaaaaatcctatcattttatttgaaatgaaggaatatgattaagccattccctaatatccacgtcttttttttctttgaaacgaaggaatatgattgacaaaaaaaactaacaatttgcttctcataccaaactaaacgaattcatacttcatgcttttatttttatatgagaagccccatgcattctctctcgcgcacacactcataaaaaaacaatttcttctaaatttctatatttcatttcctacatatcttccaaacacaaactctttaattcatgtgttttataaaccacacttcaagggagatctaattaattaatgtctttatagtccattggttctcaacccttccaaattccagtatattggcagtaaaattttgcactaccaaatcgttgataggggtaaagttttgttgtcaatgtttggtttgttaacaatattgagccaaatcttataatagagtgaataaagttctaagaccctgtttagatgggactaaaacttttaagaccctatcacatcagatgtttggacactaattaaaaatattaaacgtagattattaataaaacccatccataatcttggactaatttgcgagacgaatctattgagcctaattaatccatgattagcctatgtgatgctacagtaaacattatctaattatgaattaattaggcttaaaaaatttgtctcgcgaattagctttcatttatgtaataagttttgtaagtagtctatatttaatactctaaattagtatctaaatatagagactaaagttaagtccctagattcaaacaccacctaaaaattgtgtcaaataaagcataggcattaccaaataggagtagttgacatcaaaccaaactatcacatttatgatctgagctaccgataaatttatagggtatgttttggcatcaatctaaaacggtcatctgactgactgaacccattttgaaatgtgattttctttccaagtctttcttttttacaaaattcgtgtgattcaaaagaatcctagttttgttggttcatccgatgtactccggagtactaaagaggtggttaggagcaatatgcattatttctgcctacacgaaataccagctagtagatgccaattccacaattcccatttgcattagtcccagaaagggacagtgcagaaatgtcggtggccaggagtactactacttgtactatcaacagtgcagcatgactgacgataccgtggcactgtggcagcctatgcctgcagctcgatcctgtggatcggccgtgctactagtatgactactgtatatacgtcgcaatctcgctaattccacgcgtttattatgccatccaagaaccgacctgacgctctgacacatttatgcgtatgtggacagtagatcggtgagcctcaacggagtaatcgctgcttgatgccatgtcgtattgtctttctggtccttgcatttaagccacgtgtttcgatgcgttgcttggtgttcatgcagtagtatgagtatgtgggatggatgatgcctcaggttatcttcaggtacgatgctttgaggcaatcttttcatttctgaactttctatcagtatgcctttgcttcgaaattctgctcctattaaccagtttatgcgcccaaacatactccaaagcgtgccccccaatgagaatgacgtcctgaagctccagctccttgtcctcgttgtcgtttagtactattttttagatcagtccagcaaattcaacagacgagaagtttgggccatctgattgtgtagaataactttgtctt

SEQ ID NO: 53037 - DNA, 1963 bp, Oryza sativa
gtgacgctgcagtactgggtgccccggccggagtgatctgtcgtccagtgcaggtacacgacgagttccaactaagacgcaggtggctcgagatgtacacagtaacacactggtacgtcgtaccacctatccatcggtagcgagcacgtctccgcgccgcgcggtgctgcatgcatgtgtctccatctgcagccttgcaggtttttcgttcagatcaatcagggggggctgctctcccgttttccttcagggtgattgatcacactggccgtcgatttccaaaggttttcacaaagcgcgtattactattaccacgtgccgattggatcgagtgaacactagaagtaaaaactgctgtccaagtagggagttaagtaacacatcgcgagatccaatgacccaacaaaaccttgcagaggtttttgcagttgcatgcatgagtggcaattggctcttcggtttggtttgcatttactactatattcgcatcatcaaggattgacttcagactttctgatgagttgcaggtgcgtgcgtgttcatatacgtttattactgtcagttgattttctttgagatgtactggtctggttggttggaggaatatcgagtgcacttgatcgatagataagatagattggaggaatatcaagtgcactagacggatagataagatagatactggttacatcttcacagcttgtgcaagcctctgaacagagaagacgatatatggagttagaaatatggaaacacagtctacgggaaccatatgcgctttatgcagtgcacttaagttttaggatggaaaaatgggggagggaactggccgtagtaatgcatggtccctagttactgacaggatggtcataggatgcatatactactgtaaccgtttggtgcttggattgatccatgatacatcagtgagggcaggtagcagatcgatcagtgcatgccggactgaacaatgactgcaagtctctgcaactagcaagcagtacagtcgtacttcagtttcttttgtaattgaattaaccatcacataatatagcaagccccatttgcaattaaacactgaaatagtaaaacacgtgattttaatagaaatgtatatgcaaaacagaaaattataaaacacaacaagataacataggaataagaaatacccgtttaaatagaatatagaaaaaaaatataggaaccggaagagaataacagactagaatgaaagtttctaataggttgaacctctactgagatatttctgaggaatttcataggatttaggaagcttcaaccctatgtttcaaatgactaggtagaaaatttttctataggattaaaactctacaaagttagtacacattgtttccaaaatagaccgatagtgtattctgtagggtaggatctgattgacagattagataatgcatgcggtacagcacttacattgcaaatttgcaattagggccctatttagattccaatttttttcttcaaacttctaacttttccgtcgcattgaactttcctacacacataaactttcaacttttctattacatcgttccaatttcttcaaacctctaattttggtgtggaactaaacacagcctagctctaactctctgtgcgctcttcttaatcttaattaagtagccatagcagcgtggttgctagaatcgccaacaacatttatagaaaacatagaaacatgaaaaatacggaattttaatatgaatatataagtggaaaacataggaaaatctatgagcgactttttgaatagtccgcataaaaaacaaaaagaaaaaaaatcagataacatagatagactaaatttttttttcaaaaaatgaagctcttgctaactttcttcaaaatttataggcattaagtcatttcttaggaattttgtaggatatacatgaaaaatacggaattttaatatgaatatata

SEQ ID NO: 53038 - DNA, 1404 bp, Oryza sativa
cccccctctgctttcatttcacgaatcggatcgcaagaatctcatttcatttccgcaatctcgtagtcattagctcggtggggtaccagccatcaacgatcgctctagcagcaatcttcatcgctcggaacaagaagacggcgcctaatctagacgagctcaagtcggtcgtgggctcgttatgccagcaaatagacaccgtaagcactaacactttctcttttgcgagatctcatcccattaggtttaagttcttggtagaaatgacaatgtcgagagtaaattctgcaacgctgttgttctcttgcaggggcatgtgtattcctgctacaccaagatgatgattcaagaggacaggtcgatgcaatcgacgacgggaggtagcttcctcgggtgtctctgttgcccacattgggggatcggaggacagcgccatgggaggggccaataatgccaccaccttggaggcaaccccggacaagaagaggaaaaggttgcactcgcctcagcgccagtagagggaggagctggaggctggagctggacagcatgttggttggagtccagctctgcaatttttagttgatcattttcaccctttttcttttgtttcagctgagccctagtcagtgctcttgcaagttcagggggggttggccaaatggaggggccaacatttgattcttcttctgattatgcaattgttacagttgattgattagttagcaatggaaagattctggttttgtggagatctttccctggcccagaaaggtactagtgtaaagagcagaggaaaaggcctgaaaactgataaagagctcttgctcaaagtagggaggaagtcctcactgagatgtggagacagagagagggaatcccaattcccaagtattgagtagaagtcattttttgtggatactgtatggttatctgttactctctgttgagtcatgccattttggttcattagcaatttcctgatgctaaagccaaacagtggtagtacatttttgttgcaagaactgattgatagtagttggatagccagggggcaggggccatctctctcactgtacttcactctactctctcgtgtctcgtgtgcaattgctgaccatgagtggttgggaattgtttattgatatcttttggacgaaaggaagaaatgcgtttgctcggtgcctttctgatgttgcctttgtgccgcgtcatcaaatcaccctgccttgctatttctcacaatggctttgctgttctttgccttcttggaggtgactgacactgttggtttgtctctctcgcatgaaagcagctgtaacgctgccttctttagctctctctgaattgtgcatcatgcaatgcaaatcactactccagtagtagtacactccactaggacac

SEQ ID NO: 53039 - DNA, 1976 bp, Oryza sativa
ttccttccaacaggagttctcttcatcagttcatcgtttggaggttcagttgccaatgccagtgctcatagtgtgtccatgatcatgttaacccagagcagttggacagcagtaagaggagcactccctgaatgccaagcagaagtacaaagaacagtcaagagtaagttatgaaacaaactaggaaattcttgattttccacattaataaattttatgttagtttatttttttaagttttagcacatctcttctgccactcatttgaaatctaacgaaaaatttctgctgcactaacactaaacagtatttgaacttagaaacagtaggcagcagactaggaacagtggtgaaggagaagtataaaagatgaacatgtatcagcagtgcagttattacaagaaaccaacatcaaaggttattttaatcggaacgaaactatcaattctatacagtagaatgaggtaaaaaacatcaacatttagctgtacctgtcaagcaagctgaggagaagttcactatcagagcgaccacattgactgtcagctgaaactgcacaaacttctgaatattaatgtacactgaccgaccccatttagcaacagtgactatagtggagaagttgtcgtcaagaataatcacgtcagcactttcttttgccacctgcaaacagatagcacagtgagaaattttgggagtgaaaaagtgcatagaactatgagggcatgaaatggatggtagtacaactcaagacaactaaattagcggctaaattgccacaaaaatacacttctaaaaaaatcgaagtgatgcaattcattaattatattggttcatgcaaggggaacacttatcaactaatctttgaggaaaatcacctcagttccagcaatgcccattgcaagtccaatatcagcttcatgaagagcaggagcatcatttgtgccatcaccagtaaccgcaacaacttcatcaaaagtggtccggagatgcttcaccaaggtgtgcttgtcaagtggtgaagatctagccatcacctgatacatgaaaccagaacacatcagcaaatgaaatccagaaaattcagttaaactgaccagcaaaagcaacgaaaactttacttgtatttttggtatcaactcattcagttcctctgcactcttggttctgaaatccggtccttcaatggcaatgccaccttcagtcaaaatgccgcattcccgcgcaatcgccttcgctgtattgatgttgtcacctgtgaccatcctcaccatgatccctgccgacctgcagatggcaaccgattccttcacaccaggacgaactggatctttgatccccacaatgccaatgcaggtgtagccatcttcaggaatctggtcattcgccgagaacccgtcaccgacatcgacgtaggcaaggcacaaggtacggagcgcctcgtttgcaaagctgttgatcgtggcgttcaggtgagcaacggttgcatcgtcgagtggcacgacgttgccttgatcattcaggtacttgctgcaagatgccaagatgatctctgacgcgcccttgctgtgtgcacgcattgctcctccggggagctggatgaccactcccattctcttcttggccgagttgaatggctccaccttgacgagggtgctccgccttgcgcaccggccaggaagtcgcccgccgagtgagaggcccgaactcgaggatggccgtctcggttggtgtgccaagtatctcgcgactcccgctcttgttgaagacgacgtcgccgccggtgttgttgaagatggactgcgagagcaacgtcatggcggactccggcagctcggagaacaagctcttggtgtccgaggcgctctccacgtctttgatcttgccgcagatgcatgccttgacgacggtcatgtggttggtcgtgagcgtgccggtcttgtcgctgcagatggtggtcgccgagcccatggtct

SEQ ID NO: 53040 - DNA, 1854 bp, Oryza sativa
gtcattagtaaatgtttattgtaacaccacattatcaaatcatggcgtaattaaactcaaaagattcatctcgcgatttacatgtaaactgtgcagttggttttctttttcatccacatttaatgcttcatgcatgtgtccaaacatttgatgtgacggaaaagttgaaagtttgaagaaaaaagtttgaatctaaacacggccaccatgctcaactgcaatgtgttcggcacccaattttcccaacacttcttcctcgttttccacgtgcacgctttttaaactgctaaacggtgcgtttttttgtaaaacatttctatacgaaagttgcttaaaaaatcaaattgatccatttttagaaaaaaatagctaatacttaattaatcacgcgttaatgcaagcatcgttttgcgtgcatgggaggaggggttcctaactggaaaaaaaattagctaatacttaattaatcgcgttagtactacttgattttacaaagtgatgcagaactttgtcctggaaactgttgtggaagcttcagtactgcacaaatgctgcaccttttacatgtgtatatgtgttgcagacttgcagcagacgtgtaacgtgtttatactttatacttgcgattttgccagaagaaacatagtgtggattgtattattgtaagtttgtaacagaggaacatgttactcactataaattttgtttgccagaggttatggaaaattttaaatttaccatgttcaagggaggtgctaaacaaaatcttaagttttcagttaaaatgatcttttttttaagatacaaacttcacaaacagctcaatggataacagtgaaacattcaaactggataaagattaaacagtcaaacaggtacgtttgaatatcatcttttttaaaaatatttttttcttgatcaatgcagaatcaggttcacatctgaaacagtaaaatctaatcgaacggcctaaaaattgcagcttacactcagtaatttacagatgaactaataaggcctgacagccccagcccgtaatgattttcattatatatatatatatatatatattacgatagtttacacatccgaagtatgccaagaaaagcggtggcaatggcaatggcaattacgacgccgatgcaacacacgaacataacatatatcggcgttgaatgcggcggcagttacctggttggatcgcttcatggcggcggcctcggatcgcttgtcgaggttggcggtgaagcggaaccgccgcttggggttcttgacgacgccgaccaacctgcgccatcgccccagatcctcgtacgacgagtgcttcgccttcaccccgccgaaattctccttcaggtagctctccattgcgcctcttcaacctttcccttacaattgggtcccaatccaacgacccccttctccgatcttcttcccaacgccaacccaaaccctttctatatagccaacgcgggcattggtttctttcgcgaagaaacgcgtcaactcgcacaatggcgttcgtgaaggcgactctctgacggcaacttcagcgcaattttttttgtggggaaagtgttcggctggtcggaatcatgggagtttatgcgtagtttcctgtgtttttttagtaagtgaccggacggatgcgagtaggaggaggagggagcagcagcgggaggggatgcgtgcatgcatgatcgagagcatggaggggcagctcctctctcgaagttggttcgctactgacaatgcgccggcaattcaggggtcaaaactcgaaacgagtcttggggggcaacttttcaagacattccatgcagctatgctgcacgtacgtacatgcgtaggaga

SEQ ID NO: 53041 - DNA, 2626 bp, Oryza sativa
  unsure (1)..(2626): unsure at all n locations
atcttacttattctgttaataatcagagaagacaaggacacaggaaaatgtgggtagagcaccgaatcccatttatcctcgcgaagtattttagccggaatccaggtccagcggtcaacgtcgccgtccgacgcaaatgggaccgcgctcgagaggaacgcgcaccgcgtcttctccgcggggcgcggggaggcggaaagaaacaacgaggccaccacgcccacgcgacgcgcccacccacttctctttcgtgtcgtgcctcgtgcgttcaacgagccggtcgttcccccgcggtggtgtgcctccctccgcacggtcgtaggcccagaccaaacggcggaacgggaggtccgcgacatatggaataagttcattttagatatctcgtccacacgtcgagtttgaatactgtcatgaacctcgataccagatatagggagagtaccagatcgattagcgtccctaagtggtttcgatgacgggttcatcctaagtggcggcctatgtgacattttagttaggaaaaataaaaaaaggtggtggccctaacatgttagtgacacacccatctcccccttctctatgtgtttgtctctaccctttctatgcccttaattcagattccactgccgatgctgacggtggctggtacatagcaactcggtaatgtgtgtttggggcgggatccattggggtacttgcggtcgcgcatgcagaagaggcactggccccgataccctaacaacgtctcatcgatgatggggacgggggcaggcagccagcggcatgcatgcataggtagtgcaccactagacaagtttggcaccactcccaacgcccaaacaatatctatgtgatgatgaggacgggggtcaggtaaccggcggcatgcacggagaggcagcacgtatccatctcctcatccatcaggtggaaagtggaaccatagcaacatgtccagctctgtctctgcgtcacgcacccgccacgtcacacccttgggctctcgatgaaggtagccaaccaactgctagatctaggcatcgtgcggtgacggccaagtggagaggtcagcctaaggatgtactactctagtagatctcgtcgctagtcaactactcagtgcggtccgctctgcaattcctctccatcgccgtgccgctcggtgctcgtgtccccagccacgccagatccagtcatccggtggcacgcaggtcactgcccctctccccgaatctacactcaccccatggcctcaaggaccaaatgtgagcaggaggtgagtggatgcttcaaccctccctgcctcatgcatccatgcatccccgcctcctcttgcacccgcgcgtgcacgcgcccagccaagatggcgagcgaagctcaaatcgagcgtttccctcgggcctagctaggaaggtaggtttgcacaagtggaatcaggtccaggagcccgtgcgagaaaccaaactcgcgctccttgtgagccaacccatgtgtaggtaaccaaacacgctatgactgtatccactgcatgtggcgactcgatcgagccatcaccgcgttcggaggggggccgggcttcaggcctncccctccccctcctcatcctgggaaggcctatattcgaaactccaaggcgagctaactacacagccacaggcatctataccctgtacggcaaatctgagagacaatcaggaaacaattacaaggtgtcaatgacgacatagtacaccagttcctgtctccttttcctcggggagtgttttagcggaacataatcttttgcagtcgactgcgccgtgcctttattattgacatgtggatctgatgatctccggattcacatgttagtgataaagtcacggtgcactcaaatgttgaggatctcaatcctgttttagcaggactctcaaggtccagggtcaacgtcatggcgacgatatgcgaaggagtactgaaggaccgcgcttttgataggaacgtgcaccgcgtcttctccgcggggaaggtggtggaaacgacgagaccacccaccactgcgctgcacggtctgcacccccacgcgcacacgttgcgtgttctggacttcccgtcgttctctgcgatgggaaaagccggaaagtgaacggcgcatcacggtgacgggcctccactccgcacggtgtgccgggaccaacccgagcgcctcgcagcgaggctcggtccaaccaacgggtggcttgagtcgttcgtgcatcgtgcattggaataagtccactttgactcccttaaaagtgacccgaatctaatccgtgaccctcaaccataaaaccaaataagcgactccccgaactattcaaaccagtgcaatttgactccctcattggttttggacggcggttttactgacgtggcgctgatgtggcgatgttgacttggtttgtggtactgacgtggcgcttaggtagcattagaattaaaaactatatgggcctatttgtcattcacacaaaaagtaattataggacccacatgtcatccctatgaccctatctatccttctttctcctccctctctcccttgagatttgaaaactttcagctcgagatttgaaaattttcatgtctaaatttgaaaaattta

SEQ ID NO: 53042 - DNA, 1696 bp, Oryza sativa
aacccttactacgttttaatcagaaaagaaatgatcttactgacatcgctttagtcgctttactagctagctaatcactttggagtttcagtgctaagtgtcaaaaagcgcttgtactggcagctacagtacattacatgatttacatcttatagcacactagtatatacgcctagtaaaaatttccgtaattttgataaattgaccctttgaaaaaacttattttgatattgagccgtgtcaaaaactaattttaaaaatagaccattttctcgcgccatcgtacttggcgctgagctacaacgtattagcgccactttctttggcgttgagatgcgatccaacgtgtcacgtaaatcacacgtcatgcgatgcgatgtcagcgctaaagaatttggtgctaacctccatggtatagttgtataaatagtatgcatgtacattctagccttatggaaggtctatcctggtggtgaagggctgcctctcataacaagaggtcaagggttcgaaccccgtaacttcttatttttcttttttttccttttaggatcaatactgcatacataattatgtagcaaaatagagggtgaaaaaaaatgaaagatgtaattttataccaactattaagctataaataccacatacataattttgctccttccatatttaaaaataaaataaattaaaaaacatccatatttaaaaataaaatgaatttgaaaagcatgtgagatttttaaatagaacagcaaaagatgcttatacttgcttggctgaggatcgaacccattacctcgcagtatttagcacctagagttcaccaagctttcttgtctttgtgtgtgcaatggaagcttgtagataactaatatttgtaaattgaacaaagagtatttggcgatgacctcggatgacgtgtaaaatccgtgacacttcggatgacatctcggcgctaatctatatggcgctgagaaaacggcctaattttgaaattagtttttgggatgattcaatttcaaaataagttttttaaaagggtcaaattgtcaaaattacggtaaaaattatccacattcacgaacaatggatcaaaatgccgtctctcacatcaatctcatgcaccttgcagtgtttcccgccggctccgccgcccgtgcgcgtgtgcctccaacacattacctgcatacttgcatagtgccctactgtacatatgactgtatcactggtcactgcatgtggcgactcgacatggagatggggggcctctcccagcctcccctctcttgggctttttggccgcgagccaacacaggcacacagcgccgcccgctgtagcgcgacgtgcggccgatgaatgtggcacggaacgtcgcgccgggcacgacaaaagcggaagggcctcggactcgagagatggctcgccgtcggttgtcgcctctacgacggggaggataagctgcggctatagggcaactaggcacaaccaaggcgatgtgtacgtacgcggcacgcacgacgccgacccggttcatggcatggccccatcttatcgcgtacagggatcgggattccttcgataccccaacggagagggggcccgctctagagagcaggctagagagcagagaaccttactcccactctccccatatatgatggcatagtattatgaatttgatgtatcttggaatta

SEQ ID NO: 53043 - DNA, 761 bp, Oryza sativa
acaagaatcatctattttgcactttgaattatcagaattcaaactgtattgcgtcataactttatcgctatcgttcttaggccactcgggagttctgattgaatgtaacattgaattgtggtgctgaacttctgagccctcaggtgattttgcagcactagtactgccggtcatattacatggagggagaggatccaacaaataagctctcttcatatcggcatgcccatcactattctcgggttgagtctgattctcgttttctcgtccatcaactacaagtgatccatgcactatatcattctcttcacaatttatttccttcccaattttatcagctgtcttacctgcagctccagctggcttaggaacatcatcataagattgcaaaggtttgtcttcaaaagatgcctgtaaatctcaaggggtcacattttcatgttcttgcttcttaaaatcctctaaacttctccttatagcttcctgaacaagggcatcttcttctagatctcctttcggtactttagattgatcgttttcattactggaaggacctccaggaacatcacaaccaccttcttcccattttatctcatcatcagtacagaaattgtccatcagtgatgcttggtgatcctttcatcaacttgcataggaggtgtttcactttcaagtacgccttcttttgtaatgcaatcagagccatcagtctgttctgtagtgaataagttggatgaagctccagaagctaaatgcaagaa

SEQ ID NO: 53044 - DNA, 1089 bp, Oryza sativa
atttaagtatttttgttgttatgggatgataaaatatgaataatatttacttgtgacttatgtttttaaatttttttaaaaaattttcaaataaaacacacggtcaaagttggatgcggaaaaccgtggctgcacttaaaatgtaacggagggagtaataaaggatcgagttatccgcatccgtattcctaagctttaacagatttacgtatccctgagaaaaattacttataaccatcctggtttttgaacaaaatcgactatccttaaaggtcacactaacacttgcactatcacagagatgggtgtagtgcgcaagcaccattgcagagcagctactccaagtctccgaacactactacttgcccctccagaattgtaacagctggagtacgtagataagggagaagtgaattgtaaatggtccactcaagtattcaaatcccattagtatgtagataattgagaactgaaaaataaatgatcggaggttccagcagttccacaaaacatccgtgattaaaatgtgattagatattgatgctccacaaaactacctgtcggcaaaaaatattctttaaaatattatgggtgtttgtttgtttgttgcccgagtaaataaccccaatactgtccttacgtatatttatatttgaagtatatactttcagtaatactcgcactaggggtggaaacgacggctcggcttgcagtggttcgcaacaaaactaggcttggcttggcttggctcggctcggttagggaaacaagctaaaacttgagctcggcttggcttgttttctggctcgagccagctcgagctggcatgcaagtcttcctgttgaaacacctcttcatatatattttgtaactattaaaaaaacaagaacaaatcatcaacttgtaaaatttaaataagtttatatattcaattcttcaaaatcttaaagaaaaatttcaagttggcaaataataactccataaaaaaataaataatcgatataaacacatgatggcctaagctcgcgagccaaatcaaacggctcgcgagccagctcgggctcggctcgtttcaccaacgagctgaaa

SEQ ID NO: 53045 - DNA, 965 bp, Oryza sativa
  unsure (1)..(965): unsure at all n locations
ataggggagcccctgatacgcgccatgagtcacagtatagctgctctagtttagtagcaagagaaactctacggtcttgacatagcacgagttgagttcaacgaagcgagtttctgaattcggcatatccagctcaaatggtgatgaatcccggagttcacaataatagagaggtagatgctgcacctgatcacagctgattattagttgatcaagatcttgttcagaaanccctgccgtacacaggaggagtttcgtgaggcaacatgacagactacgagatatattaaaaaattccattaaggctctttgcatgcagcagcatatcactagacgtgcaatctacactccgcttctcagttgtgatcgcaagctccacgctctttcttttaccactgtcaatagcattgcaaactagctcaccgatgttaaacaaataatctaatgatgtctccaaatcagtgagcaagcagaacctgaggtttagctttttaatgatagattcgctccgaggagaaccaaataaactgctcatcaatttaactagaacagccatcgcttcatcggccgacattgaggaattttggtggatgaattcatctgcatctaagtcgacatcagagagcaaaagaggcaggtgcttccaccgtgtcgacaggacactggtccttagaactgtgcgcatatcaactctttctaggatagagagtaagatatgatccggcaattggttgaatctaccttggtcctacaccaataaagtgctcaatcatttaaactgaagtttaaaatgttctcttaattttacaagaaatactaaacatataaaggatggtattaggtttatttacactggaaaaactactaacaaaaattactaacagagagagggaaagagacttacatagctttggatgctattggactgcatgactactgacaatggggcttttccactcggatgg

SEQ ID NO: 53046 - DNA, 6820 bp, Oryza sativa
  unsure (1)..(6820): unsure at all n locations
nnnnnnnnnnnnnnnnnnnnnnnnnnnnnnnnnnnnnnnnnnnnnnnnnnnnnnnnnnttcattttctgtgtcttcgttatcctcagataaatgtttggaatcactaacagcattggtaaattcccagacattggaggatgctattcgtacttcaataaactcaatgccgaaggacagttaatcggtggattggggggcttacaataaaccttaccaggacatttgaggggatgaaaacctgggggcttttggattgtaaattggaaaggccagggggatcatcccttgttacaagggaatcagtgtttggtcagagagctgaacttctaggaaggcatttatcggaaatatacacaaatgtgctcgagtcaataactgtgaccacatcaaatagtacactcgttgcaaaatctgttgaaaggttggttgatgcaatcagaccaaatttatgtcatttggtgagaaatgaatcaaatagttcaagtgagtttgtttactcagttataggaaagcatatctctaacaaacaaggtgccaactggcagaagatcccaagtttatcttggctttatgtcttcttttttcgcatatatatgtcatgtagaagtttgtatctgcaatctattggcctcatgcctcctgattcagcgatagaagcaacagaactagtggggaattcattcgttgtatgctgcgggaaggaatggaccaattcagccaatattctcgcagaaggctactttgcttggattgtccaaaattcattccctctttttgatgctatcgagattttaacacaatctctttcgagaaattgttctgggtttactctgcttgttttcatccttcatgtgatggctctgcagagactaaatgaccttaacaggcagattaatgcttttgattttttgcttgaagatgatacagatcaatttgacaaggagaatagtgaaggcattgagttattaaagaagtctagctgtctcgaggccacacaactcaccagttttatgatgagctatgtgagactattatcatcaggagaacccggctctttttggtgttatgagattagttcttcctgggattcaagtctatgctctttagatgaattttcatttcctatagcaacttggcaactgctgtgtgaaaacattgatatttggagcccccatgcatctaaaaaggatttgaaaacttcttttctaatctgataaagtttgcttttgttgaaaagaggtcatgcaaagatgtggagaatagtgacagccaatcttctcaccgagaaattactctttgtaatgtttcagtgcagctcctttgtgatactattatttatgacagaaaggtatgtcctctcttaatccttccaccgaaagataatataggaccatttatctatgatttattgagtatgatgccaatattgatgtgctgtaataatgaccaatgttagtctttagttctatgtgttggtgatttctttcttgtgccctcgccaaattgcttggtctaatgcaaacttacaacttcttaggttctgttgaaaaatttggtgtcaggtttttgccatgctctgaagaaatcggtattgtcttttgttactgatgctaatgaagataatgacttgttggactcgccacctgatttggtggatatattaactaaactggaaaatgagaagttttttagtacaaattctgatgttacacacacaaatggcatagataaactatggatttgtgagaatttacttaatttttttagtacagttcctggatttcatgcaaactccaagtcattgttgcaacttatagcttacattctccatctggaaaggtaagttcgcattttatatttttgttcatgtgtactaactacaatggctattccttgtataatcatagtacaaatgtatgcacgccctttgtttataagtactaggcacttttgactgagagtagttcacaaatagttatcacttgttaatttccccaatgcataatttttcatgctatgctctatatcattgccgttaattatttgtctcatggcagtaattggagggcacaaatgtgaaacacttgagacttgagagaaagtgtccaatgtttatttgttcttatgaagatcttggtggtctttttagttgaacttcttgtttattacaacttaatttctttctttgtaaataattgtttctctgggttatttctagtggattttgtgttgtctttattgatattggggttctctagtctttttcagtatttcctttttgttaataaggcctatgatcagtttttgatgcaacgaattgtgatggtgaactgcgtgcatcctagttagtcaaaatgtcctgggaatctgtattgacaacaattttgggaaagtgcatggtgatatgcacattgcacatttcttagctgcaactgaaatcttttggttatctccttgctgagaatgacattttttcaattttcttgcagactgctgctattggcaatggtatgccatcgttatgaatcttgtaattccatggggctacttcgtctgtttgtatgctgtcgaagagcaatgaaaaatcttatcttcaattttggtaaagaatttccagagttgaagcaatactcagcattttccaaaatttttggtggctcctgtctgatttggcttttgaggtctgttcaggaacttgtcagtttgtcacacaaaatatttgaagagcacactgttgagatgaaaaatacaattttctccctggtagataagacatcagaaatattttcaacactaactaacatgaattctgtattttacttgttgggtgcaaagaaacaaatcatatcttccagcggagaaagcagtactccaaaacatgatgatcaggcattcagcatactagaaaattcagctttggagcatgtcaaaattatggctgaactgttagagaagtctacaactggcattcctgtaactgttaagggtagtcagtgtgttatcaaattagagaactgttatgacactgtatgctgggatagattattatgcaccatgtcttgcataagaggattcttggggggtcttatttcagcactagaaggcacatgcaaagattatctatcaagcccagaggaaaggaacgtgatgtttcagtatgcctccagattcagtgggtgtgttgctaagttgaggcctttgtagatatttgcatgcatgtcttgttatggagaccaaggattgcgagttggctgatttaatctctggtcatctttcacaagagctggactgcgagaacaactctctgatattacttgcatcatggatgaatggactaggcaccaaccctgaggagatcggatttcactcagatggtgtactaaatatttcaactgagactcgtggttttgatctgcccaaagtacaatttgtgaaaggatttcttttagaaaaagttttaagtggtgaggggccatccatagcatttactttaagggagctctacaatgcatctgctgctattgttaagctgaagggaatcctatcatttccaagtgaggtatgtagacatatatgcagtcctttccaaaagcttccattgggtccaatggttgagccagcttacatcgctctacacaaattagcagacatgtctaactggcctgacatgttttctcttttatggattgacggaatattaagttatcttgaagctgtaggaaacattttggcattacctgagatcaacatgtcaaaagaattgtacactcaagtagttaatgctcacttgagagctattggaaaatgcattttgcttcaaggaaagaatgcaactctgcctacccatgagattggatcaagtacaaagacactatatttgcagaatagatctggtcatgttgttgctaaaggtatcatcaataggcagaacagattaaattcactgaaatcaagacttagactatcactgggaaaatatgtcaatgtttcatcaaacatgcatctaaatacagctgtgcaagtcattgaaagagcattggttggagtgaatcgtttcagtcattcaatatatgaaataaacacaggaaattgtgatggtgggacagtttcttctgatgttgcggctgggatttattgcctctatctggttcttgaaactgtgccaggttagtagacaattttctgtctggtacttccagattcactatgtttgtaatgcaatgtggttccatgcactgcttcaaagaagtcaataatctactaaatattttcaaacatgatctcatgtgcaatagaattgtctgccaacactgagtgtgtttgacaataccaaaaattatcatgactaatctgtcttttcaaatatatgctcaaacaccaactagttaatatcaggtaataagcatggtcctcataaaatatatgtaggtcttcaataattaggaatttttcacagaaatgcttgacacactccttttcatattcatggcacctcttttggtagcatattaatatgctgtcggttcttgtcagtctaaataaactatcgcgttacatggacattgtccagaatgcatgaattattctcaactgagtggagtagttgagcaattcaggatggacctacttctaccagttcacctccacctgctgaccctccaaaatttaactgtgtttgcctcgatcttgttttgctcatatgtatgcgtataaggatttggcaggtagggcctaggactagctgttgggttattttggaatggagacaaatagttccagtccagaaagaccaaaaaaggtggaggggggggggggggttgggattaaacacaaggggtgtcagaatcatacatgcaccaggtcatgttcaagtcctatcaacttgcaccaaaactgaatggatttgtcggcaggaaaaagatttatctggtattgagagttgagggatgagctttatatggttttgagtcaagggatgatgattaaacgacactaagagttgaggacgaaaagtatatgttcctaaaagaaactgttgtatgatttttcctagagttatttcaaacacaagtcttgctagtgtcattttaaccacatgtccgcagccccttgcaatgcattatgtggttatcctacttcatggcagcacatctctttagaaaggattgtttttatacttgttttgactgattttcaacttatattgcaggaaataaacgtgtttttaagagaaccgtcccaggcctaattggtgctttattcaatattgtcttacatcttgaaaaggcttttattttctacacagagaggatgcctgttcattacccttatttgcacccagatgctggagccattgtcctaatgtgtattgaggttataccagcatttgtggggagacattcttttcaaattgattcatgccatgtctctcagtgcttgcatgttcccatgacactttttaagggccttaaacatcttctttcatgtcggaatatgccccatcttgcaacaagagtgaagagcacctgcagctagtaatgaatatatacttgatagacatttttcagttgacatgtatgcttcatgttgcaaattgttatgcactactattcgacaccaacagcggtaaaatattttgcctctcgtattttcattctgtagttatatattattattttcattccatattgttatatttcctccttttatgtctagtgaggttgcacgatgcgtggctgtcctggaagattcagtaaacatacttctaagttgtttggagtctccaaatcccaaaatggttagtagggccggttatttttcttggaacatggaggaatcaatgaaatgtgcttccttttttagaaggatttatgaagaggtcagtgatgcttatatttctgttatttgagatatatgtatcaatgtatactccctttgatcacgtttagtatgcgatgcacctactccaccattagccgcaacgtaggatgttagtatccaaaaaagagtatataaacatgaaccccgtagaagaaatggccctgtggacaatgtataccatatatatttaaggttggtaagccaacaaatcatatgcacactaattatccttttttgtggacaatgtagatgcgccagcaaagagaactcctaggaaagcactcgatgtactttcttgcaggttacatttctatgtattctggacagggtccatttcagacaggcataacacggtatgcccttcctaatgaagctctttcatttatgctttggatcagcaattttacttttcttacatcgcagagaaattgatgaggccttgagacctggggtttattcgcttatcgatatctgcgaggaaagtgatcttcaactgctccacacatatctgggtggtcagtaactcctgcttaaccttttcttaaaatgcttaatctatttacgaataaacaaatgtaactactataaatacaaactgatccccaagataattccttttttcattctttggctttgcagagggtccatgccgaacaacttttgcaaatctggtgcaggactacaaattacacttccagtatcagggcaaaatctagtcaaacttgctaaaggctttttggagcatttgatgttgatccgtcttattctgcataagatatccaatgcatcatctgcatgatcttgggtttgtgcttgtactattaattgctgactgcttatgcactgaattttcacccttcagaacggaaagggaatatcgctgttgctgaaggttttcaatctacccttttaacttaggagccaaacaaacaggatggg

SEQ ID NO: 53047 - DNA, 3156 bp, Oryza sativa
accaaaagctggagcacacacgcgcacacagtagccactatcatcggataaaaaagagtgtctttgctaagttgctaggccacagggatgaatcagattcccacgatgtgttatccatctccctgatcatgactggacacttacaacctgatccacatgtgtgtatgcaccgcactgtgcaccaggtacccttgggattttgcttcagcttaatttcggtttgtagtctaacctctatgaagcaattggccaagctcttgtgattgatgtcttatctaccccaagcactgccttaatcattcattttgtcgaataatggttcccgtattaaaaacgtgcatatagtttggacttaatcgttaagctattcgttcctctcttttttgggttagtggaatgtgatctttgtgtcttatactttggtgccaagtatatatatattgctagttcacctggaagtttgcactttgcactttgaggacgtgctgtaaaatccctctcctgttttttgttgggaaaaatataaaagccactccaaatattatcttaggtttgagattcccttctataagacaatttgttgcaaatatctcttcctaattcccttggtttgagattctcccaattaaaccttgttgggcagtgtgatgagtctccatgcttgaacatcatggttatcgaaagatgggctgttgcgcttgcctcatgaggaagggcgactggtttctcagcaaagacgacgaaaataagttttggtgtgaagctgttttgttgagaaagatgtgctaaggcctggtttaattccctaatttttttttctaaaaacatcacatcgaatctttagacatgtatggagcattaaatatagattaaaaaaactaattgcacggttagagagggaattgcgatacgaattttttgagcctaattagtccatgattagctataggtgttacaataacctacatgtgctaatgacggattaattaggctcaaaggatttgtctcgcggtttccaggcgagttatgaaaaaaaattttcatttgtgtctaaaaatcccttctgacatccgggcaaacattcgatgtgacaccaaaaattttcttttcacgaattaaacggggcccagttatataacacatacagaaagaaggaaaaagaaagtgaacctagggaggaatctcaaactaaggtatagtttttcaaaaaaaaaagaaaagaaaaaagtttgcatcgtgggttttgacttctggcaacatctttgcaatggatgaaatttctcgttcattcgttgaatatctgtaaaatatttgcagcatcaaccagaaggagaagttcatggtttccccactaacaaaagagcagatgtgttggtcaacctgaaccccacgagttgacccaaagtatttccatgctcaacccaacccaacatgcaccaggatttcctctcccatcttcgcatgcgcaatctgcaattctccccctccttttttttcccatcaagatattgttcttgatttgttagttccagttttgtcttgcagccatcatgaggcttatcttcaaccatcatgtttttacataggatgcacaaaaaaggctagagcttcctggaggctccatcctctcttttgtaccctttgttgctgactttttggccctctaacctgcactactactgataccagttgcaaagctcttgcctccagtttacattgggccacgtgtgccaatgccttgtcactcctagtcagcacacttctcccactaaccagagaagtccaagcacaaaagttaaagcctctcaaatcgcgcgttccgtgcactatgcaacctcctaatccatctaaattatgcacaggcatcttcagtcataagcccgtaaccaattttgaattttagtatgacttaaaagttcttttcattattatttttgccactcaactttggttctagaagttagaacaacatggagtataaagtttatcataaaatccagttttaccaccaaactattttccactacttccattaagataagcagtcatcatcttcaatctctcttgggggtgatgaatgttgtgaaatcccatgaattccattcaaaactcaacaagggaacgcccgcaataaattcaaacagttttctgaatgcagcaaagccgcagcctcaaaaaaaaaaaacgccttgccatgcataaataaagtccaatggacacttaatatctgcacaggagatcagaggctcacgtcacccgatctgtcatgaggagccagagtcctttggtcctcagagcaagtttaatagtataccctattactagctctatagccaatctaataactaattcatacaatatttgcttactatactattaatatatggtcctacctgtcatacacatattgcgtcttagagttcatgctgctattctctttaatcttttactccctctgttttttaattgatgatgtcgctgactttttctcacatgtttgaccattcgtcttatttaaaaattttatgcaaatatataagatacaaatcacatttaaagtactatgagtgataaaacaactcataacaaaataaattataattacgtaaattttttaaataagacgatggtcaaacatataagaaaaagtcaatggtatcatctattaaaaaacaaaacggggtagtatttcattaagggggtgtttagatggggctaaaactttttagtccgtgtcacatcgaatgtttgacgctaatttggagtattaaacatagactaataaaaaaactaattttataaatgaaagctaatctgcgagacgaattttttaatcctaattaatctataattatgaaaagtttactgaagcatcacattgtcaaatcatggtgtaattagactcaaaagattcgtctcgcgaattagccaaagggtatagaatatgttttataattagtgtatgtttaatacctctaaattggtgtataaacatccgatatgataagtcctgtttcccaaacagaccttaaaatatacatgctctcaccggcgagaacacccgtcacccgtgccgtcgtccaattattgggcccgtgtcccgtcagaaatcccgcacgccacgccagagagaaccccaagccgccacccgcgcgt

SEQ ID NO: 53048 - DNA, 1374 bp, Oryza sativa
  unsure (1)..(1374): unsure at all n locations
gaaaaaaaggcagggaaacgatggcattttccgcccacggcgttgcgttttttcttcgtgttgtgttgacggggggtgaggcgtgtataatgctggtaatgttgacgggttaggggcgtacgtgtgcagcgctgcagccagtcgtgagggcctgaggggcgctacccgagcattgtctggtgtgttacttactgattgggcaggtctgggccccggtgtttagtagggcttgggctcggatggtaagctttagtttgggtagaaaaatagggtcactcactctgacttattactatcttctagaagtgcagattatcatcggagtataaatgcaatttctatactaacgtaaaaagtagtagtggtggtggtggcgctaccaccatcctactaccatatggaacccataaaatatgatataaaactttactggtttcttagccttcatatgttagacctggtcgaaaataaaatatgacaataaaaatttatagaatttttcatctttatgaaatgatggcaaaattatcacaatgataatatattagagaaaaaaaccattgcaatgcatgggcattatactagtgatttaaagagttaaaaagtggcgatttcaagagttcgataatttcatattagaaaagtttcgtctatggctacataggagagggttaaccagatctactacctccattcgactttaaatataagcatttctgattatacaagctttttgtaccattttttacattgaacttagtctgggtacttattcaaacattttttgtgaatgaaatcaacatgagattgtgctatttttaatatagtagaagagaaatacaacccctgagagtaagttatgcagaatttagtataagctcccgaagccgatttgctccaaccgaagccatcttcttgctttctcctttattttcaccagtaggctaggtgctcgaaaactcgctggtttctctttttccagatcccaaacaaccaagagaatcagggcacgcaggtctttcttgggcacttcttttttgttggccagcatcttacaccaggctcgaacgttacaactgttgatatgccacccaggatgctattaggcttcgaatccttctattatatctatattggacgagtatgtggcatgctgactttattaaaacagattcacccatataaatatataattaagctagtgaggaaaggtgaacaatattattcttatctgctcccacttgtttagcctacaaactcttcctttggagcatgtttcgaactcaagacatctttttcgaaatgagaaaaatatggatnnnnnnnnnnnnnnnnnnnnnnnnnnnnnnnnnnnnnnnnnnnnnnnnnnnnnnn

SEQ ID NO: 53049 - DNA, 919 bp, Oryza sativa
agcgtgagcggtccaagaaagcagctggtttaggtaaaccgttctctttccattttatgtggctttgacaagcatagcgcaccaggtgatatttttttaaataaaaccctataggaaaatcaccttatttactagtgaatttggttacatactaagccagataaaaaccataagaatcggtagcatctttttaaaaatgatgctcgattggtcgagaaatgatcatattatcaatttttatatgtagctaaagatagttcgattggaaatggtaccagcttcatctctcaaaaaccactcatcatgcttggaagaatagtcttggatcgtagtgtaccaactcagattcagattccagagaacatgaaaaacttggtaaagaatcctgtatgattgtaccagacggtacggtatgaggtgagtacatgctaaacagctacgcgtagtaggagtactagtcatttgtgtgcctaaattatgctattccctccatttcatatcataaattattttatgggtatattctctccgtcccattttaaacgcaaccataagtttctttgtgcaactttaatccgctgtattatttaattttttaaaaaaaataaaaaacataagtcacgtataaagtactattcatattttagcatctaataacaataaaaatattaatttaaaaaatttaaataaaatggacgatcaaagttgaacccagaaacttatgggtacgcttaaaatggaatgaagggagtacctaatcaatccttcttaagtttaaaaaagcaacatttttaaactgggataaacttgtaaatatactataaaaacatatcgacatgaatttaatgaaactactaaatgttttcatctgtttttgattaagaaatagatttacctcaattttcgttagcacgctttt

SEQ ID NO: 53050 - DNA, 1322 bp, Oryza sativa
cccataacaccgcagctaaacataataggaataagttcacttgaggattcttatcttgttatcgagttttaaaatcgtccctgaaccagaataccagatataacacatccataatcttataaaatcaggttatattgggtcccaagacaatattaaggtgactttggatgacgtggcgctataagaaaaataaaaacccatgtgagatttgtatgtcagtgaaacaatatagtattcttcttatttctctccccatccttcgggtctcgagtctcggcggcgacagatgtggcggcggcgtgcggggtgaggagatggcggccggtgtgcggcgtgcctaacgacggcggcgaaggaggctcaacagtcggcggaggcacgccgcatgcaaaccgagcatcgacgtcgctcgctcttcccgcggcggagtggaaaggaccgcgaccaacagggagaggagcggcttccacggcggattggaaggcctcctagtctcctcctatggcgtgctcggtggcggccgaactaaggagatggcaaagcccatgccacgcacagcggcgaggaggacgtacgtgcccatggcggagacgctgaaccgcatcgtggattggttgccggactatgacgcgaaggggaagaagtggaggcggaggacgagtgtaagttattttagaagacagagatccctataaggattgtgaagcaatggacaatccaatttatcttttactacctccgtttcaggttataagacgttttgactttggttaaaatcaaactgcttcaagtttgactaagtttgtacaaaaataatagcattttcaacccaagacaaatttattaagaaaatgggagcgaattttccaggatttaatagctttgtgctttcagtggtaagtgacgtacctgtctacagcgaggcgtctgtggtgacttcattaatctccaggatagatttgccagcccagtcttcgaagatggcaagatgctcataggggtatggtttgcgtgtgtgttgtgagtatctgcgttgtaccatgtaattaaaaaaatattaatttaataaaactaatttaatattataaatattactatatttgtctataaacttgtatttgaagcacaatgatgtgaaaatctatgtctcgggaataatgatgagaaaagcacaatggtgaagcaacgcaaagctgggatcaatcgccctgttgaaataattttccgctaacaaagaatggattctttgctattgggtacactgtaaaacagattctcgcaccctgtaaaaatgatgatttttatttttcattcgatgtgta

SEQ ID NO: 53051 - DNA, 1202 bp, Oryza sativa
ctaaattgcctgacagatcatcataagtagtagctacttttgttgcaaaacggcgttcaactcttgcattcatctgcagaacaaaggactagaagtaagtagtagttgctagcacaaagaagctactctattgagccccttaaaatttcttgtatatcattttcttttcggcgcaagctagatggactaaaattaaatacaaataagtaattttcatggcattactgttcccgacattgctttcctatacgtccaggcaaagcttgagcaatggttaaccatttcttcggtccaagtttgtttaccatctgaacaatgatctcatcttcctgaaaaggggaacatgtcattgtgagtataagatgactaacccatattatataagaaatgaaaataaatggactagcatgcttacttctttggaccatggcctttgaccaatcagggtgtagaaccttttaattgccacctgtgcaagcattgtacatcggttctattcgcaagctggaaaattagaaggtcctctgtcaaagcttggatttttaccaatatacaggaacctcatcaacagggtaggaaaaagaatgccagagaagcatgactagagtgtaagctaatgaaacagcacaatgctttactgtacatgagttgtgatagcatcaaagagggtaaaaaaatgcttgcgtggcttaagatatcctactgcactgaagtactaaacaattgtagcgcaaggtgggcttgagaacaatatggtaaaaatgtattatatatcaagtataatattgtgaaatattactcctgttacaacctgacatgtattgacatataactgtatgtaatcacaaagctaatgtgtaaaaattaaaaaaaaaatccaagggagtccaacatatgcatggtaggctatataaaatgcagtgatatagataccaaaggtcacacttttgaaggtgctccccctatgttatttcatctctcaaaaaaaatcagtaaaatgatatatgaattggactttagaaggctattttgtttatattttccagcatacaaaaaacaaccgcaacaaagttgaagaaaaacaaaaaatatgacagctaaaagatagtagaaatactatgataaagagtaaggacaaagtatgccaaatagaaccaatgcactaatagaaccaatgcatgggtaccgagctcgaattcgcc

SEQ ID NO: 53052 - DNA, 856 bp, Oryza sativa
gaagggagctcacttttgaggaaggagattacgtgtatcttcgtgtcactccgctccggggagtacaccatttccagacaaaaggcaagttggcaccacgcttcgtgggaccatacaaaattttggaacgaaggggagaagttgcttatcagctagaacttccatccaacatgatcggcatccatgacgtgttccatgtgtcccaattaaagaagtgcttaagggtacctgaagaacaggttgattcggagcacattgatatccaagaggacctaacctatgtggagaagccggttcgtatacttgataccagcgaaagaagaaccagaaataaggtcaccaggttttgccgagttcagtggaatcatcattcagaagaggaagcaacctgggaaagggaagatgagttgaaagccgcccatccgcacctcttcaccagctcctccgaatctcggggccgagattccgtttaaggggggtaggtttgtcacaccccgaagtttccctcccaagccaaaattgtaatttataaatgaccctaagaaaataccggtgcaaatcaggagaaaaccctaagaaagtaatgcaaataataatcggatttgacatgtgggactttttcttgagttctacaggtcgaaattcattaacaggatttttagtggaattttcagagctctagaaataattgtaaccaattaaaattgagcaagcaatattttaattccagggaaaacctttttcctttttctttttctttgacctctctttttcctcctttctttcgaatgggccgccggcccattccctccttccttccctcccccttactgggccggccgcaggccgaggccca

SEQ ID NO: 53053 - DNA, 834 bp, Oryza sativa
  unsure (1)..(834): unsure at all n locations
ccgcggttatgggcagtcaaccagattcaccgtgattagtctcaccctagtgtaatcttttgaatttggatagtttaggtggatggttgggcctgtcgcaacgtggtgtagcgttggacagtggatgattaatactgcttaattattacaactgttttcgcattcaattcctgtttataaatgccagtatttatgcaaatgaacctgcttagctatcccttgtggaatccctgcatcatacccccgttccggtatgacttgctgagtacagtgggtagtactcagccttgctctattttccccaatcccagagctcgagtatgtgtccgatggcgggttctccgaggagtaggctttgtccgtgccgtcgaggatgcctgtggagtggtgttcccgctgcagttcgagtcaaggattagctccagttatcttttgttttccgctgcatttttgtaagacttttatgatgtttgtaagacgtggatctgaatgtcaacattgttgtttgtgtaccccggctggtcctggacggggattttaatgcacattctgcttggaattctattcgggaatttctgggcgtgacaactagagggtcctatttatagctttggattaaagagatcggactcttcccgcaagaaatcggttcgggaaatctaaactcggtttttggggataaaatcgaaacgaactcgattcggataanatacccaaccatttgctccgattcttgaggggaaaaatagaggaggatgagaggataaaaaccctnnnnnnnnnnnnnnnnnnnnnnnnnnnnnnnnnnnnnnnnnnnnnnnnnnnnnnnnnnnn

SEQ ID NO: 53054 - DNA, 829 bp, Oryza sativa
  unsure (1)..(829): unsure at all n locations
acgttagacgtgggtgtagaggtggtgacagcgctcaagagcacttaagtcctccctgtgcgggtacatagtagagcgacatctaggaacagcgagttgctagtgcctgaagtatcgcgttaggattaaaattaagctttccttggacactttttctcactaagaaatcctctctgccctgtgcccatatttatcttatgtccttgatgaaccggaggaagagataatcacacacgttcccttggattcgatacccttgaaatactccgtagggaaagtgctacatcggtatatccatgcgcttgcggattctatctgtgatcgtaagaaataccaacaactggcatcccgccatgcctcttgaacgatgctgacctcgatcttgtcggtgatcaggagatgcaagcctactacatgctaaaggatcagatatttgctcacacgcgggcatacgatccggagctactaaaaaagataggtatggatgttaattctcataccatttggaaagttgttggatggcagagatttgcggtggcagatgagcctggttctcgtttgcttactttacaatttcggtacactttgaaagaaatagaagatggaatttcctttcgctttttccgtaaagaatttacacttacatggaaatgattaagtacacttttttgttttcacgatgactataaaaccgtttttcggaatttctgggttcgagaaaaacagattttgggaaaaaatttttggtggtcccatttgcaagaannnnnnnnnnnnnnnnnnnnnnnnnnnnnnnnnnnnnnnnnnnnnnnnnnnnnnnnnnnnntta

SEQ ID NO: 53055 - DNA, 772 bp, Oryza sativa
ttacccggttcctggtcctgcgctccatggtgtccagaatcttcactggcctctccacgtaggtcaagtcttcgcgaccttcaatttgctctgagtcggcctgctcggatggcactcgaaggcatttcttgagttgcgacacatggaacacattatgcacgttgcccaagaggcgggcagctccaattggtaagcgacttctccgcgtcgagcagtgatacggaaaggacccacataccgaggtgcgagcttcccctttgtccgaaacctgtgtacacctcgcaatggcgtgacccgaacatacacaaaatcatccgctgcgaattccaggtcacggcgacggttatctgcataacttttctgccgggactgtgccatctttagattatcccgaatggttctgaccttcgcttcagcttctctcaggatatcagtcccgaacacttggctttccccaacttgatcccacattagcggtgtccggcatttgcgcccatacaacgcttcataaggtgccatttgtatgctggcttgatagctgttgttgtaggagaactcggcataggggagactcttatcccaggtcttcccgaaatccaggacacatgcgcgaagcatatcttctaggatctgatttagacgctcggtctgcccatctgtctgcaggtgatacgctgtgctgaaatttaatcgggtacccagctcttcttggagcttcttccaaaagtgaaaggggaactggcttcccctatcaaatacaatttttttgggg

SEQ ID NO: 53056 - DNA, 1005 bp, Oryza sativa
agggcagtgcagtaacttttccggcttaaagcgtctgccaccacattggctttacccgggtggtagtgaatactcatgtcatagtctttgattagttccaaccatcttcgttgccggagatttaggtccggttgggtgaagatgtatttcagacttcttatggtccgtatatatttcgcagcggttgccaatcagatagtgcctccagatcttcaaagcatgaaccactgctgccaattccaagtcatgcgttggataatttccttcgtgtggacccaactgccgcgaggcatacgcaaccactctgccctcttgcattaggacacatccaagtccgtgacgggatgcatcacaatagacttggaagtctttcgtcgggtcgggcagaatcaaaactggtgcggatactaatttcttcttgagctcctcgaaactcttatcgcactcagctgtccatttaaacttctcatctttcttaagcaactgagtcatgggtcgggcgattctggagaaattttcgatgaatcggcggtaataacccgcaagtccaagaaaactccgaatctgcgacacggtcttaggtggggtccatttggtaactgactccacgttcgatgggtcgactgccacaccctgagctgtaatgacatgacccagaaattttacttccgtcaaccagaagtcacacttgttgaacttggcgtatagctggtgctccttcaacttctcgagtactagacggagatgttgttcatgttcctcctcggactttgaatagataagaatgtcgtcgatgaacaccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatccttttcccggattctcaactggtgggtagcctgatcacaggtctatcttagaaaacactttag

SEQ ID NO: 53057 - DNA, 912 bp, Oryza sativa
aaagaataagtaaaatccatgtgaaagcctccaacaattaaaatgtgcaaagttaaaagtcgaataagggttggaggatttttgtatatttcctaaaagcctaaaatgcgtaaataaattttagtggaattttcagagcacaaataataattaagaagaaataaacaaagttaaagtggttttataaaaagaaaaaccctaaaagtctttttccccccttccccctcttgggccggctcggcccacctccctccctctctctcctctcccccgcggcccatcggcctcctccccgcgcgcgcgccgctgacgggcgggcccgcccgccaccctcgctgacgggtggggcccacccgtcatcccgtacctcgcgccgcacctgccggctcgcccgtgccctagcgccgccgccgccgcggattccgccgcatcccgccgtccccgcgcgcaataaagagggggaaatcattccccgtgattccctctccctttcccccctacttttccctctctctctccctcggattcgtttggaaactctcccgcaaacttcgccggcgcatcaatggcggccggatcttccgcgaccgattccccctcatgcggccgctctctcctcctcccaacactacataaacactccccgggcctccctccttcgtttccgccactcgccgctctctctccccgtcggaatcgagctcgggccgtcgtcctctctttccgccgtcgccgccgagctccggtccgccgccgtcgtcgccccgggcctcctcccgtttcggggtcgccttcttcgggttcgccgcgtcctcgccgatctcgtccaccccttcgttttgcccgccgaccgccggaacgccgccgtcctcgtcgacccgagccgggccgccgccttcctccggttcggtc

SEQ ID NO: 53058 - DNA, 913 bp, Oryza sativa
ccttgaatagtaatagtgaagatgtcccctcagtgatgttcgaagctggaggaagaaactacatccatgcatgtcaggaagtagcaagggcgccataggagagctccgtgatcgctacagtgatcggttggatgacaccgagtatcgctaccatcctcgtctaccacatggaagtgaccgtggcaggtacattgagagtgaaggcattgagcatgatgctaccacaaggcatttagttgagatgctgtgggctatggatgaaagccgtgcagagactgtgttagcggctcaagatcgtgaagattggaatcgtggtaagatttgcaagttagaagacaaggtggatcgtttggagaaggaactagccgcgttgaagggagaagcaccaccgcagaaggccaggatttgtcttaccgcaaggaagagagctctatttgtccctcgctatcaattggcgccaaaagttcgtgtggtggagaaagaagttgccccagcagatcctccggtcatcatcataagtgatgatgaagaagaagaatccaagcgcacccattccaagattgagtgggtagcaactcaagatgatgaagacgagccgaacgagcctacaatcgacctccgatgctcggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctttatcctaagtagtttcccccggtttctcttcttgtgccctgccagatggtgctcac

SEQ ID NO: 53059 - DNA, 2871 bp, Oryza sativa
  unsure (1)..(2871): unsure at all n locations
gtcatcaatgaaaaccaccacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcgcgaatacgtaattggtgatatccggaacgaagatcaatcttggagaatacagtggcacctttaagctgattgaacagatcatcgatccggggaagagggtacttgtttttgatggtgacttcattgagagctctgtagtcaacgcacatcctcttcgtcttgtctttcttctccacaaaaatcacaggagcaccccagggggaagtacttggacgtatataccccttttctttcagctcttccaactgtttcttaacttcggccaattcatttgctgccatacggtagggtcgcttgtacagaggagcggttcctggagcaagatctatccggaactcaatctctcgcttaggcggcataccaggtagttcttccggaaacacgtctccgaactctctgacgatgggaatttctgacagttctatctgatgaagttctgaactactgactgaggttgggggtgcaaagaaaacaaccggttgttccggccctcggtacagagtgacagtgcgtctcgcgcaatccactactccttggaattgagccaaccaattcatcccaaggatcacatccaagttcttggtgcctagcagaatcagatccgagggaaaaggaatcccctgaatttctatagggacggcagggctataatactttgctgtcataacccctccaggggtggtgatgagcagagggtttctaagcctttctacccccaactgatttctccccacgaatggcacagatataaatgagtgggaagctccagagtcgaacaaaatggtagcagggatggaatgaatgaggaacgtaccaacgatgacgtctggagttgtcagcacgtcctcggccgtcacatggttcacacgaccccgaatgacgtccttaccaccgttgttggggcggggaggcgcttggccttgctgacgccttggcttcgggcatttatccgcaaagtgcccgggctcgaagcagttgaagcacagacgctgcggaccttgagcgtccctgcggccttgaccaggctgcacagtcggtggaggaggacggggcgcacgagtcccttgttgattctgctcctgctgcggctgtgggacgcgcaccacgaattgaggtcnangcgcggagcgaggttgctgctgctgctgttgctgctgcgaggaggatccccctggatagggattggtgtagcggaccctttggttagcaccctgttggttgtggaaattcgccaagcggcgcttgtgcgactccagttccttgtgcttggcttccaagcggatgctcttgtccaccagacgttggaaatccggataatccccggagactagacagacggacagctcagggtccattcctgccaggaacttctcttgcttctcctcatcttcccgcacatcctccggagcgtaacgggccaggttgttgaactcgtgcaaatactccatcacggagcggttgccttgcttcaactctcggaattcccttttcttaagggccacgactccggcgggcacatgggttctccggaaagcggcggtgaagcgggcccatgtaataggctgtccctctggctgcgtagcctggaaatggtcccaccatagagatgcgggtccctgcagctgatgggcggcgaagatgactttctcctcatcgctgcactgcacagtgtctagctttttccccacggcatgcaaccaatccaacgcatccacggggttgttggagctagagaaggtaggtggacagatgcggaggaactcggcgagtttagagtgttggggaggtggtggtggagcattatgttgtggcggattttggaggtggtggagaaaagcagtcatcatgttggcctgctgggcgaggatttgggtgagaatggcgttggtatctggtggtggtggtggaggcggaggaggaggtggaggtgggctgccatggttgttgtggttgctgccttcgggttggttgccatcactggtggcagcatttctcctggtctcaccatctgaaaaccccacacagaaccagcaaacagagagagctgacaattaaagctaaccacccacgactaccataattcttgaatttattactgctattaaattggttcattaaagttcaagttgcttaaacaaataaaataaagacaggctccgacacagttatgccacacaccggcataaccatgccccacacaacccaacaagaagacaaacgagaaagaacacacgtgcaagcctactaactgctcgtctactgctgcgacgggccaggacggaaggtgagcaacagcgcatcctccgtgctaccaacgccggaggcttcccccttctggggaaccacgggcgtgggctcggcacgaggggtctccacgaagcaagtccacgccagggactgacgaacaagctcgggcctggaggtgctcttgcgggcggtgatcttctggctgcggcagacgcggcgacgcttggggcggcagacctctccctgggcgatcttgagttgatgcagctgcgcctccaccgcatctaggtcctttttgagctgcaggttctcctgacgcagctccaggatcttcatgttgttctcgaccatcccacgacgcaccatctgatggaagtcgatacgagccgcgtcgtacgcctccaccatgcgcgccaggtgcacgatggtagcgtcatcctccgagctagcgtcccggaagg

SEQ ID NO: 53060 - DNA, 3119 bp, Oryza sativa
  unsure (1)..(3119): unsure at all n locations
nnnnnnnnnnnnnnnnnnnnnnnnnnnnnnnnnnnnnnnnnnnnnnnnnnnnnnnnnnnnntgctaacaaaaaagcttggagcaactaaatagccagggtggatggaataaggactttcgtgagcttcctgaagtatcaactgtttaagttctctgttatctggaacgcatacccgatttccgttccatagggttccgtgttcatcctctgtgaaaccagcggctttaccctgtttcatattcttgaggagtccatgcatgtctggatcattcttctgagcctcgcggatttgatcgagcaaggtaggcttggtttccaacgcagccaaaaatccgcgactaactatgtttaggttcagggctgccatctgttgattaagttccggtggaatgccacggatgttaagagtgttgcaatggctttttcgacttaaagcgtcggcaaccacgttggccttaccaggatgatagtgaattcccacatcataatccttgatgagttctaaccatctcctttgccgaagattcaggtccgactgagtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccatcctgcatgagcacgcaccccaatccttggcgcgaagcgtcacaatacaccatgaagtccttgcgagtatccggcaagattaacactggcgaggcaaccagcttttctttgagagttctgaacgccttctcgcattgcgggctccacacaaatttctcttctttcttcaacaactgtgtcatgggtcgagcgattttggagaagttctccatgaacctctgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcgacgaaggcccagcacacacaaagacaaacgagaaacaacggaagactagggcgacgaccacaggcgcttgacggcaggcacgagctagacaccaaagccttcatcttgcaggaactcctcttctgggtttgggaaaaattgagcaagactgagtacaaccaccgtactcaacaagacacacccacaagtgcagaataaatgcaagggagtacaagggagttataatataaagggttagggtttgcagtaaacagcattaaaagacacttagttgctcaaagctattttgtaaacatgattctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaactttggtacattgctcggcttgcccataaccgagggcgcggctattcgaatagattatactctgatcagaggtgtagatctttacccacaagacacatcttcctcacatgtaaccacgtgccacataccaccacggtatacagacggaagacatgacatagtttccaacccatcctagccatagacaagagtaccgacccaatcccacctacggccggaacacccgggacaggcaggcaggactgagcccctagcaggaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaagccaattccacaataatccaacagttccacaagtgtccaggtgatatgaatattcccaaagtctagagttgtaaaaccacctaatgttacctaattaaaagcgaagcatctacctaaaatcatgctagtggtaccatgagtagagtgtccactagttggggttttgtttaatctagggtgaacaaagaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttctttatttaaattttaatttaaaaagggtttattgcgtcagccgagggggagggggtgcgcggaccgggtccatgggagtggggcccacgcggcagcctcacggtccacggtggaccgggtgcaccctggctcacgccggccggcgccgtgggccccacacgtcagccgcacccgagcgcgcgggcggctgacagccgggccccacgcggcagccactcggcgcgcccgagggcggccatgccggcgcggtcgacgggaggcggcttccctcgcccggagaccatcagctcggcggagcggcggccgagagaggggagggaagggggaaaggaggcgacggtccacaactcaccccgaggcgacggcggcgacggaggaggcggccagagcg

SEQ ID NO: 53061 - DNA, 1404 bp, Oryza sativa
cagcatttagcaaacatttcagaatttaataaaacagttaagtaataattaaacaatattaatccaacactatacaacataccctgttgtataggcccaaccattctatacaaccataccggctgcacagttctatctccaaaccaggaatataccattccaaaccaggagctaatcaaattattaccaattatagcatcattcactaaggcgagaagtgtgaaactaatcacgaaagacactgttagacccgcccataactgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccgttcctggatcataatcacccccttataaacaaggcatggactccccagcgacccccgtggacttctcgccacttctcagtctggcgcactataatgaatcacgctatacaaaagataaagccgttgcccacgctggcttgtggtaggcatgataaatgtttcacaaccgaaacttgtgaaccggtccttaattgtcatgagcacaaccatcaaaaccatatgctcacaacccaccttaaccaagttttaattatcaattaattaacatcgcactattaaccatcgtgagctaccatttaatgtaaccataattaataataatataacataacttataattaacccctttagtcaactaatgtttctaagcatagttaagcaaacttacatatagcatttagttgaaccaatccaatatataaggttcaagctaatcaatttattacccaaggtatcaaggaatagggcatccaatacaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccagcgcactcacgaaccttcgcaacgacggaaacgacaagctaacacgcaaaacaaagtaaaagactaataaaaaccaaataaacaatacatataaaataaacaaacatgtagaacatgattttagatgaattatgagacttgaacggccctattctgacttcaaatgaatttaatatgaattttacaagattaaatctaattaaagcccattaaaaagaattaaataaatttaattcaatttatggacaattttaatatgtagatctttattttagaaaaatttagcaacttgaaccacctgaaacgaagctacggttattt

SEQ ID NO: 53062 - DNA, 916 bp, Oryza sativa
gacttttagggtttttctttttttataaaacctttttaactttatttatttcttaattatttttttgtgctccgaaaattccactaaaatttatttacacatttcaggcttttaggaaatatacaaaaatcctctaagccttgtttgacttttactttgcacattttaatttttggaggctttcacacggattttaattattctaggcataatttaaaggatatattttagggtcgttttgggacgtgacaaatctcaatgacaataaagagaagagacagtggacgggtcgtagaggagtataatcgcaacgtttgacgggacatctggaaattataaaaacgaaaccctatatgacaataaactctaaaactataaaatccaaattttaaaggttccagaaagaatgaatagaaatagtgatagatcgagtaagcaaataaagaaagagatgacataggaggtagcaactggtgtgacttttaaaaactatataattagaaacacgaggatgatactggtgtaacttttaaaaactatataattagaaacacgaggatgataaggtttggtctttcaaagtcttaagacaatgagatagctatttaataaattttaagtagaataatactaaaaaatatatgattttgtttgggtgctagccgcgcaattgcgcaggccacccaggtagttttgaggtatgtggcaggtactctgaatctcggggtggaattcagaaagaagcaacaacaggttcctcagctgaatggctatagtgacagtgatatggctggggatattgatgatagaaagagtacaaccggagttctatttaaattgggagacagtttgatcagttggcagtcacaaaaacaaaaggtggtagcaatatcttcgtgtgaggctgaatatatag

SEQ ID NO: 53063 - DNA, 703 bp, Oryza sativa
aactaaacaaacatgtagagctcaattttagatgaattttgcaagttgaatggctcaatttggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagcgggacaagggcgccggtccaccgtggaccgggaccaccaaggcggtccaccgccggtccacgggaaccgatggcccggatcggcccaaaccgatcgagcggccaggggcggcgcggctggggcacagcacggcacaaagccagctggccaaacgacggcgcgcggcggcgcggccacccgcggcgacggccggcgacagcgcggggaggagaggagggatgctcaccaagggcggcgacggcgagactacaacgaggaagccggcggcgggctcctcggggaggcaacggtggtccggtggcgtaccacgggcgcgaggcggcggacggtgaccgggacgaccggggcgcggagagggcgatttcagtggttcccggaggcgagaagcggtggccggggtgcggctcggagttgccgatccgagggaggaaacggcgcagtccggcgtcgaccggggaggcgaggcgac

SEQ ID NO: 53064 - DNA, 826 bp, Oryza sativa
acatgcaacaatattttgggaccgtaaacagttttaattcaaaaacgtttcaactacaaagttgtaggtcgcgtcgagggctacaattttgatataaagtttttcttcattagagttcacatgaaaaagttataaattattttttatataaagtttttagaccgtcctgtttagggaccggggtgacacaactgaacaagttgaacgacctaaacgagtgatctgcaagtttagggaccgggatgacacagtcgaacaagtttgaggacctgaacggtcgatttgcgagtttagggaccgggatgatacaacggtacaagtttagggaccggtgatggacttttttagaggctgtagttccgggggggcattttcctttgtttgctgtgaaaacaatcataaaaaggagagaaaaggtattttagcatagtgaccctattttgatatgatagtactacctccgtttcaggttaaaaaatgttttgactttagtcaaagtcaaaccgtttcaagtttgactaagtttatagaaaaaaataataacattttcaacccaagacaaatttattatgaaaatatattcaattattgatttaatgaaaataatttgatattagaaatattactatattttactataaatttagttaaatttgaagtagtttggctttgatcaaaatcaaagcatctcataacctgaaacggagggaggaacaatgtaccgaacggttttgctaaaaaactggcaacagttttatgtggtttcccgcaaaaaaaaaagttttatgtggttgaaacttttgaattttcaaccgttcgatggact

SEQ ID NO: 53065 - DNA, 2618 bp, Oryza sativa
gactctagactcttctttcaatatttcttatttttaatatttaatttcaattattggtaaattgtattccaatattgactctagacttctttttcaatatttcttatttttttttaatttcagttatttctaaattgtattcctatatggacgctagacgactcttctcccaatcttttttatttttaattttgattttttgtaattctaaattgtatttctatatggactctaatttctacttttagtttttctattttttaattccgaattttaattaattctaaaatggatactagtctactctttcaatatttcttatttttaattccgaatttcatctatttttaaattgtattcctttatgaactctactttttctttttcttcaattagtgtgaaaatttctaaacggtgagagcaaacgtggtggcttctttttttattactttaataagataatagatagatagatgaatataaatccgacatctatattcgcatgtgggtatacgcaaacaaaggttataagaatgcttagagtccaaatctcataactgagataaacaaatggaaaacaacaaaatagaaaacacgaagcctaaactttgatctttccctgtcgtgcttcaatcttgccccttcgctctgtagcaacagagatgtgtcacactacttagaaactttggtgtcagaattatcttgccaggtacagtgattttccgctgcctgacgaatcctgcaatagaaaattgcacttaggcaatctcgtggagcagccgccctcatgaagctccccaacttataggcggccaaatatgagaatggggagatgcggaactagcccgccgccgatctgtcgtgcctattccatcccattgtcactttggccctgtttagttccaaagtttttttccaaacttccaactttctgtcacattaaatctttcatacacacgcaacttttcagtcacaccgttctaatttcaaccaaacttccaaacttcagtatgaactaaacacagcctttattcttttctaagccgccagcggcaaagacatttctacaatgatgcacacaaacatcaaattttgagtttaaaaataagaaacttgaaatagaaattagaataaacctctcacgatgaaattgtaggatcgaacaataagagctaagcttaaaaaaaaaaagggtgaatggtggtaacacgaataactgaaaacttttagcgagattaaaagttaactcgaagttaattgatatccttgacacaactgccctgctgcgcctgatagaagcccccttgcttaatttgcacagctgagatagcaacgctgctagcgcatgatgagtctaaatagactcgcatcagaagacgtcgccgatccgcccccaagcgcgaacaccttccgtcgtctgccgtccatcccaacgcgagaagatgcgtcgccgttcctcacaagagtagcaagccagtaagactgtaagagcaagtgagcacgttcgattgttgcttgcttgctttgtgtgattccttgttgctggataatggaaccaattacagtaaatctaattggagagtactctccaattagtcttaaccagagacacccacgtgctaatactttaggagttttggttgctattaatccattgagcaagtagggaaaatattcctatcatctatgcttcaaatataattttctcttaaattactcatccgatttacaatccgattacaccgttgtgttcgtaataattaaatctttacaacaagatctcacataattatattttaatgaaaaatcacaaattacttttatgatatgtctaaattacttttagattttactaagttacttcttagacatataaaagtaaattcagtaaagcctaaaagtaatttacatatattgtagaagtaacttataacaaaaagtaagttacttttagatttgattaaaatacttcctatacattcataatgctatgaggtgattacttttattatttttgtagttaattccataatttatgctgattaatttaatttctagatagagtcatgtttttatctctacaacggattcacttcaaatgacatgctaaagttacctttgttctaagttacttctataatatatgtaaattacttttaggttttactgaatttacttttatatatctaagaagtaacttagtgaaatctaaaagtaatttagacatatcataaaagtaatttgtgatttttcatcaaaatataatcatgtgagatcttgttgtaaagatttaattattacgaacacaacggtgtaatcggatcgtaaatcgaatgagtagtttaagagaaaattgtatttgaagtataggtggatggtacctcttatagatggagtggtagctggtttagacaaactagctaacactagttgtctagttacgtccaaccaattaacctatgatcgatgtgtgtcttcattattcaccggaggtccctcaatttaatagtgagattttttaatcccttaaccacaaaattagaaatatatgcccctagtcagcaaaaaaaatttaaaaaggacgtggagcccacatgtcagttacacaactttttttt

SEQ ID NO: 53066 - DNA, 1029 bp, Oryza sativa
tttcctattttttatagaatttcccttctattttctacacaaagattcggacaccttcatccgaaacagacactaatcaggacaaactcatggtgatattcaaaagtagcaagttgcaattgttgatgcttcagctgaacataagcatccatattacaaatccaaatactactacctggtagtacctcaactgtactcaaattacttaatggtaatctacaatcgtctctggccactatcggatctgaagcattgttcgccacaccggcgttttgggtcttcttgagccggctccgtcactacctccatctggtgttgccagctccaagccactaggagacataaccatggaggaggagctggagagcggccaggagggaatgaatcgacgcagtggcattttggatgggaaggacaggaggtgtggccgccgccggaataggggatcgatggaggatactgtgcagcagtacagatggagagggggccagcggtggcgatagggtctgatgtgaccatggctactacggatacatccgttgctcacatcatggatgaacaacaagatatcaagttcaagtcctccaagtgctggaatctgattcggccacctactacactgctgacttcaaacggccgccgaatctccatatgacctccgttttcggcccgtgagtacttgatggaaagctctcggagtcctctttccaatgcatcaagcctcattgccaaatttcatctcagtcggcagcaactgaagaaacaaggtgctgcgacacctgtaatgggcctatgggcttgtaacttcgtctgggaccccggcctaagtggggcccatgtggggtgcgccccaatcaggtggaggacgacctagggtcctcctatctctataaatagcttggtaccccttcagggtatcgcgggttttgatagattaaaatttagccattgctacttgcttgtagcgtgcgtgtcggctagaccgtctgtctgcttgttctttggaaccccaacttatcatttgtatta

SEQ ID NO: 53067 - DNA, 992 bp, Oryza sativa
ttttcaacttatttttttttttgtaatttggtactgaactgagttgtatgttttttcaacttctatgtgataatttaaaagctgagtttggtactgaactgaactatatgttttttcaacttctttgtaatggtctaaaagctgagttcatatgtttgtgtttatcagctccgtaattgaaaactgacctaagatgttagttttttttttcaattgtctactctgaaactaagctgagcagccaatttttgagtgctaggtgtgttatttggatttggagttcttatgtagtttgatttggaactgaagtgagcaaccaaaatttgagtgcgaggtgtgtaatttggatttggagtttctatgtaatgtgatttgaaactgaaccgagcaacaaaaacttgagtgcgaggcctataatttggattggagtcttgcctctgtccttttccgttgaacatttcaattgatccactctttaatttccttgacagtataaaatcatatacccctcaaaaaggttgcaaattttgaatacaaaaacaatataatcagatatacaactaacacagacaaggagacttctcagacaagcacagagatcactgggcgtggagctcacaagaacgcggcgagatcagccgcgtcggcggcgagctgtgtcgcgccgcccttgcgccgcgccagagcgagcgccaacgcggcggccgccgcggcgaggacgacgagaagcagcacggcgaggccagcggacaaccacaggcgccgccgccgcgcggcgacgcgcagccgatgggcctccctcagctccccctcggcggcgcccacgtcgcccgcggccgcggccacgtgccgctcgatgtcgtcgacgcgcgcgccctgggactccaccagcgccgccatgtcgaggaacagctgctgcagctcgaggaggccgccctccacctcctccgcctccgaggaggacttcatggccgcccgcaccgccgcctcgg

SEQ ID NO: 53068 - DNA, 2757 bp, Oryza sativa
agaatttttgaggttttattttctacgtatagtgcgttatttgagactagtaatatgtccgtactaacgttacggcaaaatttggtaatacacgtgcaaagcatatggtaaaaatataagttaaactgagagcataaagctttactggtaatgcagccggaaaagtttacctggcacatgaaattcatgttaccaagtaataaataaataagcatgtatttaaaccacgttgtataaaaatacaagtgcgtttaaggatacaataatacacaaataatacacagctccaccattgtacatggtataaaataaatgcaaaaaaaaaataacccctcaaagatgaaggagcagaaaatggacacaaaagtcactctgatcatccaatgctactggccatacaaaatttatgcgtaaaatttgtcatttaaattaacctaattattattctgagaatgataatacgcatgctacaatctgattcaagtgcccgtaaaaaaagatctcagcaaatttggtagcagaattcagtaaattgataatggtcgcttacttatgtttgtgcttcaactgtccaagtggaaataaaacagagaaattaacttactaatttgtcaaaatgcccaactgaaaacaacacaattgaattgccagctatatcgaaaagccaaaaatcaggattattcatgttgtagctcagcaaccaaaagtatgagatacgggatttcaaacattactactaatatttaccacattagctagaaaggcgataagctataatattaggaatgattataggaatattgaacatctgaatagaaaatgtaggattatacgatattactaatctgccatatctggctttcgttcagacctagaatacacctgaataaaaatacacatgattaaagttgttgctccaaccctcaggccctcatgaggctcatcctgcggcaaacacacttaaattgtttgtctagaaggttgttattgatagcaaaatatagagcaagcaaagaccagtaggtatttcctatagggttgttttcactctccatgaatccttcatgtcaagataatataataaacaagctaagaaacatcaatcctaataccggattaacataagtaaatttcttttgtagctgcagctctttctcctagaggcattaatatgttgcggcaactatagcaaatcaatatgaaaaagaaagaaaaatattatccattaccaatccttgaactcatgacctcttgagttaactattttttatcttcaatgcactaacaatctcaacctcatataattacatgtaaatatgtgatttgtattatttatatctagttacttgacatatattaatatttggaaaaacgtctttacatcgttttaaatgccttaagaaaatgcctttacatatgaaacaaattttaaagtgccgaaaagatgtctctacaagataaatttaacaaagtatactaaaaatgtctctaaagtgtctctagagtaaaaatattttaggcgattttgaaagtgcctctaaaaagtgtctctagactatagagcttcaaaacttagaggcattttgaaaattgtctctacaaatgagcctctacataaggtttttgttatagtgaaagcaaaggtgatactgatcaattatgtgatttgcaatgtatgtctatggagtgatatgtgggaaaagtgttttcatccctcgaggggatatctcctaattttgtgcatgtcacctaaatagttataaacaaatttgaaaaaaaaaatcacaagaaatgtgcaccaatactcaaatgtatagctcaatgctcagagcagcagggtttttcacgagcaccttatatgcataaaactacacacaacctatatggatgcttggcgctgttcacagcagcaagtccacgaggccaaggtctaagtggtcgatacagcatcatttagctttttgacatgcacagctaagagctacgaccatcaatccgtagcttcagggaacaaatatataagaggtagactcagtgtagaaagcagaaaattgagaaccataggataaccatgaagagaacctgtcagtcttggctgttctatactttgctatataagagtagcacaaaatctaccatcgcaaaagatatggagaacataaagatatcaattcttctctaagatcaatgtgtaaactaaatttgtaaacactttatcacatgatatctcaaagaaacatgtatgctgcccccataatttcatttgaaaatacaagctgatgcttagattatcatcgatagtacgattgtaacatatatactctatagttattatactccgtcttgagctgcacctccttcctcggtgcccgcagatttactggtcccaggaatatcttagaaaagcaccttccaagcccaaaaagcacagaaacaatattagaatatcacaaatccctcaaaaaaacaggttagacagaaagcaagaacaagttcaaaccttctctgttgtaaaaaagaagaaataccatgtgcattgctcaggagtagagacgcaatgtctccgtcgcttatgaggcacgttgctcgatccaagtcctactcaatctcatcaagtccatccactgtcacaattagcacattgccacgatcattcaacagcaaacacattttagcgacacagtgattcagaaagacgaggtggtgtcccgagctgtgctgacgattgaatgaagagtaagggccaccacttcggtg

SEQ ID NO: 53069 - DNA, 4989 bp, Oryza sativa
gaaggtgggttaatcctgaatcgttggatctcagggagacgatcctgaccgatagaatgaggaatgtaacactgtgttggtaaattatagggtagatttgagaagacgggtgattaacaacgttatcgttttgtttatgcgcataccaaaatttaaattttaaaacataattttaattttaaagttgattttgtgtttgttttatttttaaaatgacgtaaagttttacttacaaatatcttttggcttttaattaaccgtacatataaacgtaagcaaaaggaagcagtgaacctataacatgtgcatagcctcatgtgtacttaccatgtgcatatcatgatgtgatttttggatataaaattggttctcctttagaatatgatttttaaaacacggaaaacgtagaattcaagtgccttggcacctgaaattctatcaaaaatttatgggttaaaaatatactgaaaaactgtaaaaaaaaaaccttctagatggagtgtagaaaaaaaagaatgaaaaatagagattaggcacataagatttttttccctataggtcgaacctcatgttaaaaatcctctaaaataattatgatagataatcctaaggaatttaataggatatttggaatttggaattgctattcctttgttacaaatggatatatagaaaaaaaaatttcataggatgtgaatcctgtaaaattcctccaaaattgaaaaaaacaaaggaataggaaaaacacatgattctggcaggaatacaagtgtaaaacagaggattgaaaaacacaggaaaaacataggaatggccgtttgattggaccataggaaaaacgcaggaatcagataagagagatagattcagaggaaatgttccaagaggttagacctcttgctaactttcctccaaaatgtacataggattactcattccataggaattttaaaggcttggatatgattcaatcctttgtttcaaaggccataggatttttttactataggattgaaattctccaaaattcctatatttttcctacaaatcaaaggggcccttagagggtcattctaataacggacatgaacttaacataccaatttgtagctcagctggtagggacctgttgacgaaaaaaatcgaacacaccggcctgggagatctgcttagctcatgtgcaggtccaaagattgatgatatgcgggcgtgccagtcagtttgatcctgcaactgataagatatgtaaacagcagatcaaaacagccgatcggttgacaagccgatggagtagttccagccggtagccaataatagccgatgctgataccagccgatagcgatagggtttaagcaatcggctatatgtccaatgtagataacgatataaaggcaatcagctgatgatgatgcaataaaataacaatataatccagtataaaccaatcggctagcaatgatatgataaataagcatcgatccgaaggttaaagcacacatcggctggaggtccgatgtcatgaaatccacaagattagattaaacagtgaaacctttgttgtcatcggcgaaatccaacttatatgtatgtgcaatccttatgagccgatgcaacgtccagataactcaccggctgaaatcccgatgaaacccttattggcaatcaagaagcaggctagagattatgtttctaagcacgacttagtagatcaaacttaactgatgcagcactaagtatgaaaagaaacataatatctagacaatcaagccgttgactgaattttcagggtggtagatgtctaagctaatctaatctagcaacacgatttagccgataccggcagaaaccctaaaacgagaagcagccgatagagctaaattgatatgctaagactagattaacagagacatatgataaataggtaagcaagtatatcatccaaaccagagcaatccaagaggtcgaacgtactgatgcaaccttgaacgacgccgatgtagatgagacaattgtctgggccgacggaacattggacttaccctttcgccggagatcgaacaccgatgcagccccgcgtcaggtgccaagtcccgccggacgataaaataaagtaaaaaaggtaaaaggtggcgatgcgccaaattgtattgatcgtgagatagattacatagaccctaggtgtacatatttatacccaagggttgatacaagtccttgtcggataagaaagaaactaacctaaagataaaaagaaaatataaagtccttatcggacactaaacacactttcctaaagataaaaggaaactaacaaactattcctaattaatagataaactgccatgccgcatcctctttaaactcggtcacttagggataagttccctttagtagattgatttccttaaccgaatatagcaggaatccgactattggcgacttgataactcccatcggctgattccgagatgctgcagccgataatgattctaagccgattaccaaatttcactgttaacaggaccaaacaagaggcatgtgcgagtgtgcggtctgtgtatatggtggtgcgtgatttgtgatccgtaagcacttgcaccatgatggcttggctccgatgcgcatcaatgagaccagccacattgtgaactaaatttaaaactacactaggttttttattggaatactgacaagatgtccgtgttttgcaataggatcataacatatttggaattgaaggtggtggtggtgggagcgacacaatccacgatgtgggccattgccgtattctttcatgtcaactcgttaaaattggccacaccatgtgagcgagggtgacgaacataatatctatatatttttttaagtaagatgacaaaaggtgaattatgcgtttaggatgtttaccctcataaagaagttgttggtgacatgcataccatgcgcgccggttagaggagagatggtggtctaccatgatttggtgcacaaagggagtccacggaaattcgaaagctagattagatcatgatacaagggacagctaggatcaacctatagttcggatggctcggatctaagacgggtataccaatcgagatccacatgtcaatcgacgggcaactgatgcattagacccacctatcaactcgggtgatcaaacactactccatatggttgctggagatagtgcacatcaatagacagaggggactagcagaaggaggagaatgaaacgattttgactagcatacacgcaaaggtaaataacaatggaagacaatcgaccacgagtttttgcactgcaactcatttggtcttaaaaaagggggttcaccagcaggcttcaatgggagagagttgtgcccaaggatcttgtaacttctgcgatcattgaagtggatcgatggtgcttcgaagggcaacaatgatgactagagttgatgatgcatgatggagagatacgaaactttgtgctacagctagggcaatcgacaactctagaggggcttgagggtgaggatatgggagccctattatgagggaggggatgttgacacagagactacagtgtggcagcaatattttccttgatgacgtagctaagtcaagcctattaacatgacggcgtcgaggatgacatggactcctaccgagaaagagacataacttacaattgggctacacctattactgacagcaaaaagctggtggcattgggctgactcgggcaattgcacgcatggagaataacacatgccaacgtggttgaatgtgcagaggttttattcgcgtgtcacgcttgatagacaatgggaatattttttttctagatgtatatagataagtgatctgtgcgttgcaatatataccgattataccatatactaattatgacacactgatatatataacacgggtatcggatttggatttgcttggtaacccagctgaactctctgaaccggttttcttgtgtctcgtcgcatcgccttatgtctgataacgattttaaatattttcatatatttttctcaaataatttcaagaccggtaatttttcttagtaaaagatattttcaaatttaatttgatactgtggaggtcgcaatttgcaaatgcgctaaaaatgagcccgtcacatgatctaccccaccaaaacaaaaggagagtaaagtttgactccacagtccaccacccgtgaagctctggagtcgagcgtgaacttggtccactacgccatggcggccgcaccacagcaatccgtgcacccaagcttgccctcctcaacctcaaccctccgcctcctcatctcctcctccccacgacggcctcctccgccgccgccaagagcccgccggtataacaggctcgcggcgtcggcttcggcggcgcgggagatgccgtggccgcacgtgctgacggtggccggctccgactccggcggcggcgccggcatccaggccgacatcaaggcctgcgccgcgctgggagcctactgctcctccgtcgtcaccgccgtcactgcccagaacaccgccggcgtccaggtaggtcgcctggtttcttcttcttgattttctcccccgtgtgctcctgcctgggttctctggattaaggagggagaaatgattgggggttggtgcaggggattcatgtggtgccagaggagttcatccgggagcagctcaactcggttctttcggacatgtcggtggatgtggtgagcccctttttgccttctttttttttttcttcctatctgcctttccaagttccacgaatctttacagttattatatcttagctggttttggttcttgctacatagcttagtgcacaaaatgctctgtgatttccatatgtgtgtgatgggttgatattgtgatatcggtgacgccccctgttccagacaccatttttgtgcagaattaccagcccctgttgaaatctggtgtgccacacaaaaatcgaatctaaaaactaaa

SEQ ID NO: 53070 - DNA, 1519 bp, Oryza sativa
caaacaattagcggattttatatttacaaatggcagattacatttttaaatttcagaatgtacagattccaaggttgcaagatgtgaacctttctttgaactgctcaaagtttcgaatatgtgtttttattttcttaccaagaaatattgctgattttgcaaatgtttctaaaattcaagacatgaatgttgaattaggattttgggatataattttcatgcgatgggattataacttatacagtgtacattgttaccttttgaattgattaggtcaagacaggaatgctcccttcaatcggagtagtcagagttttatgtgaaagtctaaagaagtttccagtcaaaggtctgggaaaactatctgcatgccttgaattaacgcatagctatgctagactgccagccatatatttattttgtattacttgtgcttctgaaggcagctttagtggtggatccagttatggtgtccacaagtggagatactctttcagaatcatctactctctctgtatataggtacaggattcatatttggtttgttttatttgtatttataacatccggttggaatgcttcataaaatttagtgtaatagtgcaacatttgttttgtgcagggatgaattatttgctatggctgatatagtcaccccaaatgtgaaagaagcgtcgagattacttgggggtgtatctttgcgcactgtttctgacatgcgcaatgcagcggagtccatttacaaatttggtccaaagtatgtctgccatattttcatgaatattatgttgctgttcttaagttcttccagttacttattacacatgcacttttctgtgctattacatccatatatctgcccaaacaatgttgttagtatacttgtgattaatttctttttaatttttcatgtatggatatataaatctcttagttccagaataaggagaattaatttgtacctacctttgggcctcagtcttactgttttgcatgagagtgaatgctgcattttatattcttaggcctttattcgataagtgccaaaactatgtgcctaggcgttgctatttgcagtattaatggcatatgcaagaatgcgatatttagattcccattaaattgtgtctagactaatgtattattttctgatgcaaataatttaccatttgcagacatgtacttgtgaaaggtggggatatgctagaatcctcagatgcaactgatgtattttttgatggtacaaattccataattcaatacaatactgtccattatcacatctacatcctgcccttttagcggcctcatataaattctgaactgttttcatcaggtaaggagttcattgagctccatgcgcatcgcataaagacccataacacacatggaactggttgcactttagcttcatgtatagcttccgaattaggaaaggtgcaacgatgctgcatgctgttcaggttagtcttccagtccttttccctgactttaccttcatatagtgaagaaactgtgt

SEQ ID NO: 53071 - DNA, 2415 bp, Oryza sativa
  unsure (1)..(2415): unsure at all n locations
annnnnnnnnnnnnnnnnnnnnnnnnnnnnnnnnnnnnnnnnnnnnnnnnnnnnnnnnccatttgcagacatgtacttgtgaaaggtggggatatgctagaatcctcagatgcaactgatgtattttttgatggtacaaattccataattcaatacaatactgtccattatcacatctacatcctgcccttttagcggcctcatataaattctgaactgttttcatcaggtaaggagttcattgagctccatgcgcatcgcataaagacccataacacacatggaactggttgcactttagcttcatgtatagcttccgaattagcgaaaggtgcaacgatgctgcatgctgttcaggttagtcttccagtccttttccctgactttaccttcatatagtgaagaaactgtgtcaaatggtatgtcatgtctgaccgtgtgatcttatcaagcaaattatttagttccacctcccttttgtggcatcactaggaatgtctttgccacaatggtaacatgaaattggttgaaacagttctgataattttattattgtaccttaatactattttgttacaaagctgcaaactaagaaagggtttagcgactctttagtagtaaggtttcgatcatttaagggaaatctgtgttatttaaaagtagcacttgactggtagtaactagaattgtatccactgagatgttggagtgcacatttactgtatgcaacatcttggttacaaaccagccagtgatatattgaaaatgtgtgttttggcttattttctgtcagaactcgttctcttgcaagaacagtggtttgtgcgaaaaaatgtgtatacctgcaaatcccatcatattatcagaacaaagcctgcataagtcatcctgagactttgagtcttaccaaataccaatctaagtttgctaatcagttccggtggacatcggtttcctgaaaatttgtgttatatgtatcttttcatatcctctattcacaacagtaggctcactttgttgtttattgcacatgtgaactatccaggtggctaagaattttgtagaatctgctcttcatcacagtaaagatcttgtcgttggaaatggacctcaaggcccttttgatcaccttttcaagctcaagtgtccgccatacaatgttggctcacagccaagctttaagccagaccaactcttcctgtatgcagtgacagactctgggatgaacaaaaagtggggtcgttcaatcaaagaagctgtgcaagctgccattgaaggtggcgctaccattgtacaactgaggtctgcctattgaaacacaatcatgatcttgcatgtaatgcaatccctccattttatttttctgatgcattttgggtgtttttgatttccagagaaaaagattccgaaacaagagagtttttggaagcagccaaagcatgcatggagatttgcaagtccagtggagtaccactgctgatcaacgaccgggtagacattgccctggcatgcaatgcagatggtgtccatgttggtcaattggacatgtcggcacacgaagtgcgggagctcctagggccgggtaaaatcatcggcgtctcgtgcaagacccctgctcaagcccagcaggcctggaatgatggagcagactacattggctgtggcggtgttttccctacctccacgaaggcgaacaatcctacattggggtttgatggcttgaagacagtttgcctggcatctaagctgcctgtggtcgctattggcggcatcaacgcttcaaatgcaggttcagtgatggagcttggtctcccaaacctcaaaggcgtcgcagtagtctccgctctgtttgaccgtccgagtgtcgtagccgaaacaagaaacatgaaatccatcttgaccaacacctctagaacctagagctactacaatattctttgttcgaaggggatatgtttatcaaaatgaagagatgtttccaactttaataatcagaaggcatttcttgtaataatgcttgatcaaaagcatctgtgatgcaggggaatgaggaatcacaatcttgcatcattgggatgtaaggtacaatgttcagatttcttttacatcttttgagcaaattatccaacaaattttgttgaaagttggtagtacaaaatgaaagggtgaaaggctgtaactttcaacttctttaagctttcaaaatgaatgttgatgctatcatttagctattcgctagttgttttttttttgtcaatcagtgaacattttacaacatatgaaattgccactttactttgcctttactgtacctttgacagtttattttgttttacgtctctctacgtatcatgcgnnnnnnnnnnnnnnnnnnnnnnnnnnnnnnnnnnnnnnnnnnnnnnnnnnnnnnnnnnt

SEQ ID NO: 53072 - DNA, 24812 bp, Oryza sativa
  unsure (1)..(24812): unsure at all n locations
agatgtttccaactttaataatcagaaggcatttcttgtaataatgcttgatcaaaagcatctgtgatgcaggggaatgaggaatcacaatcttgcatcattgggatgtaaggtacaatgttcagatttcttttacatcttttgagcaaattatccaacaaattttgttgaaagttggtagtacaaaatgaaagggtgaaaggctgtaactttcaacttctttaagctttcaaaatgaatgttgatgctatcatttagctattcgctagttgttttttttttgtcaatcagtgaacattttacaacatatgaaattgccactttactttgcctttactgtacctttgacagtttattttgttttacgtctctctacgtatcatgcgccttatgcctatttagattataaaatttctttttcatacttattagcatctggaaaggtgcaattgttttattcaagttttactggtaaaaaaaacaccgtatgcgtatgtgaagttgtgaactttccaaggatggagacaaggatatgattaaaaaaaaaatcttggctgtttggagaggggaaagaattcctcaaagcacgaaagatttcacaaatgatcaaaatggagcgcccgatgcggcgcaaaaaaatggggtgccccccacgtgcgcctccgcctcgcctctcacgcacacgcgccggctctaccagtaccacgtgtcctcaccactcgtgctccgttgcaacaactatcagatataacggaaacgctctattagggggatttgttttatttttttttcaccaacaatgtttcactatgtatggatgaaatattgcagtagattttaatactgttacataatttcatcttaatggacacgtggtttgttgatgtacacggggtttaagcgttgcaatagctttaaatcgtttgttgtatacgttgaaccaaattatttcatctagtaatcttactgtgtttcactttttttaagaattgaaacattctttcactatttgataaaacattgttttatatagggtgagacaacgcccgattttttggaagccgttatatcatatgttgtagcaaaatgtttcatgaggtgatttggttgtgttccagctttttacaagattgaaacattttcgatctacttagtgagacacgttcattttacttggtgaaacaacgctcgatttgtaggcgccttggaaagatttgtagcaagattctgattagcggcaagattaatataaatccaacagcgacaagtattcggattggaaaccgtgtcatgcactcacgcgttcgcgcccttctccgattcgacttcgcttttgattcggactccgtgtcggacacgcagtggcgaagccatcgtaggggccagggagggccaacacccccctaacctctatgtgacctcccctcccctctcttctcccaaggatgattagcacttataatctagctattaattatatcattagttgcagatgagactaactatataggacaggacaactgcctagctatatatatataggacttatgaaatgacttagctaaatgatttatcaatcattttagaagtgattgcaagactccaattaatgaaacaaactgttcaatcatccatatattaaaaatattactgaattttaaattggcaaatcatgatatatgggttcttattctctcttgtagctaatcgctgtaatatgtatgatatcgagttaccgatcatacatcaacgctacaaaatcactgttcactaaaccttaagtgagttgccatgtctcgtagatggcaccctccatctctaaatcttggcttcgccactgcggacacgtacatggctggctatataggtcattagcattaggccatcactcatcagtgcattatcgagagcacgagatggcctcgcggattctgcccggcttcttccgccgccgccgctcttccgccgtcgtcccggcggcgactaaggaggagatgctggagctggagaggcggctgtgggacatcgcccctgcggcggcgtacgagctgcaaaaacggcggcaatggacgccggagcaggtggcgagggaggccgagaagcagcggtggatcgccgaggagaagcgccgcatcgagaaggagaccaaacggcaccagcagagaggaagtccggcttcgccggtcgtcgtcgtcgtcgatcttgacaaggagcttggcaaggagttcgaaaggacccggttctacgaggagctccggctgcaacaagccgaggctcgccgtgcgncggcgtcccaaggtcgtgacgacgacggaggaggaagacgatgacgacgacgtccccgcccgcggcgacgagggctacctcgagaggcgccgggaactcctcggacgttaccgcctcacgtaggccgccggcgcgctgagaaggcggcgcggcggacagtcgccgatgagatcatgagatcggccgccggcaagacagcaagatgcatgtgcgcggagcggcggaggacgatggaggcctcggcgtcagatcaaccatggcgcggcgcggcagactgagaaggcggagacgacgatgctggtttatcatagaataagatcaaaatcctctcttcatatttattacctgcaaagcacctctttgaaatgtttatcatagaataagatcaatattgtcactacttgccctgagaaaaaagattaattaatactgtcatatttaaaatagatacatccatcttgtgaaaatcaaatatttttcttttacaaaatccacgtaattctaggtacattgaattaaccatcagttttacataaaggaaaaaaaaaagataagttgagcatggcagtaaatgatggccagttcctaatctcggcccaggccagcccgagtcatctcaggccggcccaagccatgtccatcgtctgcctacgcaaaaatgatttggtttttttttatgataagcttagtagaatatttgatcttataattttttcctttatccactctggtaggcttggtgttcgcatttgaccctacatttttttttctttttggtgccacacacatctttaaactagaagttgttgtatttgtgtcgaaacaagatttcggcaatataaagggatagcgcacgagacctaaaagtggatggatgtggagacaaggatgtagacaggttcagaccctctcgatgagaggtaatactgagttgcatgcaccgaccagttcaacccaaaagcttaagctgatgaggaaaggcgggcaattcactttatattccaacactccccctcacgcgcgaccccctcaagcctctatcgtggaatagaagtgggctacaatttttatttaattgcgtgccagccaggattcgaactcgagacctcttcggtggaccatccgtgctctgcagtcggaatcctcgatgaaggatcttggcagcttgcatcacttgttgggcatctctgtttctcggcaatcctctggcctacatctcagtcaacgccagtactatctcgaggttttggaacatgctggcatggcagattgcaagccgtgtgctactcctgttgacaccaacgccaagctgtctgccaccgatggtgccccggttcgtgaccccacggactattggagtcaagctggcgctctccagtacttgactttcaccaggccagacatctcctatgctgtttagcaggtttgccttcacatgcacgatccacgggagccacatatgtccgtggaacggttgattatggtcttcacatccgctgctcttccactgttgacttgagtgcatactctgacgccgactgggcaggttgtccggacaccaggaaatccacctcggattatgctgtgttccttggcgacaacttggtctcctggtcctccaaacgtcagcttactgtatcgtgctctagtgccaaggcagaatatggggcagtggccaatgcagtggctgaaacttgctggcttcgacagcttctccatgagctccatacccctccgagccgatccacactggtttactgtgacaatgtgagtgctgtatatctctcctctaacccagtgcaacatcaacgtaccaagcatgtggagatcgatctacacttcgttcgagatcgcgtcgctgccggatctgttcgcgtgttgcatgtacctactacatcatagttcgccgatatctttactaaagggctacccagtgtcatcttcttggagttttggtccagtctgaatgtccgttccaccgacgttccgactgcggggagggggagggggtgggggggtgtccttccttaatcttctccgatattgtttctatatatcggttgctagatatggaaggcatgtgcctatatgtactctaccatatgtgataatctaatctatcgtgttgagcctatcacactttcaaataccctactcctgttgggcatttgaatccgccgggtctagtattgatctgacgttcaggttgtgtcaatatgccccctagaggaccttctgcccaccttatataggatagggggcaggattacaagatacaagccttaactaatacggtatcggtttcctaaatctactttacaatattatcaaatcaggactttaggccattccgtaatatacaaggaaacgtaatacctaagtcatgatccgttacatattacatagatataagatatcccctataaccagtcagataaccatttcgtgtgggtatggagtacccataatctccacagtagccctcgagacctttaaagtcgaaaagataatcttctctcgaactagatgactccaaagccgagtgcttcaatcatcttcgccatggtctcctgagtacttttaccaaatctgaagactgtggaggcctaaaaaataattaaatataaacttaggacttaggtgcatcgactagatgcacctaataggtgtagcccccgactgtggttagttgaacaaactaaacatatagtcaaggagtaaataatctaatcaactgagtggctttgataattgtagtcaaccaagtgacttaatattaatatatagcatatgcggtgtgaatccccgaataacatgatccgagtgatataccgtctgctttataaaatataatgcgtgcaacccaaagttgactacatcattgaaaattcacataacaaaacagctacaaagaggcttgtatgctgtgaataaacaaatttccaaagtatcgggcacacacaccatgcgcacattgctttaacaaatgtacttaaatccctaaaagacacatggtttcatcacacctgaaaatatatggcatatgtagtgtaaaatctgagtaaataaactcataaaagatttaccaactgcctgaaaaatgaccaaaatatataatcagcctgagccataatattggttagtaaaaatgcacacttacatggtagaaaagcaacgatattgtatccaatcgatcgctttatatacccaaatagtgccttgactatataaagaagtcaacggggcagctatataaagtttcactgtttggcaccttttaaaatgcattgtaccaactcctaaaaagttgagtaacagcggtataaaaagattttaaggtattaggcacttgatcatgcgcacttttgcctaaacaaaaaatgcctaagtccctaaaagaacgtgacatgctgcacctgaaaatataggctgcaaacatcttaggcctagacccaaaatatgcctaccgatacccttagaatatgacgtatataacacgcctatcaatatgctcccgagtgacaaatctcctgggtgatgtagatcaacttcatctcatctgagtagcttctaatccaagtggctatccctcacggattgtaccaaagtagatatgataatcaaatccagtctggctcaaatactcagctgatggccctcgtggggaataatgaatagtctagtcgttgagcataagaaatcgactcatgaccataaattcatgttgcatgtatctgaaacaagtccaagttgaagatatgatccttgcgtttgtgttgatgagccccctaagcatgtagcctatacttatgttgtagtcgtaattgtctattgacggtagtttatgcagtcggcatggaaacgagatgaccaacatagggatgacatcgcccatcagaggtgacgaagattattggtggtggtaaagacaatgacactaatcaaaggtgatgaagtcgcacagccgtggagtcgaagaaatcagtcgacagcagtcaggtcagccaacagagaagatgaaagcgcctagcaatattgatagagttgtgtagccatggggggcaaaataattagtcggtgacagacgaggcagctggtgaagaagatgaatacgctcattagcggcggcataataagccagccatgaaggcaaagatacgagtcggtggcaatgaaagcaagccaatgatgaagccgtagatgcacatcaacgacgatggcgaaatccaccaatcatgaagatgaagaaaatagttagcgacatgtcacgcccggaatttctatccaaaattccaaacgcttacatgtgtgtgaaccctcgtctaggaatcagccgagacacacaataacaaattgataatagagtacaattattactctaattaataagcgaataaaatgtcattacagagttagatagtccctctcaaacaacaaagttctaagcagtggaaaataagataaacagcgcagacgactccattccacaggcagcttgaccagggctacgcctaatcatccacaccttcagcatcactgtagaactcctctgatgaatgattgcaaggtgagtatatgacatactcagcaagccacgcagcaaatatgcaagtgcacaggataataaaggaaggcataatataggctcatttgcataaatagcatttaataaacatttcagaatttcataaaacagtaaagtattaattaaacaatattactccaacactatacaacataccctgttgcataggcccaaccattcggaacaaccaattcaggctgcacagttctatctccaaaccaggaatataccattccaaaccaggagctaaacaagttattaccaattacagcatcatttattatggtgagaagtgtggaactaatcacgaaagacattgttagacccgcccataaccacgggcacggctattcgaacagtttaaactctggccagaggtgtaccactgtacccacaagacacaacctcaacatcatgtcaaccatgcgtcgtgatacttaacaagtacccgaatagagattgtgacaataccctctatataatacaattcaaagcagtgcaccgttcccggatcataatcacccccttaaataaggcatggactccccagcgacccctgtggtcttatctccgccacttcacagtctggtgctctacaatgaaccatactatacataaagtaaagccgttgcccacgctggcttgtggttggcacggtaaatgtttcacaaccgaaaatcgtgaaccggtccttaattgtcatgagcacgaccatcaaaaccatgtgctcacaccccaccattatcaggtttttagttgtcaaattaattaattaaccaatcacgattaatcatcgtgagctatcattaagccatccttaaataatagtgaatcataagttatcccatttatatgagctattgtctctaagcatggctaagcatcctattcactttaactaaaaccatataatgttctagctaatcaatttattaaccagatgacaaagaataggggatcaatagcaaaagggctataacaaggcaataggtatttccaccaaatgacattcaaaaataaatgcaatagttgaatagaaacaatagctttaaacgggatcaacatactcaaagggttgtttgcgatctgtgtgacttgccttgctggccttggaactcttcaaagtcttctgcaaaatcggactctccgggaacgtcggaatctaaatagaaaagagcaaaatcaccaaaacagcacataaacaagtatgaacagtacatgtggatatttttaacatgtagatctcaattttagaaaaatttagagacttgaaccaactaaatccgagctaagatgaattagttatgaaatttcaaagattaaatcggattaaatcatttatatagattttaattgaattatgacgcaataatgaattatttttgaaaagtaaaaggggatttattgcatcagcggctcgggttcacggtggaccgggtgcacggcgacggtctacggaaacgaacggccgagatctatcctatccaaaacgaacggccgagatctaatcggtctacagcggctcacgggaaacggcgacgatgacgtcagcagtgatgtcaccaccggtggcggctcagcctcgcatgctcgccggcgaacgacggcgcggcggcgcaaacggagggcatctacgtgttgcgggcgacgcgacgaaacttactgaggcacgaacggcggtggacggtgaccggacgacgacggcgacgaggaagaagcggcggcgaccttcggcttgatgacgacggcggtgctccggtgatctacggcgacgacagagggacagacgaggtcggcggcaactcggcgaacacggcggtggccttcccacgcgacgacgacgaccggagcgacggcggcgcacgactggacgaactgcggcgacggcggcgctaggcttcacggggctagggcgctacagacggcggtgggctaaggcgagggtggcggcgggtagaggagacaccgggggtccttttatagcggctagggggcggcgacgaaggcccacgacggccggcgacgggaaggaaactttagggtttggagcggaaaaacgaatccgaaccaaactcgaatccggcaatttccaaaccaaattagcgatcgattccaaaagggaaaaggtagaggagatctcggggatcatttcccctctattaatttcaccgaagaaggaaaagcacggccgaattggaagggcggcggcggcgcagctcggttagggttcgggcgcggcggcggctggaggtagacgaagactaacaggtgggccccacctgtcaacgggcggtcgcgcgcgcgcgagcggcagctcggctgcgggctgactgggccgactgggccgagggagagagagagaaagggttttgggccgactttcggcccaaagccaaaagaggattttaaaaacctttttttcaatttaaattattcatgaaatgcaattctatttattaaaaatacttccttggctcaaataaatcctagaaaaatctaggaactatagaatcaagtaaagtatttaataaaattttatctggcccacttttatattggaatttattattttaaaattagatcttctcttctaggcttttaaaattatttctaataattcgaattaaacaacaatttatatatttgggatttttagggtgtgacaaacctaccccccttaaacggaatctcgtcctcgagattcggatgaactagcgaatagatgcggatgagctgactttaattcatcttctcgttccctagttgattcttcctctgagtgattactccattgaaccttgcaaaaacggataactcgattcctggttcttctctcatctgtttccaggatacggatgggtctctcaacatatgtcagatcctcttggacttctatctgttcaagattagcttcttcagtaggtacccttaaacactttttctactgtgacacatggaacacattatggactcctgccaaagattgcggtaactccaactgataagcaacatctcctcttctactgacaatcttataaggtcccacaaaacgcggtgccaattttcctttgttgtggaaacgatgaacccctcgaagaggtgtgacacgaagatacacatgatctccctcttcaaaacttagatctctacggcgattgtcggcataactcttatgacgagactgagccacacgcaatctctcttgaatgatctttactttttcttctgcttccctcagaatatcggtcccgaaaacctggcgttctcccgtttgatcccacaaaagcggagtgcggcatttccgaccatacagtgcttcataaggagccatctgaagactagcttgataactgttgttgtatgagaattccgcataaggcagattcttatcccaacttccaccgaagtctaaagcacaagctctcaacatgtcttccaaaatctgatttaccctttcagtttgtccatctgtctgcggatgataagcggtactgaagttcagcttggaacccatctcttcctgaagcttcttccaaaattttgaagtaaactggctacctcgatcggatactatcttcttaggcacaccgtgcaaacacacaatgcttgtcatatacaattccgccaagcgacttccggaatatgttgtcctcaccgggatgaaatgagccactttggtgagtctgtcgactatcacccaaatggagtcgtggcccgatgacgttctgggtagaccagtgatgaaatccataccgatttcctcccacttccattctggtatcttcaaaggctgcaacaaacctgcaggtttctgatgttctgccttgactcgctgacaaacattacacacggctacatattccgctatctcacgcttcatacttacccaccaaaatatttccttgaggtcttggtacatcttagtactaccagggtggatagagtataaagtgtcgtgagcttctttcagaattgcatcaatggcgatggcgaaatccaccaatcatgaagatgaagaaaatagtcagcgacggcaaacgcaaccaacgataatgacgattagcagcaacagagatgatcgactacgatgatgaagttgccaatcaatagcagtagagtaggctatgttgaagaggctttacagaatgttgacgaagatgacaatgtcgatgatccaatcaatagtagtgtagcagccgatgataatgacgaagacgctcatcagcgtttgcgtagtaggtcaaccgtgaaggtgaaataacaagtcggcaatgacggaagcaaccggaggtgaaaacgttgtcacccattagcaacggctgagacgtctgggccgatgaagtagaggtgcaggtgatgatgttagtgaaaataatccatcaaactgttgagaagatatcgaagctcgagtagtttccttgatgcgagcgtgtgcataatgaagattgatgcaacgccccttgatttataaagatggcagtagatgctgttgcagatgcttcacttggggaaaagtagatgctgttgtccaactcatcgaatctgagttgattggttgataactccaaactccttaggcccgtacttgggaagtccagaagccaaaattgccggtaaaataattgctgaagtagaactctggctctaaagcaaagacgaagataacgactctcagagttgactcattggctgattaattgattgctttatattgacataaaacttgtcgaattttgagccttgtatttgtgtagccctcgactctttggttagatgggaaacaactgaacatagagtcgagaactgtagcttgtcgtcgagtagccatcacttgagtgaagatatgcattgaggatgtctgggtagaaatcttgagtattggaacaccacttgttatagtaaaataacacgacatcttatttcgtgacgcatgccaagatgtcaaggctcttgtagacgtcgtggttggtgaagtagtaaagcttgcgatgtagagacaatagagtttgtcagtgccgaagacaacgaagatgaagtcgcttttcaatggtgatagatttgcactatcgtgatgacgtagacacaagtcggcagcaacaaaagtaaactggtggcgaagacgcacagtcgtgaatatagaaacaccagtcgatgatagaagaagcagatggtgaaaacaaagacgtccatgagcggcagcataataggccgaccatcaaagcagagacaccaattagtggcggtgaaggcaagttggtgttaaagattacgccagtcaatggtgacgaagacgtgcagccatggaggcgaagaaactagtcggcgtcaggcaaggcagccagcgatgaagacgaaggtgcccaatagtgaatcagtgatgacagagttgtgcatccatggcggcgagataattagttggcaatagaagaagcagaatgatgatgaaaacgaagacgtccttgagcagcggcataataggccaaccatgaaagcgaagactccatggatagcggcgaaggctagccggggtgaagacatagaggcccatcaacggtggtgtgaccaaccaatcgtgaatgcgatgacaccagtcggcggtgacggaggcaagccgacgttgaagatgtatgtgcccatcgatggcggtgtgaccaaccagccgtgtaggcgaaggtactagtaggcggcgatgaggcagccggtcgatgaagacatagacgccatcaacggtgacgtgaccaaacaactgtgtaggcgaggacactagtcggcaacggtgaaggcaagctagtggtgaagacgtaggcgcctatcaatggtggcataataggccagccgtgcaggcgaaaacatcagtcggtggcggtgaaggcaagccggtcggtaaagacgtagacgcccaacaacgacggtataatagaccagccgtgcaggcggagacaccagttggcggcggcgaagtcaagccgatggtgatgttctgactgatacattcctgaagcgtaggagataagcttatagcaatgaatccctactatgcacatctggatttggatcctgcagaataaacatgtagaatgagtagtatctaatttaaatataggacttgaggaaaattcaagcatttaaaatatgtttaaaatatgtatttctcctcttatcaattttaatttccccgagcaaatgattccttacgtttaaatattttgcccgactaatcattgcccacaaacaccggtaatcggcataggcacttcccaaacgttcatatgagtgacatgagttcgtcattaatggaacaagtttcacggatcagaatttactactcgggcactttggcaattgttaagagtagaaagcaaattatcttatctctatgcttttgattttatccgagtaatatttagcaccttgcattatacactccatccaacgagcccccgggtgataagaattggcccaaaggcaactatccatcaacaaaccaaatggaaagtatagggaaatagagctccataactcgataggcacattttttactcggattatttcgcaagcaatcaagataaaaaaagttgaaaaatatgatataacatctgtagctccggactcactagtcaatggcgaaccagatgatgtagtgaggcagaagtaaaggaaaaatatcatataaaaaacacaattaatgatgacttagcttttttatctccttggtgacggcaaaggtggtcggtgtggagataaaagtgcgcatcaacgacggcggaatccaccatccgtatgggcaaaaacaccaatcaatggcggcgaaggcaggccggcagtgaaaacatagacgcccaacaacggggctgtgagcagccaactgtgtaggcgaggacactagttggcggcggcgaaggcaagccggtggtgaagactagacgctcatcaacggtgttgtgaccaaccaaccgtgaaggcgaggataccagtcggcggcagacgaggtggccattggtgaagacgtagacgcccaacaacagtggtgtgaccaactaaccatataggtgagggtaccagtcggcggcaacaaggcggccggccagtgaagacgcagacgcccaacaacggtggtgtgaccaaccaaccgtgtaggtgaggacaccagtcggcggcggcgaaggcaagctggtggtgaagacgtgaatacccaacaacggtggtgtgaccatccaaccgtgtaggcgaggacaccagtcaacggcggcgaaggaaggccagcggtgaagacgtggacacccaacagcagtggtgtgatcaacctatcatgtaggcgaggtcactagttgacggcggcgaaggcaggcctgcggtgaagacgtggacgcccaacaacagtggtgtgatcaaccaaccgtataggcgaggacaccagtcggcggcaacgaggcggtcggtcagtgaagacggagactcccaacagcggtggtgtgaccaaccaaccatgtaggcgaggacaccagtcggcggcgacgaggcggctagtcggtgaagacgcagacgcccaacaacggtggcgtgaccatcaaaccgtgtaggcgaggacaccagtcgacggcggcgaaggcaggctgacggtgaagacatggacgccaacaatggtggtgtgaccatccaaccgtgtaggcgaggaccaatcaacggcagatgaggtggcgttaaggcgagttgcccattagtagcgctagagtcggccagatcgatctcatcatgcaatgaatccatcgtatatgcaaaaacaaagcaagcatatagattctgttagtaaacatgaaaatatggatgcatatcatatacaggaaaacatctattgcatggcatattaaatatttaatccatgcgtgttgattagatcagcacgtcaggcatgtttcctgggaaccgtgatttcctagcttgagctttcctgtgcacggtgtaggcatggcgagagcacatatgcatattaaatcacaggcatgcctgccagcttcagcatgtcgcatggttcccatgaagacgcggccggcttacgacttgtcttgcatggcagcgctgcagcggcttgtcaggttgttggcacccatcggagcaactcagccgccggtagtatatatgcggacaagcaaaataggaaccaaaaagacaatatcaatctctgattagaaattaatctaacagaaattagattagaccgatgaaccggatcgtgcagcgtggcttgcatcgtgagcgattaaaaaaaatagccactagatattggtctctctgtttgcatgccgcatgcatgtgcacacccctggatggccctccggtatgatgccgtcattggaagtagtcggcagagctcatcaaccaccagttcatgcatacaaacaaaaatcgaatagcagaccaatctagattaaaaatcaatctaataatactttattgaaacggcaaaccggtcgatgtcaaagattgaagtcgtcgaaattgttgagattaatcccagttgattccatcgcacttcctgacaggtaaactcaacgcaacccctacctagctgttaacaatgaaatttggtaagcccggagtagtcatcggcttagagtcagcatcggctttgaagtcctgagattagctgatgaaagttgtcaagtcgtcagttgtcggattcttgctatagtcggttaagaaaattgatctactagaggaagcttatccagaagagaccgatttcaaagagaatgcggcatggcaagttatctattaattaagaatagtttgttagtttccttttatctttaggaaagtgtgtttagtgtcatataaggactttatcttttccttttatctttaggaatgtttctttcttgtccgacaaggacttgtatcaacctatgggtataaatatgtacacccggggtctatgtaatctatcgctacgatcaatacaattcggcgcatcgccaccctttttacttctacttttgtttttacgttccggcggaactaggcacccgacgcggggctgcatcgtcttcgatctccggcgaagggataagtccaatgttccgccggtccaggcaattgtatcgtctacgtcggcgtcgttcaaggctgcatcaggacattcgagatcttggattactctggtttggataatatatttgcctgactatttatcatatgtctatgttaatctagtcctagcatctcaatttagctctatcggccatctctcgctttagggtttctgccggtatcggctaaatcgccttgctagattagattagcctaggcatctactaccctaaaaaatcaatcaacggcttgattgtctagatattatgtttcttttcatacttagtgctgcatcagttaagtttgatctactaagtcgtgcttagaaccataatctccagcctgcttcttgattgccaataagggttccatcggggtttcagccgatgagttatctggacgttgcatcggcttacaaggattgcatacatattggatttagccgatcgcaatgaagatttaattgtttaatataatcttgtggattttatgacatcggacctccagccgatgtatgctttaaccttcggatcagtgcttattatatattgtttctagccgattggtttctattcgattatattgttattttattacatcagtcgattgcctttatatcatcatctacattggacatatagccgattgcttaaaccctatcgctatcggttggtatcggcatcggctggaactactacatcggcttgtcagccgatcggctgatttatctactgtttacatatcttgtcagttgtaggatcaaactgactggcatgcccgcatctcatcaatctttggacttgcacaggagctaagcagatctcccaggccagtgtgttcgattttttcatcaacactagcgcaccaactgtcgaaacaaaatttcggcaatataaaggggtagtgcacgagacctaaaagtggatggatgcggagacaaggatttagacaggttcaggccctctcgatgagaggtaatatcctactcatgttggggatttgaatccactgagtgtagtattgatctgacgatcaggttgtgtgaattggggcaggattacaagatagaaaccttaaccaatatggtgtcggtttcctaaatctaatttacaatattatcgaaccagaactttagacagttccgtaatatataaggaaacgtaatacccaagtcatgatctgttacatatttcatagatataagatatcctctatagccagttggataaccatgtcgtgtggatatggggtacccataatctccacaatttgggggagtttatctgcctccagatgatcttatattccttagtgcttaaaccttctgtccaggtgctaggactaacctaaagaaatcttgaaacaagaaaattatatagaacttacatgatgtgtggaaatcctgattattcttctatcatgcccagtttgaagaaaactaaataatgtactggttgcgaaccaagttggtactatttttgcaatttatcctaaactgtttaacctaattaaaattgggcactgccggaaagattctcacaaggagaacaacttctatttagaacacaaaatttgattccttatggattaatacaagatttggaaagaatgttttggcctaccggtcaaggttaaagtttgataatttaggaactaaattctgaattttattctggaatataaccaaattgaccaagccacgaaaccctaaattttcctcttcttccttctccctctctccctccctgcttccttcaattctttcccttgaacagcagtagcactatagatggccatatggcccgatgcctgcggcccggcccaaggcacgccaatttggcccagcccaagcatggcatggcccgacagccgggccatgcttgggctgctccctcggcatggtgggccgggccggcacggcaagataaaaaaatagcagagggatttaagacctaatatctttgaaagaaaaattgtattgaacaagcaaacaaatgagtccaattagagttgttatgaacagacttcagatgtaagtatacgtatgagttatgataaaattgggaaaatgacctaccagtgattgttcagaagtacaaaaaaaggaggttggagacttggagagtggacacacaactatgaagagggaaagattttaataaatattatagactatggtttctagtgtccttgtgtaagtacgtactatggattcaaaagctcctaggaatcattcacaaaaatggatactattagacgtatagattctattggcctatataacaaaaagaaatatcacttgctaaaatgggatactatcaatactcagtagacccaaaattttggagatggtgtttctggaaaaaaatatatatttatttacatgttggtataccttactgaactatactccttaccaggaatgctaattgtttagggcccattgtaaattttctgacaaaaaaattatttctttcgattcaaatccatggagtgtaagaggcaacacaatcaacatggtacactcaaaatgtttctcaaggaggagaaccttgatatggaaggattcatatggaagtcaatgctaaggttttttatgttggtgaacttggccaaggggagtacgattatgataagatgcttttaactttgaaggaaaaaacatgatgggtataaatggaatcttattgtggtctatgtggggctgcatatcataggacagaaaagaccctagttgggcttgtgcatgacagtttcaatgctattgttcagaatgtcaacctcatggaattggattttccttatagaagatatactagtcgtaacctcatggaattgggtttgtttgtgttggaggcatgtcacgagggccttcggtcgagcctgtcgaaacacctcgtcaagctcttggcggagcatcaagagggcgaagcacctactagagcgaagaccgaagccttggagcaatattgctaggcgaagcaccaagggtgaagcgaaggatcctcgaccaaagggagatgaagagaaaggcctttgccagcaggcgaggcggaccaagccccaagtgggtcaacccctcaagaaggcccacttggaataggtcttagggctgaaggccagctatatgggtcaattgtccctattataagggtagccatgtaaattcccctttatatagaatccttagggttacctatttactttccaccttttagagtgaagcatgtcctttcaacaaacgctattccgttcgacaacaatttgtttataaaactagataaaattcttattagtcagtccagaaggggaagatatgtgtccttcaatgtttgtcagtgctctaaacagagctttatctaagcatgaatgcaccttttatcatacttggttgttgttcgaaatgaaatttaaatttgaattatcttggaatacacatactagctctatgtgtaatataaatacctatcactttacattaaaacttgtaataaagacttttaaagattgaaatataaattgaggatcaatacaaataactaaatctgacataatataccaaatagattacatagactacataaattaaaggcttattaaatgtgaatacgagacaactgaaattacagcttcagaaaatttcgaaggaaaattacaactgaaattacagcaatataaattgggctgttagtaacaaaaattttgagggaaaatggtgctaataaattttaactcaaatctcacgaatttattatagcatgcattttagaaatggagaaataatttcataagcattaaaaaagtaaataaggtaacactggtagtttgttaataccttctcacggaccttccactaagaatagaagtagggatgagccgcacaatatttgagtggtagtttgttttctcacggaacttccactaacaatagaagtagggatgagccgcacaatatttctgacggcttcacaaatctgatgtccaaattttaaggtaagagtggtagtttattaataccttctcatggaacttccaaagtagggatgagccgcacaataattctgatggcttcacgaatctgatgtccaaattttaaacacgaatctaatatctaaatgttagatatatagtaatttctaatgggtgtgccaattttgagtgtagactaaacaatgtataaattcaacattggataatcggtaaagaaatgttacaactggtaccagtaactacagcagatcactaattttgtaccacccgtaaatcaaaaaaacgagtataaagctgagttcttccaaacaaaattgataaccattgcaaggccatagttagtgtacttgtaattatctactatgagcagctcctgcccttttgcaactccctgttgcaaatcttgaagacaaattggtcaccttgcttatcatcgaagtgattagtaaactacgatcttgtcaagcattttcttgctgacttttgacatgagacttaacgatttgcacaatgatcgaatttgaccatgatgaatgcaagtctctatcttctcgttagaaatctcaagggtgcataaatcataatagatgataacttttatgctagcaacacacatcctatagtactcattctataatacttgggtaacgcaactcttatacgtgtagaagagatcatcagtagaagtgttgacaataaaatcatgtagtctatataacttgtgtgatgtgtaatttctccctttacatcaaaatcacataaatctttggatgatcccttgatctaatggtaagttggggccaaagcccccggtcatttttacagtgagtgggggcaaatgcggatgatccgttgatctaatggcaagttggggccaatgccccagttaattttaagtgagtgggggcaaatacaacttgataatattggcaagttggggccaaggcccccagtcaattttatagtgagtgggggcaaatgcccactcgataatatttactttgtttgtcgacttaagcggtagatcttggactctactcatgctacttcctgttccgcccctgatctaatgacaccaacttcgatggcacattgatgattaccaatacaaatattgcatcgataccatacccatttttctgctcacggagcacctaaatacaactgaaaccttaaaatctaagattcgtcatgatttatgtttgagaatgaatagaaccttaaaggcatattcatctgtctcgtcatctccaatgtaaattgggagaacattagagtcatttagcccaagtgtccctataagatatttgatcactttacctttgtctgcaacatcttcaggtcgaacttccagaacctaaaaattttatttttatataagttatgtaaaacatcgttgaaatggactataagttaaataccgggtattgaatcttcgtaccattttcccgggtttcatctcaagactaggacatctttcagtgcattaataactatttctttaaccaactcccaatcctatagttaagacaagcatcatttgttaaacttgacctaaattgataaaagaagaaaaaaaaactaaaagtagatccatattttacttctcctcaacattctttgtcttcgatcattgccccctcaatttttccaataggcacaattatagacttcaaaacatgttttatagtaaaattgtaacaatattgtattatacattcatataaaattgcacaagtcatcgttttgcatttattagaaatatagattatacctgactaatcatagggacaaactttctcccaggctagaagggattggcttcttcactgtgtagaagttagaaacagaaattttaaaaactaagcatgaagttacactacaacacaaacatcatagtgaggttaatttctacgactagcaaactgggtgaaaaagccaatagttaattatgtgcttttttttgctatgatctttcctcaatctaaagtccttttggaaaattaaggccaaccttatattcaatacactaagcatcttaacctcacatcatggtttgtacctctgtctttcgttatttatattcacttattactcaaattaattaaacatctaaaaatgcctctagagaggcaaacacgttttcaagaaaatgtcttccacatttggtgaattagggtgccttaaaaatgtgtataccaaataattagcacagatatctaaaaatgactcaaagttgcttctaaaatgtctctagagtacacacattttgacaatctacagggtatatcaaggaaaaggtccctagatgatagaactcgtttcttaaagctgatttgaaaatccttcaagtataataaattgtaagagattgtaagagtactatgaaaattttgttctaaaatgttgcaagtacttactatttcactagtacttccaaaatcagccctttgataccatgatatccaacccgtgacacccagcatagtagcgttctactagttttacaaattcaaacacctgagtcagaaagacaaaactcacaattattgatctaccacatatagtaataatttgagtatagctcgtcaatcaaaggggttgatcgttcctacctttctgcgggatctcccggtgactattgcagttggaaaaatcttcgctgcatccctcacggtctcacgcatctaacagtaattagaattaaacataaataattgttacatgcatttacaagtatttaattgccaaatattcttatttgacttacctcaggggacataaatgccatctcaggattatttacgattggcgaaagtgtgccatcataatccaagaatagggcaatcttcttgccttgagcattggatgtgatttcatcaaatgaaaccaaggtagaagtacattgtgtctgttataaatagacatgcgaaaattcttcaaaacagcattcattggatagctaaaagctagtgattcaaactatggagactacaatattagaacatgagtaataagcagaaaatataccttgcaagtatcattttcacaccctgaatcacctgagccttcaataatccttttattttcacctcctaaatcattagagccttcaataatattttcacccttaactagttctgcatctaaatgtttagaaacaatctccataaaagtctatcttagaatgaagtatatgcactacgtattattgttcaatattttataattaagtgcttacttgagagctttgtgtgttttcttgacacacgtttcttcccccaaaaaaaacttagtgttaggactactatgatgaccacaacactcggcctactattgccgctatgagagcagctctatgttttgtatgatgtgctcctgcatatatgtcacgcccagaaatttacaagtaatttccgaactaatttgtgcattaaaatcctcgcccaggaatcaaccgagttacacaaactaacaatttaatatacagattcatcaaaataaccaaagtgataaatacttacataagaggcacttagtcctcaccataaagaaaaactgcagcggaaaacaaaatctagcgaagcttcaactccacccccacatgcagctcaactggggtataagccaaacaaaatctatgacttactaaagaaaagttattatctaataaaaatattcgtcttttgctccacttatcttcaacctagaatgtagattgatctatggacatgttcagcattggaaggcccatgaagaatggatacaactggtagcggaaattgcaccaaattattgatgctcttgcaccttttgatcccagcttacagtttggtgcataaccaatatcattgaaacacttctgtcattctaaacttgtcaactcggatgagcactctgcaagggcatatatggtgtagtcttagcctttgctatgagattttcctgtcctgtggcgaaccttgtaggcaagttagttgccttatttgtcacagcagaaataagtgataggacaacattaacatataattggttctgaatgaaagatgggtcgcaatgtgatgctatatggtctatgtctttagaactactgaaactaataatgtgactagaaattctaatgccacaaaagtcataaaagatgatagcctccatctttgaagcacaaaccaccttaactttccttagtgcatcggtaacacaactcttgcatgtagtattatcaatatcagcatgacaccatccaaccgcatacatctcatcttttgctctgttggccatgatcctaccaaaaaaatccggggtggaggagacattatgtggcagtgtcctttataaaaagtgcatgtttcgcttgtatatgttgtctgctgagtaatttatgccttcacaatttgaataccaaaactcattggatagtcccgtggcatatccagataataggtgtaaaaaagatcttcagtagaagtgttgataataaaaccatgtagtctatatagcttgtgtgatgtgtaatttctccctttacattaaaatcacataaatctttggatgatcccttgatctaatggcaagttggggccaaaccccccgatcaattttactgtgagtgggggcaaatgaggatgatccgttgatctaatggcaagttggggccaatgcccccagttaattttaagtgagtgggggcaaatgccccctcgataatattctacattcagtcttatcatgaaatgtgtttcaattttatttgtaaattagatcatgtttcaactgttgcttttcatcataaagaaacttatatggttgttggagaatgaaacctcctcatttagatagtgctagttccatttctcttttcaaa

SEQ ID NO: 53073 - DNA, 847 bp, Oryza sativa
tatatatatatatatatatatatatatatatatagggagagagagaccgtatatgactccagttaatttacgtgatatcgcttggatggtaattgcaggttagatggaaagcattggctgttacgtcttagagaaattcccaccttgtaccgtaattgattctaattaattgatttaggtgacatgattagaaggtaaattaatatgttttgtttaacatgtcattatatccgattgatggtaaggccccacaacataaaatatagataggatctacggtaatgatagtatcatccatctaatcaatagctagatctttttaattaacgtgggagctcgtagctagaaagtgtctgattagtatgattagtataggtatacatagacagaaaagacagaatagatagatagatagatagattagaaacaaaatgacacgagagagaaaagggcatttttatcatggcagcaagttgcaagtatgacaggtgccttctttcttgcaaatgaagctaattagttaacggaatttatcatggcagcaagttgcaagtatttgacaggtgccttctttcttgcaaatgaagctaattagttaacggaattgctagtttactgtcgacagtaaacggggggaaaactgtcgaatttttgaccgtcggattcgccttaagattagtgctagcgcgttggtggaaaaaatctgcgcgataactgtaatttgtgttctgcgtgggggtggggtttgaacccaggacctcattcccaccagctatatgtggtagccacttcatctcttgcaagtttttgaaaagtttgcaaccctagttatattgtagttacatcg

SEQ ID NO: 53074 - DNA, 1664 bp, Oryza sativa
  unsure (1)..(1664): unsure at all n locations
nnnnnnnnnnnnnnnnnnnnnnnnnnnnnnnnnnnnnnnnnnnnnnnnnnnnnnnnnaaattttggttgctcacttcagttccaaatcaaactacataagaactccaaatccaaataacacacctagcactcaaaaattggctgctcagcttagtttcagagtagacaattgaaaaaaaaaactaacatcttaggtcagttttcaattacggagctgataaacacaaacatatgaactcagcttttagaccattacaaagaagttgaaaaaacatatagttcagttcagtaccaaactcagcttttaaattatcacatagaagttgaaaaaacatacaactcagttcagtaccaaattacaaaaaaaaaaataagttgaaaaaacatacaactcagttcagtaccaaattaaaaaaaaaattatagaaaaatcagttcagtaccaaatttaaaaaattaaaagaagttgaaaaaacatacaactcagttcagaaccaaattacaaaaaaaattatagaaaaataatggagatgcgggggatcgaaccccgtgcctctcgcatgcaaagcgagcgctctaccatttgagctacatccccttttatgacaaaacaattcaaatcaactaactcaagtaaaattaacaagttgggcctagtgagattacggcccaatgtggtgatgccacttcacttggcagtagagagcagcaggtttagtcccacctcggcgggagagagcgagggggcatcggagacaggctataaaaggaggtcgatctcgccttacataggcatgatccttcaggcagttaaagggagatgaggagtggtaacatctcgcaacttttactgcgagaggggtgcccgccccaacccaagcctgttacgacaacaggggcatccccatcattttaccatctgatcccgaaattttaactgaatttgtttggattttgtttttttgttgtggctttttgtttttttgttgttgctttactccatttcttgattgtttatttggtttatttggccaaatgttttctattaattgccggtttttatttgctttgttcctcttaagttgctggtttttatttaccaatttcaagctgtactattgtcgctctcttcgttgttgagatcacgcagcaagcatgatcaaaatacgaggaaaactaacaaggtgctgcgacacctgtaatgggtctagcacccaccctgatgctctgccttctcgcactcgcggcgctgtctcgcactcatcgtcgttgtcgaccttggagccacccgccgctgccgctgccgctgcctcatcgactcctctccaagaccctgatgaaccctgagttcctctcaacactcaaggctgttgttggcccgatctttcggtgagttgtgataactacgatttgggagatacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatatgatattgcaaatagaaatttaatacaaatgataagttggggttccaaagaacaagcagacagacggtctagccgacacgcacgctacaagca

SEQ ID NO: 53075 - DNA, 7754 bp, Oryza sativa
acgccggtgtggcgaacaatgcttcagatccgatagtggccagagacgattgtagattaccattaagtaatttgagtacagttgaggtactaccaggtagtagtatttggatttgtaatatggatgcttatgttcagctgaagcatcaacaattgcaacttgctacttctgaatatcaccatgagtttgtcctgattagtgtctgtttcggatgaaggtgtccgaatctttgtgtagaaaatagaagggaaattctataaaaaataggaaaatgtgttgtttaattttggtttcatatagtcatccgaatttttaataggattattcttgcatcagagtgagttagtgtcccaatgttaacctctacttatgtaattcgtgagtttctctgcaaatcttgagcatgggtcaaaatgattgcaatatatttgatgtatgtaattttttgtatcaataatttcattaggaagcagcaaattcatggttgccagtaatggctgtcatttgtagatcttttgaacaaagctgaagccatatccagaattaaccaatggatacaatgcattaggagaaggtttgttttttttttttggcggatcatggatagttgaatcctctatgttgagagtatgacattatttatacttaacaggatagtttgctactttgcttgatatgccattattctttatttcctatgccccttcccttccagagcataaatggtcttttagttcgaatctactaagcatcttctgctattgtcttttagtgtttctgcaattggtttattacttataaaatcatggtgttaaccacctaattttgtttacataatttctctcatgcataatccttttcagggcaatctacagcatgaacacactggtagcagttgtacgtacatacctaaacagtttaaaaatagggaaaaattttccaaaaataaagtttaagcccgaccgtggggatcgaacccacgaccacgtggttaaaagccacgcgctctaccactgagctaggtcggcttctgaccatttttgcaaaaaccaagaataaatacatattttcaaacaggagaaacgagcacaccgtagccctgaaacagaagtaacctggttttcctctattcctttgttggttaccgttcatctattcaactataaaaatccatttttcaaatatgcacgtaatttcggtaaaggctgtgaaaatatcaaggtgccctcactagctcattttttcttagggctttcacaatgtgtataggtgtcatttagtctcagtctcctacatcaaagatttcacgccacatatgcttctctgaccaagtgaagaacggggagccaaaataggtcgtgagtttctcgtcagggatttctcagggaagggagaggaacggcgcttgcgcggtgatcgttccaagctgcattgtcgcctccaacatagtgcgggagatttgctgggggaaggagatgattgaggaaagtgattttcgtggtggggctggcttgagaaaaaaaaattggtggtgggcccacctaaagccatgcgtgcaccagggagatgggagcttcatttgttttgggagtacctatacatctttcgaaagatttttataatcatatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaattcgagtgagaaaatcgagtgagagataagaaaaaatctttcgagtgagatatagcaaaatcgtttgttttttcctacctggagagttgggcttcttgttgaggcccggacgtgctgctattacccttagggcatagacaatgtatagagatcaggttacatacatacatacatacatacatacatatatacatacatacatatatatatatatatatatacatataggcaaagcagacgataaggttgttcccataagaaaaaaaattctctactcctcaatttccctatctctactccacatccaatccgtagtttgtgtgaaatggcgaaatcctatcccgccgggttcaaatccatatgagtggacagccatccatagaagcgtgagcggtgaggcgggcagacaactagctagcgatgagagcagtgttggaagtgaagctggggtgtttgccacgaccggaaataacccaatcaggctttccaatcatgcataaatcctcgtattgggagacaaggtacacaataagttgataaatatcaaagtacataagcgaaagcatattgtatttattacatgggcgaccaaaggtccaatacccaaggagaaacgataaaccatggaagactacgaaaaaaaaaccacatgcacttgatggtaggcccgagctcgtgtgagagggtgaggggcaacgacgatggtcgaaaagggatgagggacgtccgagcaccaatttataggggtcagacctatagctactgcttgtcagcgcctctgctagcgccgaccgttgggatcaaacccatgaccacatggttaaaatccacacgctctacgcctaccgctgagctataggtccgcttttgccaaaaaaatgatagattggttcttttcaaaaacttatttcagactagactatgcaaaatgatagagatacaattttgtattcttatctcttgtcggttttccttgattctctcatgattatgtttttataagtcagttgtagagataaggatgtacgtgcctatatgtactcgtggtccatgattaatcaaattatcgtgttgactcaattaccctttcacagaagaaaaacatcaacaaaaaataggccaaagctcagcactaggcctattggcactaaggtctaatggctcaacggcaatcgaattggcgccaacccctactaatgtggcctgggcaccgatcccctcgccaacgtggcaatgtctcaacgccaatcacccgattggcgctgagctcccaacctcagcactaggcccgttggtgctaaggtaggggacttgatagcccctccctccttatatccatccatctctcactcatttttttagcaaccaaacaagggtttccgaggagcctaggtgatttcaaaagtgagtttacttcttcccctgcaattatctaaaatatagtgtttgatctatctattctaggttggaacttgtattgccacctcatgccttccatagattagagtttatggttagggtttgagtagttccaatctatttgagttttattgtccgttgtttatgttttatggagtggggaattgtgtttggacctacttggtatcatttgtttgaagtgtagatgtggatattagtgtggtaatggtagggtttagtacataatggagaaggaacgaatgttgggttatttttgggtatggtcctaatatttaggagcggaaatggttaggacattactaatacttggaagatgaagtaatgtttgtcaactacattatagttctacagtaatattttgtaggcatattgaataaaagtgttgatttattaaattacatcaaaattgctaatcaatgagtagttcatttgtctatgatttgttgtttacaatggacattacgggctatgtccctccgttgggggttccggactttatgaattatccaagtcctcatcaataaccaccgttgggggttccggactttatgaattatccaaggttgagaattgagggtgcaatttacgggtggataaaatttgtgatgttcaaaacagatggcacagacggcaggagctccaatactatgtttataagcattaggagtttcactttgtctttcaatcacaaaagttatgacacttgtatttggtccaagacatcaacaaaacaatcattctgtcaatctaaagctactggttctcctgccaactgattggtcaaattttggcccatctatgtccactggtacagtaattagaacagacaattggtattgtaaatcagctaagcagccaaccgtgatgagagcttatgctagttctgacgtgaatgattattaccctagtgatctaaggcttcgttcgttcctgatcgatccaagggattgagagagaaaagtatctcgttttccacacgcacgcttcccaaactattaaacggtgtgtttttttaaaaaaaattatataggaaagttgctttaaaaaatcatattaatccatttttaaagtttaaagtagttaatactcaattaatcatgtgctaatggctcacctcgttttgcgtatcttcccaatctccccaattcccttctcctcaaacacaccctaacttaacaataaatggattaaatatgaacatgggtattcatcgactgtacagtggttattggtttggttttctctaatatctcaattagaattgctaaaaatagattaagatgatatttgctactttccgtctgttaagatgatatttgctacttttcgtctagatatttactgcatagaggaatgccaggttagcatagcgcaagcactatatatatatatatatacacacaaaaaaaaagattcataataactgaccaagacttcatcacagctctgtgcaaatatcaatatttactggatggttgctcatggttgataaggtatgtatgatcgtgtgattttttcctcatgagtcatgcgaatgagaggataaagctcatgaatctgaagaaaaacctgtacatcaatcttatgaaacatttttttttgaaaataactgtttttcacaaattcctttggctcagattttctgaaccttcaagcttctcttttccctcaccaaaatcgtagaaggagatcgttccattactcaattactcatattgatatcgttcagttactcatatttgcttactcatcaagttagcttgttaccactgaaataacagcactctaatatacaggtgacagttagtgaaatctaaataccgtaggcgtaatttcactgattaatggttatggtttgaaattgcatccaagcgcaggctgcaatgttcattggagaagcccaactggtcattgaactgcccgtacgtgctccacgtttactggtctaacagtttaaccgctagctcgacaggttctaaggctgcgttcggaaagtccacctgtccgcatggaaaacggtattttctattagcgcacgattaataaagtatttgccaaaaaaaacttgaaaaatgagttcatatgatttttaaaagtaactttcatatataaagtttttctaaaaattacaccatctagcaatttgggaaacgtacgcgcgaaaaacaagtagaagttgaaaaagttgggggaaagaacacagtctaaatgtacgactgtggtcagtttttttttttcaaaaggacattgctccttggccatgtgtcaaagaaaaaagctcacatgggccaacaaggcaatgggtttggtgggtcgaaagtgtgtgctaccagcaaagctgtgacaaacaacattcttgcatgagcgtaagctgttgacaaaggatagggacggttttagaacaggtacaataagactgacttagcaggcggtagattgatctacattagcctaatcctaggtggaagagtgagaaaaggagagagaatagaacgggcgcttcatctgtagccggacgatagcagtagaaacgaagctttccgcccgcttaacgctagtatggttgatacttcacgttattttgtcggcccctgcggtgtttccttgatctggcgtgctcgcttttccatcgttctttccgtgttcaaaactatatactacctttgtcttacaatataataacttttgactatgtatctgaacatatatttaactaatatagcaagaatttgttatattttgggacggatggagtaaatattaagtttttaagctatagaaattatcccataactctaaaataccaaattaaatagtaatttcaaacgaaccgcccagttttctcgccatttgatggttaacattgaacctttcaaatatgtatctatctgtaaatactaaatactatatatcaattggctagtttccattctaattacccggttggaagactacagccaacatatttaagctcagtttgaatcagatttctgtttggctgctaccttgttttccattagcacgtttctcaaaaatgctaaataatactccctccgtcctagaatataagaagtcttagggttagacacggttattaagaaaataggtagaagtgagtggtggagggttgtgattggatgagtagtggaagtagttgagaaaagtgaatggtaggttgtgattggttggaaagagaatgttggtggagaagttgttatattttgggacaaatcctgaggagggacggaggaagtattgtttttcaaaaaagtatatatagaaatttctttaaaaaatcaaataaatttatttttcaaatttataatagttaatatttaattaatcttgtgttaatgactttctacgttttatgtgccatcaattcttgtgttaatgacttgctgcgttttatgtgccatcaaaaagctgcagttaattaacaacctattcgaactaagcctacttgctaacaattcaaattattcagaagtgatacgatttttcttatttaattcaatacatatcaatagaaatactttatcttaaatgaaccgaccctaataaagtacattctcttaactttttaatattttcttgacatgcacttcaattaattccctaatctgctgttattccataagtgtggggatcgtggaagcatgcgcatacgttcgaataaccaccaacccttatttacccttatcggcatagtaatcacaattccaaactagaaacagggagtacgtgaatcctgccgaggcatgtcacctactcgataacgataactcagagtacaaaacctattttacatctcaataattcacatgtctaaattaacatgcaaaatgtgaccacaatttaacatcaccatgttctagtcatctctacatgcaaaatgtgaccacaatttaacatcaccatgttctagtcatctctacttgcaacgcaatgatgctgtggtaaaacaattgctatttattgtgtgtacagctccatccctcttagagcatgttcaatagtatcactggctaccgacgatatccatatccacatcagctaacagttaatatggagagcaaattatccagtacatcacagcccccaagaagcatttctttttttctgtgggatccaactgacaagcatctttcatagtattcatctcactgtgtgtggacccatgaccatttttaaaagttaaaaatttctaccttgctggctttttcaccttggagctcacgtagagctggcgacaaaatagtcgcccgttcctatcacctttcttcttctctgttctccagttcattagttttgctgagatggttgtactatcaccggttattgtactcgctcttacactgcataaggacaaactgatgaaaataatatgcttgtagacattgatcatttcattaatttcagtgcctaatgttagccgcataatatgtgtgcca

SEQ ID NO: 53076 - DNA, 1751 bp, Oryza sativa
  unsure (1)..(1751): unsure at all n locations
ccgttttgtattgagctatataaaaggagaacttttacggtacaatatactatagaagggcatgttagaaattttatagaaaataaaacaacactttagtaattttttgttcaaattaaatctaattgggagtacctcgtcctaaatcttatcatacactagggaaggaacattctaagcgccatttgatgacaaaacacgtgacgatagcatgatctgataatagaataatgaagaaaagacaaaattaccctttcaaacattataatgcaatctaattaactaaaaaatcaaatcaatctacactattagatcatatatacttgtagtatattgtaccgtaaaaatacagtataaaagagccagagagatgtccttgaaaaagaaatagaacaacaatcatcttctctctacattctctattgccatcgtgctgcgttgccataagatccaagctgaccgtggtgctcgtcgtgcaacgaccatcttcatgagcagtgtcttcaaaccttcgctgcatatgcacctgcatggaggcggtgtaaaggtttctgacaacgtatataatatgcggccgctcgacgtcttcaacgactcgatcgctgtcctgttatcgctgcgagcacggaggcacaacatcgatcgtcttcatcttccctgactcgttggtgtagatcaagtgactgcactgctttgcctcactgatcttcatcgatctattcagtgactgcataagttaaacccttttgattaatctcagagtccaaagagaccggtgtatttctaatctagatttgtgtgcacggcactgttaatctagattcaaatattgtggcaagattcgggggtggatccaggaaaaaataatagtggggactgaacaaactagggcagtataaattgaaacatgtcttatatataaattggctacatgtctagttcaaagcacacatacaccaaattaatgatatatagtgaattttatccataccaaaccaatgtccaatagatgacgtgtgtcgcccaatcgcctattattcttcatgactagtaatctatacaaagaaaatagcaaattaatgaataaacaaaacatacttattttgaattcaaatagtttagaaactaagaagataatggaggcatggagcataccactcatttttgttgaggcaataacgtccgacgccttttcatctcttcaaagtgttggatgattttttcatcactaatacttctaaaaatctgcttctcagtgtaacaaatcatctagtcatttagtcattcatcccccattttgtttcgcaaatctttttgtaagacacatagctgaaaagaccctctcaaccgaagccattgccaccggaagtatcaatgataactcaatgagcctatacaccaagtgataagttctgttctttccaatctgaaccattaattcagcaacctttgcaagatctttacatccaagaaattctttagttctcctaacattgctaataaaatttctaagttgagtccgtagtagcataagatcaccaaccaaaaaatcttcaacataaatttcagcaagcttcaacataaatttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccgagctcgaattcgccctatag

SEQ ID NO: 53077 - DNA, 734 bp, Oryza sativa
ggctctccaactaatacttcttttccattggtaaatacggcttgtccggccgaatcaacacttttttatcattgaagtcaatagtattcacaggaaaaagatcatgatctagcttcttcttagaaccctcagtaaatttcaatcgtccttcctctatggccgattgaacctgtcgttgaaacacattgcaattgttagtagtatgagaatgagaatcatgccacttacaataagcacgacgtttctgttgacgtttgatgtcgcaattctggtatttgcatagtatggggatcgtcggtgctaggatatatgcgagactgaggtaaaatagacggagacgaggatttttatacaggttcgggctcctgagctgtcaggtaataaccctacatcctgttagctggagccggagttgcttttattcaccataatcacaccaatacaatatgtggggtagcctgtctaactgttgtcgacatggcggtttgaaggtctgactcatagtcgacaacagggtagccttcctcctcgaatccgtgtccggcgagatcagagatagcgctttcgtttctcctgacggtatccggagacaccgtaggggaatagccatgcttatccctgaaatcgatatccggcggcgtgtcttggcgtttgttggcttgtatgttgtgacttctgttggttcccatattgtggtggttgttgattgtggtgggtctcgatcgtggggaccg

SEQ ID NO: 53078 - DNA, 1248 bp, Oryza sativa
gtaaacttttgacttaataaactttgggtctataaactttaggtgtataaactttagatgtatataaatactatatatagaaaatatttgaattcaaattcaaatttgaatcgggtatgtaaacttttgacttataaactttggatctataaactttaggtgtataaactttagatgtatagaaatactatatatagaaaatatttgaatttaaatacaaatttgaatcgggtatataaacttttgacttataaactttaggtctataaactttaggtgtataaactttaaatgtatataaatattatatatagaaaatatttgaattcaaattcaaatttaaatcggatatataaacttttgacttgtatacttttggtctctaaactttaaatgtgtaaacttgagatgcataaatttattaaaataggaaagtaatatggtgctaaaaaagaaaaccaggtggagggaggggaggggggcacccgatccctatcccatgggctgggcgattgatcgcccattagaggtttcgggaggggagagtgtatagggggatggggatcgatcgatcgcctattagcttattagctgtccccccaatacattgcctacgccgtgccaagtgccaaacagggaaaggagacaatatttttatttttcaattattatattaattataataataatccccgcaaaaaaaaatcataaagacttgtctcttcgtatcgaatatcgattcctacccggactctttatttacctttccccaattctcacaaactgaatgccaccaaaatcgaatcgctacaaaccctatccactgccgctggactcgtcgccgtgattcacctcgtgccgccgctcgcgcagcgccgccccgccccgccccgccccgccccggcgtagtaggagatgaagcggcgaaaaatcgccaaatcgacagcaagccgggggagcaggtccggtgtgaaatccccaaatccacggagcagagcagcgaatccgagccggaccggcggcttcttttctgatgaactccgattgggcagatggacttgttaccacggggaggaggaggaggagaagccatggctgccaccggccgacaaatcatccgagtccataagggagtacgtcgccgaggcggcgcgccggctacccctcgaggagatgccggagctcctccactgcgtcggcgcggtcggatactgctttggcctcgccgaccccgtcaccaacatcatc

SEQ ID NO: 53079 - DNA, 6105 bp, Oryza sativa
  unsure (1)..(6105): unsure at all n locations
cagtacccgtctcatttgctctctcctatcatggacaagctgcggggatcggagctgctcaccacccatgacgtccgggccatcatggacctacttcttgcacgccagtgcctgcctgccaacatggacttcttgtgctgcccaaatggcgatgcttgtgctcatcgagccaccaaccatggcaccctgcaggttgccacctgcattgggggaggtgcttttgctcgaatctcgaccgaaatcgtaaccccagatcacatccgacctcagcaactccaatacatctccaacctgacatttgatgatagctcagccatggagatgaagctttccaagtgcagtagtggtggttgtcaactggactatgatttttcctcgccatgcgagtacatactgtccctgaaaatgtgcctccttgatgccatccatggcttctacatccgggcactcgccgtgctgcccacgggtgacgactccatgcgccttggccgccttctccgtgccctccttgtgtccggacactgctatggccccttggatcctgtgtcaaacataatcctgaatgctgtcttgtatgatgccgcataccctccgcaaccacacgaaggtgatggcaaggctgagttaccacatgatatctttgacacccgcgccatgcgggacatggcgtcctgttccctcgatggcctcgttgccctcctctgcaccatcaccaccaccaccactggcaccccgctctcaaagcatgaggctgtggagtacctttggtcctggcagtgtgacctcaccgagaagctgcagcagaccgtgatggcaaagaacccctacgccgctgcagccatggcttccaagcacccacagcacaccatgctcggcgcgctgctcgtgtccttctccagcgagaagctcgaccgcctgcgctactttctgagatccattagtgatggctctgggtgtgttatctccggtgatgattgggagcagctaaacaaaatgatcaaaacacagctaaccacaattatcacgacaagagaagtgctaccattcaatccacaagccttgtcagcatcattgagagtgtcagcctatgtgaactcgcatagttttgctcgcagcaagctggaagagttgctactgagatattctaggcaacatccctgggtaaattcagagtagaaacttattttgattgattgttggacctgcttctcttcaagtgtgctaaaattccatccaccctcttgtgtttgttattgcaggaaccaaggtataagcttgatctcatctgcggagtagaggaacccagatcagcccgatgtggatgctaccatgctaacttcttggcaagcgcccatggcagtgtgctcaagttcaatggtgagacaaccgtagcacaaaccactgtgcgcagactcttcttcgctgaattctgggactcacaacctggtcgattttatgaatcacatgcaaaacccatgtgctgccctgttcaagatagtagcccttgttttggtgagtcactgaacccttgttgtgatgttcctactcattttatttccgtcaagtagtagacacactgtggcatgtgattgcaattttcatgcatgttaatgccctggattggtgtaatatatttattgttttgccttatgtcttggctttgttgtgaacaggtcgttgtatcttctgtggtgaagcaagcacgattgtgcatccaccatgtgcagctagaagtcatcttgatgatgatgattatgcccccatccttgactatgatgtccaggccgccattcgtatgtatgtttctgtttcacctatttgtatctatggttctgttatccaagcttagcaaaaacggggcctgttaagagtccaacatcacttattgatcatgaaaggggatcaaaacagaaacaagggcttgtttttgtttcacccattcgtatctaccgttcttgtcaaacttaaaaaaaatttgttttggacaaagagtttaaagaaaaaatcacaatcaactaagaatccagattggaagtcacaatctgtaaataggactgtagatacaatgagtgtgttctcagggatgtggggattattaatgaaacaccaatgaacatgggagattgtttgaggaaaagaggtgtgataaataccgggttatggctttgtggctgacgaggaatgatttagtattttgataatgtgttggtgtcatctccattgcaggtggtttccaaaagccaaatcaggtaagaggaagaactaaggaaaaggctaaaggaagctggtagtgtggatgatatacctgatgctatatagttatataggggtcgacctatgttttgtttcagaagtttggttagatggagtccgcttagatggttttgaaacttatgaactcttttgaggtgtaatcaggggatgttgctaacttgggggaagctggcttatgagtctcttaggctttctcaacttgttgtcaattatgttggaattcaggtggatgatatacctgatgctatatagttatatagggtcgacctgtattttgtttcagaagttcggttagatgaagtcttcttagatggttttgaacttatgaactcttttaaggtctaatcaggggacgttgctaacttttggggaagctcaatgcttatgagtctctcaggctttctcaacttgtcaattatgttggaattcaggtggttttccttctgattataactgaatgaaagtcacaaaggatgtttaatgtttgttaagattttactatctctttggtttgttggttcggatccagatcctccgacattacggagtaatgtcacagtgtgacattccttccatccggcacgttcattctaaagcaacggctgtggattatttagtctataataaataaaattaatcagcagattatttcttaaatagccctgcaattgctagtggtgagagcgggagataatttctgtttactcctctgttggtgccaaaataatccctccatcttcgttaccattaacccactgacaaaagtgtcgtacttataagaaaacagattgattatagactgaggattgcatcgtctcctcatagttctgatgatggaggatggtaccgtacaaatgagaatgatgcacatcattcttcacttcctcaacggcccgatattgtgccaattgcagcatctaactaacaggtaagtaaaacctaaatatcgtattgtgctaagttgtccgcttattctcttatgatttattagtgattgttgcctcctgtaaaaatgcaccatctagtctttcatatgtcaatctctttctctctaactctaccctcttcacttttgttctagtaatatgcccatactaacgctacagcgatagttagtactgcgaattgaacaatcaaatgcttaaagatttgtaatacattaatcatctaaaaataatttcatattcctgtaaattctcgtacatgtagtaacatgatacaatttaccaaatctaggctaaacttttcaaacaaaatagttattaatcagcacttaatgctacattaccattaacatgatcatacatttattttacaatcatcgttctgtacaaacatgtatttcatcacgggacaaaatatcttaatgggaaaattgcaccagcgctactggtgaactttcatccgtagttcctaatattttcattgaactatcatccatgacagagcgctgatgccctttcaacaatgggacactgcaagcaagaaaagcatgaagatagtacaattggtcatagcacaaatagagcaggatgacgaaaaatatttatttgctccgaaccagagtggtgaaagaaaagatctaagtcatctattcggatccaacttatatgttgccgaatagtaaatgcaagtcatctaaaaatgataaatggtacaatataaattttgcactctcttggaacaaatttaatctgtatgaacaaaaataagtgcacaaggcattttaacttttagcaagctgacatgaaaatctcaagaatgttagcttaacaatttccgtataacaatgagcttaagcttcagcttaaacctaaccttctctctacagactgagagaaccaagagagaaaagggacaatttaaaattttgtgtgtttcataagtatactaacaagcaaaaaagcaaccttcgattaagtacacagttttgtaactacttcaagacacaattctgatgacatcccaccattttaatttcttaaaccatgtgctacaggcatatttaggacaataattgcaaacataaatgcagagcatgatacatagaggataaacaattcatgaaaaaatattagttggtgcctacttcaaattagagttctgaatttggaattaaacctactcgaaagtcagctattcaggcattctgcaatcatgcggaacagccatatcatgcatgcatttctgaaacacaaaacaggctttctcttgcaatatgcaagatctcaaagacaaaatgagatcagaggatttgtttttcgctttttctttttagacaaaatgatttatacagaagttgggaacagttgcaaaggggaaaaatatcaaaaaaaaaaaaaatctatacctcatctgacaaatgcagtgaactgaggatgcaaagacgtccacattggaagtaacataaaaaagaaacatacacaaggaatgcagtaacacgttgaatacacaggtgtttattcgtacctagtgcagatcaatgttacgtgacaagtgtttgatgtcagtcagggacactgttgaggcttgcaaacaagtcatcgcttatattggaatttagaaaatctagatcagattcaaattcatttgccaattagtatcttcttcctacaaaatgaagcccagaaactatggcatactgtatatagctattgtatgtaatcttcaaaataaatatagacggttccaatgctagtggtttttagagcatgattaaaaataaatatagacggttccacatggcgaaggcaaaccgcagcgtggagcacggcacgatgaggtcgtcgtcgacggagaagatggcgtcggaagggccagatccagcggcagcggcggcggatcccaggcacacgccgcgccgccgcgaggccttcccggcacgctgtgccgcctcctcgcaccggagacgggccgccgctggggtttttggccccgccaccgccatcccagcgtccacgcggttttcggcggcggcgaggcggtgagaggaggggagggtggcagcggccgggggctagggttcgcccccggtcgcccgcgcgtggatgacttctttggtgttccctcatacaagaatgtgtcggtcgtcttctttgcctgcaggctgcaggtgtcggcgtcggcctccttgttcttcatcttcctcctcgggctcctttgcgtcagcagtaggggtctcgacgcgaggagaggagatcgtggcgatattggggtgggggtgaggtaggcgcggatgcggtgcgggagaggcgggggatcctgagtggcaggggcggtggcgcgggggttagggttgggaatcgcgagggaatcggcgggggccggaacctgaaagagggggagggcgtaggcgcaatgggggcgtggtggagagcgatgggggtgcggggaggagaggagggggagatgtggagtaatctgaggcgttggattggatgattttggaccattggatgtgtaacatgatgaatgatgaatgagtaaaaggatttgttgaactatagggtagatagatagaagaagaaaactatacctagctaggtaccccagatgcgcatgacatttagcactgtagatgaggctcaaaactattggaattactatggaggtcaaattggctttgacattagaaaacgattatgtcatgtggggacaccactaccaccacaggagcaagccggaggcgcaaatgcagcaagcagcatgagtcaagggtgcaaattagaaagaatcatgcaaggaaagtattaattaggagaaaataaannnnnnnnnnnnnnnnnnnnnnnnnnnnnnnnnnnnnnnnnnnnnnnnnnnnnnnnnnnnnnn

SEQ ID NO: 53080 - DNA, 12264 bp, Oryza sativa
  unsure (1)..(12264): unsure at all n locations
nnnnnnnnnnnnnnnnnnnnnnnnnnnnnnnnnnnnnnnnnnnnnnnnnnnnnnnnnnnnaggaaagtattaattaggagaaaataaatgtcatttccttgtattagagaccaagtgcctataaggcatgtaatcagcaacatttgcaagcaagcaatatgaaaccaaatttcctaatctccctccttccctaatcctcctctttccaccattgagcgtgcatggaagaaccctgccgccgcacctgatcctggctacgaactccgtagctgtggtccggctatcctcaacggtaacgcgcttgacaacgcttccaggcgttcctcttcccactccaacacgccctcaccaccagccgacgcaccaccatcgccaacgccctacatttcttcggccatgtccgagcccaccgccgccgagcttgccgcgctcatcaaggcgctctcggcaaccgtcgacaagctccaggcgtccgtcaccacactccagcaggcatcctcttccaccaccaagtccatcggcgagcaccacaacaaccggccaccgcgattccaaaaaatggattttcccaaatacgacggcaagtctgatcctctcgccttcatcaaccgttgtgaatcttactttcaccagcagcagatcgcggaggaggagaaggtttggatggcctcatacaatttagaagacggcgcacagctatagtacatccaagttcagcaaaacgagggcaccccgccatggcatcacttcaccgagctgcttcatctccgtttcggccctccactgcgttccaacccccccgacgagctcatggcctacaagcgcaccggctccgtcgtcgactaccaagacaggtttgaggtgctccttccgtgcacgggcaagctgacgaaggaacaacgcgtccaaatcttcacggtcagactgcaaccgccactcagcctcgacgtggagatccacagcccgtagtcactcgccttcaccatgagtctcggccgcaagctcgagttgcgcgaccagtgcgccgctaccgccgcgccccagcaccacaaccggtgtggcctcctgcccgcgccgccacagcggctggctcttccggcgccggcgccgccgactgcaccggcccaagcgacagtgaccgtcgagggccgcacggtcaactgcctctcccaggcagagatggaagaacgatgccgcctcgggctgtgcttcaattgcaatgacaagttctcacgcaagcataaccacgtatgctagcaccttttcctcctcaacttggccacgccagatgacaacaacgacgacgacagcacacccgaggagacaggaggaactaacacacacgtctcgctccacgcgatcgccggcgtccgcttcaacgacaccatgcaagtgcacatcaacatgggcggcaccaacctcctcgcattgctcgactcgggtttcacacacaacttcgtctccacggctgctgcgagtctcaccaagctcaagctccttcctaacggcaagatgcaggtcatggtcgccaatggagaatacgtatcgtgcccgggcctctaccgcaacacagctttcaccaccgacactgagacgttccagataatgttgagattcaagaggatttgacttatgtgaagaagcctacgtgtattttggagaccaatgagagaactagaaataaggtgatcaagttttacagagtttagtagagccatcattcggaggatgaagcaacttgggagagagaagatgagttgaaagccgcccatccccatctcttcgccagttcgttcgaatctcggggacgagattccgtttaaggggggtaagtttgtcacacccggagttttccctttccttagatttcaattcactaataaatggtctatagaaatcactttggttaaccaggagaaaactctaattaacaatatatttaataaccggaattgtcagggagaatttttttcgaattgtcgtcgtgcggctggcgaggtgcggagctagaggaacccggcgcaggagagatgcgctggagggcaaggttaagcgcacgaacctgctccgaatatttgaacgcagacgcctggacttgagtcacgtggtccggcaatgcatcaagctttgttgcgagcggcaccaatggctccagcgcactcatcttgcgagcgagatcagaaatttgggcagccatggaggtgaggttttttgctatctcatctaactggttttgtgtgaaggccatggaatcagagccagaggaatctgataccaagatgtcatgagctagagtggatgaaggaatatgtcgaaggttatacttgaaggaagtggagggacgtggccctggacctcgtcggcacagcggtgccgtgatcggcgacgcaccagcgaggcagggcaagaactgatataatcacaaattgcttgattgattattactctgcatctgccgcaatactctaacaaacctcggaagataaaataacaaatcctaacaaacttaatctaaccgaatacctattcgtattgcaccgttactcgtcacgcgtgttgtcgccgatcaagattcctgccgtgacgccgggcatactgcagtgcccacatgacatctctcccccctagagaagcagctcgtccttgagctgaaaactgggataaagagcgcagaactcatcgaagggcatccacgaagcttcagccgctggacgtcctttccattgcaccaacagttcacgaacatcccgagcaagacgactctgaagaactttgtccagctccaaacatgcacggccatgcacgacgtgaggcaatggcggaatgtgatcaggaacagtcctccgaaacagtttgagcaagcccacatgaaacacatcatgcaacttagtagaaggaggaagacgcagccgataggccacagcacagatgcgctccagaacttcatacggcccataaaatttcggttcaagtttgccacgccccttgacattgagagaagcgaccggctgatgaagtaatctgagccacacccaatccccgactgcgtactccacctcacgatgcctatgatcgtaaacggacttgtattgctgctgagattgctccaacctttcacggatagctgccaggaattcatcacgctcttgcaaggactgctgaactgccggcaatcgagctgaacccggttcataagagcgaagaacagggggtgtgtggccatataccactcggaatggagaagttcgaagtgaagcatgatatgaagtgttgtaacagaactccgcccacggtagccaacgcaaccactgccgaggacgatccccggaaagacatctgatatacatggcaataatcttgttggtgacttctgattgtccgtctgattgtgacgaaaagcagatgtgaaattcagttgaacacctgagagatgaaagagttccccaaaaaaattgctggtgaagatggggtctcgatcgctcacaatggacgtcggaatcctgtgcaaacgcacgatctcagcaaagaaggatgctaccaccgtagttgcgtgtaaggacgtgccaacagaataaaatgggcgaacttagaaaatctgtccacaactatgagaatgactgtcttgccgtgcactcggggcaatccttcgatgaaatccatagcaatgtcagcccacacagccgacagaaccggaagagactggagcagacccgccggctgtagctgctccgttttgttgcgttggcaaactaggcaggcacgcacaaactcctggacggtggtgtggtcacgagcaatgtggaagtcggcgcgcaggcgagccaacatcttctgggtgccctcatggccgatgtcgtgggcaagctccaaaatcactggaagcagtggcgacgaggatgacacaaagacacgtcccgcaaaggtgatgaggccttccgtcagtgaccattgtggcggcttgaggcccttgcggatgtcctcggtgaggctgatcagtgccggcgtcgtggccacctcacggcgaaggtcgtcgaatagcccgaaagtcggcgaagaaagcaggaacgcttctgtggtgtgctcgtcgcaacgtgacagtgcgtctgccacgacatttgttgaccccggcttgtactccaccgcgaagtcgaagccgagaagcttgctagcccactgatgttgcggcactattgataggcgctgatcaaggaagaaacggaggctgtagtgatctgtacggacgatgaatcatctgccccagagatagggtcttcaatgcctgaccgcctgtactaagctaatgagctcgcgttcgtatgcagcgagcttcgcatggcggcgcacgatgggtttgctgaagaacgctaccggcccgccaccttgatgaagcaccgcgccaaactcagatcttgatgcgtcacattcgacgatgaaattggtggtgaagtccggcaactggagcaccggtgcggccgtcagggcgtgttgcagctcgctgaatgccgtcgccaccgcctcattccagtgaaagccctccttgcggagcagggccatcaagggcgccgcgatggtgccgaagttgcggatgaaacggcggtagtagcccgccaagccgaggaagctgaggacggcctagatcttgtgctggtccatggcgacaccatcgctagagatcaggtggcccaggtaggatacggcggtcagcccgaactcacatttggagcgcttcaaatggaggtgatcatcctgcaacgtctggaagacagtgcgcacgtgccgcaggtgttccgcccatgtcgagctgtagataagtatatcgtcaaagaaaacgagcatgaaccggtggaggaagggtaggagcatgttgttcattagtgcttgaaacgtcgccggggcgttggtgaggccgaacagcatgacgaggaactcgaacagcccttggtgagtgcagaacgccgtcttgtggacgtcatctggatgcatgcgtacttagtgatagccggagcgcatgtcgagcttggtgaagaacctggcgccgcgcagctcgttgaacaactcctccgccaccgggataggaaatttatccttgattgtcttgtcgttgagagcccggtagtcaacgcagaatcgccacgagccatccttctttttgatcaacaatgccggagatgagaacaccgacgaacttggccggatgacgccttagcgaagcatctcatcacactgtcgctcaagctcatccttttggatgtgggcatagcggtagggccggacggctacggcggacacccaagtggcgctccggtggtagaccgtgcgggtcgttgaagagaatgcggaagtcgtcgagcacctcagccatcagttcgtctggcgcaccgtcgagagcgatgacatgtgttaagggtgacggagcgtcaacgctaacccatgtcactttgttgtcacctgtgccgaacgaaaacgattggtcagcaaagtcccacagcgtcggaccgagcgtgccgagccaatgtgcgcccaggacgatgtcataccctcccaacagaagggagtagaaatcaacgtcgaaagcggacgtgccgatgacgacgtgctatgccgggcagcgtcccagcgaggcgacgcggtcgccattcgcgacggtgacacggaggccggggcacggctagaggatgatattcgcacgtgtgctaccgtctcgctgaggaagttgtgcatggagccggagtcgaggagagcgaggtagtccaccgtcccgacgcatgcacacaccttgatggtgttgaacatgagtgcgcggataccggccagggcgtgtaaggagatgagcagcttgccagcgtcagccaagattgtgttggccgccggtggcgggtcgtcctcgccctccgtgtcgtcggggaagctgatgacctcgatgatgaaggatttctcgcagtgttgcccggaaacgtacttttcatgacagttgtagcagaggccctcggtgcgtcgttgtgccatctctaccggtgacaggtgcttgcgtggaagtgctgccaccaggggctgcttgccggatgcggtcgtcgacgcagcgtcagttgatggcgttgaagacgccgtggatggtgcaggcagcaccatgcgcagtgcgcggacagctcgctcgggaatagggtcggtggcgcccaagtggaggcgttgttcgtatgcctgggcgagcatgatcgcgtcgtcgagagtggatggtcggcgaagcgcgacgtccgtcttgagggggttgacgaggctcgccatgaagagttgaatctgctggggctcggagagctcgacgtcgcggcacaccagggcgaggaaactgttgacctagtcctcgaccgtgccggtgcgccgcagcgccgttagttcgccaagtagactgtccgtcatgggcggtccaaaccgcgtatgcaccaaccggacaaaacgccgccacgacggctcgctggaatcgagctcgagcctgtaataccataagtgagcgtctcctattagatgcaaagacgcgtaccaaaccttgcgggagtccggagttttctggccgcggaagaaggtctcgcagtgatttagccatggtagcagatcgcccttgccatcgtacgtgggaaactcgagcttggtgcgaggcaggaagttgttgtcgaccgccatgtcgtcgccgtggcgttcgcgtcacgcgtcggtgtcgtcgaatggcttgtcgtcgtgcggctggcgaggcgcggagctagaggaacccggtgctggacggcgaggtgaagcgcacggacctgctccgaatattcaaatgcagacgcctggacttgagtcacctggtccggcaatgcatcaagctttgctgcgagcggcaccaatggctccagcgcactcatcttgcgagcgagatcagaaatttgggcagccatggaggtgaggttttttgctatctcatctaactggttttgtgtggaggccatggaatcggaaccagaggaatatgataccaagatgtcacgagctagattggatgaaggaatatgtcgaaggttatacttgaaggaagtggagggacgtggccttgcacctcgtcggcgcggcggtgccgtgatcggcgacgcaccagcgaggcagggcaagaactgatatgatcacaaattgcttgattgattattactctgcatctgccgcaatacttatagtggggatgtcttacaaatcagaaacaaactctaacaaaccttggaagataaaatgacaaatcctaacaaactgataaaatgacaaatcctaacaaacttaatctaaccgaattcctattcgtattgcactgttactcgtcacgcgtgttgtcgccgatcaggattcctgtcacgacgccgggcatactgcaatccccacatcacattcttatttcccacataatcactaaaccctagccacctccaccaagccaccgtcccctgccgcctatcgtttgccgtaccgaggctctaccgtgaatcgcgtctagcctaccgttttagtcatagccatccgtctttccgttaactgttcgttcgaacgaagtgtcgtcccgtgctttgttcgttcggttgttttgaatcattccctagttgaaaccgttcagagccgccggttccgttcgccggtttcagttgatcatttggatggtcccgtgtcacgtagaattgactcgttgagtctcatgaggcttgcttaccaatgttatatttccgttgatcctattcctttttggcattaatatatgataaatgaataaggtttttcggttaatagtaataacacatttcatcttgtaaaattcatatataattcattcgagctccgttttaatccattcaaattgccgtaaattcgttaaaatgtctagaatccattaaaattggtttcttttgctgtttcagtagctttatagcttgtatttattgtgtgccttgtttgtcgtttagaatccagcagttccaatgctccagtttattttgaagtggttgccaaggttctgtcagctcaagagcaaggaaagtcatacgaatatcattgatcatattgtacccatttgcaaagtccctgcttttctcttaaaattgcattattttcataatgtcatgtgggatggaatttacccgtactcagccttttgaataccttaattgaattaatagcctgggatattaatttgactagatgattggtttagaaatgcttagccatgcttagatcaattagctcacaatgggattcattataatttagtccttaattattattattattatgatattataccaccatggtatataattaattaactaaaacatgttatattggtgggtcgtgggtgcatggttttgcaagtggcacccatgacaattaaggaccggttctcgggaatccctagaagataaactcgtactatccacaagcctgatgggctccgggtttgatctaagtataatcttttctagctaacacaccgttggcaagggtgggcatgatggagtatggatggaactgtatattggtctatgctgctttcggatttacctaggcacgagcggggactgcccatcgcctatatagggatggggtgaaaccggaggtggatgtgttggttagaggaggatatatggagggttatgtcacgatttccccctttgcagtatcgtagcggtacttcggggaatggtaacatgtgtggaatcatgtcttgtgggtaaagttgtacacctcttatcagagtaaaactattcgaatagccgtgcccgcggttattgggcagtcaaccagctcaccgtgattagtctcaccttaataatttgacttattgaactggtgtagttcaggtggtttggttgggcctgtttcaatctggacttagcgttgtatagtgatgatggttaatactgctgcttaattatatctattgttttactgctttcaacttctgatttataaatgttgctttcattcaaaatatcctatagcctattccttcgtgatatcattgcatcataccttccccttggtatgacttgttgagtacggtggttgtactcagtcttgctttatttttcccaatcccccagaagcagagaatatatcagatggtgagttctatgaggattaagcttgtgccagatgtcgaggttttgcctgtggatttggaggaagctacgcttttgtcgtgaagattaagtttagatagtctttagtttttccaatgcgtttgtgagtttattttatatttttgtaagtcgtggaactgtatcaaattgtcgttcgtgtactctggttgatgcctggacagaggttaaatgtgcagatagccggtgattcgggatgtcgaatctctgggcgtgacacctccccacccagcggtgcctctacccctcccctcccctctcaggaccggggcaccgctcctcctcctccccctccccctccccctcccctccccttttgacggtgcctctcagtgcggcggcttcccgcgggtagatccggcggcactgaaggtgttggccgcttcccacggcccagtctggcggtggcggcagcttcccgcggtggatccgatggcaatgatggtgctagcgacttcccacggcccgatccacctgcagcgacgactcccgcgttgaatctgacggcgacggcggcagccgcagatttggtggcaccgactgcgccgatggctacacgcgtggcggtggcgctggcttcccgcatcggatttgacagctacgacggtggcggtggcttccggtgatgatttttttcctctttcgcttggttgtcctattggattttgtgtctatgtttgcgatgaattttcacagaatccatcatgcatttggttgttgatgcgaactctggatgattttttttttgtcttggagtctcatctcagatgttgcggacgagggattttttttaaggggggggacggacgaaaaattaacgtgttgagggacaaggtgacgatcggaaattttaattagttctattaagaggtgccttttttaaaaaaaaactaacgcttataaaatattataggtgtccgttagtttaaaaccgacacctataatatcttataggtgctggtaaaaaaccggtacctatgaaaaccgagccgagtcttatccaaccatccacagcgccaaagccgagccgccagggcccaccgaggagataaggcaccgagatccatctaatttttttactctctcattttcctctcctctctctcttggtcttctctctcgctctcctctctccgaggcggcagtgcaagaggggaggcggcggttgacgggcggcagcggcgggtggagacggtgcggcccagcggcggcggcgacggcgatggctgcgccctcccctccgcggtgtacagcgggaggagcggcggatgcccggaggcaccctcccttagccagatctggcgggaggaagggctacggagccgcgccgcctcaccgtcctccgtgccgcccgcctagaaagcagcgcaaggattgatgccgtcattgccgccgtcccacgtcaagctcgtccacaaggcctacgactgcaccaagcacttccgccaccgcacgtcgcctgcaacccgacgtgcctcctgctacctttgtaccgcagcctcggattctatcatttctacattgtcacttagatggatcggatttgggagggaggtaatacatgggtattaggtttcttgtggggaacaaattcacgaggtcgagattaaatttggtatttgcgtgttgtttttggttgtctagttgattgattgatttggagatctagcttgtggattatttttttttaagacagactcggactcaaacgattgggaggaacgaattgcacggatgagtgaaaaatcacgcataccgacaaaaattaggtgacggttggaagattatgaatcttttaattagttaagttatagattttgttggtttgagctatacctggaaatctttgtcgttccggatattcaggccggtgaatatcacagaaggcgaaacccaccacgtgcattacgagcagactggatctggaaaaggccgagtaaacaaacttagctggcatcattttcctttagttatatatatatatatatatatatatatatatatatatatatatatatatatatatatatatatatatatatatatatatatataatgcatgattagaacaataaaatacataattaaaagagtggcgcgaatatataagacaaataatttgttcttcaagataatcaagcatacagtcacacacttacttagtagtcacacaacataacattcataaacccccccagacatagacatagtttctcaaactaataatcaagcgatacagtcatacacttgatagtcacacaacatcaaacatttatgttgtgctaaatacaaaccccatacacttggtagagtcacgcaacatcaacattcatgctgggctaaatacaaaccccagacatcagtaacgtcagatgaccacacaatgaagtctccaccaaactctctcttctgataatgagaatgagcttttatcccgtgagaatttctaaccttgtaaaatgtttctgttttgttgccattagaccctactccacatccgatcaaagcaactgcatgagcatcactagtgttctcacatgttggggcacaataatactgaccatcacttaagtaattaaataggaaaccgtgacgaatccctgctactaatgggaagcctcctgccaacaatctagttatataaagaacatccttagggtcaacacgaaaataactttgaatcttaaggcgtgggactggagttgttgtaacatcagaagctccaatcaatatagcaatcccatcactttttagaacttccatgacaattggacaattatcataagtctcatataacttatcttgaggttcatttcctagtttaaaaccagtccttttgttatatgtctcaaccatctcatttatatcaaatggagcagaaaacacaaatcccttttgtgctccttccagtctacgggtacaatcaattaccgcagtaattgcatatagagtacaatgtgctgaaatgaaaatacagggaaaattttaaaaggtattcgtgttaaagagacaggaaatgtagtaggataagtgtatccaaaagaaaagtaaaaataaatgaaataatgataataaaaattagatgaaacaaataaaa

SEQ ID NO: 53081 - DNA, 1951 bp, Oryza sativa
tagttatataaagaacatccttagggtcaacacgaaaataactttgaatcttaaggcgtgggactggagttgttgtaacatcagaagctccaatcaatatagcaatcccatcactttttagaacttccatgacaattggacaattatcataagtctcatataacttatcttgaggttcatttcctagtttaaaaccagtccttttgttatatgtctcaaccatctcatttatatcaaatggagcagaaaacacaaatcccttttgtgctccttccagtctacgggtacaatcaattaccgcagtaattgcatatagagtacaatgtgctgaaatgaaaatacagggaaaattttaaaaggtattcgtgttaaagagacaggaaatgtagtaggataagtgtatccaaaagaaaagtaaaaataaatgaaataatgataataaaaattagatgaaacaaataaaaatggtttcagatgataaaaggagcaccaaaaactgtgttgaattctaagttctctaacacaaataagaaataaaatcacatctacaatcaatgtacaatgtgtaatttgtgaaatccagtccaaagtgcaaatgatggtaactatatatggtgttacgggaaaagataagtaaccttggtcaatgaaagtttaccaaaataaaatttactcaaaataaataatagggatcggaatagtatacttacgttcaagtttttgatcataggtcttaaaatccaaagaaataccattgagtgtacattgagttatcttccactcgtaagctgcatcgttctgagagagagagagagaggaaaatggtagtaaagaatggccatgtacaaatatcttatatttaaaacttctttacgaagtaaaaaagcattaaagatgtgaaaaagatgaatggagctagtttagaagagagagaagtaaaaaaacattaaagatgtgaaagagatgaatggagctagtttaaaaaagagagaggaaaatgcaagtaaaaaatggccatgtacaaatatcttgtatttaaaacttcttcacgaagtaaaaaagcattaaagatgtgaaaaagatgaaatggagctagtttaccttcaaaccacagtcaacacacccgaatggaggcaagtctacaagcatattcttgataggctcgtactccttcctacacccggggcaaatccaattcctgacgtaatccatggccttcctcttatcacggtacatggcagcccgctcatctagctcagaaatctccggagcaggcccgatgacccaactacccatctgaatctgatgccagcaaacaagtaaatgaaatggctaagaatgtgcatagcagagaagaagaagggagggtctagagcccttcaggaagagagaagatagcgtacccggcagatcggaggcggtgcgtgccccggcagcgtagataggcgagcggcggcagatggataaacaaggaggagaaaccctacataatgggggggattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatatcgacaattccaaaaaactgctcatactatcattatagtataatgaggagcggttgtatatggccctatcgtctagtggttcaggacatcgggggggggggtggcaagtgctgctatggctatgggcctgcccttttgggccaggccttcgattttcctttttcctgaatggaataagttcaccatagatcccttaggttgatccacgtaccaaaatacttaatataacgcgcctttcaactcctgaaactgttgcaaacttaatcctaagacggtttggatgatggtttcaactgacatgg

SEQ ID NO: 53082 - DNA, 5162 bp, Oryza sativa
tgactggatcctcatcccacatgagacttgcaatcataaaaaaaaggggctttgtttctgtttcacccattcgtatctattagtcttgtcaaacttagaaacttttgttttggacgaagagttgaaggacaaattcacaatcatctataagaatttagttttccaacgtcgaaatctataaatggtattgtaaatacaaagagtgtgttctcagggatgtggggattattaatgaaacaccaatgaacataggagattgtttgaggagaagaggtgtactaaatacagggttatggatgtcttttgtgctagtttttgttggctagtgtccttaacttgcatgtggtttccaaaggaatctcaacatgaagagatgaagagacctacagcaagaggaataaccaagcagaaagactaatggaactgaagccggtggtgtaaatgatctacctgatgctatatagttatagtggtcgatacaaaagcaaaaagactacaatgcccctgctttatcaaatctcaatacaactattcctcaatttatctactcccaatacaattattccttactttcacaaactccgatgcaatagtgaacttattttgggacaaatggaaaaagctaaaaatgggacagagaggaagcataaagattctacctttttcttgtttcctgctggtctacagtctagaagcattcttcctctctagcactgcagtccactatatttatggttttccaggatgctgcaaagcacacttcattttcattcttcaaagacaaagggctggttagaaacaacaaaaataagaaaaacagtatgacctgaattgcagtacacaaaaaggacagcatctcaccacttgaactggcgttcaacttaacttgtcggtcatcgctgttcatcattcaaatgcttgctctctgttcactctctcctctcattgatcctctctcttgtgcattctcgtcaacaaaatcttagcaacttgtttccggttagagaatagctcggacacttttatcaagtgaagtcaatgggttcaactgttcaagccttccaaaccgcatctttctttcacaagtagtcaccactggtcagggtcattagaaggataattccaaggtgcacctccaaaaatcaagccagcaccaggatgatgtgtggcaaataagctactcagcgcagattttgcagtttctatgtcacgtctgtcagcaccataatcccggtttatgtgaatttctcttaggcatgctggcaggtgatcaatgccaacaggtaagcaagtgccgctgcatttctaccatcccgttgcatcaagccatagctcaagcttctgtaacctgggcatagaacaagctttgaagtccaggaatggcttatgacacctgaacagcaagtgcttgagagctcggaatgccatgcccgtaccggagaagatgactctttcttctgggcacactagaagcctcaagtcgaggtgaacaagggaaggtaaacatgcaagaatagtaacaccatcatccatgggcaatgccttcctaatcgtaagcttcaagctgtgaaggtcacgaagctgtacgatccatgagggtatcctggaaaacaagcaacgttccagatggagcttccagagatggcgcggtggaggggacagtgtgctcaagccatcaacctgcaaccatgaaggaaaatgtttcagcagaacgatgttcctgaggctgccggaagatcgcgagagtcgttcaagggaacagcgcagggcttcaatacggctagtcacatcctccaagggctcactactgctgcagtcaagtttaagatctcttaagttggtcagctcaccaaggcattcaatattgctcattgagttttttattaaatcaaaccactctaggttacgcaaggatttcaggtcgccaatcccattgggcagaactgtatttgctggaataaacagctgtgacaaatggggcaaactaacaatatctgatggaatgctcaattcttctgatgtatgcagctcaattgtctccaaatgccacatcccaccaagttggctaggtagcaccaacttgacatcatgtgaaatctttaaatatctcagcagagaaaatccacagatacctgtaaggtccactctttttcccctccatctccgaggaaattcaagaagtagaactcgcacatatttgaactccaaggatgaaggcctaaaactgtttttgaaaaatgcagctgaacgaacttgtgacagtgatctattgtttgatgctggtatcacaccgtcctcttcatcagcatagtggaaagaaactcgacggatcttcgtgtgcagtcctggtgccacagtacgatcatctattacagaaaagaagttctcctcggcagacttcgacctgataatttccagcattatatcatgtattctgcaggataacacctcatcattgtaatctgtatatatgggttgaaccatgctcctattgataagctcattgaagtagctacctgcaacatcatccacatctagaccactgattttactcacgaagccttcagctatccattgtcttaccaaatcattcttctttattatgtagtcctctggatacatactgacatatagaaggcatgtcttaagatggtgaggaaggttattgtagctcagttccagtatctgcctcattccacccaaggtaggatttccttcaaacatggacctcatagaattatttacatattcccaggtgatatatggttgaccagatagaaggctagctatactgatgattgcaagtggcaagccatcacacttttttagaatattagttgtaacctcttcaaatttattagggaaagcttcatgggatccaaatattctactataaaagagatttcgtgaattttggtcagtaagtgatttcatcttatatatatacgcttgactgttggagcaacaggtggtagcaacagacaaaattcgtgtagttgttaataccctgctgccatacttgttctctggaaaagcacatctaataatgttccactcaaaggaatcccataaatcatctaccacaatgaagtacctgccaaaaaatttcatggatttctctacacagtatcaacgtaatgtagtacatagatgaaattgtgcaaagtgtcttacatatatctatttagaggaatagcttttcggcaagtgaaataaaatgaattactaattatctcacggggtcaatagaaaaaaggaacattgaaattcatctaacttcatgctttctttataaatagaacataagaattcccggccaatgaatcatcccaatgtactccctccgtttcaggttacaagacattttgactttagttaaagtcaaactgcttcaagtttaactaagtgtatagaaaaaataataacattttcaacccaagacaaatttattatgaaaatatattcgattattgatttaatgaaactaatttggtattataaatattactatatttgtctataaactttgtcaaatttgaagtagtttgactttgaccaaagtcaaaacgtcttttaacctgaaacagagggagtataaggctcccatcggatggcccattaagccaaagaaaaagccaaattttaaattttcaaacttaattttgagattgattttgagatattttcaacgtagtttctttttcagcattggcttttaagttaccaagaacacatatataaaagttttacctacaaatttatttttatttcctaataagtcattttggcttattagaaaaaaagcaaaatgatggggccctaatttaatgaacttaagggaactttggaatgtagcactttaaagtagtgatagtagaatttttatccatttatactcaccttattttgcatatgacattcaaagtttgaagcgcattcattacttaacctttgtacattagtattgaaaaatcagtttcatattctgagtgtcagaaatctttgtattgccgcctgaacttgcaaattgaatttcaacacttaaagcttttaaattcgaagtacttataattcaagttattatgagcacaatctacaagaattggaacgaacgtaaaagtaggaatcagaattttcatgcatttaccctttcaagttatagctttgtaggcctgataattttataggacttcacctagaatttagatggtttttttagataatgaacaatttaaatctacttatgtaatttcattttttgacaaaaacaaaagcttatgactgcaaacatagtatgatacatgagaatcattacctcttatcccgcagactatttatgatatcattgagaatcccatccaaattggtgttgtgcacagagcactgccccctaacttccaataatattctattgagaagttttggtatgtcaggtttttgagataccgacacaaacgcgccgcagtcaaatttcctttcaagcttgcggtacacttcctttgcaagcgtggttttgcctacacctccaaaacctacaatagaagccaccttcagcccttgctcttcacccatcagcaatttgaggagctcatctcttggcgcatcaattccaacaaggccagccgcctccgaatagattgcgaccactcgcgggtcaaccggaacatgtctggaattgggggtatactcatcaatcttgtacctcatgcggcgctcgctcacctctttcacaaggttcttgatctcctgaatactgttaccaatctgatggcgtgcccttatctccttcagaaatttaaccgtcttgtgaacaaatccattgcttccattgttcttgtcaagctgatgcaagaaatcatcgatgcaatcctcaatgtcataggacatctccctcacttggtctctccactccttggcctgaccatcaagctcatccatggcggcgagcttctcaagaagggccctcatgcttctcaactcgtcctccaaggaagccacctccttccggacgcctctcagcttgccgtactcttcccccatcagcgcggcgagcttggataggagggagttgatcgcaccactggaggcgctcgccatggttacggccaaagatatctttgttgcttagtcagtacgcactcacttggagttggaagaagccg

SEQ ID NO: 53083 - DNA, 4869 bp, Oryza sativa
aatttaactgatacgccgttgacttcttaatatgttgaccattcttcttatctattattccctcagtttcgttttatttgacaccgttaattttttagcatatgtttgaccgttcgtcttattcaaaaacttttgtgaaatatgtaaaactatacatatgcataaaaatatatttaacaatgaatcaaatgataggaaaaaaattaataattatttaaattttttgaatgagacgagcggtcaaacatgtgctaaaaaatcaacggtatcaaataaaacgaaacggagggagtatatactaaaagtacattaaacttcctacaaactctctcaagctgccacgtgacgctctaataaattagagaaaatcttagaaattctaagaaaaagcaaaacatctacctttaatcacttaaattggtgggtccaacattacacaccgttagatgaaattgatcttaaaacaaaccaaatactatgggtcctacctctccttctcccgtgcatgtgtacgtggggatatataggtacttaccatgtacgtacgcccttcttttcttttttttttctttttttcttctttttccatttatataatatggctatatacttttttaaataatcataaatttacaacacaaagaatctactaaattagctctacaatttttagaaataaaatttaaaccattatatgtgaccattaaattaataatacaatatagtttccacttaaacatgggtactcattattttgtactattatttttaaataatgcactattttaaaataaattttacacaattatattgtgtacctatcaaataaacaatttaagatctatattaattgatttatacgtgcacttaaaccgatggatctattatttaaatcatcggaactattttttattacattggactattattctcaaataatgcatggtttcaaaataaagtctacaccattatattatgtacccattaaatcaacaatttaaaatctatattaactaatgtagacttacactataaccggtggacccattatttaaatcatcttatatattatttgctaataaataaagcgtccgaagttctcttttttgcccgctgcacaaggcacatatgcacctttgccttttgcacgtgtgccaaagcgtcttgtctaaggtatctaaggtgatcacgactaccgcagcactaccgttttgcaacatatcaaatcatatatggagatgattaattttgttaataacatgaaaagaaatttaaaggtgtgatgcagcgagagaggaattaagcaccgtgggttgtgttttttctaatacttagctctgtttaagctgaaaccgagagttaattacagaataattataatgtattgtgttatatatgtcgtatttgcatttggtactatttgttcgtataggtgaaataaatcattatgttataaatgtgagcacaattttaacgaatattaatagcactcttacaaagactagggtgttataagggagtttaagatccgctttttttcccgatttcatagttggattttcgtttgcacgctttccaagtttttaaatggtgtctttttaaacaacattttaactttttagaagtcaattcattcatttataccctaaaatagctatcacataaatcagataattcatcaatttcagttgtcctaaaccctaagtagtacatatttttttatgtgagtcatggtgatcagtaaattgtggatcaacggataatcaaagtcgtaagatgaatatataagagctactatgaacaactataaatacgtgtcaaaattaattgctactaattagacatctaatggcttgctagccacataattaatttctctcgacatgtatataaacatgcacgaagctggaacaaatattattatatgccctatacatatatattaagcggctaatattctaattacatgtgttaagtcctttaaaatttcttaaaacgctctcaagctgccacgtggtgctccaataaattagagcaaatattagaaattctaagggaagaaaaagagcaaagtatccattacttgatttttcatttaatcagtacgtccaatattataaaccgttaaattaaattgatctttgaaaaaactaaatactataaggtctcacctcttgtcccgtggcataggtatgcacctacgtacatgggtacgtacgcttcccctcccttttttcatttttccctttcttctttttttccatgcatacacttccctccctttcttactatatcatacgccttcttgagatgatttaatcacaagaattttgagtatcatgctctcacatttttcatttgttgccatactacatggtatgcatatagatggacggtatgataattaactagcaatagtttcttatttactcgagaaaaaaatgattcaaaagtcatcccttaagaaaaagtttgtgaatggttttttaagatactttgaaaaaaatagaacccttaaattattataaaataacattatccaactttagtttgcccttaatctatgagacaatttttgaacaaacaataattttacctttcaataatataagtgcccgcgcatgcgcgcgggccaccttcctagttaataaaattatacaattaatatttaagtatgatttaaatatttttatatatacacaaaatattcaaaataagacggatgatcaaacattaacaaaaaaaaagtcaacggcgtcgtacatttaagatagtcctagaaaaaggtcccgcacattgccgtaggatcgcgcaagattatcaaatgctcaacttagattaaagcagtgatatatgtatattattatatttattgtatgtgctattatatgtatattttttattggaaaatagatatgttcaattataaagggcacaaccatttgagggttttactgtaatggacaaatgatttttctcatttgtatcataggaatttttagtaagaacttacaatgaagattaagtgtttcacgcaaaacgaggtggtaataacgtgtagttttgattattacaaacttgaaaaatggattaatctgatatttttagagcaacttttatatagaaaggtttcgtatgaaaagtaccgtttagtagtttaaaaagcgtgctacgagtatccaaaatttcatcccacctttgttggagaaatgaacgcagcctaagtattcatttctgtatgatttttcagcagcttgaaaaacccaacattaacctaatatgtcattttattaatttaaaaatagcataattcatcaaactcatcagaataatcaccctcacattattttttgggttaataggatccatgccattaaaaatatgttggttttgaaatatgccactagtatttgcgtatctggaaccatgccattataattttacacatattcgagatatgccactactgtctacttatcctttggatgcattttaaaagaaatatctggaccaaacgaccctttttccccttattccttctcccttcttcccctttcatcttccgcctctcttctatggcttcacctgaccggtgatggtggccaccacagttacatctcctccctctctgacactccttcgtctgcatctccctccaccttggcccgctgccagcctccttccacgtgtcatctccctccacctcggcccgccgccggcctccttttgtgcttcagcgcatcccagatccagtcacctctctttgccgcgaggagctctgggcagtggcgacgaccaaggaaagagcggccacttctctccggtgagctcctgcaccttcctccctccctcactgcacccgtagctcctctggtccagcagctgcctccaccacctcgtcgccgatgtccgcctcgacgcctgatgcagcgaggacggccttcgtgaagagccttggcggatggcagacctgcggtgttctgtccggtgctccgagctcctgtggcaaacgtcgctgccgacaaagagaggtagaagatgagggtagagggaggtagaagatgagggtattttcgtccaatacatacaaaataagtatcttagtggcaccactgagattacaacagaagtggcatcgttacaaatacttttttttttgtcttttcatttatacgttttcacatgagacgtacttggtttgacaccatccccaatacctcaccagcctgcttcaaaacttcctgtactagttgatacctcacgcgttactgtgggagttcaatataataacaataggtaaaaataatacgtaaaatagttagacaacatagacttacataagttgatgtggattataataatttaaatttaaataatacatagaatgatgattcgaagataaaagtaaggtgatgtatatgagagaagaaaatgaggaagatagtttgtactatagattaatcatctaagactaaaaataattggtgtgatatgacttaatgagagaagagagaaataatgctaagtgagaatgaactatatataagtatataagataatataaaaatgttgaatagatatattgaaatattatatgaattatatgggacgatgatttaacatgcttgtattttaaaccctaaaatttaataaatgataaaattgtagataatatagaatgcttgtatgatgtttaaatgtaataattgttagtggatgataatgtgatatttttgcatgttaagctttaggatttagtgggctataagtttatagtgtgataggatttaggtgccactttataaaatctgtttttcaagttctcccatagtatctcacctttttccttagatttcatatacggtttct

SEQ ID NO: 53084 - DNA, 5527 bp, Oryza sativa
ctatagattaatcatctaagactaaaaataattggtgtgatatgacttaatgagagaagagagaaataatgctaagtgagaatgaactatatataagtatataagataatataaaaatgttgaatagatatatgaaatattatatgaattatatgggacgatgatttaacatgcttgtattttaaaccctaaaatttaataaatgataaaattgtagataatatagaatgcttgtatgatgtttaaatgtaataattgttagtggatgataatgtgatatttttgcatgttaagctttaggatttagtgggctataagtttatagtgtgataggatttaggtgccactttataaaatctgtttttcaagttctcccatagtatctcacctttttccttagatttcatatacggtttctttaatttacttcattcctttgcataagtttatttattatataaaatataacctatttggaacattttccttattactgaatggaaatggatagttttataattaacaacagtactaatttgagctgctaagtccaaacctggaatgcaagaatttaaagtcaaacatcacattgaccagaaatatccctcaaatttttgtgtttgtaaccttcttattttaagtatgttgttattatattccaaataaggtgtaagttttccttataaaatataattaatagattaattatagtagattttataggtgatttacgagatacgataatttgaaatatgtcaggatgtgtaaacaggatatatatctaggtgctcatttctcctctagcgctgaactgatggcctagctttagttacgaactacacttcattgcattttgccttaggccccgtttagatctcaccctaaaattttacaccctgtcatatcgaacgtttaacacctgtataaagtattaaatataagctaaaaaataactaattgcacaaattacgactactttgcgagacgaatcttttaaacctaattgctccatgatttgataatgtggtgctacagtaaacatgtgctaatgatggattaattaggcttaataaatttatctcgtggtttactagaggatactgtaattagttttttattagtacccgaacaccccatgcgacacccaatataatacccgatgtgacacgcgcaaactttacacccctggatctaaacacctcgtatagtgatggtcttgccttgcctgcatttcagtgatggttggatcctactacgtttggtgcatagaacccctggggcagagtgtaggcctgatgttttaccgtgtgcgttgcagcagttaaatagagtacaataaaaccatcggaggttaccaattgtaaacagtgaaatagtaaaacatgcgacgtggatgaatgttgtatttcatgccatacctctctaggaatatagttatgtgtagtgatggttggatcctacgtttggtagatctcatagtgcagactgcagagtgtaggttgaatgttttactgggtgcgttgtaatagtcgaatagaatacaacaaagccatcggaggctaccaattgtgaacagtgcaatagtacaacatgccatgtggacgaatgttggttaaatcctatactatagatcccatggtgcagagtgtaggatggatgttttaccaggtgcgctgcaacagtcaaaatgagtacaacagagctatcggaggttaccaattgtgaacagtgcaacggtaaaacatgcgatgtggacaaagggagaggaaggttgctaagtgtgagaaagaagacgagccggaggcagttaggaaggggaagtacccacattgcacccagtagaacaaattcaatttccccaagttgcatgtctacgatcgtttaaacccttctgtagtcgaatcaattgaggagatgccgaacctatcgagcaaatttgtttccaatgcaccggaaccaatttatgttttatccatgtcaatgtttgtacaagtgttgatttcaaaagcgctggaaccaatttatgttatatccatgtattcaatattcgtacaattgttgattccaaatcatcggaaccaatttatgttttatccatgtattcaatgttcatacaattgttgatttcattgtgaaaatctataaagttgcttccctccgcggaatttgggaaaaaaaacaagacaaaaatcttagctgatgtgtaagaggatctcagtgccagaaagaatcgcgctaacagtacaaagctcagcactagcatatttggcactgaattttgggacttaccagcgcgcgacccgcccaaccaaacaaaactcctatgttgggtggccatgaggcgctgagctggcaagcctcagcgccaaaaattggcactgacattgaatacctcaacgtcaatctttggcgctgacctttgggacttaggcgcgcacggccgtcccacccaaacatagctcctgcgtttggtgatcatgaggtgctgagtcggcaagcctcggcaccatatagaatggcgctgaccatatagaagggctcggctacagcggcggccaagcttttaatctgctacctcaatgccaacgcggttggcgctgaggccttgccacatcagtgaggggatcagctctggctccacgtggacccggggggggaggggggtcaatgccaacgtctctggcgctgaaccgttcaacaacctcagcgctaacgtcccttgcattgagtctatggcttaaatactgtctaaagtcatttaaatggtaccatcaaatatatttagtacatggaagattgtttggtgctcttggattatttgagcacatttcagaaatttcacaaagtaattggattgtttcctctaactgacgtcaattcatttttcgatcaatttgcaaataaagatgtaaaagttataattgttgtggtagctagagttgaaagctgacctaaaccaaatatgtcattcttggtatgtattggcagcgaaagcataaagtaaatatcgattctgcctataaagagtccgaggggtattgtatgtatgtatgtatgtatgtatgtatgtatgtatgtatgtatgtatgtacgtacgtacgtatgcacgcacccgaccagccacaccattcgccttcattcacatcctctcccctcctattgcctctcatgttatcatcctatattagttaggaagcataatttattataatattttaaaataaatagctattttttatcagcttatgacattggacccatattaactatatttcaacttctaaaataaatatgttattttgggttatattctgacttttttcatatcatttaaacaattattaaaaaaaatatgaaaaatccaatgatatatattttaccggctaaaaatatttttcatgaattttcttcacctctatgtatatcatgtagtcctatcactattgaaatacaaaccaaataatttagaaaaattccaaaatgatttgagaatgctaatctcacacaaattaaagtttaaattagatctactttgaaaaaacacaactaaattctgttgtttgtattttacatatgtagattcaaattgccgttgtatatctgttaagtaatatttgatatgatagaatattatgatgtgattttttttgaaaaattgttatggaattaattaatacatgtcaagatcatctgtccgaatgtattttgcactaaaatatagccaacataagtcattagtataaaatcataataattacatcaatagcataaaaaaaataaacgggatgaataggaagggaaaaggagaatggaggtatgtacgtttatacattacctgtacatacgtacatgcggggagggatgcatatgtacgcgcagggtaggggggaggactaaaatcagtttttaatctaatatgacggtgcaaaataatggacctaccagaaaatcgagggctagatgtttctaatatattaaaacgccatgtggcgacttaggagcgtttataggagtgccacatgacgatatgagagcgtttataggatgtttaatggatttttagtatataataatagatacttgtaacgctccgcttttcgtgagacgttaaaaactaattcggcaaaatcctaattgcgaaaatttcgttctttgagtgttgagtctaagttgtgccaaagatctcaatttaaatccctccctcgtctcgataccctgttatcaaagatcgtctcctcaaaattaccatcccaatgtagtcccgaagctcgattccttctattcgaaatcccctcctggaaccccatccgtgaactttgtcgaatgcccgaaccctaactccgtccaaggattcaccttcgcgtcatatgctctctcattggttccttcaaaccgattctcaaattcgaattcaacctctcaggttttgattcatctatctttctccctgtattggttcatcaatatacccttgttttctttctcgaacttctgacccaagtctgaatatgcaaatcgagatcacttccacccttgaactcaaaatcccaagattcaatcccttttgccctgagttctccccaaaatgatttccgttccgaaataatctcgaagtccgaacccttctattcagacttctctccaaaatccttacccacatatcttgttgagtagtcaaactcaaactgccaagttacactctctttctctaaattatccatccccttttgactcgtctccgaatattgttcccttccttgactccttcctattctcccgagaccgagtatcaacctcgaaattcgaatccagactccaactctaaaacctcccaattaaatctctctgtgaaagtctatttaacctccctcataggttggattccttcatcctttttccggtccacctcttccttttcttccatcccatctctctctgagtctcgatctatctatctatcgatcgatccatctatctatctactatacctatctatctgtttatctatccatctgtcaatccatctgtctatccgtccctctacctatcaacctacctttctgtctatctatctatccatggcattctaccgctatctcccttgttccatttttgaataatgatcttccctttttgaaatcctctgaaataatccttcgtgccgccaaatataaatccatcccaaaaataccaaaattcccgcttttgaagcccttccttgacccctcccttggatccaccttgaaccctcgtgtacaaatatacaaattgaattcaaattcaatctccacatcaaacttctctccaaatcaaaccttccggtaaaagtctattttacctccctcgtgatgatttgggccgaaacctgccgctggcccatctctccccaactccctccatctccacgtgcgccgcacatgaccaccgagagagagagcgctgtctctctcccttccctctctcgaacgttctctctctctctccctcgccgcgccaaaccgctcgccgccgtttgaatccgctcgcc

SEQ ID NO: 53085 - DNA, 7848 bp, Oryza sativa
  unsure (1)..(7848): unsure at all n locations
nnnnnnnnnnnnnnnnnnnnnnnnnnnnnnnnnnnnnnnnnnnnnnnnnnnnnnnnnnnnnnnncgcccgtgaacaccagccgagctcccttgaccgccaatgtcggtttccctcctccaaaccgacctctcctcctcgcctataaagcccgcgccctcccctctcgtttcgtcttcgcctcgctcgaaacacccgcgccattgttgccggccgccagctgctcgcccccgtctcgccgtcgcacggtccgtcctctgccgcctcctccctcaacctcggtcgccgtcgcgtggccaaccccggagcatcgccgccttcttggtcgccgcggccaagaacgccaccgccgcgaccaagggcgccaatgcacgcctccgttcccttccccggcacgcccgctgtgacacgatgccgcctcggcatcgcgttcgtcgccgtgcgccgctgctcgtccatgcgccgccatcggccttcccatcctcaactcgccgtcgacgccgttacctcccgtcggtgagctccccacctctcttttcctctgtcctagcactcgcgtagctcgcgtcacgcgtgctctgtttccgccgccgtgcgcaatcaagagccgccgttggcctccctttcggcgactcctctagccaccgccgttcttgagttcgctctctacctccccaagcagctgtttcagccgccggcctcccctctcgccctcgcgtcgcgtcgcccgattcgccgctgccgcgctcggccacttccgctgtgcctcccctgccgtcggcctccctcctctccttgattcccggcgccgccaccttcctcgggccccccctcgacctccccaacccctccccctggccgccgaccttcctccttgctcccgcgccgtgccgtccctcccgccgccgcaaagcgccgccgcgagccacagcccggcgaccatcgggtcccgcgtcaccgcgtgtgcgccgcaaccccataccgcgtccactaagcccgagcgcgcgagccgcatcccttcccatcgcgcatccacgtcggcatcccggcgagcttcgccgccgccgccggccgtcgtcacgcgtcgtctccccaatccgagccatggaatcggttcgccttgacctcctctagccaccggtgttcgtcgctcgcttcggctcgccgccgttcgccggattccgccgcgcgccgtgagccgtccgatgccattcccgcccccccttttctctccccatccgacgtggctgcccacgtggcgttgaccgggcccgcccctgcccagtcagccggtcagccgtccccctccccctctctcccctggctcgtgggcttggcccattggccagccttcctcctcggcctaacaaaacaaaggaagtttacttttactccctcttccgagtccggtgctcacacaccgaagagctaaaggtccgcaattgctccctccaattgctcctctctctctctcaccttcttattggccccactcgtcaatgagtcaaagataatcttgagaatgtctttccaatattccacaaatatttctctcttctataaattcagtaaatcattttatcttatttcatgggttaataaatctttttcccttgatcccataaatcaattctctattccaaaatttcatgaatcattttccttataaatcatttcctttggtcccgcacgtcagagacggtcaataatattcttgagaatattatttctataaatttcatgaatcaatctccccttgttccacaaatatcttccttcgccagaaattctaattaaacttccaaaattcgtatctctcgatccaatcgtccgattgaccccgttccacttccagtaattccataaaattgagatctatttaatggcactattatttagtctaaatagggtctttttcttggtctcttgtttaggtttttgtttgtttgcgcatagttgcggttaccggattttcatcgatcgtggatatcttgaagattcgtgaagcttcgtgaagaccctgagcaaggcaagccacctttgaacatattgagcctatatttgaacttaattatattgcttgcaaaatattatgcattgataggattacacttaatttgtttgccccgtctgaaaggcagaccggtgggcctacccaactcgttgcatctaatccttccattgttaattgttatatcatgttcccttgtaaccatctagttgcgcctcgatattcgtgcactctgtgcgagtatcgacggtcgccttcaaacttaaaatctgagtaacttcttgggtaaaacttggtttacaaaagctttggaaaacccgatgcctgggtcggtgccttgtgaaagaaaatgagttttaaaaataaaactcgcgacacaaggccattcctgggcggaatacttgtgcggtcgcatctaaggaccgattcctttggaattacatccgagcatacaatagtgcgaccacacgggtggaatgggacgcccctggctgagtaaattgctaatcgggggagccttgatgccgagagacatgtggattcgccggggtggtgtcggggaggatccctgggcttcctggcacagtatggtctgggacctaacctgttgttggtctgggacccctctcgtcggcatatggcaatcctgtgtctgctctcgaaatgccttgtcatgaaagcccttaggtcaccagacgtggccgttctacacgggctaggtgatttgggttagtaatgtcgtatgggtaaagtgtaccccctctgcagaggttaacaaactgttcgaacagccgtgcccacggtcatgggcggatgtgaggtgattccttagcgtagtttttgttttaccctgttttatgaaaaggtgttaaggtttgggaaacctaatgcttgggaagcatttagctgtccgggggacagcgggaccgggtgtccctggaagtgattggtcgtttggggacctctattatcgggaagtttggaaaattggtttggtttgggaaaaaccagatttgaagccaactctgggagttgtgcaaatcgtgataaataaatttgttacttctcacctcccgaccgagctgagacttgtctcgctctggttgtagaaagcacacacttagattgttgaaaacttgaaaacaaaactgtttgcaaaataacagccttcccttgaagcctgcattaaccacctaagttcccctggcttgctgagtacgtaagtactcacccttgctctctatataaatatagttcagtcagctccgaagatgaagttgaagtgaagtaaagattagggtttcgtcctagttccctgctgctgcctgtggtgttgggtgttagaccgttggttccgctgctgctgctgttgttggtgttcgcctcgtccgtgtcgtcggttgcattctcgggctgtctgagctgcaacctaagttaaggtaaataagtcctctatttattttaaggattgcaatgattcatatttatcaccgtgggtaccagcgctatgtcctgggactggtactgagatcgcggtttcgtaggaagcggttcgcgccatttttcccacgacacgctcctgtcaggtaccgttgtacggcggtgccagattaaaggaaaatcgagggctagatgtttctaatatattaaaacaccgtgtggcgacttaggagcgtttataggagtgccacatgacgatatgagagcgtttataggatgtttaatggatttttagtatataataatagatactgaagcgtccttatccccttaatgtgtgtgttaagtttacacaattttctggagtggtatacacatgctatatgaatgttctcaaatatttcaaatgctatatgaatggtatacacaattttctcaaatactgtttgcaaggtatatggtgaaacgatgggacatcatttgcatattctcccactagaatgcaagcaagcatgtactgttcatcaaacccatacattggataaacatttataccacattattgcatagctttgttagcagcttcttggctcgtagtcatcgcttcaagaaattgtccacctgtgccaagcaaagacctcaaaagtgaaagatcaagtcggcgctaggttgatgcacttcaaacgttctccgcaacacagacttagcagatattacatcctggctccccgaatctgtaaaaacatttactagatggatcttgagaccagatgatggcaagttctcgatcccaacaggtaggcaagtgccaccttgttgctccaaccattcacataaaaccgtaggtcgagcctctggagcctcggcatggcccccactagaaaggccaggcgaggcttagggcagctgaatgtaaggtccctaagagctcgaaatgccgtgccggcgccagagacgacgatcctctcttttggacattctcgaataccaaggtcaagttggacaagggagggcaactttgcaagaatacaaattccatcatcgccttcaaattcaataggcaccacgcctccctaaccaaaagtaccaagctgtagaggttatgtagctgagaaatccatctggggatcctgggtagccggcaaccatacagattgagtctgcgaagatggcggggtgaagggcacaagtcgctcaagcgatcgaatgacactagaataaaatggctgtccaggtcaaggctcctgaggcagctggaagaacgagatagactttcaagagaagagcacaatgcatccaggcgcctggccacatccgcatccgccaatagaccaatatcgcccaatggactccgagatgtctcatgttggttagctcaccgaggcactcgatattgttcaccgagtttagtgccaaatccaacgaggtcaaggtgcgtagagatttcaagcttccaatcccatcaggcaacgttgtaccgcaaggaataaccaggtgcaacaaacagggcaagtgaacaatatctgatggaatggctatccttggtacaaatgattcacctagatcaaatgtctccaaatgtagaagctgcctaattttcatacctagcttgaaacatgcgtagtagccacggatctttaagtatcgtagtagagacaatccacatatgccggtcaggtccatcacttctctcatcggaagttcaagatgaagaactcgtaaatgcttcaactccaatagagaaggcctgaaagagcttctgaacactgcgattgatcgaacttgcgatagtgacccaaggattgttgtcgatataatgccatgctcttcatcagcatcgtattggacagaaactctgtggatctttttgtgtgcccctaccacgacttgtggatgatctagtacaacaataaaattctcctctgcagactttgatctgataaaatcaagcattatatcatgaactctgcaggacaacacctcatcattgtagtccacctgcacaggttggatcatgctcctgttgatgagctcgttgaagtagctttgtgcaacatcttctgaatctaacccatgggttctactgacaaaaccttcagccatccattgcctcaccaaatcattcctctctatcgtgtggtcctctggataaatactaagatatagcaggcatgtcttcagatgttgaggaagatttctgtagctaaagtccagtatatgtttcatgtcttctaaagtaggatttctttcgaacatggatcccaatgaattccttacatactcccatttcgtctttgattgaccagctagaagactggatatgctcataatggcaagaggcaaacctccacatctttttagaatatcacctgaaatctcttcaaatacttcagagcaagcttctccagtgccaaatattctactgaataataatcttcttgagtctacctcaccaagtggactcatgttataaacatattctttcttattagagcaacaactaatagcaacagagtaaatcctcgtagttgtaagtactctactgccgtgattattttcaggaaaagcacatctaataacattccatgcggatgaatcccataaatcatcaattacgatgaagtatctacaaacatgtgatagtgtaggggtaggttagcaggtattttcagtagaattaatattttcatgagtatctatctaaagaataactaccatccttcattctagaccaaacttcatagtaggtattaacgataagtacaataacatcatttcgtatcaattaaaaatattcattttgtatcagctaaaaatatccattttgtatcagttaaattaaattgtggggtaaagatttctatatcatgcatacaattgttaagtgtaaatgggtggcccagcccgagccagtcccttctccagatttgtagacctattagcctcatttcggtacatccgaaaacctggtaaattctactaaataattaagaaaaataattttgtatttgttgttgtcaaaaatcatcttgacacatcgacgaggcagggccacccaatgaaactccaattggatgagcctcatccaccttttttatatggcttttcaacaactccaatgaatgttatcttcacccataaaaatattttactagtagttgtttctgatgatattggctttacaaacccatcgctacacacatatcctctcaagttaaaagccaatgcactcatcatctcaatggatcctgtttctctgcctgtccaactaaaatgacactaataactcttattatgtagtcggaaaaaaaatattagatggacttatgtgtagaatcaatttctgaacaacctataagaacagtgattttcatagtaaaatacgaaatctgcacagattattaaaaatatacaaaattaggagactagcagcaggaggaaagtacatggtagatcttttttttttcataaatgcacataaaccataatcacaatattattagtactccatccatttcaaattgtagtcatttctatccacgaatagcaatactccctacattctgtccagattcatatatagaaataatacattttgatagggagggactagggagtatgggtaaaatataaaatcggaactttgtagcataccgacacatgaaaaggtacctcttgtcttgtagatattctcggataaccttcagaaggttatctaactcgccaatgtgaagattgtactgccctgtaagttctgataatactttactcataagccttgttatatcagacctctgagagactgacacaaatgctcggcaatgaaaatgcccatccaatttgcggtacacttcattggcgagtgtggttttacctagacccccaaatccctgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggcttcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacagcgggtcggtttatatagagaagggtcacttgatcagggcgcc

SEQ ID NO: 53086 - DNA, 897 bp, Oryza sativa
cttagcttcctcgaaagttcagtagttttcttgataagcccagatctcacatcatacttgccaaggcggtgaacgaaatcatcgatgcaatcttcaatgtcataggacatctccctcacctggtccctccactctttaacctgaacatcaagctcatccatgcatgcgagcttctcaagcagagcctccatgcttctcaactcaccctcaagagacaccacctcgtttcggacccctttgagcttgctgtagcactcctcccttatcagtgtagcgagcttggtgaggagtgagttcatcacgccactggaggaactagccattatggccaactctctctttgctcaggttctctcttggcaaactatatgctcaggaaatgtgagagtagcacagataatgcttgcaggctcgtcttgattgtccagaaggttaattaacttaataatatatttcctcaagatccacgccgtctaaaataatcttacttggagcagcaaagagagcagagtacatgggactaagtaaaaatcaacccactctacttattttagaagcactgggtgttgacttattgccctgaatcaatgtactccctccgttttttaatagatgacgccgttgacgttttctcatatgtttgaccattcgtcttattcaaaaattttatacaaatgcataagatataaatcacacttaaagtactatgagtgataaaacaactcataacaaaataaattataattacgtaaattttttgaataagacgaatggtcaaacatgtgaaaaaaagtcaacgtcgtcatctattaaaaaacagaggtagtatttaggtcattaggttgtaattgttattttatagataactagcatggtggccgcgcatattacgcggct

SEQ ID NO: 53087 - DNA, 1065 bp, Oryza sativa
ccagcccaagcatggcccggctgtcgggccatgccatgcttgggctgggccaaattggcgtgccttgggccgggccgcaggcatcgggccatatggccatctatagtgctactgctgttcaagggaaagaattgaaggaagcagggagggagagagggagaaggaagaagaggaaaatttagggtttcgtggcttggtcaatttggttatattccagaataaaattcagaatttagttcctaaattatcaaactttaaccttgaccggtaggccaaaacattctttccaaatcttgtattaatccataaggaatcaaattttgtgttctaaatagaagttgttctccttgtgagaatctttccggcagtgcccaattttaattaggttaaacagtttaggataaattgcaaaaatagtaccaacttggttcgcaaccagtacattatttagttttcttcaaactgggcatgatagaagaataatcaggatttccacacatcatgtaagttctatataattttcttgtttcaagatttctttaggttagtcctagcacctggacagaaggtttaagcactaaggaatataagatcatctggaggcagataaactcccccaaattgtggagattatgggtaccccatatccacacgacatggttatccaactggctatagaggatatcttatatctatgaaatatgtaacagatcatgacttgggtattacgtttccttatatattacggaactgtctaaagttctggttcgataatattgtaaattagatttaggaaaccgacaccatattggttaaggtttctatcttgtaatcctgccccaattcacacaacctgatcgtcagatcaatactacactcagtggattcaaatccccaacatgagtaggatattacctctcatcgagagggcctgaacctgtctaaatccttgtctccgcatccatccacttttaggtctcgtgcactacccctttatattgccgaaattttgtttcgacagttggtgcgctagtgttgatgaaaaaatcgaacacactggcctgg

SEQ ID NO: 53088 - DNA, 1780 bp, Oryza sativa
  unsure (1)..(1780): unsure at all n locations
nnnnnnnnnnnnnnnnnnnnnnnnnnnnnnnnnnnnnnnnnnnnnnnnnnnnnnnnnnnnnnaatatttgaaatcaaagtcaaatttgaatcgggtatgtaaacttttaacttataaactttgggtctacaaactttaggtgtataaactttatatgtatagaaatactatatataaaaaatatttgaattcaaattcaaatttgaatcggatataattcaaattcaaatttgaatcgggtataaaaacttttgacttattgtcagggttatggataccacatacctaatagtagtcgactacatctcggcaggacccaccacataccatgtcctacacggaaaccgacttcagatatggagggagttccggataaggaaagacaaccagagttctacatggaaacgacaaggactattcggactgtattcatattggtttccctagttctacttggataaggggacacatatgggtataaatacaagaccccctaggaggagtggggacacaagacaatcgacagacgatcgacacgatcaacatgatcgacacgatcaacacgatcaccacgatcgagacccacctcaatcaacaaccaccacaatatacggaacaacagaagccaatacaagccaacatacgccaagacacgccgccggatatcgacttcagggataggcatggctattcccctacggtgtctccggataccgtcaggagagacgaaagcgctatctctgatctcaccggacacggattcgaggagcaagactaccttgttgtcgactacgagtcagaccttcagaccgacatgtcgacaacagttagataggttacccacatattgtactggtgttattatggtgaataaaagcaactccggctccggccaacaggatgtagggttattacctgacaactcagggtcccgaacctgtataaaaatccttgtctccatctcttttacctcagtctcgcatatatcctagtaccgacgatccccatactatgcaaataccataattgcgacatcaaacgtcgacagtggcgcgccaggtaggggtattttggtgctctaggaattcgacgagatgggttcaaaagatggattcttcgacaacaagctactcgacgacttcggctgtggagatctaacccgatcggagcatgccttccgacgagatcggaaccatcatcgtcattgacaacttggtctatcgagatcacccaagcctcaagatacgtggcataccaaaagatgtcagatcatatgatgtcgaacgagtatgcaataaggtaattggtagattggtttttcaaattgatctactaatttcgtagatacatccggcatatatctacacaggtacgcaatatttgatatgcaatttatcatacctattcagatcatacagcattgtcagatctacaatttattatgtttacctagagcatgtcttttatacaatatccgttgtgcgagtactttcgacgataggccaactacggtataacgctggggctcactctgttttcttctatataaatcatgcttgtttacggtttacataatgcctgataattacatctgctcgttatatcctgataatgctagaagatccatgcagttttttgagtacatactcgatattctctgctatatattttgccttctagaaaatatttttcaggaacaattgagcactcgattaggttatggtcgagtacactccattatcgagaacattctcgacaaatgcggagttatcgcacccaa

SEQ ID NO: 53089 - DNA, 13628 bp, Oryza sativa
caatatccgttgtgcgagtactttcgacgataggccaactacggtataacgctggggctcactctgttttcttctatataaatcatgcttgtttacggtttacataatgcctgataattacatctgctcgttatatcctgataatgctagaagatccatgcagttttttgagtacatactcgatattctctgctatatattttgccttctagaaaatatttttcaggaacaattgagcactcgattaggttatggtcgagtacactccattatcgagaacattctcgacaaatgcggagttatcgcacccaacctaccaacaaagaccaatgacctatctcatagcaccggccatggctggactactcaagaaaaggttgttaatggataattcctcgcgaacatcgtcggcttgatcacccgacatgattgcgaacggacatccggatatgctataagttgggtacgtgagtcatgctgaccacatgagatacacttgcaataaaccaactctagcgcttccatcggtgttcgagagataattctgctcgctcactggttctcgcgccagtacgtagcaatctctcgcaccgcagcttccatcggtgttcgagagataattctgctcgctcactggttctcgcgccagtacgtagcaatctctcgcaccgcagcttctatcggtgttcgagagataattctgctcgctcactggttctcgcgccagtacgtagcaatctctcgcaccgcagcttccatcggtgttcaagagataattctgctcgctcactggttctcgccccagtacgtagcaatctctcgcaccgtagcttccattggtgttcgagagataattctgctcgctcactggttctcgcaccagtacgtagcaatctctcgcaccttaacttcagatggtcgaggtacgactacggcagcgtagcggtcctcgcaccatggcttcagatggttgaggaacagctacgactggtcttcgaccggcagcgtagcggccctcgtaccacgactccaaatgatcgagggacacctactcaccggttctcaaccagttgatcatagtgatctctcatacatttgcttctagtggtcgagttacgactactgcctcgtcctcgaccagcgatgtagcgtctctcctactacttccactttaagtggtcgagttacgactactgcctggtcctcgaccagcgatgtagcgtttctcccactactttcactttaagtggtcgagttacgactactgcctggtcctcgaccagcgatgtagcgtttctcccactacttccactttaagtggtcgagttacgactactgcctggtcctcgaccagcgatgtagcgactctcctactacctctatttcaacaaagttgatagcaggtacacaatatcgccaagtgttttacccagagatcccttgccacgacgacacctagcgttgaaacctatcctactgtccctttacgccgtcttgacaaggcctccgaggaacctaagggatcttcggctggggacgcccagagccaataaggccttgtcggatcctgtagagacaaaagaccatgtaagatctggtcatgtaagagttctcgccgtgcgtattaaccaagccgtgtaatcggaaattgagctttccaacttcacggctgggggctaggatcaatgcttgttcaactaaggcaggtcaagggtccaagagccttatcctccaagaacgattctccgacgacaaggctgggggctagggagagtgtatgactctacaaactgactgatcgaagtcggtaagagagaagacgctcatacacaaaacattggtcggtaaatttaattcattttcaatttaccatacatattataacattgtcaccctttgagcgttcgctcaggggctagttctatttgatattcttttctgagcattgatttagggaaaattctattcgacattgcggaagactccatgtctctttggttctacaccaagatcgactaaggcgagtacgaccaatgttgacaaggctccgtcgcagactctacgccttctcgatcgctcgagaacagttgctggatctcgacaaggaacatggagtgaagagatggtgtaccagccgagatagaatttcttgacttcaatccaaattctcgattacagcaagacgggagacttagtcgtctgctctgtacttccttggttgacatcggagattgacttagacaaaccctttcggtgctcgcacgaggctgacaaaagaagtctaacgttatctctgaactcaccgagaacggtcacttgagctcgataacagttactccatggtcagcggtcgagaatatgaattcgttcatttgcattgaagtcggggactactgtcagggttatggataccacatacctaatagtagtctactacatctcggtaggacccaccacataccatgtcctacacggaaaccgacttcagatatggagggagttccggataaggaaagacaaccagagttctacatggaaatgacaaggactatttggactgtatccatattggtttccctagttctacttggacaaggggacacctatgggtataaatacaagaccccctaggaggagtggggacacaagacaatcgacagacgatcgacacgatcaacacgatcaccacgatcgagacccacctcaatcaacaaccaccacaatatacggaacaacagaagccaataaaagccaacatacgccaagacatgccgccggatatcgatttcagggataggcatggctattcccctacggtgtctctggataccataaggagagacgaaagcgctatctctgatctcgccggacacggattcgaggagcaaggctaccctgttgtcgactacgagtcagaccttcagaccgacatgtcaacaacagttagataggctacccacatattgtactggtgttattatggtgaataaaagcaactccggttccggccaacaggatgtagggttattacctgacacctcaggggcccgaacctgtataaaaatcctcgtctccatctcttttacctcagtctcgcatatatcctagcaccgacgatccccatactatgcaaataccataattgcgacatcaaacgtcgacacttataaactttgggtctataaactttaggtgtataaacttgagatgtatagaaatattacatataaaaaatatttgaattcaaattcaaatttgaattgggtatataaacttttgacttataaacattcgctctacaaactttaggtggataaactttagatgtgtaaactttaggtgtataaacttaataaaagaggaaaagaaaaaaaaaagaaaaaaacgatcgccgccagcgatcaatcgctcattatgacttttcttttgaatgtaagggggtgtttagattccggaaaagctaacgcgcgtgtacgcgttggtggcgagcgattccggaaaggttagcctaactaactaagttattagtagataatgacgataattaattaagataagatttcttttttttggaagattttttttctactaacagattgaaaactttcaggttagatttgaaaacttttgaagtcaaattttaaaaactttcaacttaatttgaaattttttaactcgaattttaaatgtgtaagacaaattttgaaaactttcaacccagatttcaaaactttcaacttgagattcgaaaactttcaacttgagatttgaaaacattcaagtacagatttgaaaaattttaagttaagatttgaaaaaatatgaaaactttcgactcagatttaaaaactttcaactcgagatttgaaaactttcgactccgattcaaaaactttcaactcagattcgaaaactttcaactcgagatttgaatactttcaaatcagatttaaaaattttcaagtcaagatttaaaaactttcacccaaaatatttggaaaaaaataagtgtactaaagattaaaaaaaagtaatcagaaaaaaaggaaaaaaaagcgaaaaaaatcgcaaaaaaaacagtgaaaaaacaaatcgcgaaaaaaaagaaaaaaaagggctaatgggctttttgcgccgggagctgctggtgcgcacgcgccaactagcaacaccctttagattcaggggtgtaaagttttcgcgtgtcatatcgggtattatatagggtgtcgtatggggtgttcaggcactaataaaaaaactaattacagaatccgtcagtaaaccgcaagatgaatttattaagcctaattaatccgtcattgtcaaatgtttacggtagcaccacattgtcaaatcatggagcaattaggcttaaaagattcgtgtagcaaattagccacaatctatgtaattagttatcttttagcctgcaggtaaacgttcgatgtgacagggtgtaaagttttgggatgggatctaaacagggccacctaagtgcagtggatcttaaggtgtccccactatcatgtagctactctcataatttataaacagacggctatttctctgttgacaaattcctttgggctaaaccttcccccttttttttgggagggggggttgctacaccactgccggctgaatttttttttgtcagctggatacaggagcgtcagattctctggtagactacccacacaattatatcgacacaaatgtaaagtaagagcggtactcatactaagaatagtaccgagaatataagaagaagattatttcattaatttcgaaagtattgtagaagagaatagaaaagctactagagccataccgaaactcttccgaagactccgagggctccgagtactattctattctactccacttagcactaaaactactaaaataaagtatgaagaggaatcttgagcttgcttaagtgtgttgagagtgaaatgagctcctccttttatagggtcggtatgacggttgtagagaaggggaaataaccttcctaccccttaaccgtcattgagagtgcatcctggacgtccacgtgaagggccaagctaatccgtcaccactagggttcggccgaacctgggccggcccagcaggcctccagctttggcagtgtggctgacaggtgggtcccattgtcggttatggccgttaaggtgatttccggacggttacacctgacatgtgggccctcattatcctttagtttacttagaagtgagttttcctcatttcttcattattttatttgctcaatccctgcaacaaattattctcctagtacaagtggaactatattattctaaagcaaatatgctttataagcatagctaatcctcttttattatggttatattgacggtcgaaattggtctataacgaccgtcaacagacaaccgctgatgtgctgaactccttctcttccaagccttgatgaatttgcattggttgcatatgaccatacatcggcggcagtgccccccatggcatgaagtaagaaaaagaaaaacctggcggcggcattggacaaggcccccatggcatgagttgaggattgtatggaaaaggtggctccaatggtcttggtgatggaccaaatctctcgctaggaggagatcttggtctttttcctttattaggatattgttcggcactctttcttctcatacttgttcaaaaccatatcaaaagacacctttggctttcacggtgttctagagtttgaagcctcacccttattttccttccaatcactaacttctgtattctttgacacaaccatcttgtgtctaggctctccaactactacttctttcccattggtaaatacggcttgctccggccgaatcaacacctttttatcattgaagtcaatagtattcacaggaaaaagatcatgatctagcttcttcttagaaccctcagtaaatttcaatcgtccttcctctatggccgattgaacctgtcgttgaaacacattgcaattgttagtagtatgagaatgagaatcatgccacttacaataagcacgacgtttctgttgacgtttgatgtcgcaattctggtatttgcatagtatggggatcgtcggtgctaggatatatgcgagactgaggtaaaatagacggagacgaggatttttatacaggttcgggctcctgagctgtcaggtaataaccctacatcctgttagctggagccggagttgcttttattcaccataatcacaccaatacaatatgtggggtagcctgtctaactgttgtcgacatggcggtttgaaggtctgactcatagtcgacaacagggtagccttcctcctcgaatccgtgtccggcgagatcagagatagcgctttcgtttctcctgacggtatccggagacaccgtaggggaatagccatgcttatccctgaaatcgatatccggcggcgtgtcttggcgtttgttggcttgtatgttgtgacttctgttgtttcgtatattgtggtggttgttgattgtggtgggtctcgatcgtggtgaccgtgttgatcgtgtcgatcgtctgtcgattctcttgggtcccctcctagggggcctcgtatttatacccataggtatccccttgtccaagtagaactagggaagtcaatatggatacaatccgagtagtcctggttgtttccatgtagaactctggttgtctttctttatccggaactccctccatatctgaagtcagtttccgtataagacatggtatgtggtggatcctgccgagatgtagtcaactactattaggtatgtggtatccataaccctgacagtttcaattcttctggagatggaatgacatggcctttaggtaatctaattttttttttttttacaaaagataatcaaagattttatcacacttggccacatcaaagctatacttaatctgactttgccgatctttacaaggagtcagcattaagttagaacaaacaaatggcttattagtccatgaccactcagcaacatatatatcaggatcaccatcatcattatcagaatcactatcatcagggcaatccacaatactaacattgggttttttttgtcattggacctaacaaacttcttactttccctaacccggctttcttgagccagagctttatgcataagttgactaacatcaagaaattgttggccaactaatctttatttaataggagcaagcaaactactagaagcaagatcaaccaaacctctttcagttatattcaaactaaaacatcggtttgtagcatccatagacctcttaatgtaatcagtcacagattcattatacttttgcctaaccgatgttaaatcgcataacctaagctcagtttcaccagtgtaaaagtaatcatggaattttgttataattgagcccaagtatgaatataaattgccggtaaagaagtaaaccatgtaaaagcagtaccagacaaagataaagaaaacaaatacaatttaaaagtatccgtgttgctagcctcaccgcattgtgctaagaattggcctatattttcccatgtggttctactatcctcaccattaaacttagtaaacttagggaccctaaaaccacgaggatatgtgatattatcaaaataattaggatacgactttccgtaaaccctatcacgattccttggctcaattccaaaagcgcttccctagtaatgttcctcacacgttcctccatatttttaggccttggtgggtttggtggcctaaagggtggttgcggcggcacaatattgttatattggccatatatagcatcttgaggatatccaatagcaggatcattataggaattaggtatataaggaggaatctgagggttaacagtagctacaggaggattaggtactggataatggtataaaacaaaattattagtggttggatctacctcctacacaagaactattgcaccggtctgaccggccatatggccggtcacaccaaaggtcggtgcgatctgaccggctagagaaccgccggtggtcggaccggcctaatggtcggtcaaaaccggtatagtgggctccggtcagaccggccgcagctgtacgatcaaggaggccaactagaggggggtgaataggcggttttaaaacttttggctaaaaccgagttttgtatgcggaagcgtaaatcaaaacggttttgtacaattcaaaacctaaatcaactagtctcaagtaagtgcacaaagaagctagcctatgttaaagtttgcaagcctagggtgataatagcacaaataagctctagtatgtaaacttgctcaaatgtaaatgcaacaaataaatgagacaagagacaaggaatttttcaccgaggttcggaaactcaccggtttcctaatcctcattgaggcgagcctaactccactgctcaaccacgaagccaccgcacgcccccttcgtcaaggagtgggcaaggtgggaaccggcccacggagaggactacccaagcctcgatcactagggtagttcttccttcactccgaaggtggtgaactccaaaccactcacaaccagcgccgggcctcctccacaatctcctcggagaggtcaccggtctacacctccacaagccgtctaggaggcggcaacctccaagagtaacaagtctaggatgcttgccgaggatgatcaagtgccacactagctctaacaatgaagcaatgcacttggattggcttaactcactctctaacacctcactagataaactaagtgcacaagggtgtgagagctcttgcaagggttcaagataatgcaatggagtgccaaaaccttaccttgctactggggagtgggtatatatacccccaaccaccaaaactagtcgttagggtcgaaatccccaactctgtgctctgccggtcagaccgccatagtgtggccggtcagatcggactactttgtaacggctagaaaactagccattacagggcaatcattgagcccactcaacctggccggtctgacctcagtgtagaggccggtcagaccgtccacggctcggtcagaccgctaggggctcggtttgaccgactgcggctctggcggctctggatcgccaagacgagacctccttcaaaatcaggatgagcggtcagaccgccatgggatcggcggtcagaccgcagaacatactttggtcagaccgccataagggtggcggtcagaccgcaggtcacttttcagctcaatcgaccgttagtaaaacggcgatatctcttgactcgggtctcagaatttagcgttcttggactctatggaaagcttattcaaagggttatccaacccatgaacaatccatacaataaaaacaacttttctcagggagaaatggctcacactccaaaggatactccaccggacataaccacatgaggctacccaaacctataggatttgcccacttctctctttgtttaggacttgagaaaactcaccacacttggctagacaagcccaccaaatatacctacatgcatatgaactaatatggtacaagatcatccacatgctcgcttcatagacccctcttgatagtacggcgtctatctagcaaatccggtctataccaaacaccaagaccgggaaaagtctaagaaaacattcttagctccattatacctttgccttgcaccatccaacttgaggtcaatgcttgagccaagatcaacacttgtgaccatccggttgaaccatgtttatgccgaggtcttgtccatcctttttcaagactttcttctcatcacaagctttcattcttatcaacatggcgatgtctttggtttggtgaccatcaactaatggtgtcatccatttgcctcatcacaattagacctatttctttgcacatctcaaagcagaacattagtcccaataaatcagttgtcatcctccacttgatgaccaaccggttgcatatgaaagatatggatatgtatgttgagtattcattaacaccacaagcgtcatatactcatatgcaagcttaagtgtaaagatccaatataaataataggtgaacaacatgaatctagaacatgcacaataaatgtataggatttgctccccctaaatatatgcatacaaagaaatatacaagagaggcaagtgtatgcataaataaagaaaaaccaatggggtttatcctatatacatggagaaggcatgtagcaatgataaagataaacaaaaacacataccttcatgatctccatgttctcaaagtaaaggagactatcaacaagtatgagataagaagtgatacatatcgctttatctccatgcatttcatccttgtcatgattaaggtccatcagcaaagaatgcatatctaccacatctcgttatcgagaattaacctagttgacaacttatttaaaagatatgttaatcccataaacatcggtttatcatctatcaccaaagcaacaattacacaaattgtttaatccaagatctttcaatcttttctctcttttgtgatagataataacccgatataaacaatatagagagatgagatgaaagatgattccaaatcaaggtagagatcttataataaataaaatatagaataagctctccctcaagatgtgcatacatatggatatgaaggaacgcatatgcacataatcaataaagatcaaagaggaagctcacactatattttggatccacaagagagaccaaattagaatatgtgaagtttaatacatacctctcatcatttttactttcatatccaaatgagactagtcaaagaaagactcataaaaacattagtctcatatagttagatttgtcattaatcaccaaaaccaaattaagtcacttgaacatacagcagcgctagggttttcactcccagcatgttgcatggttgccccatcatttttactaaatatgtggtgaacaggaggttgactagtacttgcaacagaagtagatgtcaaatcggtcataagagaactgaatttggaattcataaaagattaaatccacttataaaaataacaactcatagcatgttcaagcttattgttaaaagtagcattaacagtctcatttatggaacttgctacgagcttttgaaccagaagagcaatatcatcaccacttacctcgttgacggtgacttttggtgtagaaccgggcttacgaacaattccttgacgagtcttgatgaagcaacccgccaaaagtgcttcttgtgtcgcctttagatgttgttcaatctcccgaggttgctcctcatccaaatcctccaatgagatggggaggatattggtaggatctatctccggcttggtcataatgtagatgaagacgtcccaagcggagtggcaaaaaatcatgttggcaacttttttggcaagaagacaatcacgatcgagacacctaaacgccttgccgtgatatagaatcgccaaccaccccaatctagcaaaactagaccaagatgggttttgatagattaaaccggctctcggagccgatttagacaaaacaatagataactacccgtctcatgggcaaacggaaggtttatgggacaaacctacaaaggatttcgcactctcgcagcaaaggcgaacgatttatggcgcaaatcgacaacgatggacaaactagactagaactagattgaaatattgaaaaagcgattcaattggcaaaattggattgtgtgtagattgtcctccagttgaaccggccgccagatccggcaggggcgggaggggaggcgcgacgacagacgacggatctggagccgtggtgcagtggcggctgaggcccgacggcggcagtggtctccacctccaccgcctctgccagcgacacctctagccgcgcttccgcctccgcccgcgctagccggccgccacctacgcctccaccttcgctggtgcctccccccgcctcccggccgccaacgccaccgacgcctcctcacctccgccaccgaccgcgctagccgccggatccggcctccacgaggccggggatgcgctgatctgaacgccaggtaccgcctcctccatccccacccaccggccacctcggtgaggtttcttcttgttgttgttttttttttacttaaatcttcttgttgttgttgttgttgatttgaggtgtttggtttgagaatgtgggctctaatggtggtttcttgtttcttgatttttgtttggtggtgcagcagcagaggagtgcctctttgagatcctccgccgtctccccggccgctgcgagcgcggcgcctccacctgcgtctcccgtcgctggtccatcatggaggatgacgaactgtcggccagtgtgccccttttgtgaatgatatgatattgttgtatgataaattcttgccatccctttttgtgaatgattgctatatgagatggtgatgcggtgatggaggaagatgaactgtcggtcagtttgaagtttttgtgatggtgatgcggtgacagcaagcaccaccatggcagtgtgcgccaattttcttgctagggttttttcacacatgtgacaggttgcaatctatttttcttttttttttctggattatagacatcactgacggctcacaaactaatgggccgtttgagataatagttacctgtgacgggttctatacatagcccgtcataggggctggtcaccactgacgacccttcacctgtcaaaggtgaagagagtcatcactgaccactaatctctgacgaggggccgaatccgtcagagatgatggtttaggcccgtcacagctagcatggtttggcatagtgtaagtgagttggtatgtgaacccacttatagatcccacttatagatcgaaataagtgagttcgcgggtcaatccacttataaccttactcctgagtgacgagtgatgacataaagacagctatgaaaacaaaccaaaacagtgaatgtccgcaagggatagatcgatccctccaaagggtaacggtttggaagagggatcagtcatcagaggcagactggcggcgattggaggcactcagatggtagtgtgctgtgtgcggaggagtaggcggcgaagcatgatgggtggtggccttcttgatatcgatcccatctgtcccgttcaacatgctcccagtccccttgatcccacaaaatactaacttttggaatgaatcaggtcaatcactccagatacatccagtccatcaccggtccctaaacttatatcgttgtgttatctcagtccctaaactcgcaaatcgaccattcaagttctcaaacttgttcgactgtgtcatcccggtccctaaacttacagatcactcgtttagatcctccaacttgttcagttgtgtcacccaggtccctaaacttggatttgaatatcatctgggtcaaatagtacagtctaaaaactttatatttaaaaacaattcataactttttcatgtgaactctaatgaagacaaactttatatcaaacttgtagccctcgacgcgatctacaactttgtaattgattttttttttattttaagtcattttttgtctcaaaatg

SEQ ID NO: 53090 - DNA, 16427 bp, Oryza sativa
actatagggcgaattcgagctcggtacccatttgaccacctcgttttcaatgattgcacagtgtcaattttcttgtggactcactgctttagtccattaagaagatgacacgtgtcctcagcatttgaaaaaaagtgtggtctctgtgcagggagaccagacggaggagtgccctctccctccctcccctcccttgccaagaacggcaaataaagtcatgtctcccagagtctccctttctaaaagcagcaaacatagtcacgagcggaggagacgcagaaggggagcaaacagctcgcccccaacaagttcatccccagtccagagagagagaggcagccaccaccaagttctttccaggccaccctcctcctcttccccccaccgcacgcctcactcaacaccggcgaactcgggagcgcgcggcccgagtgtgtcggcggcatgaaacgcaaggcaacaactgcagcctcagccgaccccgcacaggtgaaagacctagttcttcattgctcctcatataaagccggccccctcggcgtccgcctcggctgccgcgacgccattgttggctggttgcgctcatgcgcgcgatctctgtgcttcgcgagcgcttaacggcgagaggaagttccctctagggacctggggcatggccgtgcaggttcaccatggcccatgccgactacatgcataggaatcggctgctagctaggtggcagtcacggtggcagcctggacggggacgccagggccacgcggggtggtggcggccggcgatggggctcgagccgcgaggcattagccggcgatgagcaaaagagccacctttttattattgttattattattattattctcagatttgtgaattgtgaacatggtagccataaagggtttgacttctcgatctcccaccccgataggtaaagatttcggatgaaagttttcattttttttaatttagaaaaaaaatcttcaaatttggccaaaaaatgttcaggtttttttttctagaattaatagaatcatgttgtcatccctatatatgctcacaaatgccaccaattttctcactgggaatattattgatcatgtctcataattaatcttgtaattagccgatttatctggtcttttctcaggggggcagcgaagctgaaaaaagacaaaagatggagaatgagatcaagaccttacaggtcgttaagttcagtggtgtttactacactctgcctcttcatctcgtcgcacccgctgtccagcacgtgttgggaagaaagaccaccatattaaggatgaggggagctactctagatgagaacaacatgttacatctagagatagaatttttgtcccgtcatgctgccatgaaggctatggaacactgcaacgacatagacccgcgccacaaacgctatattcaagtaaaatggaatgatacaaatttggatgtgtctgctaacaatgaggaaccggtacttcaagaactatcatacctagagcctcagccggattccacagaagaggtaacttctcttttacatgattctaactagaaccggcttgaatatttaagttgatttgaacttgatagtgtttatgttggttaaaccgccctctgactatatataaatttagtgttttttctagagcatggaataaaactacaattaaaattggttctttcttttacagaaaaaggtaacgtcaactatttttcaaggatttaaccgatacctcccgtggcagtgagtgtactgattgttgcagatgaccctttcatgcccccgtacaagaattgttgcagatggccggcttgtcttttgatattagctatgtagtttccttttagaaatttagtggttagcgagaagaaacagatagtaacattttttggtgtaaattttggtactttctatcaagaggtaccaaattttacataaaaaaaagtaacacctcctggtagctcttaggaccattataaaagcactcttcctcttcaattagtctgcaaacaatctaaggtagtgatattttttggcttaccagtgtgccactttcgacaaacacactgtgacaatgttatttatgatcacaggcctatggttggctttggttgtttatacagatgatttgtaccagattgatgaggtacacagaaattcccagatcagatttgatgtttttgttgttctttctccccaatgaagccagaaggccacttttgcttcttggatttgttcatcagtttttgtagtactggccatttctttgttcacgttggtggggacatctttcatcctaagacaaactaatgtgtagaaaagctgtgagagaggcagcatatatgtctagatatgccctctcctccatgggattgagacacaaaacagttgtagatcacagagaaaacatgaatgcagaccctagaacaattggctaatttgtaaaaaaaaataaaaatagctccacgaaaaccaatcaattgggcttgtttggatccggagggctaataaattagccctccaaatcttactatttaggagtattaaacatagattatcggcaaaacccattccataacccccagttaatttgcgagacgaatctaacgagatatattaatccacgattagctgatgattactgcagcaaatcatggattaattaggtttattagattcgtttcgcaaattagctcagatgttatggaatgagttttgtcagtaatgtatatttaatactactaagtaggtacatgatggcccggacgtcatgggtggtgactggtgagcagctccgatccccgcagcttgtccatgataggagagagcaaatgagacgggtactgcgctgtcatggtctgcaccagtttatccggcgcggggtggtctgcttggacggcggcgatcctgagtgcgatcttcatcctgccatcgtcgggaagcaaggatggtcggggaagacagcggcggcggtcatggtggacgagctcgatggcgaggagaaggtcgtaggaggcgaggtagaggtaatgcctggcctggctgtccgtgaggtagcggaattacaccttcatgaacgcgaggaggccacagaaggagttcaatgagatgtacccccagccacggctgtacgtcctgcgtgtcctcttcttgggcggcggcggcaggtcctccgctccgccggcggcgaggtgggcgacggcgttgaggatgatgttggtgacggggtcggcgaggccaaagcagtatccgaccgcgccgacgcagtcgacgatctccgggatctcctcgaggggtagccgtcgcgccgcctcggcgacgtactcccttatggactcggatgatttgtcggccggtggcagccatggcttctcctcctcctcctcctcctcgccgtggtaacacgtccatctgcccaatccgggttcatcggaagacgacgacgctgctcgatttagggtttttcgccgcttcatcctgctacgccggagcgtagtcggacagttgtgggggaggaattagttcacattgactcccttaactactgatgcgaatcagattcggtcactagttaagggggtccatgtgaacttacttctggatcagcccagcccaaccaaacgatcagcccggcccaaacaaacgagaggaggcttttgccgtgtcgtgtccttttttctctcgggtgtaggacagcacgctgtgcactcggttcacgcacgccaaaatattgccgcacccaaagccgcctccgctcctccgcgtgcgccgccgccgactcgatcgaattcgatcgcttccgcctcctccaccacctcgacgcccgtctccgtcggcggcggcggcgagctcccaaatcctaggctagctcaggccccccaacatcaccacagaaaccacgggggtctcccttccctcaactccaccgcctctcatcggccgcgggagaaatcggtcgaatcccctccgcccgcgctgccgccgggaggtatgggacgcgagccccctcctttgctgctctcccttatcgcgccggcgccccgattgtgattgctggttgttggagttgcctatcattcgatctggggggggggggggggggagtagattggtcgctagaattggtggggtggacatgattgcccgatgagtggattgcgccgccggctagcttctaactagtttgattggtagcttctaactagtttgcacactactttcatggcatgggctcggaaaacaagcaaggaagaagaaattctgaaaaatcagttgctggcacctgtaattctatactaccgaacaagtaaacctacatattataaatgtaaattggccggcatacaagtaaacctacatatgtaaatgtaaattggccagcatacatagttctatactgaacaagttaaattacatgaaaaaaaagaaagccaagtctagttgcatgatcagttgcatatcgatgttcggagggaaaaatggatccaatggatacggcatcagataatacaacaattccttgccataggaattcctagtatagtttcacggaactgacaatgtggtttggctcccattttttacctgataagcgtttggcaatttgatgatcaacaacctgatagctgctcatcaagtatataaaaccccatttgatctgtctcctaccagtattgtatagaaacagatgtgaatcatccttgatatggtttgattctgcagttcactgcaaatcttccatagataagaacacatagagaatttggaacttccaaatcaacctcaatcaagattaggacaggaagctttggagtaactttaacaagggtcaactttactgcaatgaattggaattttaatcatcttgcccatttttctctgtaacataatttttttttctctgaaagcacaagaattatattgctcagtcattcttttaattaatccttaatacactgccctaatttttgtgtgacttatctgagtgtctctgtaacacaagtgatatttctctgttagcacaagatggtattttctcattcaatctttagttattcctttaataaactgtcctaattttagtgtgccttatctgagtgtctggattgtattgtactcatcaagtgcagctgaagtcactctactatttggaagtgaagctgcttattcgtaattacactgatgtaagatgccttttcttcccctctgttattaggtcttagctttaaaggtctagctggagtatcctgaatggatttgaatgcttcaccatcgcctgaggaagatgaccagtcttatgaagagcatgctgatttttcacagagtgaacatgctgagtctgctgttgagataatgcgaagggtaaataaaatactttcttgttttaaaccatgcaactgttttgcagcattagaagagcattccccttgagatgagaccatggagtttttggactttgtattatgggttgtggtgaaggcgatatcataagaagtatattagaatataatactctgcaatagacagacctggcaaaccacgttttaacttaacatttttcttctagttactcaatctacatctctattatctggaccaactggtcatttggtgcgatcttcttttgtttcatatagccagcggcatttggttttcatatgttctgtttattttattactaattaagtagttgatgctttttaaaaacagcaatggtgcaaagcgagcttaattattattttaaccaatttcttttgagttatgatccatcattgctacctgtttatatctttcattaatcactaccatgtttcataggaacgcgaagagagacggagaaagttaaagagggagcaacatgatgatggaccaaggctgaatcgacaaccgattaggaatgatcatatgaatcaaaataaaatcattagacatggacgaattaaagagccacctcagggtatgtatcgtgtgctacggatttctttatcatgttgaattcccccatgtaattcttaattgatcaacctatgctaagtagactttaagttatgtattattacatttaaattatcattttttaattattatcaggctggttggattgccctggatctggtgagccaatagataggattgtaccttctaaagttcccctggatgaaacattcaatgagtctgtgcctgctgggaaaagatattcttccaagcaagttgttaataaacaaagaaaagctggaagagatgtaagtactgcatgctacctaatatggccgtgataataatgcacatgatattcgttttgtcctgccttctgtttttttccttacgcatggtcacagatttgaagcaatttttgttagaaaaaacattcgtatttctcagttcaattcttacgaattgttatttgtacagtgatgcagaggcttctaatagtcacaagagggacataaatctagttaaattttagaatattattattatttattgaataatatgatttacagtgcaaatatcatgaattaacaagcagaagttgcttgtaatagatatctgaaataacatttattctgctaagtgctaatgcacttctctcattctttaatatcttgttcctatttattgttgaagggagcatcacaaactccaggacactttattcaatttaaattattttaaagagattgcagctaattacctgtgttgacatatttttttcctccacttattttatcagataggtttagtgattgacttgacaaataccactcggtactattcaccaactgaatggacaagacaaggtactaaatatgtcaaggtgagaaagtgagatgcactccggtagtttaggattaatctaagataaagtccttttcactcttaaagtgtattttcatttagattgcctgcaagggaagagatgctgttccagacaatgaatctgttaacacatttgtgtatgaggtaattcaaattatttggattcatgattttgacataatcttttttgtcagctatgttgtttttcccactttcttttagatatgaatattcagtgtcccttcattgttttacaattgaagcaatttgcttttgtttgagattgaaaaaaaactttatgatgaaaatgtatttgctcctaatgtaacttcatttgacaatgcaactggagttagtttttgattttaggtaactttacaggttatccatttgctttgcttgaagtttgacttatagttgttgatatatttcatcttgttagctgtttgttattaattctaacctcgaatgtgttgggtatttattttccaacatggaagaattactccctaaggtttatggtaattactaatattctttccaaatcaatgacactacatgagagatgctttgctgttataccttttatatcatcaaactacaaagaattaactttcaacattcaaatgcatgtctgctgtagttatcagttctcttaggagttcattaggatcagtgataattctcaacctgtccccatgaaaagtatcaactgtttaaaatgctgcatttatctagtgttcttctggtttatgtgcgtaataatcacctattggcttacacaaagtttcgaaaactagcattgaccgtgtgttccgtatatttaatcaggactggttaaacacagtggactttagaaattacatgtctagatttgagtttgagcttcaaaactatgaactagttggcattgattaaagctatgcgttgtctatgttatgccttctaaatagaaggcctgcatatgtttccttctaacctgaaaatgttgcatatatgtcactagaagtgaattggcacacatacgactgtgaacagagttattacataggtagcttatggcctcgtgtgtcttatttaccaatagaagtaccctgcttatcaaccgttccagattaactccattcttgcctctgctggctgtcaatactatgggttgctggatgataaatttgttctagattgacataggttagttagcctctgaattctggagtaaatattttttttgcaattcagctatcttcaagttattgtggtagttatttttgttgattccaattattttgttgttatgtttgcctgtttggtgcaaatgttgtaaatgtatatgaaatgcaatgagtaggtagtcttgccctatgtttcacctttcactggaaaagctctttattttagggcgtgacaattgtatgtaataagtctgttgatcaaacttgacattgtaacttttaggtgatggcgtttcttgaccgtcaaaaacaatcaaggaatcccaagtatattcttgttcactgtacccatgggcataatcgtacaggttttatgattgttcattacctaatgcgcacacaactctctagcgttactgaggtaagaaaaaaacatgtttcaatttgtatttgttgaaaataatttgacattttcctgagctaatgtttttatttgctaggcactgaacatatttgctcaacggcgacctcctggaatatataaaaatgactatattcaagctatctattcattttaccatgaaattcctgaaaatatcgtatgccctccaacaccagaatggaagaggccctctgatcttgatttgaatggtgaagctaagcaagatgatgatgatgatggcaatgtagatcgtgcaccatcacctgtaggttttcatatagtactatttatgactccctttgttgattttacctggatgtataagtatctgattcctattcaataccgcaatatgatttgacaacactaacaattaatttgaaaaataagtgactatagggaggtatatctagtgtaaactagaatatttttgtaccatgtaatgttagtaaaactgtccttaaagattgcccaaaattctcaacgcaatggatgatatagaggaacagatatttgatgcccctactttttttatgatcaaatttaaattttttgggagaaataaaaattatgtttttccatatacatgcgagtttggccataaaagttttgcagtgtcatttaacacatttcttttgcagacccacatccaccaaagtttgaatatttcatgggaaccgtatgcacagaattaacttgaattgcactggatttagtcttacagctgcacctaacatttaactctgcatatgctgctccaatacagaccaatagtaaaaatgccactgtgatgcattagtgaattacctacccttagctctttcattatagctcttgtgcataaaaatgcacaagaaagatcatgttactctgtttgccactgttgtttctctcactaaccacttaaagaatatggtcacctcataataagagtaaatacagggcaatattggaatttactgcacattaggacttggtatttgctaagagcaatcttaggcaagaaacacaattggatgattgtaaatagggaaaagaagatgaggacatcttggaggtgttacataactatcacttcttcatccctatcatagttgggtgagacaggaaccataatcatgattggtaatttccattgtacatgccaaatcataacccaattcatgtgccatgaaattggtttaaataaatcaaaagttacagggtgttagtttgaaagtggcttataggattctctcttgtctgagatgattgccaaattggaaagtatgatccacttcagttcagacaggttgtacaacctaggtaggccttttttaaggaactgttgtgcttttgtttgaggaccaaaagccctgatgatattcatccaacctcatcctctatttgagcacgtgcctattagaaaagggtataaagtataaacctaattcattgtttataaaatgatgaatctaattcataacgaggctaagcatctcctagacgatagccagatggctttggcttgctagtagggaaggaactagtgagtgagaggggtcaaaaggggacttatgcagttcattgttagctttcaatggatgatctgaatgtatttcctataatctcatcatactaaaggatattttgttcataaataacatgtgcctaacaatgtgtctaataatttagagcgttacagggtgttttatcattctctgttcaaaattgtagatcataaaaaaaaaatcctgaaaagattatatacatatttttatgttctttaatttcactcaaaggatcccttcttattgcagaatcacgaagatgataaagtcattactaatgatgatatcttaggggatgctgtaccttatgaccagcaagatttcctgcgcagtatatgttttaggttacttgaattagtgcccagtgtaagtttacaacgcgttgttggttactttgctatattgttgttgagtcacattgttttccccttcttgattacaaacatcttaatttgcagtactgtctgaaagatatattttgaaagctttgtttctatgttcactgtagtatgaacttgtagcttgctttcttgattatataatactgctgtttcatttttttcttactagtttagaaagttgtttttatcttgcttcaaatgatttcaggaatccttttgttttatcacaactactacttagattaactgtggcacaattttgatgcaaacttatttcaaataattgtaagctgatgcaactgcatgcaacatgatatgatgttactaaatgcaaattcagagtataatttttgaaccttctattttcttgaaaatagcaatagacatatgaattgattagtatcacaatctcagctaaccctttcactcaccagggtagagctaatgctcagtttcccggatctcatccagtttctcttaacaggtatggatttatgtccaattttgattcttttggcaaagtgacaaataaattagtgactgcaacagctgatttaataattaatacttgacggtttatatcaaaggtcatgccaagtaccttatttcaggcatgtgaaaaacataaaatatagatgtatatcacatgcaactatgcaatccttatgtaaccgtagttgagcaactatgcacatggtttactttttaaggcattaatgttctagcaagcaaagcatctgaaggatgaaaataaaccacataagtttgagggtaaagtaatacatactgaagactaagaaatcaacttcaactctttgcaggagtttgagcactaaccttgtatatgtggctggaatttgcttagatttccaaccttccatcaaagatgtacacagtactcaacttcgatacctacccatcccataatgctgtcataattcacttcctcactttattttgcgccacccttgttttatactggcctcctttgtcttaaatatcccactctgcaccaaattcctttgacagttaggcaccccttcagtccctttgctacacggtgctttctgtgtggcatttgggtcattcggagggattctacttttgcctttttttgtgcctggcgcatataattcattctgtaacagttgatgctacattttctggtgagatcatgagagggcatacataatgttttgtctttcttattctagaatctatgggacttaagaacatcattcacacattagtaatttccccctagtccatactttgtattgcaattgtctcctttccctcacctcacccccctatcttgtagtttcttttgttggccttctggtcctttcctcctaactcatttcatttatattttgtatatacagcgagaatctgcaaattctgagacagcgatattattatgctacgtggaaagctgatggaacgcgatacatgatgcttataacacgtgatggttgctttctaattgatcggaacttctgctttagaagagttcagatgcgttttccccttagaaattcgaatgaagtaagattcccattgtgatgcatagtgcattttattctctttttcaccatcaaattgtaaacttcaaacttccttttgctgtctgaagggttttcaccactatacgttaattgacggagaaatgattgttgacactgtaccggatttgggattgaagaggagatacttggcatatgatctaatgtcaattaattcccaatctgtagtcaaggtagatatgcttcatatgttatcattaattggtgatgcaattttgtggtcttctcagttgacactattaatctaagatgttgatttttttatgtacaatatttcgtataaatatttcccaagcactcccattcgaatagtgattacaaagcagtatggatattgttagaggttgctctgaagatttatatgctacttattaataagtcaaaattctcatgtctggtttagatgcttgctgattgaatcgatttttataatgatcccaatatacatcttactctctaaaagagtgagtgattttataatgttctacacccacccactccatacctctctggttttaaatatgtaggaatgtgtgcgttatttgtaagattttaatagaaatatattgtatcttttcatacaagtataggttggtggtcaattagtctatattatcatgtatgtgtgttttaaacttaaattagtatttatttactgcattttgtattttttacttatagtatacagtatatttatttgggatctgttgcatgcacgggtatggtgccactaattttaagttagaatgacattgctgaagaattgattagcttaaggccacataatttcattacttgccatgtttgttattttgtgctccatatgtacatacttattatagtttgatttctggatgcagttgcctttttctgagaggtggaaattacttgatgatgagataatacgcccacgctatcatgataaaggacgcagtccatcatacaaatatgacatggaactattttcggtaccgacatggaatatggaagtttggacttatttgttttttcatactatgttggtgcactaaaattgaaatatatctggcttttattaggtaaggagaaaggatttctggcaactttctgcagtgaacaagatactgaaggagtttattccaaagctttgtcatgaatctgatgggcttatattacaggtaggattcttgtgtcttgtttgtacctttcaaaactagaaaagctattacaaagaagttatcccttcaacttttttcctgattctgatgggtttatatcataggtatggttgtcatatgtcttgtttgccactttgcactctaactgtgatgattttgcattcttctagtttctcttatgcaacattggaactactgccatgttgccttgtacaatcaactagatatttagtgatgtttatgccctctgttcttaaatctagtgtgttgatcctgccacaaatgcgtgttttggaaactgacagtccacaaaacataacttataccatgtttatctatttttatatatttgtaaatccttattcaattttatggtaaaatacttttgattggagagtttaatggcatgtatttctgactgtagggagtaataagcattgtttagctcaactatgactgttaggcccatggtcatatcctccagatgctcttgccgtgtattcggagtagatgtactaatttctgttttcacatgggtggattcttactgttgaactggttctggaagtggtttgctctatgttataagtctcatatctaataattacaatgaatcaagcttaactagggacaagaatcctttgtcagccaaatacttgctgtcctcaagtatttgttgtgaagctaggaatgtttgtgctaggaatttcaggattatgcttcactctagtgcatgtctcatttatgctgagacttctcttttgatcaatttgtatcttgtggcaaaatcccatcaagttgattctgtgataatttcatctcttcagaacgccttgttaaccgccagaatagctgcttccatgcagctgattttcatccctccatgcatgtcaccgtcatatcccaacttacacaaaatgggaacttctctgtttttcttttcttcatgtgtttctgttgttttttatgtagggctgggatgatccttacgtgactcgtacccatgaaggtcttttgaagtggaaatatccagagatgaattcagtagactttctgttcgaggtctgctttcttccatgcaaagttttcagatggatttacttagttatttattgaagttttctttccattgttcaatcgttgtagattggcagtgagaatcgtcagttcattttcctctatgagagaggtagaaagaaacttatggacggtgcccgggtggtgttccctggtaagcatccatttaatttaattacttgtacatttgtctttattttctggataatttacaacgcatagatggtgcctggttggtggtccccagcaagcatatatttttcattttcaaatcgtgcatctatttgactttatcaaacaacttgtttttttgggaattataatcatgtcctatgctaatattctcatgagcacacatatattatgttccgaaattttgaatataacccagcaacttttactaagcagaacatacactggattttgtcctttaaatagaacatacactggttcaatgctttgtcgtgcacttgtgttatgttccttgttaaaattttcattgggatttccatgagttatatagtgttcctatggctcttgatacgcctgattgtttcctttttgcaacatgtcatgattcttgaagtaggctaattgttatactgtgttgttttattttttcctaattattgctgatgcactggaatttaacgcagatgaagttgacccgccttcaatatcagggaaaattgttgagtgctcttggaataaagaagaggactgttggtcctgcatgcgcattcgaacagataaatcaactcctaatgatatcaatacttacagaaaggcacgtcttcctctcctctctcacacatgtactatatcaaattgttgaatactaccgtcagttgcactggttacaaggttaacagttttgtttgcttctgtagaactttacatttatgttctattcttctttcatgaaattgttctgtgatcaagaccagatcctgacagtgttcactgttgatgggctgtaactgcttgctttgaatgcaatatacctttatcttttacaactctgcgtgaagtttgcagctagggagtttatatgtgctgcaaatactgattcctccctattaatttgagttcgtgatgataattcagttgtgctgaggcgctccaagatacagttgtgacatttattggttggatttagttttcaaatgctgtggtttgatgaattgacttgggatttaggacttggggcgcatctcatttcacttgcttgctgtcgtgccttgctgttctggttgtgtcatgaatcaagatgtgtagaaatctaagatttctgttgggcatgagaaagcataaagacaatcctaacctaacatttttcctctggtaaatggacaggtaatgaggagcatcactgataacattactgaagacaagctcctggaggaaatatatgagatcatgacctttctatgtatgctgataggaaagcaaaggctcacgcgcgaagtatggctcaacaacgaaggagatgattaggattggttatatgcattcgtcttacttcttagaattatagagagttgtaaccctacaaccaacagatggcaaaggctagctggcccaggctgtagcatgcatagataatgttactatatcttcatagcgagccttatgcaggccgagaatttttttttcaatatgatctttctgttggtcattcacatgtgtcatttcagaatgctgtaaatcttcaattaatcctgtattctgtatatccctctttttttgggctataccttcctttggttcaaaatcgctccaacatacaaccagggtttccccaaccggcagggccggggttaccacgtggtaaccgtgaaaaactgtataaaaccgggtaaaatttatcaaaaattcaaattatttttaaaatttatttgaatttaagaaggataccgcggtatttatattaccggacccttgtggtaagcccgataaccgcggttaccggcggtaaggtaaaccttgcatacaaatgggggttgtacaaataggatgtgtcacttattagtgatggtgggaagatgtcgacaaccacaatgcacacatgtaatgtgcatgtaatgaaaaagtgaagagtaaattttacaaaactatagatattctagttaaattattataaaaccacagatttaaagcgatgtatcacaaaactccatatttaactaaatttatcacaaaactacaaagattt

SEQ ID NO: 53091 - DNA, 8878 bp, Oryza sativa
tgtcgacaaccacaatgcacacatgtaatgtgcatgtaatgaaaaagtgaagagtaaattttacaaaactatagatattctagttaaattattataaaaccacagatttaaagcgatgtatcacaaaactccatatttaactaaatttatcacaaaactacaaagatttatggtgaagtgttatatttgagttataaaagtctaagttttgtgattgacttgacaaaaaaaactgtagttttatgataattttgatgctaaatctgtagttttacagtactccaccttaaatctgtagttatctgaaaaaattagtgttaaaatgtagtttttggtacatcaccttagatttatagttttgtgataatttgaccataatatctgtagttttgtgaaatttacttaaaagtaaacttacagatggtatactaaagtatgtgatgttttctgtcttaagagatatcttttgtctaggggtctcatcggatggcttatttggttgaggcttgggccaaggcttttcagccaaacaagtgggacccacaagtggtggataattatgtgaactctccagtgaccatacacaaaaaataaaaatccaaataccaccagccacagaaaaatccttcaacagccatataagcaaaataagccaaacaatggctgaattgaacttggcagatttggctgatcagccaaagcttcatgccatccgataaggccctaggttatacacttctttgtaaaatatagcaactaataatctaagatcagattggacactctgtaatactatgaatctgggtaggctctatccaaatcactactccagtatagtatgtgtctaatctagttatagcttggtatatttcgaaacggatgtaatattctagtaagttgtgcatgtggttggccaacagataaacatattttttttttggatttgtaaggaaatacaaaaaatagcactattatggtatgtactttctccggtttcatcggtttcataattcttagtgttttggataagattgaggtcatacttttatacctttaactatcaatattttaaaagtatttagtttaaagacactagatttatttacaaattactataataatagtaaaaaagacatttatttattgtatgtattgtaatagaaaagatatagtcaaacatatcattgttcaaaacataaaaaattatgaaaccggacggagtacaataccaatataagtttgctgatgtggaagaaatagggaaaagagagataaatatgataattacttatgataatggtttaacatcgacttagaatttataaagaaaactttttctgcatatgaatggagacaaggaaagcgagctaacaaaaaaattgatttgttgtattacctgtgagtcttttatcatctcagttgttataggagagatcatatcatgatctacctttgaacatctccttatattttcagtcatcctgtgatccaatcctagcatgatcatgaaaatatcccatctctatgtgtttttgctcctattttattggaatggacaatactatcgaagccaaaaaggttatgcttatatgttgagctttgaattgctctaatttgtaagtgatatagtatagttatatttaagttttaatatgtactactcctatattactacggagaagattctgcctccggtgaggacacgtgtcgacgcgcgaacataccctttctcatccctctacttctacccaataccttaatttaattttttctcgaataaaccttatcttctcactaagctttacatgtttagtgagttgtcacagatctagcgttctttatttaccgtcttctaaagtgttttgatttaaaacaatttaatcgagttacttcctccgttccaaaatacgagagattacttcctccgttccaaaatacgagagattttttatcggatgtggcatatatattttgtaatgaaaatccctagtattttgaaacggagataatatttcataatgggctgcctgggcctcagggctccctgagcacgcggccttgttactcgatcttcctccacgtcgacacaataccacacccatccccctgcccttcgccgtctcccacctccacctcacctgcgagcagcggtgcctcctctcctcctctgctgcctccgccgcgcgcatcctcctcccatccatctcttctcggcctcggcgcccgtttcctcgctacttcgccgcctgcgccgatctccattaatccatccatcccgcgagggggagcagcggggtaggggtgccgtcgtcctgccgcttccgcctccggtgagcgcccgtgccgacgcgcgcgcgcaaaccctttctcatccctcccccttgtacccaatacctttatttttttttctctcgaatttgccttagccttatcttgtcatgtactccagaatatattaggagtagatctatctggaagctaggttttctctctgtcttaataaccctttataggactgacaagtaataacagtttttgctaccccgtctaaaagaaatatgttaggttgcttaatttcctaagcatgggttgcagtggatatcttaatcaactcacaaatgataaaatgatgtgtaattagtagtagtaatttgttaagagggattttgaggtcttgacatgtcatagattgattcattcggaggtggccactacagttacagtggctcagcatcagaagatactgatatgcgcgccttttgtggtgtttagagctacctctctttgatggcatggcatcttgagaagttgtcccttgattgcccgccttctgtctgggctcgatgaccacatgattgttgcttaaagttcaccttttgtgtgtgcttgtgttacatttgataggataaagttaccctttggtaccacatatggtaactatgagtgccgacatttgcgtttagtgtttagaatgtgacgtcatttacaattaaaccttttcaaagttttgggaaaaattaatattttttatggctattatccatttccattacgataaaagattacgaaaagtaaaataagtacattgaccaacatataatttgaacataacttcctctgaaggataacttagatttcagctacaacttaggaaactatttactcacctaagagctaggtagctaaacatgccatacgctcagacctgctacttctagaacctttagatccccaaacagggccttaagccattataaggatttgcaacaggtttcagtcaaaactagtgctaaatgtttggggccatttgccaggtgaggaaggagggtgggaatggaactaggaagtgaatggaaccacaaggaactattctctcatattgtcattctccaccctaaactgtgctggcggtgagcactgggaattggaaatcattaaactccacattgattgatttatttcttaaacggaccatgcttgttccgatgccattgaattgattttgattgttatgtagtcatgtggtactggtataccattattcttttcccttatattttccacaacaacacccccatgctccgcacaagtcagccatggatgttaaccatcaatttgtaaatactgccttcacacttctagcatctagagtcacttctgccaaaattatgcagtgccatggttcacagggacaatacttgagcagatttttttttaaaaaaattctggtctgatttggagagttatgggattggaatgggattcctctagtttccccagtgcccttatccctattggttaccggtggtgcatttctcttttttttggggttaaaatggaagtactgattgcatgctggttctttggattgttaattattttctgaatgagcaagttgcggactgcttttataggaactcatataatgttttggtagataggtcttccagtgttgaattatatcttgtggcataccttgtgccaaccaatggtattatttttcggtctgtcagaaggtattgctgacatttcttaggcaaatcagttggagagtctccctctgtgttataatgccttgttagcattattttattttatttcatatccatccttgcggtgctgtttaattaatacatattgttttttcataccgttagtgatgaacctaatcatttacttttgtcgcttccaggactagggatcatgtcaggaagagatcgtctgccacgtcgctttatagaggatggcaggggctaccctgacatccgtgtagttgatgaacgtaggggctatcctgacatccgtgtagttgaggatcgtaggggctaccatggtattcgtgccattgaggatcataggggctatcctgacatccatgaaggccttgtcatgagggttgcacctcgctctcacacggctatgccggaggaagaaattgagattcagggggccgaattcaggaggcttatggcagatcaccgtgctcttgctgaagaacgtttggccttacaccgggaattacaagctggaaaagatgaggtccgtcacttgaacacgatcattgcagacatcagtgccaagaaggaaacttatatcggtgagcttgttgacaaaaggaggaaacttgaagctgaacttagagcaaatgagtctttaagagatgagattgtgcagcttcggggtgaaattgataagcaccttgtagtcaggaaagagctctctgcgaagtctgcatctatcatgcatgaactaaccagggaacaatctaataaacagcagattcctatgttgaaagcagagattgatgcccttcgacaggaacttgttcatgcaaggtgtgcctcttttgctagctctgattctcagatacctttgtaagttattcagaggctttaagttttaagattgatttgactttttgcaggtctgcatgtgaattagagcagaaaggaaattttcagttggttgaacagaagaaagcaatggagaagaatatgatttcgatggcacaagaaattgaacaaatgcgagcagaattagctaattccgaagggagaccatgggccccaggtatgcttgggtattttacagcatttgtttgttgacctctcatttctcttccatgcgtgcttcatttatttgacagtaatcgtaaatgctatccctctgttaagagaaaccaatcagagttttagataaaaaattgcagtaggcttgtgtgtatggctaaaatcatgatgcattcactttacattttaacctcgaaggactgcatgaacttctgcatattgttgcatttctattgactatgcatctgccatctccagtaggatgttagatattgacttgtttttgctgtttcatggggacagcacttgtgattatattgtctgaattttgtctgtatgggaaatacttgcattgtccccaactccacattgagccttaggtgcctttacttttgacctgtagatttcttgcttgaaggtaattatcaggtgcgctcaagtcatcatgaagtggattttggcatttgggtaattgcacaattaggggccatatatttccaatatagtgaaggaaccaatactatattatgttttgtcccatctttgctgcaacctatggagtctgattcattttgtctaagcatagcatataatcatgtctctacatcttttttccccacttcttttatcctcatctgtttaaagggtcatcaaaatcctccaagatttacctagttccattgcttcccaccaaaaatcctgaaaagaagattgtgcatatcagtgatgaaaatttagtgatcttgatttcttgctggagaagtcataccaattcttgtttattgagatcaattatcaatagggcagtgaacagctgcgttcgttgtaagccacatctactgagatgtgggctgtctctgtctagtgaaagccgcaagctgttatagtgtcatatatactttttttttctgtgtgtggccggtaagtgaggtccagcaaattgttaacactaacattggcagtttggcccatatttattcatcaactgggttatgaaggagagttgacttagctttagctgttccatatatttctatttattgcaggacgcctggacctagtgctaagctatttaaaacatttagcaatgtacatatggtacatcaaaatatattaagcttgctttttttttttgaaaagttatgagcaagctttttttcccttgaaaagtcataagtaagcttatttttttctgaaagaaggaaacagtctggtgtcaactaaatcataagtttgagattaataattgaccatttattttccagtatcctaacatttaatttttggcctcctatatgcccgcacgtttagcatagtttaacagtccaatggggcaaattcaggactattccttatcaatgatgagttcttcaatcacgcagacttgtagtaacaatgttctgaaaagcactaagtgaatggcacctgctcactgatcagtcagactgggcatcctcctaggcatgctatacagcaataggcacaaggcaggatacctaggaggtctagacagctgccttagcctggagggtggttttctcctaagtagattcactggaacagtttatattgctttagcattgacacattacatttctatggaacaatgtagaacttttttcatggttgtttacctgatgtttaaggtgcgacatatgggatgaagctgggcagccctgaagtgaccttccctacttcatatggagataactacaatatccatgtggtacgataataagaaatatagcagatatgatacttcctttgttaggctgaaatgactcctacttacttttttctaaaattactattttgttaccagggaggttccgagaaaggtcattcacatcttcctgaatcaagctcatggggtacatatgacaacaatcgccttcagtaccgttaagatcgcagctgctatgaaaaaagtccgtgaagacttctgggtcccatggtcatatcacatggtttagattatcgtatctacctccttttttgtggtacaatcaatagttatctttcttaattaaaattgaaatgcctctaatcattttcttctctgtgtgtcatataaaatatgttccaatggtaactactgcttatactttggctcgatacctatatccaagtttccttggttatatggatccatgacacagttattttaatatgacttgggtatatatatgatatagtttagttaatgactcagtcatgccacatatggagcatgaagtctgaattctatgtggagatataattaagcatatcagagaaatgttccttccatcatgtattacatgtcattctgaaaaaaaaccagtgagctttttatgaaatgaatacacattgttgcttgtgtttactagtatgggtctataccctagattttactcttgacaataactaatttattgtttctctcacttttagttttgcaatggtatctatgttaagggcgttagtctctttatgctagattatttcaagcgtttattacttgttactagatttcatcaaacatggtcacatgggcagcaagctgttttttgtcgagctctcttgccaaattcccaaacggcattttcttcagataccatacttttcttatctaggttgacgtaggtcaatgcttttaccaatagtgaattgcgataagatgatggctagattaatgtcaaccgctgcatatttcaaagtataatgtatcagtgaaccaaagactgttatcagcagaaggggatgcaaaatagaagtgatgtttgttgtgttagaagttatttgcctcagtcaatctttaaggccatcatacctcgaagaagtctatatttaggatcatggttgccttccctttttggggggttttggctcaacttatatgatgtagtttacctacctaagttgttcatctgaatttgtttgcctttggacacatgaatgatgagtatttcacatttcctatccttgtgaactgttcatgtggaagtggaacttgttcttacataccttttgtgagcttgattagaaagtgcttctcacttatggggtttaaattttaattattaagtctgatattattctgaccgctcctaaaatattttgggactgcgtgtcctgagaccatagtttcaatctcatgtcgtattatagagagtgagcttagtcacagacttggcaggtactaggttttcaccattgtacatctcaatagatctagtggtcagtcaggaacatatttggccattttagaagtctacaggtaatattaacctgtatagctttacatatgcatgagcatatcaccttgtgctccctgaggtcagattaccacggtggctgcaactctgatccacgtgccactttgctacctgaggtcagattaccagagtggccacttcgctacttgtcaagttggccttgtcctgtactggattgtctactgggacatccaacttcaacatgtattagcagttctgctttctggaagtggagttttgataccagcagtttgtgtactaccaaaacctgaggttaatatttgagttgctgctactagcctttttcggggttcatggtggaacgttctaggtgatgttaagctgtacatagtgaagcatcactgttgctaaatttgccctttaccttgtactcttggaatgatgacgggcaaaataaattcttgcaaagtgtaggtggaactatgcatgactatcatcaaccaggtgttagagatgcataaagtggttccttctgagttacatgcctaaattgcaactagatgaacctgcctcctgttctaaatgtgatat

SEQ ID NO: 53092 - DNA, 14204 bp, Oryza sativa
  unsure (1)..(14204): unsure at all n locations
ttgtgtactaccaaaacctgaggttaatatttgagttgctgctactagccttttcggggttcatggtggaacgttctaggtgatgttaagctgtacatagtgaagcatcactgttgctaaatttgccctttaccttgtactcttggaatgatgacgggcaaaataaattcttgcaaagtgtaggtggaactatgcatgactatcatcaaccaggtgttagagatgcataaagtggttccttctgagttacatgcctaaattgcaactagatgaacctgcctcctgttctaaatgtgatatcttcaagatgagcactatggacgctgattggcattttggtccattttctgtattttggaacctgggcattgctgatcgactaccggaaaggtctgcataaccatgtttggttcaaatttgcggagtgtcatttgcctaagcctggaaagaccatatatctacaaaatagtgtatcatgcctgaactgtatgaactctttagctctggaacgctgcctcaataaggggaaatgatatcagtggttctgtatggttgcagccaatggaaatttggtgtgctctgcctgtctgcaatagacttcttaaagcatgctgcagatctgaatacaaggtggctgaagaggttaccttccaatttttgggctacatgggtgcaccctttaacatacaaggtccatgtaaagagcttatggatattaagttgtgttggtggttcatggggtatagcttttgtggagaacaggaaatgataataaaattgatcgaattacagagaccgttctgatgttttcaaatgacacagacaagctggtgatgacttggcaaccatgaggcaagtagtttcttcatccacagcagaagttgcactaagtttttatctgttctattcttataatgcagcttccttaacctctagtaaaatgttagcttgcatgctcttaggatatttgagtcagctctgctgctctagagtaacccatatcgtatgctagatatcattttccttctgagaattggtgattttagatcctgtaccattggaaatttagaaccaagcctatacttaactgttcttctggttgataccttttggaacttagtgaagcagttaatatgccatattccaagaaaccttgttggtgatgaggcttctccttcagatggttatccccatatatgttgatttattgccatgaataagcttagctgaatgcggcatttgtgcctttaggtaacatatgattaatgttttggcaagaaatatgtccatatgacccctagtctacccaacacttccaactataaaaccactcatctgacattttgtattgcttaagtggtgtgataggtaataggttgatggtttttccatgtgttaacaaggttgccacattagaataatgatctggtgggttttgagctagtggtaacatacccaacatatggccctacgagctaggggtgctgggtggaagggagagaagcagtgagataattgtgctcttgtctagtgaacatgcgggagccccaaataatggaatgagttagtgaaggggtggttttatcagtcgccttgctggtgatggcatcatagaaggggcaaagtaaggcaccatgcgagtgccgcagtgcttagatgtaagtgatgggtgatagaccatgcacttgccttggatagtgaggagtcatttcgtcatacaatgtatgggaggcattgttgattgtgttctcgaggacaacaaatcttgagcagtcatcccgtacctaatgtactggtttagtagggaagccttttgttaaggtgcccttaagaaaggggtcgtcccaaacttgtggagtgcgatggggacttggatatagattgtgtgctgagtgaggagctttgcagagcgtaatctggtagatgtattccactgcaagatattaagtgttgtccgtactgaagataggttagattacattaggttagttctgatggtgggacatgctgagcgtagcatggggagatatcctgaaagtgttggatccggttctaccatcattggaaaaggcaggtgtttgaaaaatcaaattccaggacagcaaaccactaagagatgatgacacaaacttcaatagatttgtactgtgatatccaaacgatagagccatgcattggcagtggggagggagggataaagatgattggagacttagctagggagaaagatgatggccacacagtgctatctgctggagctgaggaaaaatttagtggtgtcgcattcctatgaaagagaaagtatgattgaaggaatgacaacaatatagcggcgttcgagaatgcagtttgatgcaagtaattggactcactaggtagaagatgatgacaaggcgaagccgtctgctggaattgagaagatggtagtggcatgacattcctgtgggcatgatcatatttgattacgtaaaagctagagggtgtttgagaatgcagtttgacacgatagatttggaaacatgctcactgtggtgtgcggtgtccatagtgtcgatgatgcttgtaaacctcgtgagggcatggggctttgagtgatgaatgttattccggaaatcggtgcatggcactctcctctatcttctcaagtccttaaccgcctccctaataaaaaggagacagtaaattccaaaatagactaaatatagtctgaacgttcctaaaagtccctcaaatgagataatataataaagaacccaatgtagacagtatgcaagggtgctcctaagaatccaaaagaggttgctcagaagagatagatgtcgtgtaaagcctttctttttacgtgacaggaaaaattgactatggtttcccctttttgtttgcaaacaattatgggaatagaatagaaagcagctaacttttcatggttaatgctgttgcttgttttgtttcactagtttgagagaaacattatggtactctacatctgtgtgaactgtgttgctaaacagaactactgaagaaaacatggcacttctttgggaaaaaaaatgctgttaaacttgtcatgaaaatggtagtcacatgtttgttataatttcacacatggttggactttttaaaaaatgtactgttagaaagcagcatcctttattgaagcagagttttgttgaattcgtggtagggtttttgaaatgttagtccatgatctcaagaatattatgatttggatgtatatgtagcttagatttattttattcaaattctagataatagatacaacaattgaatcaactaagggtataagaccaaatttcctgcaatgttttgtttgaagattactaatctgtatctcgagaattattcttctaatttcaaatttctgctggcttaaaaactggagtgatatccttgctgcatctccaaaacttctactggaactacattggataacatgaaatctcagtgtaccgatttatcttgttatgtgataaacctgggtacatggtacagtgcagttaggaaatggaagcggaacagctttgatgaaattgagactataatctagcatgtaacctttgatctaaatccatggagaggatcaacttaatacaaactctttttttgcatgtataaattgcacattgttttcttcctgaacattttagctgcatatgagttccagtttgtttttaccctactcgtctcccttctgtttattatcagattgatgcctattgacatgtttatgttaagtgattaagtggtttctgttatattcatgagtaatcaaagtataatttctgtagtatgtgctgcttttctcctattacaatagcttcttgtttactatttacacaactgcttatgcctttctgttttccaataaatgtctaacgctgtttttgaccatgcaggttgaaatcattagttggtctgtccctctgactgaagatatattgcattaatgagaagacagggacatctgcttgaagaaaacagtaatacggggagctgctgatgccgaatcttctctagcagatcagttatgcttctaggcatgtgctctttggacaagcaacagatcggcatatctaaactttctgatctcaagacacgaaaatgttccatcaactggagacacgagcaaaatgttaaatcaaccaggagaatgcataagcatctacagtattaatgcttgatggagatgaatgtgacaccttcggatgattgattcataagcaggcattgttcttttgggagaaaggatagtagatattgattatgtactacggagctgtagaaactttcagctgccagcttgtcaagattataacaagttgctctcatcgtgtgctgcattcaggaaagatgtgaggcaggaactattataaggttgaactgaaagcctttcttaactctgtttgatcgaggccatgttgtgtagcggtattgatgatgatggttcttatggaaaacgaagagactaggacaagttccatcaaccttcttgataacaagcggatactgtacctgcttcattttggttaagagtgttgcttgaaatgaagatctcccaggtccccatgtgatatcacatcttctctgaagcttgtatatataactgaaatggacttgtgtcctgaaccgaacaattgtcagcatcatgcccaagcagaataaacagattggaggaaaaacaagagttcgaggtggaaggaatctgactatgacaagatgggcctacacctacctagtggctcaagtccaacatctcactgatgtataaggttcaaaacccatcgtaaaccacaggcacgtgacattcttcatccaaaggaaaccaagagttccccagccccaggactgcagataccactttccatgcgttgtttgtccctccctgcatcacatgcaatctgacatgtttctggggttgattccggtatgtggactccattcaatgactgtttgtttcctgaatcgactgcacaattgtggttgatggatgattgccagaacaagccgttgatgaggattcttgtgggcatactgatggactggtatttgcattgcatattgcatatggttcctagtagtaggaggtttgtgtgaatgttttgatcggtgaggctgagtgaacagtagagtgttggtaatcctacggctttccctcattttatgatgggttgaggtatggtcgagtttccattcgagtgagttttcttttttctgggtgacgtactgacttagatcagtttcatcgtgtttagttccaaaataattcctcaaactttcaactttttcatcacattaaaacttttctacatacacaaacttccaacttttctgtcacatcgtttcaatttcaaccaaacttacaatttttatgtgaactaaacacagccaaagtcgtgccaagtaaattagcaaacgttcacctgcgatgcatcttgattatacaaacagacgcttcgtcttgcttcccagaaatgaaagaactgccgttcgatgtttttgccgatatgaccatgagaatttcattatcaaattgcacgaacggtttccatcgttttcttttggtactcattatttgtacttgttttcttggtacctagtagtgatttcagaaccctaggttaggtgttaaccatgcatcttagactagtgtatcctgccggccggccaaagtcatttgcttttttttactctccagtgttgcactgaaaatataagagattattgcatcgagttgccatgtgtttgtccatatcgtcgcctctaacactcaaatcgtcccgtgcctcaggcctcatctataaaatcccttgtgcattctccaactcgcaactacacaaacaccgtgccaacaaatggagagaggcggagcggcggcggctgccggcggtggcgtggtggtgtgccgtcggcggcgaaggattcgtggccggagttggtcggcgtgtcgtcggaggcggcgaagacgaagatcggagaggagaggccggagttggacgtgcaggtggtccccgccgacgccttcgtcaccacggactacaacgccggccgtgtcagggtcttcgtcgactcggacgacaaggtcgccagacctcccaagatcggctaagctagctgtgccctaatatttaattttaaaccctttgtattttgcatgaacaatagaaacagaaaataattaagccagtgcgagtagtatgatcactgtttcactatagcaataagacgagtaatatgtattcccgctataaatgacatatgcatcgtatgattactattgttttcgaaatttacatggttttcacggaaatctgtttaagcctcatttgggatggaaaacttctactgtaattttaaaagaaattaacaaattccagtgaatatatcttctacggtaattttaaaagaaattatctgattcaagtgaatatatcctatagaatccatgcctgtttcctgcaaaattcctccaagaaagcaagcagggttaagcacgggaattgcaaaatcattgaacctcctcatttcacttgtaatttgtacaaaatttatcataaatagcctcgaaaattaaggcttcagaaagagtagaggtggtgcagcctggccttgttctcctcccaccaaactctcgccttcacctcgccaaacttctcgcggctgcgacaaaagtcaacgatcgcgcacacgtcagcacggcacaagtcaacgacccgtacacgtcagcatgacgcaatcagtcacacacgccatggatgaatgaacacgccggagctgcgatagaaagtgcggcgtacctgagctcgacgcaccggagctggaggcggtggccgggataggctccgacggtgatgaacacgccgggctcgtactcctccacccactccctccacgtcgccgccgtcggctggtgctggtcgcggacggcgtcgtgctcgccgcctccggtggtgttgggcgcggtgacgaggcccagtatcggcgagcccaacgtgccggttgacccgccgccgctgccgctggaagggccaccggagaaggtggacgtcgacggcgaccgtgacgacgactctgctccgtcgtcgtcgtcgtcgtcctccgcctcggattggcatggggtggccggcaacatggcggcatccgccgcggctatcgcctcctcctcgtcgtcgtcgtcgtcgggcttgacgaggcagtagaactcggcgatgcggtcgtggttgtccgcccaccagcactgcggccgccacgggttgaacacctcctcccttgacggatcctccgtagccggttgctgacgccgtcggcgcgcggcgccagcgtcagcaaccacccccgggtccgggttcggccaccaatcccggctcacctcctgccgccgcctcatcctccgcgccaccgcctcccgacagagccgagcagcacttgtcgcagaactcttcttccttacctcctccacccccctccccctcctcttccggcgcgatcttggcggacgcggacgccaccgccgccgccgccgcggccggcgcggcatccttgcattgccgcatccgccgccgccgcgccagcgcgtggtctccacctcgacgaccaatcaagatcttggtgaagtcgctgatgacgttgaatgacttggcgagcctgccgccgccgccgccgccgccgccatggaagcacacgtgcatctgcctctgcctcgctctgctcgtgagcgagctcgctagatttggggggaagaagacgacgaggtggttttgaaattcagttcaaatgcgagcagcacgcagtgaatgcgggcggcgtgtacgtgggggcaaatacgtgcaaaatttatggcgaaaattttggattcgaatttagtgcgtgattgtacattttgggggtacagctaacggctaccgttgaaatcaccggaggtgaggcgagagagagacgccgtaggatctggaccgcacgctcgtcatctaacggctctcagatggcctcgtgctggaattatgcagatgagtccctccacgtttgggtcgctactcgctaccattagctgcgagcgttgtagtttttgtgtattacaacaacaacaacaacaacaacaacaacaacaacaaaactgcgtgaaaaaaagttaaacacaaagatagtttggatcgtattactatcacttttagtttcccgtgtgctttaatccggtccgcaagcttatcatctgatggtacaagttggccgcgggttaaaattatgcaaatgggtcccttgttcggatgagtgacggtacaacagaatgcgctgtttggggacaggattttggacacgaagggcctgttcactttgatgccaaaaaaaaccttatcaaaatttggcattgctaaaattttggcaggatttcttatatagttaccaaaatttggtagcaaactaaatgtagccattttttgacaactttaccaaaatttggtaaggttgaaaattgcatcaaagtgaacaggtccgaaataaacatctgaaatttctgaatcttgtgctccatttgatttgaggactcctcttttggtcgagtactaaatttcagggtttttattcaggcgggtgcaaatgcaacgattcagcaaatcatatctccgctgaataattcattaggaataattcagtgctgtggatgatcccaagtgaaatttcagatgcatcagaccgtcaaaaacaaacacaagcatgcaggaacacatgtgtttggagttccatcttcagaatttcagagacttgcactagaattgcaaaaccaaccatcaaaaagcacaagattcgtttgagttgcctatgcaatttcccctgatttcctcataattcgaacaggggatcttgatcaatcctctctgtttgcaaaagaacataattcgtttgagttgaaaagcatcagaactctcaaatttcaatccacgttccgaatcgaataaaaactctagaagccatgttgagctgtaaaatttacaattaaagatgttttggacctggaaattctactctgttctccgactcgaaaaacaccaggagttttcaaatttcaatccatgggtccttcgaaacagaatcaaaataactctggaaaccgtgcttacctgcgaaatttaaactttaaaaaaatttgacgaacggatgaaagggaacgtgtaagcagcttctgtggtgtcgtcgtcctagtggcagtggggcccagctggcagctacatttggtcagtgtggctggcacgtgtcggggagccaacgtagtgtggccgaatgctgattaaaacggaatagatcactattagcacataggattaattaaatattaaaaattataaattaaaaatgaatttatttggttttctaaagaaatttttatatttaactactttttataaaacgtatcatttagcattttcgaaaatatgtttggggagaacgatactatctcagacaatttattgtggcgaactcggccttattaggagtatttacttggcttgcttgtaagtcaaaaggagttgacttttaaagtcaacatggcatagttgcgccgaagtcatagtgatgacaaccctgctatagaggcttgtggtcttaagagcaagtataataggaaaagatagagggatagagaggagcaggtgcttagcgaagaacaagcactggcacaagctcctataaacctgctctataagatggatgtgcaggacggataagagtgtgggataaagagggttaaggaaaagacgatatatctgggtgagtaggatctagtaacaacatgtataatgcttggcacaaaacggcggatgcctccgctgcgccacgcgcgtgagactctgaagattgcataactgaagaaacttgaagattcagaaatcagaacgcggctgtgtgttatacacgggagagtggatgaacggttgggattaaaggataacggttcgctgggatggttatggagatccaagggctacaaagcgccgcgacggactacagattgctttgtttgccgtactgtagtcatcattctttatcgcgtagctctggagtctggactcgatataaagccacgaagcagtcacaaacaaactatgcgaaaagtttttattcctcatttcttgttcttgcgctgcactctatatgttgtcaaatccagctcgatttcatcaattactttactattttgctgtgttaaggttcctagttagttagccactagtccgattatctgaatctcacttgttctgaaccaaaatctgctcggttccttttttccttcttattttctcttcttcttctattcctccctcttcatccggttcttttgtaactctttatgcaacaccttgactaccattaatacaatggttataaggtagagtctctctacctttttcagtaaaaaaaaaatctgctcggttgctgacagggcaccagtgttcgtggttccggccttcacgagtaatcaagatcttggtgaagtccctgatgacgttgatggaaggtgcatctatgtgcctctgctttgctctgctcgtgggctcgatatgttggggaagaggacgatgtggttaaaaattcagttcaaatgtacgcgcataagataattttttgtgtgccatattccctggagagattaacatgtaattacattcaagatgtaaaaaaagtaacatggttaagaacatatgttgttagtacaaagttaatcaaacttgaattacatctcagagttaaatttctgaacaacatacaacaattttagaaagttctcctactacctcaaagaaaacaaacttcacaaaaaaagttttaccataataatgtcttagtccatgacttaatgtcaggtttttagtcaggtttctctgctgaatacatcagacaacttccatcttcactcttcagaatttcagatttgcagtaaaattgcagaaccaatcatcaaagcacaagattcgttttgagttgcaatgtaattttcacctaattttattataaattgaattgaacaggggattttgatgaatcccctgtgtttttacaaaaagaacattactgtatacattcttagcatttacatagcacaaattcgtgcaaaaccatgttgatcacaacttgggatcaatagattacatgactagtagttcatccaactagaagccctgcagctatcttatctcggtgcctcgttggctggccgcgtcgtcgtcgtcgtctccgccttgtcagcgtcagtccgccgcccggagggtgatccggcggccgaggttgcgagcgatcaaaaacggcgaccagctgcctccatcctcctcgccgatcttgatgtctgctcggctgcccgcgggatcgtgcgccggcgtgaggcagtagcgtcccaggatttcccggcgcctctcgaggtagccctcctcgccgcgggcggggacgtcgtcgtcgtcgctctcctcgtcgtcctcctccgtcacgacgaccgcggcggtggagggctcttcctccggcgtggcacggcggcgggtctcggcttgcagccggatctcctcgtagaaccgcttcctctcgaagtcctcgccgagcaccttgtcaagattgacgccagcgccgtcgaggaggacggtggtggtggcggcggcggagtcgccggagttcctcctccgctgctgccgcttggattccttctcgatccggcgcttcttctcggcgatccaccgattcttctcggcctcccgcgccacctgctccggcgtccagtgccgccgcttctgcagctcgtacgccgccgcgggggcgatgtcccacagccgcctctccagctcgagcaactcctccttagtcgccaccgggacgacggcggcggcgatggcggcggcagagcggcgggggaagaagcagctggggagaatccaagacgacatggctcgagtcgagtcgagtcgatcgatgcggttgtgatttgtgaagtttagggctaataggggattagggctaatagggaggggatttagggttatatagcgagtcggagtcggagtccgatttgaagcgggtatccgaaaagcacgcggattccttccgatttatgaaatttggcgagttattaatcaatctatctaatgctggcggcagtattgattggaccacgtgtcacctctgaattaacagataaatcccaaacaacttatttgagagagaaaaagaattaagctagagagatagaggtccatcgatccattgagaaacacgagaagacgtctggtggtctccttactcctggactgactaattgtgccaaatatatgccgattgggccgatggaccatgagaccaactgaccaagttagatcaaagtcaactagacatgaataataagtaaaataaaataaaaatacataatcagtatttatgcatgttcaatgcaaaattaaatattatttaatattcaaaatattttctcttaggctacatttatttattcattaaagttaaatgatgctccctctgtttcacaatgtaagtcattctagcctctctcacattcgtattaatgttaatgaatctagacatatatatctagctagattcattaacatcaatatgaatgtagaaaatgctagaatgacttacattgtgaaacggaggaattatgaccaaatgcattactcttttacttgatttagttttcaaatttagaaacctttaaatagtccttgctaggaagaatatgggcatgtataatccgcggaaaacgccagctcatgtgtcctcacttggaagaagcactaaatagcacacgcatgttatataatcagaggatgcgccaactggcgcgtctattttctagtattatcttttaatgctggctgtgcatgcaaacgatgattgggccacgtggcacctttcacactacaaataaatcttgaaattatacgagagaaaaaaataagcgcaaaaatatggtaacagtgctgaagtgctgaaccatctcctgagtcctacatggctcgatagaaaaaggaaataaacatccataggcaaaaagagaatcaaacatgactaagaaaaaaaatagacctagatactatagtttacacagagagaaaagagaaaatgcaaaggagaagtggggaaggatctagaaggattgatggggcttaaaagaattttactaaggagcaaaatatcaggtatagatcagtggggtccggttagactttaatttttatcaacaagtataattttttccaacatagatacttatattaaatcctttagctcataaaatatatatatatatttgcaaacaaatgccttttactccctccattccaaaatataaggcataaccacctctaacccaaagaccaagaaataattattattatcttgtagtttggatcatcctaataaatataatacatgtatccaatagaattagagaacatgagagtagaggatttaaaaaaagtaataatttaatggagaaaagatcatagttaattgcttacatgcatgcatgcgttatattatggaacattaaaaaaagtggttgtaccttatattatggaatggagggagtaaaatattatcacctattttgtcaattaatagacaatacaattataattttactctacaaaggaaccctaaatagttcagacaaaaaatagagtaaacttaaaagattttcaaaatttaacaaaagaaaattatacttttaaaaaatttcaaaatttctactttctaatcacagaaacaatgcggacaggctataacatgagcgcgtcaaaagacgcacggaatttctatctttctaaaactagcttgtatctcgagccatcttattgagccacatggcgatattaaattttgagataaatctaagaaaattaagcataagaaataggcaaaataaaagaaaaagataaatccaatttatagagacttcccaattatctatccactttgatataaatgtagagaatatccctatgaaagaaataccaagaagcaaacaaaaggcacatcatccagattccagaggtttcccaacatatttttcccctttgcaatctatctatctatctatctatcttatgccggtcgtttcatgctagctaannnnnnnnnnnnnnnnnnnnnnnnnnnnnnnnnnnnnnnnnnnnnnnnnnnnnnnnnta

SEQ ID NO: 53093 - DNA, 3003 bp, Oryza sativa
tgctggtgggtttcatgctagctaattggtgtctctcacgatcctttgggtgagcaacccatggtgacatacaagcggctaaaagagcgctaggtaagaaaccctctctataaaactgggaagcgcacaagttacgatggtgaattgaaaagagagagaataagagctactccatatgtgcagatgggccatgcggcaccataatccaacaatgcgtgatcaaaccagtgcaaacacctaaaagaagagggaagaaaatttaaaaaaagggaaaaaatactttttctaaaattatttgcaaattattcggggcaagcatcatgaccacatatcttatatttcaataaactaaaaatggtaaatagaaaaataaatgataggaacaatttgctcttttttaagattgaatcgatctctataaccctgataacaattttctaaatatatgtattttttttataatataaaataaataatatgtagattctaaatatatgtatttttatttgtactataaaataaataatatttagatatttcaacttttgaaaaacattacaattctgataaaatcaataaacaatactggtgttggatccatacatagagtcttatctaagcactctgatgctaaaaatcacaaaaaaaactaaaatattagtatattaacaatatatggtttttaaaggttatacacatagattaatcagtggaagcgccaaccggcatgttgattttctaatgaaattctattgctggatgttggatcggcatcccggtccacgtgagccatacacttactgaacatgtgcacacggttatgaggagtaggcgtgccgtgcgagtagtgaccttggcttgggcatttgttcatttattattttttattaaaattaaaacaaatgcaaatactgatgaaaaatggctggagaaattattggtgaaaagttggaagaaaaagagagaagagaacagagaaaatgagaataatattaagattatggccttatcgtaatataatatagtttgctactatgcttgaaaatattcaaatagatatgagctgtaataggttacatctgaataaggaataaccttttttaattaaaaaaaatgagttaataagccctcgaccttttatcttatcccctctctacacattcctttagtttacaatgttttaaccattatttttttcttttcaatataactatattgaactactctcgtacttaacttatgtgctattttactgataaaaaatatattttctcattgtgaaaaaaatagaatcagatgtaaaataaggagatataattatttgaccaaattttgtaaaatcaaaattttaattttttagataaaatttcaagtcaaatatgtgaaacccgtattatattttctccaaatttcaaacctaaacagacaatcattttggtgttcaacatcttgatggaactcttgtttggagtcaataaatttatttataaactttttaaaataattatttttattttttcagtttttgatggaaaataattttgtccatttagttttattttaaagtactttatttatattgagatttatgtttttgatgtaagtagcgcataatgaagtaatttttttttaaaaaatccaacggtcaactcacaactgttacccccatcccaaatttgtggtcgttttgactttttttgcttgcaacttttgaccattcgtctatttaaaaaattattgtaattataaaatagggcaagtcatacttaaagtacttttggtaataaagcaagtcacaaacaaaataaataataatttcataatttttaataagacgaataattaaaatttacaaacaaaaactcaatgtgacaagtactttgggacggaggaagtacatatatacatataggagatcaaaatgataacccaagggtttggaattttctcataagatgagataatcaggggtaaaaaactcatagggtaaatatggagttttcttctagtttataaattattgatcgtttggtatatgcatgcatatgaatatctatctaacaaaaaggtgtgtgcaggagggtcttctcgtggtattacgttgtatcatcatatactgcctatgcatgtattaatttatggaccgaaatcaatattattatatgaaaaattttagtagtattatattatcaagtataaattaattcaattaatggatcaacacatgaattgatttaaatggtttaattaattcctcccatgatcttttttgagttctttttggtacatatatgtgctaaccaaatgtgaaagcatatagtaccggttagtcacttggtctacacaccacatggctcggtggctgggtttgttttttgaacgttggtgtgtacgattaaagtgaatgcgcacgcaccagtgcaccatggcaccagcaccagcagcagcgagctagctaggttttccaagatgatcgctccgtgggaaaagcagggagtacgaatgccatgctaatttaatgcaagttttgctcacctcaggtgtcacatgctatgatgctaatgcatggaggaagataagcaaactgtactatctagcacatccagagatgaatgtagtatacaagtagtataatataatacacacccacagttccacaccagcttcttaattattgcaatttccaactaattaattagggcacacaagaaatatatatataattgagaaaattatatatatatatatatatatatatatatatatatatatatatatatatatatatatatatatatatatatatagggagagagagaccgtatatgactccagttaatttacgtgatatcgcttggatggtaattgcaggttagatgggaaagcattggctgttacgtcttagagaaattcccaccttgtaccgtaattgattctaattaattgatttaggtgacatgattagaaggtaaattaatatgttttgtttaacatgtcattata

SEQ ID NO: 53094 - DNA, 859 bp, Oryza sativa
actcttttctccccataacaatactgaaatcaaagtggaggaattgataaacctcgccgtcgccggcttattcaatcgatcgtccaccgttacgccatagcttgcacggtggctcgatcattcactcgctgtgtttttcaacagcacgcgtcgccggcagcgcttcatcatcatgtgcaggcagctccgacgagccgtatccatgcagctgttgcttcccggcgccggagtagcatcgcctcaggttgctcgcatgcacgacggcctgcacgtatataataaaatgagttcaaatattccacggtgttatttattttgggatgaggagagtaactcgctacttactacttccgtctcaggatatctactactacttaaaaagtaaaacctgcttccgtcgtccgtgaaaaataaaacgctgagaaaaaaacgaaaaaaaaggtccgattcccattaaaaacaaaacttccgactcacttggaaattccgttgaaaaaaaggaaagaaaaattactgtatgaaaaaaaatcaagcgcgagaaaagggcaaaaattttgttctgccgatcccaaaaaaggtgcgacaaaagagtttccgtcttccgtaaaataaggaaaatctatatctatatctatacctattataaaaatacgtaaggtttttgtattttttttcgtccgtcacttttttttttgttattttcgccttttttttccgttttttccgtccctccaattttttttgcctttggttcatttttcctttttttcacccgccgttttttcgtccgtttcaggttctcttttttttttcctttttgtcggcattccttccttcaattggtcgtaaaaatcgattc

SEQ ID NO: 53095 - DNA, 712 bp, Oryza sativa
gatattatcaacccaattctacattatcaggtaagacaaacgcggatgaagatgaagcactaatttgggggctacaaggaagaagttcaaaattcactatttatgacttttcgcaagtattagaggccacagataatttctcaaagaaaataaacttgggcaaggaggctttggtcctgtatacaaggtacataagacgaaaaatctgacaaaagttatacacatatattattcgttaatttacatggagtattatgcaattcactctctgctttggccgattatatcttgatcataatatttgtcaagtgtcaaaagtcaattgaaactgcaaattaactcgtgtcactcatccatctcttttgcacttgtctctagggccgatttcctgatggggtggagatagcagttaagagacttgcttctcattcagggcaaggcttgacagagttcaaaaatgaaatccaactcatagctaagctccagcacacaaatcttgttaagctcttgggatgctgttaccagggacaggagaaaatactaatatatgaatatttgccaaattaaagcttggaattcttcaattttgggattaacttcttgctgtaccgaaccgcaaataaaagatttggttcactaactctaactgcaaaatgtatatcctttgttatatctatgttgaattgatttgcagatgaaacaagaagagctt

SEQ ID NO: 53096 - DNA, 746 bp, Oryza sativa
ggattaccagttgctggagttggaaaggtaagtcttgtgtattgcatcgcacaaacattgaagagcgtctgtaatctttctaatgtacgacctttccatccaggttttcttggagtatgcagatgtggacggcgccaccaaagcaaagacggcaatgcatggaaggaagttcggtggaaatccagttgttgcagtgttctaccctgagaacaagttttctagtgcggaatatgacgcgtagattatcccgctatgtaaaacactagtcttttgtttttcttttgcgccagtttgctaaattgtaacaacaatttctctttaagttgaaccttccaatagcttggatttatgcagagcgaccgattaattaatattaaaagatgtgatggatttcctaaagttaactgaagggcttggagtatgatctgattcttgtccgtttatcctgatagacctggattatttgttaactctgttaggcggtagctcttgtcaccggagacgaaggagaatggtgggggcgaggacacctcatcagtctgtccctctggcgtagacgcgagcgaagaacgcaagtggaaggaaattaaaggatgcgggcgaagaacgataggaagaggattatggaggtttggatgtgatctgagcagttggattgtgatctaatggtctaaaatttgcaagatttggacgcaggttttctggcaaattacatgtaggtaggcccctatgatctagtaattctt

SEQ ID NO: 53097 - DNA, 801 bp, Oryza sativa
taatttaacaatgtggtgttacagtaaacatttgctaatgatggattaattagtcttaataaattcatctcgcaatttatagacagaatttgtaatttgttttgttattagactacgtttaataatttaaatgtgtatgtgtccatatatatgatgtgatatgccaaaacttttcatctctggatgtaaaattgtaaacacagccatatacaatgtgtcgttgcctgcatgcacgcagatcctggatggtcgcggcaaggaggagaagaagaagcgcgtgggattcatcctcctcctgtccgacggagtggatcagttccaatactcgaggatcaattgggagaaggtggcgaagagcaccgacgtcgaccactccgaagttggcgccatgctccgcaagtacgcggtgcacacgttcggcttcagcgcgtcccacgaccccgtgccactgagacagatctccgcgctctcctacggcctctactccttcgtctgcaagaacctcgacaacatcacagaggccttcccccgctgcctaggaggcctccgcacggtcgtcgccgccgaaatccgcgtcgatctcaagcccaaaagcagtgataagcagcagcagcagcagccggtgctcatcaagagcatcgattctgggggctatgagagtcaagtcatcggcggcggaacctccggcaagatcctcatcccggtactctacgtcgacgaggtgaagaagttcatcgtccacctgaaggggcccaaggtgtcggccaccaccgtcaataaccagcaggagattctcacagc

SEQ ID NO: 53098 - DNA, 1038 bp, Oryza sativa
cccacgacatgtcaccatgcgcctcaataccaccacggtacctcggaaaggagctgtgacagtacccctcgcacaacacaatccaccacagtgcaccgttcctggatcataatcacccccttataaacaaggcatggactccccagcgacccccgtgggcttatctctgccacttctcagtctggtgctccgcaatgaaccatgctatacaaaaggtaaagccgttgcccatgctggcttgtggttggcacggttaatgtttcacaaccgaaactcgtgaaccggtccttaattgtcatgagcacgaccatcaaaaccatgtgctcataacccacctttatcaagttttagttgacatattaattaattaaccaatcacgattaaccatcgtgagcttccattaaatatccataagtgatagtgaagcatgatttatcccattagtgagctattgtttctaagcacggctaagcatctattataagcatctagctgaaccaaaccaatatataaggttctagctaatcaaattataacccataggtaaataaagtcatcttcggccataattaaatgggaaaggctcaccacccggtgacattcgaaaataaatgcacaattaaaataaatagagaatttaaatgtaggatcaacatgctcaaaggaattatgtttgggatctgtgacttgccttgcaataaagggtcttcaattaatcttcttgaatacttccgacgcactcacgaaccttcgaaacgacggaaacgacaagctaacatgcaaaacgaggaaaaagactaagaaactccaaataaacagtacatataaagtaaacaaacatgtagatcatgatttagatgaatttagagacttgaacgacctcattccgatttcatatgaattaattaccaattttacaagatttaattcccatttaacctaattaaagaaaagataattccaaattaattaaccaatttacaaatccctataatgagagaaaagattaaagcaacctccggaaaagggctgcagga

SEQ ID NO: 53099 - DNA, 734 bp, Oryza sativa
ccccctcttttccttgctcgatctcggagtttccctacacctgcctcggcattccactgtcagttcgcaagctgccaaaagcggccctgaaaccgcttgtggataaagtctcccatcggctcccccctggaagggccgtctcaccactctggcgggtcactcggttctagtccagttggtctctcttccattccggtctatgtttctgtggcgatcggcttgccaagctgggttatcaaagccattgacaagaagtgtcgcgccttcttgtggacgggtacggactcggccaatgggggacagtgccgggtgtcctggatgagggtttgccgtcctagggatctcggtggaccgggcattccggatctcaggatggctggctttgccttgagtgttcgctagctctggcttcagcgctcggggcatccctactggtctgatctgaaggcccctattaagcggagcgtctccgacatgtttgtagcatacaccttctctatcctgggagatggtcaatccaagctcttctggattgaccggtggatcgatggtcgctcgatagcttctatagctcctgacctcctccacgccgtgcctccacgcttccggggatcgcgcacggttgctactgggttagcgaactactcctgggttggtgacatacgtggcgccctcactgttccggtcatctctcagttcctgttagtctgggacgcggtgcttcctacccagct

SEQ ID NO: 53100 - DNA, 723 bp, Oryza sativa
attttggaaatggcagataagactccaagtttgtctggtaaaaatacattcaaattcttttaggtaatagtgatgaataatgtaattgaacagtctgtccaattactttgttacagtttcatggcgggggtgttccaatattattgtcgatgcgatagacacgaacaccacaacacggggccggctaaggccttgtttagttggggaaaaaatttaggttagttgtcacatcggatatacggacacacatttgaagtattaaacataatctgataacaaaacaaattacagattccgccagaaaaccgcgagattaatttattaagcatgattaacctgtcattagcaaatatttactgtagcaccacattgtcaaatcatggcgtaattaggcttaaaagattcatctcgcaatttcccggcaactgcgtaattggttttttatctatatttaatacttcatatatgtgtttaaatattcgatgtgacaatatgaaaaaatttgtttgggaactaaataggccctaagccaaattggccagatgtgatcgatcgttcaaatgggcaattatgtttgctaggcaaaccatgtggccggaggccatgcatgtagctatagagaagactctggacgaaagacttgtggagttaacggcacgtacggtgccgcacagggttatccttgacacttctgctttctatcactgctgctgctgatgatga

SEQ ID NO: 53101 - DNA, 718 bp, Oryza sativa
actagaaaagaagtcggacaagcagggtgaggaagacaagataaaggagcatcagttggagaagaagcgtgagttgttgctgcttgttgaaatcttggctgcaacactcacttaccaagccggcttgaccccaccgggtggcttctgggaaaatgatgagtttgggcaccgtgcaggcttccctgtcctactagacaagttccctatccgttacaaggcatttttttattgcaatgcagcaagcttcatggcatccgtggctctcatcattctccttctcaaccgaaatctgtacgggccgggcataaagtgctatgcgctctttgtctgcatggtagcgggcatgttcggcctcatcgatgcctatgctgctggaagttcgatgcatctgcgaacctccatcgttgtcttaatattggttacggtagtttttgcagctgtagtctatgtggcaatcatcggtcgtggacaacgtgcaaacataaatcaacatcagtcaaaacaaacacaaaatcaacaaaccaacaaggaagatggcatgatggacacaccaagacaaacacaagatcaacaggaagctgacatgaaaaagaaagccgacatgatggccaagtacttaatgctacaggaatattggctgcgagtgtggcctacctcacgggcctaaaaccacctggtggcctgtggagggatgaaggtaatgggcactctgctggca

SEQ ID NO: 53102 - DNA, 814 bp, Oryza sativa
  unsure (1)..(814): unsure at all n locations
nnnnnnnnnnnnnnnnnnnnnnnnnnnnnnnnnnnnnnnnnnnnnnnnnnnnnnnncaaaaacaccacaaggacccggcctttagctagtcggacgataattgatggtcttgactgagaagtcgtgatcatgcactgccaggcatcggcatcgtgtgtccatcgcttccctgaaacctcgctgtcccgtacgtcgccggcatcgtcgacagcgatgcacctgctcgcgtagtacgtgaatgcgcctgcacctagaccaatcgataattaaactgtacccatccgacgaaagagtacgtactggatctcgtctcgtcgagagatatagctcgatcgatggatcgatcagtcatcagtgcatgcactgcacccaccaagccaacgtattacgtatacttagctgcaggttcagtgaacggcttgcatcgcgtcgatatgatcgaatcggacctagctagtagtagtagtagaagggaccagagagatgtgtataggagtaagggtgtgcatgtgtgtgtttgcgtttcttttttcttttcttttttttggcaataggggaaaatttggactgggaaacttgtactgccaatcatatcaaaatgtcttcaattaatagaaataatagtatttttgggtggttcatataggtataatgattagtaaagggtattaatgaaatgaaactcgaatagaagtagatgagtgcatagaaatggacttattcagagacaaataaacctataagatttaaaaatttattatagaatatatcagcttacatctactttttttatcacaaccaataataatcaatc

SEQ ID NO: 53103 - DNA, 710 bp, Oryza sativa
gatgaagccgagcggatttcaaggcggagcaaactttatgttatgcatgaagccgagttatacaagaaaagcccttcaggaattctgcaacgctgcgtatctttagaggaagggagacaattgttgaaggacatacattctgggatatgcggaaaccatgctgcagcgcgcaccattgttggcaaagcttaccggcagggttttttctggcctactgcagtgtccgacgccgacaaaattgtgcgcacatgtgaaggttgccaattttttgccagacaaattcatctaccagctcaagagttgcagactatcccgctgtcttggccgtttgcagtttgggggctcgacatggtcggcccgtttaaaaaggcagtcggcggttacacgcacctctttgtggccattgacaaattttccaagtggatcgaagctaagcctgttgtcacgatttcagcagataatgctcgcgatttcttcatcaacattgtgcacagattcggagtacccaatcggatcatcaccgataatggcacacaattcaccggcggagttttcaaagacttttgtgaagattttggaatcaagatttgctatgcctcagtagcacacccaatgagcaatggacaggtggagagggccaacggcatgatacttcaagggattaaagctcgagtttttgaccggcttaaaccatatgccggcaaatgggt

SEQ ID NO: 53104 - DNA, 708 bp, Oryza sativa
tatagggcgaattcgagctcggtaccctgagcatctgttgcattataaggagagaagctcagattgttagctggcgttaccttcgacttccttcaaggctgagtccctttgcgcagccagttctgtcttgtctctctccagggcttcaatttgcttcaccatctgttccatcctggcggcttgcgctgtttgaaatccagatggttgaggatgcaattatgacagcacaaatcaatggaacagatctggatgattaccttttgatgaaccacttagttcgaagtttgcatcctggagctgggcgattcggtcccttaactctttctctgtctttttggcgcactccttggcctcatgcagctggtccctaactgcttctagagttcccaaatgaggaaccagcttttccaaagttgtagtcttggcctcattgcgaagatggattctctgcatgatggatcatggttcagttctgctaaaaagaaaacaaagttaccgaaggccgtcactcggaagacttacatttacaatacgagtggcttctccgagcgctttcttcagctggcacacttcttcatcttctttttgacggtttatgactatgccggcagcttgtgagttctcgtcccaccatttgatcaagataggaggacgagagtcgtcggtcgcctttatgcgagggatttcttctccgtcatcacctgatgg

SEQ ID NO: 53105 - DNA, 1528 bp, Oryza sativa
tcattaatcctttcccttctcctctgttaagatggtcagaaacgccgtcagaaaaaatacttcagattcaaacattagacaaattaataacacaattaggtcctaaccttagcatagaggctttgtgtatccttggagcactgcttatggcctcttgaattgtcactttgtttcagcactacagatccatcagttgcagcaattgaatcctctccgacgctgctcccggaggaacagctaggattgacaagttcagagctagtctcatagtcagtaatggttgaactacttgatacctaaaataaaatgaattttagtcattacaacagtttaagcatgaaccaaaattctcatgccaaattgacctaccgagcgagaagttcgggttttcttcttcggcttcttctgctgctgctcaaagtgctcatccatggggaacatcctcttgttcccagtgatgacctgatgctgatgatcagaacacatatccatgccagtgctaaccatcaattgcactgtgccaaatccctcatcatccatcagaggaagaaacagctgctaggcattgtgctagttgtgacacaagaatttacactactgtcaggagaataaaagttgatttcagcatcagtgctgctccagaacatggactttagttgatcaatcatctcagattcctcactccttgcatcagcagagctccagatgtttgcacaccttgcatccatcctattgatctgaaacttccaagctctaatttgtgatcttttgaaaagagttgtaatgtgtgatctcttggaattgtttctgtgagcactgtgcaggtaggggcacaaatttatactatgtttccagagaatcatctgcagatataaatttgactaaggttccatcataatcttatctttatgtacaaatgacaactaagagctagtactttatatcgcaagttccatgacccataccctcaggatcttcaaatgatagaaagattatatggggaatcgattgcccattgagaaatctaaagaggcatgctatatagacttttggttgaggtgagagggaggaaaaagaaaaacaactaacaaggttaattatatgataacattaaatgattcatatgatcggcaattaagtcgcaagatcaatagccgataatacgacacaaaaaaacatcaacaccacttataagaaaataataagagctggccacaaataagaaatttggagggaggtgatcatggagaagaagtgctggcaatgttataaataaaataggacacaactgatatcaaactcagtttggcagcttcacattttctttcttggtgacttaaagaggatagtgaagaacagtatggcatgccataccctttgctataataatgtacataagtaactaatcctagttgtgcaattcagtaattcacattgtgcaagtctatctacatactgaattgaaatgctatgtgaacaaataaggtgaagccatgaatatgatgtcacttaatggttctttattctg

SEQ ID NO: 53106 - DNA, 22592 bp, Oryza sativa
  unsure (1)..(22592): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctggccaggctgcatgcttggtttgggaccggccggactgcatcccttggttggctaggctggttgggccgttgcatacgttgcctggcattgttcttgcattttttttgaacttcctgattttgcttgaatatgttgatgcacttattaccggcttaccgccaaaaacttgttgacacaccaaaactcgtggatacattaaggttagtgccaaaataaatacagcatttatcaatacctcatttattcataagtatttaaggagtacaaaatatcacttttagcattttacgggcgtcaacaatgctccatgtggaactaatctcaccaaaccacaccatgggttacatcactagcaagtagcaactactgggctagaatattacattcaaagtatttgtagttgtgtggggatccttatgtctttctcgagcaattactttgtttctttggccttctccatttttttaatgtgtatgtaactacaatagtctccttaatacacaaaacagagcatgatcgggagaaaaatattggaaagccaactgcaaaaaatcagtgttcttggtgacaacaatacaatcagcgattatccggcatttgatgcagattacaaagtttgtaagtgttgcatatgatattcactaaacatgtttgttagtatgtcccccacatttgtctcacaatgttgctggtcctaaacaattgctgacttctttttcagtgtgggccaaccatggcgatgcaataagcactcagtactctggaactcctgccttgaagggagactttgtgcggtaatttgtgttttcaagtttttgtgaattctcttatttagccccttttcctttgcacaatttggacctactaatttcagaaaaagaagtaatgatttgattgcaaccataagcacgtttaagctgagttgctaatgtttccttatgaagcaaaggttttgtaacttgtaagatcctttaacacctagcctgctaaacattttctctagtttcatgttgtgaatctcctcaatagttaaacctttataatggcaacttttaaactgatttatttcttgctcgctgtgaaaagttatcttctcgtcaccatcagaaaaattacttgttggattatgtttagttgcttacttcccagtatcaggactgagctgacacctaagatgttgacacagttctaatgcatgagagtgcagtattataattaaattactgacaaactacatgatcacataaggtgcaaaataatactatcgttctgccaatggcattgccacatgttttcactttttcctctattaatccgctgtctatgatctatttcttcttttggttgttggatctttagaaacaaataatgattaattagttatttgttgttcttaacctaactatatcttatttatttattaggtacggaaagcgaactacacagggaattttaaatgatctgtggaatgcaatggctagatattacctgaacaactttgcagatggtactaaacaggtatgttgcttacttggtctcaccattgatgggctggagtgagttggattttgctattttaggtttgctattttatccaagacatcatggacgagtgaagaaaagatcccttacgttggtaatgatggatcaaggcatagtgataactcattatttgtttattgtcttgtataggatgccatggatcttcttcaaggacatcacatatcctcagttagtcgggatatgccaactccaaccaaaggacttatagagaatcacgcggttggttattttctttctattacttgagatttttttttacagatgaataatccttaagttgcataccgtgaattgcatttattgttcttactcttggttctgaattctcatgcttaaaaggattgcaatttacaatgaatttctatgcataattttgatgtttccatctacttactaggataagttgacagcggtgatgctatgatccataccaaggttttgaataccagtctttctggaaaaccactatatccattttttttaattcacaaaccatttaccagccgtaaccgaccatgaaccagtttttgatggaaaattttgtattaaaacttatggcatggataatgcgtgcttttttttaatgacttagtatttatcacacttaatgctgcaaaaaatatacagctcataatgttctgaccggaaataccagtaactggtttggagctcctggccggtaaccagcagtgtaattacctgcgaagatttccacccctgatgtattccctcaatttagttctttcgtgttgatagagttacatgggcatttgaatgtcgttatgcatatcttagtggagatatttgttgaatagtcccacattggttgtggaaggacctaagatataagtgggggagcccctcacctcaatggctagcttttggggtgggaaaggccctttacggtcttacaattggtatcagagcctggctaggttaacatctctggcccgatggacacagtatgtgaaggtttgatggaccgtgggtgcctgcggggcccgtatacctaatggaccgtgggcctgttctgtggggtctatacacggtgaaaggctgagggacttaagatataagtgggggagcccctcacctcaatggctagcttttggggtgggaaaggccctttacgatcctacaatatttttccatatttaaattaggatattttagtggagaacttacttgagttttcatttgcagtccttccgccttgcttttgctctgcttttggctgccgtgatattcttgataatgtcactgagaagaggtactatttcatcctaccgaaatggcaatgatttaagttaatttatgcagattagaggcactcaactgttgtaaacttgacgagttgtttgcagccaacatattactatgtggaaacaaatacataaccaagtcactaggccaaattcactccaacaagtttaatttgatccttcttcatgctttgtcatactaacttgattcatttccttgcagcacgtaatgatgttttccatttggtgctgtcactactatggtctggtttttgctttggcatcacgcgttatgtcaaagctaacggacggaagttcacgaaccgtcctcgctttcacctatcgcgccattgatgcgaacaaaagggattatatacacactcatggtcgactcacctttctgggcatgcatgtgtgctctcagttttgtatcaagtttaactttccctctttgtaagattttgcacatgttctgaccatcacggctttatattttcttgttgaatgggaacatcaggaattgatttgttctattgcatttatttatttatttatttatttatataaacgttttgcagaaaatgttgcaaagatgtatatgatgatcaaaattgcaaatggtttagggtttcatatattttgggcatcacggcttctattcaatccacacgtagaaacaagactgcagttgtctagcattgtgtatgttaagggtatatatgagatagtttgtatgaaaagtattaaagtaactttctatcactagtgtatataattgatatgccatttaggattaaactccaggaaaagttaaattcccaatttctcctccctgtatattgatattgtaccggagcaagagcaagggagtaaaatcctaaaaatcctagctagccgccgccggctcaacgtctagcaaccctcagttcagatccagctccaattgtccaccatggctcgttgtcacccacgtccgtccgctgctgcttgccatcccccactgcatgaaatttagtgtatgacgcaagacacaaaaggctcaaaagctaagttactttgaaataaaagataatcataagtttgttcatatccattccttggccataaggcatctcaatttatagtacattcagtatctacccttggttccacacgagagctagcttaaaagcagaggaaaacagagaagcgacaaaatgaaatgtaaacagtggttcctgacaacgagcaagctcccagatgcaaaactaatatgcctcgtctattaccagtcgtccgatcttcataatccgctcctgaattgtttccttatcctcttctcttcaattggcttaagcatcctcagagattcataaattcagaacatattcagtccatttctcatctccagattccgacattaccttcccctcgagacaatccttgtcctcaaggattgaaaggtagaaacatacttcggatcacagtggtatcttcccagggtggttcagccggtgataaatttaccaaagattcaaccattgagtcacagcttctccccttctagcaccatcctcctttgcaatacaacaactggttcagttttgatccagccgtctggtctaacagatagcagattggccattggaactgcatgagctcccaagtgttttttcagttggctgacatgaaaaataggatgtatattggagccctttgaagttggagtctctaagcagcctgtccaatcttcctagtaattgtgaaagggccataaaattttaatctcagcttaagagagcccctgataccaaatgatgtacgcctgtagggctgcaattttaggtaggcaaaatttggtataaaacatttaaaaaaattgcaattagctatgggacatcacaaagacatcaatttgccaaggacactctaaaagtgtggtaattttctgtagtatagtggacgcattaaaatatagtatccaccaatttgatgagagagaaaccatataaaatgacaaatttccctttatcttctcccttctctcggtcttcttctgactctcactcgcagtgagctccaccggcttgcccatggtagatagttgctcagcatggtcatgcaacatgtcgaggccaccgctaccggacgccgaacaccataggcgaccgcggaggcggcgcagctgccggagccacttgcactcgcaccaccgtggtggccgtgccccggccagacgaccacgtgagggatgccagtgccgtcgtgttctccatcaggtaccgcctcgccctcaagcaccgcctcccaccgcagttgacgatgcgacgggtttcctccactggattagggaacacaccttggacaatgctgatggctggctcaccgaggctgctgacttcggccgcgtgttcgtcaccggtgactcggacggcagcaccatagcgcaccacctcaccatgcacgccggcttggcgatgcccaatctcactggcgcctgtggcatgatgtgcaaccgcgccatcgactgcaccgagcggttgttcacaatggacaagccaatggagctcactgcgagtgagcgtcggaagaagactatgagaagggagaagaagataagggcaaaactgccattttatgtgatttatctctcatcagttgggtggatattatatattacaccaaatttgctccaagacactcaaatgcgtaattagctgtgggacaccacaaagaaattttcttgaggacactctaaaaatatcgtaatttgatgcaagacactagactcattaaaatatattaaacccacccaattgaatgggtgtacctatataatgctttgaatagggtcatctcgatagttgtatgatatgtggtatattaccactcagccaacgccgaccataaataccaatgttggggctcttggaaggtcatatttctcatataggactcaaagacattgattcactctttctgtctaacaatttgtttcatggaggtgacctgtattgaatctcgaaaaaaattttggaaatacactctttttttaataatttgtgtttatatatctacattggagagtttagcagaaatatatctaatccgcggttcggaaacacgggaccgcaaagcaagtgcggcgtggacatgcaggaacggcggctgcttcggtgccgcgcagcggaaacgcggaataggcccgatcctgcagagcagaagagcgggaccgtatcgttcccgcggccctatcctgtggcaacgtggcggagagtgggaccgatttgctcccacggaaccgtggtgcgctaccgacgcggttctgcatcccggatatgcggcaccgatctggtcccgtcgtgaggcaccgctccctttcccgcataaccatcatgcgggaccgtgaatcaatctctacgcaattggccggcaggtcgtcggtcccgcggcatagtagtgcgggaacgcaccagcacgagcggcattgcgttctggattagaggtcacaaccgtaaaaaaaagcaacttactttgttgatgtgattaggcttttttttttactcttctgcttccggattaatctccaacaactaataagaaaatattatactggctaatgaacctccgttggtaacttaatttgttgatgtgattaaccctgtttgattcagcttaaaattattataatctggattattatgagtaagccgaaacaaaccagtagattattataatctataagccagattagtataatctaataatctcctatggaggagctttttctagattattgagtggctaaagacccactacccttagatgtctccagtaatctagagaaacaaacaactcgcaacttattctatatcagcttattataatccagcttagagtaatctgatttaataatctggattacaataatcttaagttgaaacaaacagagcctaagcttagtttaatattttgtttccggatttatctccaacaagcaatgaaaaaaaatttgtgagctaattaacgatgccggccaaagcggcgctgctcttccgaggtgcggagcagcgggaccggaaagatggcgcgcattcgggacactgaaccgcgtcggtggcgcaccacggttccgcgggagcgaggctatcccgcacgacgccgctctctaccacgctgccgcaggacagggccgccggagcaatgtggttccgctcttctgctccacgggaccgaggctattccgcgttttcactccgcggcaccgaagcatccgccgttcccgcatgtccatgtcgcgcttgctttgtggtcccgcgtttccaatctgcaaattaggtatatttgtgctaaaccctcccatacaggtatataaacacaaatttttaaaaagaagaatatttttccaaatttttttcgttgaatctcagctgcatattcattgatttgaaatacttcctgaaatatacagctagtgaatatcttgtcaccatcaattatgatacccattggcatcccatgtagtttgtggatgttatatatccatataaagatatccaccacctgctccactgaataatgatgaaacaaggccaaaaagtgagcatacttagtcaatctgttaaccaccaccgatatcacatcctttcctctggattttggtagcctataatgaaattcatggtaatgtgtgaccaagccatgtcaactatatcaaaaggattgaggagtcctggaatatgaacttgtgttcttctttagtcgcttggcatacgatattccctaaccattttgtcagcatccctcttgagaccaggctagtaaaaaaacattttgattctatggcaagtggccctcattccataatggccccaaaggaggagtggtatgcccttagtagttggtttaagatgttttacctgcatatatccttcctttatacttcagcagtccaccttccattttatagttcctatcagtatcgagctcacaccaccattcctacagctcgagtgcgtgctcgtccaaagaggatgtgccgagtgaaggacatgcagaatcttatggccaagtgtcaatgcatgaggatcaaggcttgacgttttgtcccgactccgagctgtacttgtaaaaagatcagttgatgcaggcctacaaccttctcagggatcaagtgttcgctcatacgcgagcatacgacccggagctgcttgctaaaataggtatgaatgttgattctgctactgtgtggaaagcaatatgttgggatgatttcgcgctagtagatgactctggttcacgttttcttaccgtacgatttctctgtatgttgcgatacgtgtgggaaggtattacgttccgattcttcgggacggaatactatctcacacgaaaggatcttagtactcatatgggattcaacataagatgttctgttgatttggagtcagtgactccagatttcaatagaaacaacttctggcaacatattacatgagactttctatgtagaagcgtggatattggatttgttaattagctcggttcgtaagacatcaaagaagaaaaggttctcttcatgtctagtgagtttgatttttctatttggtaacaatgcgtgttatctggccatggattagaacaagtcaaatttaaaacagtagatgtagttgaacatgatttttgaggagtctatgatgtaacaggtagaaagaaattcaatttcacttagcaagacgattgtggtgatataagagagggtggaacactgttgcaggtgcaatcaagaggaagaagttacagggatagcgggagtctcttgttgtggtgatcctggtgaaggcttgtcgggccaactcagcatgagcggtggaagaaccaactcaagttctggcacacggaggttcgagcaaataacaaattcatgttggcgtggcatattcgctaaggaggagtttgttagagttcgcatagtgagagggagcggctgccaacggcgttcgatcgatagttgttataactctaatacgctgtaaatgctggatgggaagaagcactccagggatgtaggcttcggttaaatctcgttaacaaatatcgtacttcaatgcgatcatcgtgtttgaattacctatgacgtttctttcgtgtttggttttcgatagtgatttcggaccagttttataacaaatggaattaatattattgcatcattgaatcctaaagtaaattagaatttaggccatattttattacccaaatttagttttggagcatattcactttggtctgcactagcacgagtcatgtggcaaatgaattacatcttctcattactacactaacatgggatacccttctctatcaactcatcaattttgctatcacatcactcgtcctactacttaattatatgagaatgccctaatacaacgattggaagtttggaaatcaagaactgctcatagggatgctttcacagcaatgggaagctagaatcgagaaaaaaaaaactctttacaggacgtaacgtgaccatatctgtgtttagcatacagcatttgacatgttaattaacttgttgatgtgtcagaaatgctgttgaagtagcagcaaatgcaggattactcccaggaagagatcagtcagtttggtcattctcttctgcacaccaagatcaaattagcttgcacgtgcggcgccgtcttttcccagatatggacaataacctccaaggtgttttatgttcagttagcctaacaggtctgcgaggaaacttctgatctctggtccccatcagatattgcctggacttgtgcagcgtactgcagattccagagaacctcttcgatcgaaggcctggctgaagattcaactgataaacatttgacagtaatggaaatcaccatcgacaaagaatcttgcgaagaggtgctcagcacaaccggatcaagaacttgctcgcgctcttcctgttttgatattgacagaacctgcagatacaggtaaaattttgattgttctggtatgatcagagcatatgagtcatgtagggttttagagagctaaggatcctatcagttgaagttttatcatgccaaattaatccggatattaaaatttgtagttcttactctgcaagcaacattgctcctaatatttgtgcatgtaatgctctttgttgggctaatgcagggaagcagaagtgcttgaaacatacatttcatactcagaacttattagtgtgtggtgtcataattcagcttatgatatcatggattgcagagcacaatgaggacgaaagttatacggtcatacccaaccaacaaaatatctgtattgagttgatagatagcttaatacaacatgaaattagcccagtccagacagcgctcgagctatgtatcaccgtgatattgatcgaagtatcattattataactatcatctggatatttgattaattatctttacgcaaaagacaaaatggaacataccagctcacttagcacagagagatctttcctatgacgttttggccccataagtacttcaagtaaaatacctccaaaagaaagcacatcatcctccaaattttccctaaaaacataaattatattagactttcagcatgtctgatcatttattagttgtatgcaactttgtgtaagaaatactttgctacaagttctgcaggtacttacaattctccaccattgtcttctacacatctctgcccttctcctgctgcctgtaaagtgtaaaccaataggaataagggcattaaaataaagaatggtctataattgagactcctttaaatacaggggaagaggagtaggatcattctatgatatggcaaaccaacctcatgtttgtatatctcctccgtaattatggatagcccatagtcactcagttttgccacaaggtgttcatcaagtaaaatactagaaggctttaaccggttatataaggaaccaggaattattccagtatgtaagaaatgcacagccttagcaatgttcatcagcacttggagcctctcacaccagttcagagtcttctctggactagagcctaccacagcaaaggcattcacgaaccacaagttacaaattcgattgctatcacttcgtacgactttaattcctcattttatttttagttccttaccagaaagatatgaaggaaacgttccactaggtacatattcatagacaaggaaaacccttttcacacttgattcatcaacttcgccatcaatacagtgccccaagaggcaaaccaaatttgggtgacgaagcttcgccagtagatctaatcgaagttttagattccttattgagtatcgttggtgcaatgccaaacatcttatggcaatcagggttccattctctagttttcccttgtacagctgaaaacaaaggaaaggagtaaggaaaatgccacattaaaatagtatgaggaaaaattgtcagaaactatctagcttgcagagctaataaaatggagtaattataatactgttaacaggttaaaagcagtacaattattatctcatgtatacggtaaattcctaactaaatcggagtatcagacagatgttgaagatggcaacagacctttccaattgacccctcgcctaaaaatgccgacctctcaaagctttttgttgcttccttgagctcttccaaagaaaatgctcgatacatgggcattatttgtgtccctaattttacagcttgagatatgtaccctgcaatgaagtgagggagaggagaatttcaataggaggaaatacaattatctcttgtttattattcagggaaataaattttggagttcattccaataccatcatctaccattaggatagtctacatgtatgatgtatctatctgtgactatgacaaacaatcggctggatggatctcaaaacatgggatgcagtgatgcacacatgatccacatctagcacatcattccatatatcataagaaactaggcatttactagcaaaatttcttcagaagaagacttacttgcatttactagcagttcagttgacattcctgatgtcgaattatcttgcatttgcttttgaagtaactgttgttctgctaaaactctctgacagcttcttctgtttgaagccattaatataagagaaagcacaagcacaataaacaccaccccaacaacagtgaccacaagtccaacatccttgtttgatcctctccccttgtgaggttgttgacaatacttagtttcatgctggtgttcagggtcgtcactgaagcaattaccatcaaacttaactaccctgttattgacattaacattaagacagacaggcaggtcacctgtgagttggtttgtagacaaatccacaaagccaagggtactgctgcatgttaaactagtagaaaatgatccactgagcatattcgcagctaggttgagatagctgatgcttggaagagcgaagagcttttcaggaggcttccccacgagaaagttgaatgagagatcgaggtgctgaagtcggttcaactgaccaaactgctcagggatttcgcccttgagtgagtttttgctgagtaggattgttaccaatgctgtaggcagctctgggagctccccatccaactcattgtccctcaagtccagcatctcaagcttattcaagctgcctaattgtggaacctcgccagcgatgctgttgccagcaagagcaagctcactaagcatggtagctttaccaattgatgctggtatgggccccttcaaccggttacgctgcaagcgaagaaccgtgaggttcgagtacaagttgaaccagtccggcatggtaccattgaagaagttcccatccaatgtcaaggtgtgcaactttggcatggctgacagcttcggaggaatcgatccataaaggaaattggagctcaaatcaagcacttgaagagatgacagccggtgaatcttgtcaggaagaggaccccatagccccaaggatactaggataacaacgtgcaaggcaggtaaccttgccaatgtagtaacaaacgaatcgagaacaaaggcttcagagagggtgatattggagacaggatagccactgaactttggtggcttggtgatcctgtcaccgataatcttaagctctgtaatggcgttcccctcgcatgccacggtgaccaccgaagtaggctgggtgtagcaggggtcactgtttgggttattccatacatccagctgccttgggtactccagctgcttccttagctgctgcagcacctcaccctgcgaggactgctcgcttcttgggaataacatcaaacaggttgcgatcatgaaagccgcagtaaaatgccacgccattggaggctcagcttagcgctcacaactgtaagaagtgccaatggttgtgttgtctttctaaattttatcacttcccggacaaaagattcaaaattccagccaagattggagtaccaatgaaggagaaaaacagctgtaggctagccagtggaagaggatccctaagaagatgctcccatcgctctcaaattacagcttcctgcaaaggaaaaagattaaatttacagcccaaatcaatgaagaaactaaggagaagcaagatgtgaatgccacgggactgaatcatacttatttccaaaaaccaaaaaaaaaaaaacaatttggagaccggatgcaagaacatcgcgaacaagttttactccagattgaacagaaaaaacaaggcagtagttgtcatttgttcaaattaaaaaatatggaagctgcagccttaaaaatctgtacggtcccgacatagaaaatgacattctggacagactattgacagaccattaagagcatatgtacagtaaaccgaacagatgaggctcatgagaaaggcatattggtgaacattttgacacaaacaaacggctttatacaaaatcgaggccggaaaaaagaatgctgaagaggcaagaaacaaatccgagctttgaaggaaaaactggaaaggaaatgcagtgaaacttgaaggggaaacgaagtcatagcaagcaaacaactgaactttaagcaattcgaagtttccagctactggaaacagctggaaattggcagaagaacaagaaagagagaatggctaccgctcgggggagagagagaaacaggccaaagaaaatctgaaactgcagaatcttcagttcaaatatctctctcacacacacacatacacagagtacaagaagataacaagaaccaagcaagcagagcatcaatgccatctagagttagaacgaaatacaagaaatttctaaaatcaatacaggctcagagaagcgcgagaggcagcgaactcaccaccatgtccgcatatccacccaaatgcatccaagaacccgcagcccatcagcatgccatcaccgcttcttcttcctcgccacacagccgccaagaattaacgaggggagaggcggagcaggtgagagtagactgtgcagcagcaggagacagcgctccaatgccacatgggatctctcgctcactccacccagcagcaagagcaagagcaagcagcagcagcagcggccctgcacgccattaatggcccctgaacggtggccggtgggcaaagttaagcagctgctaccacggtagtggtactactctccttctactagtacgtcaacagttgcacactattgtcactctgttcagaggccccaatgatttgcttcgtttagaatcagctgctgtcaaattttgaattttaaaaaggaatttatataaatttaattttcaatattgatatttaaatcataacatacatataaaatatttacttataaattatgcgtactattgctaaaagatggagaccagagatcacagtttcctcccccctctctctactggtgattataattagcagtaaaacaaagttattagagcaggtataatagcagactattagtcagctataaatatattttaattagataaaagatgagagagaagagaaatgggctagagatctgtagccagctgcagcacggatttcaaaacacagtgtgtataataggtgggaccatatattaatagtatagtaaacaactattatatcaattagctattagattagctatagataaattgaagccagtaataggctataatattaaacttgctcttaaactaccgtaacagccgcagaacacgagcagacattgcagcagtggggactggggagtagttgggctttggtttttgtcaagaggcacggtagccaaggcaaagcgctagcgatagtagctttaagtttaaccgcggggagagagagcagagcagtgagtgaggccgtggagtagatgggagcaggtttcctttactgccgcgcggttaccatagttatcgggtttatcatagagtacggtaatataaataccataataacctcctgaaatttaaataaatttaaaaaataatttgaatttttgataaattttacacggtaaccctggcctcgacggtttgggaaaccctggatgggagtacttcctccatctatagaaaatcaataatatgataaaatactttctaacacaataaatgtaattgtttaaatgagtctttatctagattggtttctattagacccataaaaggttaataacatgatggaatacttcgtacaataataaatcctaataagtttttatgtagattgaattttttatagaacggagtagaagagagtagaggagatcacaggttgggggttggatcccatgcgggcgggcgagtttgggattttccgcgcggatctgtcctgcttgtcgctcgctatcagatgggctgatggggtggtggtcgcatcatgcatggtccagattttggacaatttggcaatatgagaggaatctaatttatttgtccttgcgttctcttgataaggatgaaaaatattttgtttgttgtttgatttgaaatgcttttagaatgattaatactcctacagtatgttttaaaacttttgaagttttctttttccttttgaactattgcttgcacactcgcgcgtcatgtaagtgggttcgtataatatttacgctaaatttaatggcggaatctggtgaagagtaggcacatgcttttatcgtgagtttgctggcatgtttgtgtagaaatgccatattagtagttgctacgtagtacaatttatagtgttgcatcattttttttctacacctaatctcgtatacagctcctttgaagcacaagattgtaaaaacaaaaaacacaagaataaagtgtcatactcattaaatttctatagaaattaagaacacaagaaagttgaaaacttcgtttaaaagatacacatgacatagcaacaagaaaacataagaacataaggtaggacaaatctaaagcatcaactttatatccacgaatattcatatatacaggtgtttatttcattaaaaacatttatcaatcatgaaataagatctcctgaccaaatgattttttttctctgaggctgaattctaaacagattattttctcacctattttctcgtttatcataagcatatttctcatactgctaaacaatgtatttttaaatgtatttttaaaaatatatgtatatagaagttcattttttaaaaaaggaaaagtctgaattacccctgaactattgggtaagtacgaattaccttctaaacacgaaaactagacaattttcaccgtcaagtattaatactagatgcagaacccttttaactcaatacggagtggttttagctctatatgtggtagttggttttagctctatatgtggtaatctagtcagcactttttttttataaaaatggtgggaccctcatgtcatattctctccctctcaccccctctctcttcacccttccctcctagtctgtccatcggcaggggacgacactacacaacagcagggcggatgagctagagcggcgaaggcagctgggggcgactagcgggggaggcgggtcctcctcagcctccgccggcatgcgcctcctctacgaccgcataacttctcctcggcctccgccggcgcactccggcacatggtgggagacggaggcacactccgacgacagttgtgacgcgtgaagaggatgttgcgggcagtagctctcttagccatcacatgcgcactccggcggaggtcgtcgtctccatactttccgtcgcatctcggtcatcgtcggccacttgcaaaccaagagtcggagggagaaagcaacttgacaaggtggtgacgatggcgatagaggcggaaagctaggagtaggcatccgacttcgccaccttgccggttccatgccactcaacgtcgtcgtcgccgctattgagaactgtcgcacccaaagttggggcagcggatccacccctcctagggccgagggcaccagatctaccaccgccgagacctgccgcacctgaggctgggaacggcagattcgtcccggggctaggaacaatagatccgccgctttgtgagctggttgccgtcgccgagaccaaccgcacctgaggccatcccagagctagctcgacctccgctgcgcccctggtgccgtcgaggcgacgacgaaccaaggccgtggacaatgccacctccattgcagctattgcagagagagagagagcacatgagaggatggcttgagggagagatgacaagtgtgtccatggatttctcttatattttttttactaactggattgccacgttggcgttacgtgtgcaatttcaagttaaaactatccaaaacagtgctcagaggggtttttatctgatattactagttgagagtgaaagatatttagttttcaagtttagggtaattcttagtcacctaataattcagggtaattcaggcttttcccttgaaaaaataaatgttttcagacttataatagtacgtaataatttattagtactctgctgattcgcatggcgctaataagctgagccaaacagctaattcgaacgaaactacggccttttgaacggagaggagaataatccaactcatcttcgagcgttattaaaaagaaaaaagaaaaggagttccagtaggagtgtccgattcgggcatcccgataagctcaagcgaccttgggggaagaaacaagtaccagcttcttttctgctttcaaagacggtgttgtgttgttgatcacgtatgcctcgaatccagtcatctctaaacaaaataactatttaatttatttatattattttatcgagtcaaggtgcttcttccctgttagtctgttgcgtgcgtttttaagggtttgtttgatcgttgttttacttgacttccttcgtcctgaataaggcacatcttaacactatcaatttagatgaggtccatataaattagtagtactatgacatattttatctgatactatattgctactatatatttttatggagagtatcgacagttgataccgcgactacagtatttgatggtttggggatcgttggtaccagggtatgtgcaagattgaggtaaaagagatggagacaaggatttttatacaggttcgagctccttatctgacaggtaatagccctacatcctgttggccgaagtcggtgttgctctttattcatctggatcacacaaatacaatatttgggataacctatctaattgtcgtcgatttggcagctagataaccatctcgtagtcgacgacagggtagtcttccttctgaaatacgaactcatcgagctcagagatggcacttgatccctcttgccggcttccgtaggcacgggatgtggtatgtctaggcttatctctgatgttaatatccggcgacttgtcttggcgtatattggcttatgtattgtgcgtctatggtaggtgtgtcttgtggctttgtggtgtatcccctctcctcctaggggtcttgtatttatacccatagatgccccattatccaagtaaaactagggagataaatatggatacaatccgagtagtccttgtcgtttccatatagaactctatttatacttccttatccggaactccttctatatacgaggtttgtttccgtataagacatggtatgtggtggaccctgccgagtttagtcaactattattaggtatgtggtatccataaccatgacagtaacccccgacttcattgcaaatgaacgagttaaggttctcaatcgaagactttggaacaactattgtcgtgatcgcttgaccgttctcggtgtgatcagaaataaggctagctagattcctcttatcggcctttgtaggcactatattaggtttgtctaggttaatctccgatgtcgaccgagaagatacagagcatgcgactaagtttcttgtcttgctgtaatcgagaatttggattgaagtcaagaaattccatctcggtgggtagaccatcgcttcattccatattccttgtcgagcccaatcaaccgttctcgagtaatcgagtaggcatagaatctacgatagagccttgaaatctgacttgattattttgatgtctaattttcctgaaatcaatactcagaacatttgccatactcgcttagtcaatcccggtgtagaaccgtagagacacggagtcttcgacaatattgaatagaactttcctaaaatcaatactcaaaatagaatattaaatagaaatagccctcgagcgaacactcaagggtaacatgatataatatgtatagaaaaatcgaaaataaattgaatctgcatgtgacgataaaagagtactctcgctagagtcacccttagcaatcggagtttggtaccattcctagcccctagttgtttttatgaaaaagccattttccacagagacaacttaaatcttataacaaaccatgctgaagctgacaaatcctagcccccagctgtgaagttggaaaaatcaatttccgattacacggccttgttaatacgcgtccattgagcactcttacatgaccaggtttgacatggtcgttcggctctcataatccaacaagaccttatctactctgggcgtccctagccaaaattcccttaggtttctcggaggcttgtcagaatagtgtaaagggacgataggaccgacttcgaagacgaggagatataagaaaagaggatcatcggacaaatattgcacatataaacacttacagaagttgatgtagatgatgagacgaccaccacactgggcaaaggccaggtgtatagttgtactcaacaaatcacaaaagtagtgggagaatcgctacaccgttggtcgaagaccagttgtagtcataactcgaccacttgaagtggaggtatgagagatcgctatgacctactggttcgagaaccaggagtaggagtctctcaaccgtttgaaattgaggtgcgaggaccgctacactgctaattgaggaccagttgtaatcgtaactcgacctttggaagacatggtacgaggaccactacgctactggtggaagaccagtcatagtcgcacctcgaccattagaagtcatggtacgaggatcgctacgttgctagtagagaaccagttgtagtagtacctcgaccacttgaagggaatccagagtaatagatggatgacattctcgtgacctgcgagaactgcctcctgatgacgacgaaggcaatgaggaattaccgtagtcggaggttccgttcctggacctactacctcatcctcgagccctctagaagtatggggatctcaagttttgtcgtcgtcgtgtgatgtcgtgatgtcgttaaccttgtccgttgtcgttccgatgtcattagtcctggacgttgtcgtcctggtgacaacggcgatctagtcggtcttggttgtcgctatcacggcaatgttgattgtcgcgttagatgtcgagagattgttgtaaccaactggtcaacaatctactggtcacctgaagatcgctaagatctactggtcgaggaccaggtgtaggcgtatctcgatcacctgaagatgaatttttaggtggtgagagatcactacgatgtactggtcgaggaccaggtgtaggcgtatctcgatcacctgaagatgaaacttctcttgttatccacgacccccctttatcaatatttgccgtactcacttggtcgatcctggtgtaagaccgtagaggcatggagtcttggacaacgatagatggagttcaacggtccacaagtgaatttaaattgataggcgatgagatgtcgctacaactgtctggtcgataactaggattaggcatctcttaatcacctataggggcgctagagttggttattacatgtgcatctcatgtggccagcatgactcacatacccaacttatagcatatccggatgtctgttcgcaatcatgtcggatgatcaagccgacaacgttcgcgggggaattatctgttaacaatattttctcaaatagtctagccgtagccaacgctatatatgagataagtcgtcggtctttgttggtaggttgggtgcgacaactcagcatttttcgagaacgttctcgataatgcggtgtactcgaccacatcgtactcgagtgctcaattgttcctgaaaaatattttctagaagacaatatagtagacaatatcgagtatttactcaaaaaactgcatgaatcttctagagttatagtattatcaggatataacaagcaaattaaatatcgggcattatgtaaaccgtaaacaagcatgatttatacttgaaaaaagtagggcgagccccagtattaaaccgtggttggcttaatattggaaacactcgcacaataaatattgtataaaaaacacggtctaggtaaacataataaattattgatctgataatattgtatatatatctgaaaaataggtacggtaaattgtatataaaatattgcgtatctttgtagatatatgctggatatatctacgaatttagtagattaatttttaaaaaaaatcaatctcactaattaccttgtgtgcacgtgtccgagtagtatagacatgtcttaacgaagcaattttcacatgcactgtgtggatgcatgttggctggtccacgcatgcatgcatgctcttggtttgtatcctcatgtccgtcggcgtactcggtcgatgatagtggatgtcatgtccagcttggactcagcgggccaatgccttgcaccagctagcagcgcgacgtttgatctcggtacgaatcgggccaacgtgtccgaggacaccctgttaggaataagaccgacacatattggatcaatctctcatgtcgtcgatactgttggttttccgctgtgacgaaatcttaaatattggtcgatctcgacggatcgaatat

SEQ ID NO: 53107 - DNA, 3932 bp, Oryza sativa
  unsure (1)..(3932): unsure at all n locations
nnnnnnnnnnnnnnnnnnnnnnnnnnnnnnnnnnnnnnnnnnnnnnnnnnnnnnnnnnnnnnnnaataagaccgacacgtatnggaatcaatctcttcattggtcgtcgatactgttgggtttccgctgtgacgaaatcttaaatattggtcgatctcgacggatcgaatatttgggatggtcccgactctcggagccatactccggtcgggttagatttccctacagccgaagtcgtcgagtaatttgtcattggagaatccatctcttgaacccatgtcgttgaaaccttgaagcaccaaaaattcccctacctggcgcaccgctgtcaacggttggtaccgcgactacgttatttgatggtatggagatcgttggtactagggtatgtgcgagattgaggtaaaagagatagagacaaggatttttatacatgttcgggccccttatctgacaagtaatagccctacatcctgttagccgaagccggtgttgctctttattcatctggatcacacaaatacagtatttgggataacctatctagttgtcgtcgatttggcggctagataaccatctcgtagtcgacgacagggtagtcttcctcctgaagtacgaacacgtcgagatcagagatggcacttgatccctcttgtcggcttccgtaggcaccggatgggatatgtctaggcttatctctgatgttgatatgcgacgacttgtcttggcgtatattggcttgtgtattgtgcgcctatggtgggtgtgtcttgtggctttatgatgtatctcctctcctccttagagggcttgtatttatacccatagatgcctccttgtccaagtaaaactagggagataaatatggatacaatccgagtagtccttatcgtttctatatagaactctatttatcctttcttatccggaactccttatatatacgggatttgttttcgtataagatatcgtatgtggtgggccctgccaagtttagtcaactactattaggtatgtgatatccatgaccatgacagagagtgtattaaacttttataacaaacatatgacatgacataatttatgtggctaaaaaatctttgaccactagtaaactaaaggatcaagatggatatcccgcgtgttgccgcgagaaaattgtgtgataaaatagtatacacaagttgtaagattttctttcttacttactactaccttcgtttcaggttataagactttctagcattgtccatattcatatagatgttcataaatctaggcgcacatatatgtttagattcattaacatacatacatatatatatatatatatatatatgtgtatatatatatatatatatatatatatatatatatatatatatatattatagcgctatgggcgctgcctaactaggtggagcgacacagcgccaccaccctggtgcaacctccctcctcccagtccacagtatgtagttaaaatttaacttacccctgcgcctcctcccccacgcttataatccgagtaaacttttaacttaatgttacccaattttcagcatatatatgtatgttgttttctcaccttgtaaccaatcacatatccgatcctattttttcttactctctccgggtatttcggatctgagcgcgtggctggccatggcagcaattcggtgacggcggtcggtgaccagcacgcgcaccgacgaggttgcccagtggttctgtccgtgctagagggtgacgggcggtgctcgccctctgtgtggcttaggccaccggtcgacgggcggcgggtgaggagacgacgaactactccaacagctcttcaaacgatgagcagccgtctgcagcgtggaggagggcggatcaggaggacgcgctccttgatctgtggtggtggtcctgaagcagggcactggatcaatcgtcagggaggaccttggtgttaggtcgccttcttcttgctcaccgtgcgtaggctgcgttcaagccagaagaggaggaaaatgttgcgccaatggacgtcagccccggtgaccagcttacaggcggactaggccgctgtcgatgaggatggtgaggaggccgatgaaggtgctggtgagctttggctgcgccggatttgcaggccaaactcctccccggtgtgggatccagcgccttgtcctatcccgacaggaacggcgaaggagtaggtgacggggagatggtggacgtcgcgcggcggtgctctaggccacagcggcgtagtctggctggcagatgaacccgagtccaaccccgaccatgctttgtgcggggctaaactggagccctgtcgccttgctcctgcttcgatgccaacagctgctggtggctgggatgggattggagctgctagtctatctgtctcgagtagtcgccgccaactgctgcagcacgtcagcacctcatgccatcaacatctctgctgtgtctcctctcctcccttggatggagatgttattttttcctcctgttgtttctgtagttttttacgcacagaagattttgtgtgattgataatttcatatgcatgattgaatgtaatactccctaattttgattgtatgtgttaatatgtcccgtaaaaatgataatggttctcatatgttaatgcctgaaaaaaattctctttctcttctccatacgaacagattgagtaaaagaattaccaaaatatatgtgataaaaatattactatgaacgccaatgatgtaagaaatatgctggagtaaaaatttcactaaccttggtcttgatgagtattatccagccccgaacttgtgggagtaaaaattttactgccagtctaaagagggtttgatttcgcttcttttactagttattatggggatttgggagtaaaaattttaatatcggtcgaaagagtgtgatcttgatgagtatctgaacttgtggggagtaaaaattttactgcccgtccaaagagggttttactgattattgggatttggggagttaaaattttactgtcggtctaaagagtgtttgatttcgctaaggaatttttttactgattatggagactctaggagtaaaaattttattgcccatagaaagagggtttgattttgttaaggaatttttttactgattatgggaacctgatttctctcaagaatatttttactcaccgtgtgaactgatggagtgagaaaaggggcttgaggagggcacgtggagaccgggtggcagttgtgcaggaaaaaaacggaaaacactcttggtgggaggaaaaatacgaaaaacccagacacagaaagggaggaaggagatacggaaacacaggaggagatcgctcctgtgagaggcgctacgtagtttcctagcgtgctacgtctgtgtgtcgcgctacgtagcatgatcgtgttatatatatatatatatatatatatatatatatatatatatatatatatatatatatatgatatccataggggactttatggtgtccgggctctaaggtataaaaaacacaaattctctcaaatttttaaaaatttacaaattgtaagtagatatctaggtatatgaatttaattcatacaaatacctaacaacaaaacaactcaaactcaacttcatttcacaattcattattacatacataacgaattatatgtttagatgttatatatctagaaccaaaatctaaaaaaaaaagttcaaactcagttcaaacttgtttgaacttgttagtaaagaagttaatattcatatctaaacatttaaaaaaaacatttaaacattcaaattgggtatatacgcaatttgaatcttggagcccatactccatgtagcaccagttaatttacatatatatatatatatatatatatatatatatatatatatatatatatatatatatatatata

SEQ ID NO: 53108 - DNA, 12688 bp, Oryza sativa
ttttctagaaaaagagaagaatgggaaaaaataaagagaagggatggagagaaaaaccgaagaaaaagaaaaaaaagagaaaaaaaagagaagatcgagaggaggggtgggggcgccgggacgggggagggagatcgagaggagtggaaggaggcggggcgcgcgggcgcagaggggagagggagaagcgcacgggaggggagaaggggaggtgggccggatagggtaggatagagggggggtgtagaatagttattttaagggaggggtgtataatagagctactatatatatatataatgtgggtaatgctagaaagtcttataatatgaaacgggggaagtatatactttttcaattatccaaaggttataaataattgagttatatgatttttataaagttttcaggagaagggatgcaatttgcacccttgacaaatgattcaaaagctacaaataattgagatgatgtgacttagagaaatagcactccttacacttaatggggaatacatatagacatataatatgccattacttaagagttggtggtaccttgtaaggctaaataagtatatcattgtgtgtgtggcttagtcttttgctacatttttgcttgtaacttatgtttgacaaatacaattttcaagtcaagaatttcatatatatcttttgaaatccattgcaaggcacgagtactttgctagtcgtaagaaaagtagagaaggacaaattaagcctgctatacattctacaacatatatgcaataagacgttccatacatacagactctctgtaatagtcaatgaattattgggagttgttaatttgaaatttggaagatgtaattaactgttgccacgaaagtgataacgcgtatgtaaccctttcggaagtactactcatatagtagtacatgtgtactgtgatcggtggtagtaaaatgcaatcatgcatccatagaagtccccacgcataggtctgtactggaatgaaatgtatggaggcattcttgttaacttttctttgttgtacgcagtacaattttaaggcctaaccacaccagtgccgtgctagatgcacccataatttcaggcctccgtactaaacaaaaacctggtctcgtatacttacaaatactactctctccagtaaagaatatacaaagtaatagttcttttcaaacttctaaaatttttaactcactggtacacaacccgaccagtctgtgtgatgggagcgtgtagcccatcacgtaagcctcacctttgaccggccgtaataatccccgacacataagcactcatagagtactacaaacaccacataaggaccggcttacaaataaaccggcacctataatcatttaaccaactccgcacgatgaaaatatacagaaccggcacatttaaatattataggtgccgattctagaggaaaaccggtactaataatataggtaccggttttttaaaagaacatgcacatatacttatattagagatgttcgtcgtaaagaaaagaaccggtaccaatactgtaggtaccagatttttaaaagaaccgacctctaaaatatgaacttgggtgtcggctctttgaaaaaaccaacacctattaacaaaactgtccggacgtcagattgattgaccgagcgcactactctttatcttttcgattgccaagcacatgcactactccgcctcctccttttttccctcctccctctctccccaccaccacttcttctctacccggcggcgccaatccgagccgcactgctcctcctctcctccctcaacccccgccaccactcctgcttctcctcctccgcgtcacaccggatccggccgcttggaggtcggggccgccagatccagccaccacgcgcggcagcagcgcccctcctcctttgcgtcacgccggatccggccaccacgtgcagcagcagctcctcctccggccttcttccggcagcagcaccacggcaacagctcctcctctggtcttcctccagcagcagtgcaaaggtaattacacatcccacctcttctcttctacacttcttttcttggtgattgattggattttgaggcctgatttgtgcgcgcagccaaggtctgcatggtggggttctaaatggggttgggaagggcgtggagacgaacaccgccaaggtggaggaggcagtcggcgacgacctccaagggctcctcctaaaggaataaaacgctagctatgaacttgtagcttgaacaaacaaaatgtatatgaatcaaaaggtcacaaacaaggtatctaagcaatatataaggtcaccaaatatatctactaagcatacaagtagatcgggtaaaatcaagctcaagcacaatatgagagaaggcaaaaatggacaaaccaagagaggagacgcgtgatttgtttcctaaagtttggatccacggatcctacgtctccgtcgaggggccacaaaggccgggtctatttcaaccctttcctcttgaggttgcacaaatacactcctcggtttcactcttgttttctttccttgcggagacgaaattgaagccttcacaaactttccgtggcacgccacaaccttgggtgctcatcgacgatgcctagccgtctaggagaccttagtccccaagagtaacaaacacaatcgaagatttgcttgctatgaacttgagtgctcaaagtatgaagtgaatctcagtagctctcaactttttaatctctcaatccaactctttccccttctcaaatcccactcacaaacaggcaccataatggtaggaaaatggggaagaatatctgatattttttttagaattgctgaaaggcacagagtaaaatgaccataactttttactcaggagtccgtttttgatgatctaggactctatggaaagctcactcagaggattaccgaactgttgacaggaaacatggcggcctagaacatctgcttaactctagtgcaggtccaaggctagcctcgagtgtgttaagggcgtgccaactggtttgattcaaccaacaagaaaaacaacaaacagagtaagtcaacagatagccgatcagccgataggccgatgacgtatcgttggcgatcctagccgatatagttagaccaaatcggctatggattgatatataaattaagcacaaaccctaaatatgcctcatcggccgtgatatcatctatttggtttatcaaatctattttagacaatactatagaaataaccgatggaacaatattcagagcaagatagataaataaagataataatactctagtacaaacttatataaacaaatcaatctatagaaatatatcaaatactgataagttaccaagtttgataacccgactgatactgatctagacttgatatatttatatagggtgatctatctatataagtggcaaatatacataaatccagtaaagaagcatgtatattaggtaagatcggctaaaactttgatactatccttaattatgattaattccaagttagtttttagggttcaagacatgactagggatgatgtatcgcaaattatgtaaagaaacttaaaagtataaacaatcaagtaattaaccattttttaggatggtacatgccttagctaatataatctagcaaaacaatttagctgatatcggcgagaaccctaaagggagaactggccaatagggctaaatcgagatactaagactagattaactaagacatataatagcagatggtcatgataaaagggctaaacatctaaagggacataatagccccgatagtacaagtcatcgaatcaagttacctcttgtcgagagaactcgccgaagagaagaacaaaagggtggtgatgcgccgaagttgtattggattttgtcgtccttttttttacaactagtaattgtgcacgtgcaatgcacgtagtttaacagcatttgtcgcaataaatatatcaacacttcaaattttaagaataatatcagcaataatgatatggcctatttttataggtccctgttacacacttgccatgaaaatagtgcaacgttagagaaaattgcttgacgaacacttgaaaagctggaataaaaaagatttgtctttcagtgggattgaaggtaactccactgtcgaacaaaaagaaaagaaaagcataagcataagctatctaaaagtaaaaggctgaaaaataaacttcgatgaaaaacccccaaaatctacttcaaatttaaggttgaaaattcaaattttggctaataagcataagcctaagcaaaaagacctttgaacaatcacgcaccttttgcgccactggacatgttatatatacataacaaaaccttatttatgataaactagttcaagtatgaactaaattaatatttcaacttcagtagacagtgagttaccttagaacatatgcttgtcttgagggctattataacataataagtaccgtaagtatgaactaaattattttttcaactttagtagacagtgagttaccttaggatatatgcttgtcttgagggctattatagctgaataagtacaatgaactgcaaaaatactaaaagttttctcaaaaccaacaactgcaaccattgcaccatgtagcccattctctaaagaaaggagagatagcagtgaataactaacctacaactacaatggccataaaacatcatcaagtacaaactttaccgagatgtagaaatggtataataattcaacttgtctccccaggcactctgacatattgtctaaattgtgcatgttgctccatagatagcagagggaggcccatatcttctcccataattcctgaaagtgcatacctaaagacatttgtttctttaatgctgaagcacatgtattcataggaagaagtcacaacaattgagatatcagcttcattaacaaaattttttgatacaacaattgtccaaattgagatacaaagaagtacttgcaatacacaacatcaggtcaggaggcccttatcctaattggcttcctcgtaattcctgaagcccttttgtggatgccatggtatattcaaatttaaagcacccatggaacttgctgcatatttcacccaagaatccgcatggccacatcaagccccaattgcattttcagatacaaaatacctgtcagtccataggggcagaactataaaggaaaagataatttgtaaatttgcaaagtagaacgtgatgccatgaagattccatcaaccatgtaattaacatacttataggaaatcaacctccaacatgtatacatgaaatgaaacttgtatcctgctgcatctccttcagtggagctgacaccaccgaccagtggagcaagagaggatggatctaaaaactatatattgtttccattagcagactaacaaacaaaagcttatctccaatcaaataataaattgtagaatatattccttactttcaatagtaagagaaaaaacagaaatgcactgacactgcttttgtgatttgccacctaaacactgcttattcaatatttagaaccaaactgacatatcaaaggtctctaccggttcagaactgcatatcaaaatgatatatccacccagtacatgatcaaaattgaagcaggtgagccacaaatggggtctggatagagctcagagatggtagttcgtcccgggttgccatcaccagtttggcctccatctccgattctctgatccatccctgcctcagttgtttgggcatgagacaagcacagtctgccccagggaggctggaggcatgggcggggtggaaatgatctcgaagactgcgagatggagtggagagccggtcgtgggttaggagggttttgtccatcagggacagcacgacacgcgtgggcacggctggagggcaaccccaagcaaagtgtgatggaggcggagcagccacgcctgcgggagagcggaccattcccaacaaagaagcatctaacatcaatttagatcacaaacataaatcaattatctatatataagatttgcaaaccataaattcacaattaattcaatacgtatattttctaagacacagcaacataagtcatccatgaatcacatatttgcttgctgaactaaatgaagaaatagtacatgaacaagatcaagggaaaaggcctactcgcacttactcctcggtggtggccggttcagcctgatcaggtgcctccttccccgctgcttcttcttctcctcctgcttgcgctgcttcttctactgcttctgcacccatgggaatggcggttgtcttggaggtcgggtgtcggcggagtgggcgcaagtgttggatagtataggaggagagaggatactgcgaatattggacacattatattgagcctcgggggccggtatatataggagtacatggggaggagataaggaaggattacagatatggaagtagtccacataaatcaatcctatcctaatatgactctaactaccatatactctaacagcaagcaccggcagccaaggggacgcgcaagcggggccgctggagtcgcgcggtagtcggtgacctagggtgcacgtctagcggtggtctagtcacggccatgaaaggagaggggtggagggcagcggcttgatgtccgcaggcatcggtagcaacttggggtggacaataacgatgatggtggcagtgggtgcactgatcttggtgacggcgagtgagtggctggcaacagtgccaatctaagcgagggcgaacaacgcccccactctctcgtcgcccacgggagcacagtcggggtcaggtgggaaggaggaagtgatgttgaggccgtgcttgcgggagcagggactggtcttcgctcacggcggatctccgtcgcgccgcctcaaaccccaccgtcaggcagatctccggcgaggctgtgtgcagttgtggtgaaggagatgaccagcaagtcaagtggaggaagagattgagcgattttgtggatggcgaatcatgtctaggctgagcgattttgtggagggagagctaaggagaggaggacgctatcggcggcatgatgaccgatgaggggaaaactacgatgcggtgacgaaaggagtggggtgaggaatttgctacgctaggttagcgcgtggaggaatttatggtggtggggacgaggatttggtgcattcgcatgtgggcctagtttcctctaatgatttcaccataggattggataggcacaactcctcctttttatattagtatagatgatctggggtttatatttatacctcaagtacaaacttagtccattataaacatgactcaaactttcctaaagataaaatacaaacaagaccatacggaggtctcttaccatatctctaacaaaaaccaacataaatatcctaattaatagatataattgccttaatcgagctctatgtctaattggcaatggcggttatctcaatctaggctcataccgagccgaagccatatcatataggccacttgccatatcggctaaatcaagcttcattccagctgacacgatgtccagccgatgcgcagtccgacttcaaatctaactcgatcttgcatcaaatccgcttcgatctgcttcctttttctctgagtttggtgtaaaattccattgttagcaccaacttaaccaaaaacaaagtctaaaactactcaaaggataggttaaagcttgggtttctcctatggtagcactatgataggtcactctgagcaccgagacatacgcaaacatatcgacgttgcatccctcttaatagtacagcattcctatactcaaatgtaaataggaagagaattataccaataggaatgccttctttccatcttttctttgtcttaaggaatgccaacgtcgaaaccgtttcaccatatattcttgaaatgattgatgtggttacttgtagcttcaaatggctccgcatggtccatcatgacaaagtcgtcactcgtccttcaccattggatttggttcttcagcaccaagccccttgcttgcccttcaccaccacatggtccatcgcggcctagcattgcttgcccttcactgtcttgccatagtagccactttgtattccacatctacaatatattcattctgccatccttgatatctttaggtgtaataatatcacttgagcatcaacacctttgcaatccttgggacctatttctctcattcaacacaataaaattattagcctcaataatctggttgtcaacctttacttgttgaccaaccaatcgcatgtataaaaagatatgaataaatgataagtattaatcaacagtacaagtgtcatatactcaaatatatgcttaaatgttaagatcccaattaaatgaaagtgaacaacttgcatcaattacatgcataaataaggtataggatttgctccccctaaatgcatgcatacaaaatatttgtgtgaagcaagagtatgcataaaatgaatgaaacattaggaacttatcctatacaagaatagaaggcatttatcaaatataggcattaaaataaatgtataccttcatcatcttcatgttcttaatgtaaagagactaaacaaaagaaaaggctcaaacaaaacattagtctcacatgtatattgttattcacgtggaaatattatatatgaacatgtcaatatgtacatggtgagaaatagtgatatatatagattgatctccatgcattttatcattgtgatttaggtccaccatcaatgaatgtttctatctcaactaatatgaagttcaggaatcacctctcacacactacactttcatatccacatgagactaggcaaagaaatggttataaaaacattagtctcacataattggatttataattaattaccaaaaccaaattaatggtacttgaactttcatgatcgacatagcaaagagtataaaagtggcatttcaaattttataaacatagcgaggaaggagaggaaaagaaggaacaatgattatataacttgtccatgtgttgattgtaaaaatgaaaagatgtttaccagaagagtagatatacactctcatttgatatatcgaggattcatgaagggctatacatgttggacaaagcatggagaaaatgaatcaatcgatattatagatgaagggagtggtagataaaattaggaagaaaatgaagttgacatgtttgtttcttatccgttgggcagtgaaatggttgatgtcaatcacaatcttctgcaagcaatgttgcatgatgttgaggagacaacttacaatgcaagattgcaagcaatgttgcatgatgttgaggagacaacttacaatgcaagataccatgagttcaccaggttggttagtgattcagagacacctctatacgatggatgcaaggcaaaacatacaaagttagttgctaccctagatctaatgaagctaaaagcatgtcgtggatggacaaacaagagttttacagaactgttggatatattgaaggatctgcttctagaagagagaacacacagcccaaagcgacacatgaagcaaacattttttgtgtggggttagtggttcgtagaattcatgattgtccaaatgactgcatattgtactaaaaggaatacaccgacttagagtcttgtcctgtgtgtaaggcttcttgatacaaaccaaagagaaattgtgacgaaggttgtgtagtacttgcctatcatcttaggagaatctttgccaatccctaggcaacagagttattacgttggcatgtgttaacaacggaattttgcatcagattcgaagaaggaagaagatcgaagcagatttagtgtggaatctagttgaatttggagtcggactgcgtatcggctggataccatatcagctggaaataaagtgtgagttgatcaaggttgatggagccgatggccgatacagccgatatggtatgacttgggctcgcatgggcctgtattgggataatcgtcattgccaattagagatagagctcaggtaaggcaattgtatctattaaatagtttggttacgtcggtttgtgttagatttggcaagagaccgtcatatatggtcttgtttgtatcttatatttagaaaggtttgagtcgtgtccataatggactaagtctgtattcggggtataaatatgaatcccttagcattgtaatacgagggacaatccaatacaacttcggcgcatcgcgaccctttcgtttttacttttcgacgagttcgcttcgcaagaggtaactcatctcgatggcctatgctattggggctattatgtcgttttagatatcttagtccttgtatcatgaccatcgatatcatatgtctatgttaatctagttttaacaaatcgatttagctctatcggctgcttctcgctttagggtttctgccgttatcggctaaatcgtcttgctagattagattagcttagacatataccaccttgaaaatcaatcaacggcttgattgtctagacattgtgtttcttttcatacttagtgttgcattagtacattcgacctactaagtcgtgttgatctctaccctgcttcttgatttctaacagggataacatcagggtttcagccgctcttacctaatatacatgcttctttatctgtttcatgtatatttgccatctatatagacagatcactttatagtaatatatcaagtagaggtcatatcggctgggctatcaacattgactattgacctctatttggtatattactatagattgatttgcctatatagatctgtactagagtattagccagtatattatctttcttacactaaatattgttacatcggctattttaataatattatcttaagcttctttatcaatcttgatagacaatgttacaaccaatgaggcatatttagggtttaatattctttaatatatccagtctatagccgatttggtctaactccatcggtagagaccaccaacgatacgctatcggccgatcggctatcggctgactaactctgcttttctctttcttgctgattgcaggatcaaatcagttggcacgcccttgatacacttgaggctagccttggacttgcactggagttaagaaaatcccctaggccgccgtgttttcacatgaacagcatgccacggatcgaagggttaatggtatgcttaagaaccctgcagattcattttaatggagaaatattaataaaaaataccttaaatttgttgctgaccagagagaatgtaacaccccagaaaaccacataagcctgggatgccactaaacaaccacacataagtgccaaaacaagcaaatttcggcaacaactatcttagacaagaaaacatcgcggaagcatcaacatatagattaaggttatgatacaacaattgactgacatgtagggataggcttgaaaaagtggctaatcaatggtcaacaactctagtatttaattaacccattatgtctaaacacaagtattcttatcaagatattacaataatcatgactaagtgagatcatgtcgtgcgactgtgtagctaatcctatcccttcatgcaaacatgtcacagcaagtacctgaaaagactataagggggtgagaataaatctcagcaagcaaatggctttaacaagctatttaaaccacatgtttattatataactaatttaaataccaagttatgattcacataaagacaagttcaaaatccaaggaactaaaacatcatagcgtcaccaatcaaatccatatactcacaaatcctagagaagaaaacacttctcaaagacatcttcgatcaataattttcataacgtcctgcaatatgtgcatatacaatgcaatgatatgtactcctgccttcacacccaacaaggtgtgaagctgcatcgtattacggcaatatacgatgctgtaccggtacggtcgcaaccataggttcacgacataacttcaaatgcaatgcaagtgatgcaaatgcagtatgaattccagagtataacatcggaaccacattccttcgatggagatcagtataaggttattataaccaagagcataaagtataaccataaacagtgtaaaatcaataagtatgattcagataggtaaatcctcggtgtaatatataataatcttggttgatgatatataatttcaacgtggaggtagaatcaaataacaagtcaaggctgtagcaaaccaccgctacgtttacttgccttcaccgatgatgagatgaactctagttgcattccgaagtggcatcacctaaataaacaccggctcagactcaaacaacatgcataatcattcaagaatcacacatacgcttcctacgctgggatcccaccccaaacaacataaagcaaatcactgataatcttcctataaaagcagcatagattaacaattcgatacctccaattctacatcacataacacagaaaaatatgtcatttctgacatctacagaacaagaattacaactttcatttagataacaaaattgaattcttccatttagctggcctaaaacatggcacaaaacagagaagtgcatctgcccagaaaactgtgcaacaaccattcaagagagca

SEQ ID NO: 53109 - DNA, 11138 bp, Oryza sativa
  unsure (1)..(11138): unsure at all n locations
nnnnnnnnnnnnnnnnnnnnnnnnnnnnnnnnnnnnnnnnnnnnnnnnnnnnnnnnnnnnnntccgtttacttgccttcaccgatgatgagatgaactctagttgcattccgaagtggcatcacctaaataaacaccggctcagactcaaacaacatgcataatcattcaagaatcacacatacgcttcctacgctgggatcccaccccaaacaacataaagcaaatcactgataatcttcctataaaagcagcatagattaacaattcgatacctccaattctacatcacataacacagaaaaatatgtcatttctgacatctacagaacaagaattacaactttcatttagataacaaaattgaattcttccatttagctggcctaaaacatggcacaaaacagagaagtgcatctgcccagaaaactgtgcaacaaccattcaagagagcactgacaacaaactacaagataaaagctaacaatttttatgtaggaggtagatcacaacatatgctacaacttctgtaaaaacaagattctctgattccatcattaagatcctctaaaatccctctgaacctcgactacagaaaaaatgcatcgatattcagacagtcaacttcagaaattgatatctcctaaaccacttgatataaactcatgccatttggtcagaagatagatctacacgttatctacaacttttgtatagagacgtttcgcaggaaatcccattatgatggccgaaaaggcatccaaaccagaactgtgcaggggacagatcagcaaaaacctggctgaggaataaatcggttgatcccaaacttactcgcttccaacacttgatctaaaccctaatagaaaaccaaaacagggggaaaagatcatgtattagatacctaggcctccatgggcagcggcaaccaaaacccctcatttccttcttcacctcaattccctccgcttccttctttccctttcttcttcttcccttcttcccaggtctgcagtagggcaggcatgggggaggtcgactagagggggaggtgggcgcccccagggtaccaaatgacggctagggggaggtgggggggacctcctagggttttgggatgtggaggggacagctaggccttgggctggccaaaagctaccccagctagcatatacctattgtttttcttctaatttcaaacaccaaaaccttacggacttccaatatatcctctacagtattctattttttctagggcattacattctcccctcctttaaggaattcgtccccgaattctaccttcaaaacaaaacagtccaaagagatagacaccttaagcatcacacacacttacctctaggtgatgaaagggaaaaaaaatcccatcaaggaaaaaaaacacttgctacttatgccaatgattcacatataaagaaatacattagagaaattctttagaaagagacacatttagaaaccgaagttatgccttaggcacaatcaacttcgaggtcctgctctgtcccatttggttgatgctcgatcccaaactctagttctcctaaacttcaataaggttgtatgaagctctagctcccactcccttcgacaactaattctattttaggaaggtcaaacttttctcgtacccacacccataaccatcaaagccccacaaaacactccactttctattacaattgaacttcttgggtcccttgtcaaaactatttttcttactaccaaaagaacattgctaggccatccaacctccttcccacttcccaaaagaggcaaagaccagagaaaactatatggctcttctaaaataagacatagccaaacatggggcattatccctttgtacactcatgcatgcatgtactgctggaataaacacctattgtgacaccgaaactacacgaaaatatttcgtttggctgatgcaacaaaacctaaggcaaaacatgctcaaacacacaacatattgcaacatcacaagctaacattttactcaaaggtgaacattcatatgagaaacaccattagccacctaggtagaataaccgtgacgttttttctaccataggattcactcaaaggactaaaccaataggctcgacaaccaatacacaaacaatcacacacacaaacaagacaccatgggccacaacttgaggtctgcataatcaacaaacacaatggagagctagatcgagaaaaatactatttttaaaacttgatggcatgctagagaggacaactagccaagcaatcacaagaaaccctactatgaacccaccgactacgtcgatttaacacaacttcaagagcgtatcaaacacttaaccaggataacaaataaccaatgtagataaaaacatgcctttgggccacacaaacattccacatgttcacaaaagtaacagagcgtctcaacatccaaggaaagctttcagcaaccaaaaacaatgtggaaaaagcaacaatccaacttagacactaggtcccaaagcaacatgccaaaaatgtccccaacaacaaagatgcatccagccatggggacctcacaagattctacataggttctatgccatcataactcactagtggcgataatattggcccaatccttttgggaaaaaaaaacctgttctatactaagattttctagggtcatggtgaaagttaacgccccaacctatgtggagaaacacacaataatccaccctttctttgcatcgagagatgcacaacattgtggccaattgatctatcacacactatttgcttcaaataaggacacttgagtcatcaacctaacacttgggcagcgtcactcagcaatgaagaaaaaaaaattgtgacagcccttcatttagcccatctgcatcactagtcggtgctcactctagaggctcctaacttttgtcatcctaaggaccacattaggatctaaaatatatctaaaacaaaaccactccaatacagataaaaagaacatgatggtgcatcaaacatcaaaccatacagcagaacaccacatatgagcaattgtgtataatgaaaaaataataatcaaaccactaggatagaacccatttaaacaataataacaacatcaaacaaggcattcgtgaatatagcatgaagaaatatgaatgtacaagtgagatgtactctacttgagctctacgttttgtgtgttgaagtgtgtataagctcctccttttatagtgagtaatgacagttgttgacagttggaaatatcggtaacaccccttaaacatcattagggagtaatctgggacattcacgtggaaggccaggatgggaggcgccagaggcggtttggccgaaccctgggctccacctcctggcctctcctttggctaggagactgactggtgggccgttatggcggttaggcctatagtatggctggacgaattcgagggcgaattcgattgaaggggggaagaatgtaatgccccgggttttgaattaatatatttcggggaatattagagcgaacgtgcaaaagtttaacttttaaactattgtttgaataggcgatcaggaaccgtggatgcgtagagctcgtcgagtagggcgaaatagactataagtttgtggtaatcggagtcccgagttatttccggttatcgatttaatgtgggctgtttgatcttcattagcctctccctttttaaccaatagaaggggaaaaaaaagaaggcatcgctagcagctagccctagccgccgacgtccgcctcttcacctcggcgccgccgccgctgtgcgtacgacgccggttaccacagccatcgtctccttggtgagttgctgctgtcgatctgatttttgtctcgtgttgctgctgctgccgctaggattgctgcatgtgctgctgcggctgctgccgatctgccgttgctgctgcttgtgcgttgctgctgctactgctgctattggctgctactgcttgttgctgcagaagaacaggaaggaggaagagaagggaaaaaaagttagaagaagggaaatttggggagtttggtggatatttccaaattctttgtttttcttacaaaattagtacttctaggtaatccgttttattccctagttgtttctaatttatatataagacgttccgtttctggtagcttgaatttatttttatagaacgctaggctgaaaccgtattttcaattctggtattaaaccatcgggattcaggttagttgtcctaaataaagtttgtagttatcgtcgatatctttctaacactgctagtttcgttcgattctgataaacagtttgggagaaacaacaaaaacagtactgctgaccgggtccggaaatcaggacagcaattcgttttccttaatctgggattttcataggcataatctgattttgtgcccaacatgaaagttgtagacaattttgtatagatgtccgaagttgtattatttgctagattctggtagacggtttgcaagttacgtataaaacagtaatggaaccgctataggttatttaatacaaatcggtaaaaagtttatatgttctaggttatcgattttagtaattatcccttgtaactatcattggttggatatagtggtttatgcatagttttgctccaccggtgtggagggttccaacgttggagttgagtcggagtatcgaagaagttaaggcaagtacaagatggacttgtgtgatggataaactgtattgctttgttggtttcatttacccaattattattcgaagcttcctattatcaattgtgtggttttggtattatgctacatattcatatttcacttcatgttcaagttcacaacgttattcatgtttcattcttctggaagtttttgtttacattattcaagtaccatgtgtagtcatgggagtgcaatttggatctttattcataatccttgagaagcgctgatcacgcttgctcggcttatcggtaatgctaagaggatattcacatctgcccgggagggaactactactttttgcctccttcgttttaaattaaagaaagtcaaatgtttcatattggtttcttattgcattaaacctatgtatgttttactagttcaatattgtacttgcttagtattctttactcattcttgtatttaatttggtttttaggtacctaatggtattgatcggcatgggacgggagtagcacccttgaactacacactattattgcacactattgaaatttagttttagactatgtttttgcttagcataagttttccgtagaacttgtaactgtcatttaaagttatggtccttactttcacgtagaatttgtggagctaggatggtttggattgcgtggattatattgttattgagttatcttataattgcctgtcgtggatatccgtatttttaggggagactctgccgaaatttctaataatttttggagttagtggtttttgagtgtattttggtgtggcattctaggtacgtggctacctggggtgttacagtttggccccattttaagtatgtttcaactgacttgtgggctctctactcgcgcatgattggtcggaggcttattttcgttgcatgtcgggtgtattttctcctttagtgacctacatatatatatttaccaaaacaatgcaagtggttagaggtaaactcctacttctaagttttggtagtatatttgatatcttttatgcatgagtttacggttaaagtttgcacttaacgaccatcaacagtatgcggaagaaaaagtatatattctagtgactaccatacttgaaggacattgagttccgtcattgcattgatctaatgcacgtagaaaagaatgtgagtaagagtttgatcgggctactgctgaatattcctagaaagacaaaaggacggattaaacatgtgtctagatttacaggagataaatattcgaagtgaattcgcaccagcaactaatccggacacaggaagagtgtacctcccttcaacttgccacaccttatcgaagaatgagaaaatccaaatgttatcctgcttgaaagatataaaagttctttcggtctattcagcatggatctgaaatgccatagttgttttagatcgtgggaatgacaatcatgggattgttttataccgtcaaacaagatgacaagagtacagtacaaaacagcgaggtccatatagatgcttttattgatcaacttgggtctagctcatactacagtcgtatagagcaaacctgggaactgaacagtaccaaattcaaagtactgttgtttcgttgccattgggtcaatttacgcactggagtaaaagtagataaggaaggtttcacaactatagatctaagcaaggttggatacatggatgaaccatttgtacttgcaaaataggttatgaaaattttctacatacattacccgacaaacaagaagttgcacgtcgttagggatggcagaagaattgttagggttgacaatgtcgtcgatgaggacgattagaaccaaaaccttcatgtcagtctgcacatagacctagacaatggcaccgaagaggaggtggtgcatgtatgttgagatcatgccgaaggcctatccttataatagaaacattgtatgccatcatcagtttctactattgccatgtaatctggagtttcaataaaacattttgttcatcttagtcatctcatcttcggcgtaccttattaaatatgtgacatctctaagttagaaaagaaaaataagtcaacagtggtctatcctcaaggaaccaaaaggaaccaaaaaaactaacatgttacttttttaaaaaaaataaaaagtcatctatgacgagcttttagtaataaccatttgagatgacatctctaatgggcctttatgaatagccatcacggatgccatctgcaacaatgcttctttccaatccgtcaaggatgactctccatgacggtgtccctttctagcctatcactgatagctatcatctgtggcgacgttaattatattgccctttacgggtatgggttgaccaaatcggtgtaaattaaagatgagggtgagttcgcctccccacagcgctccggaccttttcggggcgacgtgctcgcttccgctgatatccacgtcatcccgctccctccgcacgcgcaaggctggtgcggctatgggcccggttcctgccgtttcccgcgctcggggagcgcctcttcccgcacggccgcgcctccggcgcttgtgatgaagctgctgcgggcttgggtatctctaaatgggctgttagggtggggcccaaccaagggacagcaagctagcaggttcgccgtttcactgctcgctcgttcattagacccgtcgggcgttttccgccgtccattgcgctctgcgttccaaaaaccctagccgcaccgaagccgcctcctcctcctcctcagngacgcngccagccgtctttcgccctcctccccacanactcctttgcgcgtcctctttcgcccaggcgctgctacgatcgttcgatgccgtggtgaaccgcctctaggctgcgcttgacgccacggacgccgcggcggcgtccctgttgagggaccacacggcgctcgacgacggcaacaccggctcggggcgaggctagatcgcgcccacgcgtcgaaccttgtgtgggcggcgacgacgccctcggcccactcctttccgatggcgtcttcgactccgtcctctggcacgcgctccgcatcgctccaccggcttcacccgctcactcgccggcctcctctgatgcgctgggtgggatcttgttgctacggcggagattgactaccctgatgtagactactccaggcctaagccactgccggtacgcactcctctccctggtttgcgtatccaggtttgatggcttcgattcataataataatttggtggttcaactgatacgagcacactggaaggaatcgatgttgcaacctggaggaacgagtcactgcagtgattaatcgagcacttagatgcagacccaattgaccttattttgcgaccggaagtacaagtagctcattcatcctgctggtattgaagtctatttgtgacagcgctgtggtgcagctatctgcatgctttgcctcctccttacaatatgatctcccttgaatccatcgctcgggcctcaggccatggttgcagccgctgcccaaccgtgctgccccgaactgctcacacctcaatgtatacaacaggcactgattgctcaacgagcaggacaatgccacaccgagtcacaatcacagacatgtgagttctttccctttatttctgtatcattacaaggagtactgatttttttgttaactaaagattgttgtatttatgacggtataagatgtaatccctgacaatgtgatatatgccttgtgctgttctgtaaaaagagagattattttcattccttcttgtttgtgtgtatgttttgttttttccctcagcatcaaggtagattccctagcaattacatactgaatttgtttgtgacagtacccgaggttctagatttggtttggtttggaattagctatgcctcacgccgaactattggataagatgtctttgacgtgacatttgcatcttagcattttttttatttgagaaaatgtgaaatatgtcgatttgtatgttctttgtgtttcctgacatactgattttgtttatgacgattattaaaatacatctctaccataaagggttctacactggtaaaaggaccatatgtttagacgctcactgtaaatgacttattgttacaacgagagcagacatgcaagctttagggactgtccatttattgtatctcatggttgctagcagctatatcctcctccatgttcacatcccattgagactgtcccatgtcagctaaaatagtggcataaaatcctcttgccatgaaccgaaacacctacaattctaaatagtgaggtgctgatgtgctatagaatttcttctaactgatttatgtgttgttattgcagattgtccttatccaagcacatgctgaaaaatctaaagtcaaagtaagaattcatttaaatctccagagactcatttcagtggattatctactgtggtaactcccgtagtcacaggcaactcatttagctaaatgtgttgtaatttatataaaattcttactttaaaactgtctcaggtgatagacgatgatcaaagggatgcagttctgctgactatgaagattgattctaaagaggaaatggaaaggaatatttttgccttatatgtgctcctaaaacttatttcaatttgtttgattttcatgtaggtatttttgttggtttagctacacatggtgctcactgatatactattttcgatgccatgatattgttacatgtttcgtttcctatatacttattgtacttattgtagtgccaagaaagccgaccatcaaaagctttcaatgggtacaagccaaccattgatttcgaggtaactgaccatggactttcaatgggtacaaggaaccattgattctaagggaactgaccgtgaacttgttaaaggaggataaaggtaaactgcaatacaacgccatttaaataaacataatagattctcattgcctcgattattttcgatatgtgttactccctccatcccaatatattacaacctaggatgggattagacccattctaggactacgaatctggacaatggcttcctatgtaccatgctatgctatctaactactgctttggagcatcacttaatgtattaatcgctacactacttatgataagctttgcaaatgtgctagattagttacatatctctatgcgtaatgatttgttctgttcgtttgaactgttcatagcatagtgataatgtgcttttcctatcattctattgctttatatttcaatgcttacttcatatgactaaataataacacctttactcatgatagggcgctgcaaagcgcgcctaatggtctagttaagatcacggtctagggtttaaattcactgtacactcttcactcttcaaccagttcagatctactatgggtgtcctttgctcccttgtcggcctccatcgagccccgttgaggccaccgtcctctccactgctagcctcctccaagcactgacgaggctgccgtcctctccaccgccggcctccatcgagccccaacgaagcttgttatacatgctatatgtagtacaatcttcgatgcttgtgtatatgtttgtattgctaagtacattatttcttgcaaattgtaactcggtgataggtttgatggttaactcttcaagatgcatcgatggttttgtgtaagttctctgaattttttgacaaattttaaattactacaacaatgtgaaatggatgtgaatggaaatgtaactgtgaaatggatgtgaatggaaacgtgattgtaaaatgcatatgaatgtatttatgtatatgttgttgtgaaatgtatgggatctgggattatggggatgctgggaatcatcaatcaataactcccctaaccccaccgtttttctccgatttttgaattatttttgggctatctcgttactttacacgtcgttcctcctcctcccggctcctcgcgcgtgcctgcgtgactgctcgtaagcggtcaccggtccaacgttttttttggcgctgtggggcgtgtgcacgcgccggtcttgacggcgggttagagccggttgcattagtaggctattttgcaaaaaagtcctcgtgtttgcacggaatatcatatatgccttacgtcccattgtattttttaatgtataatctctcgtattccaggaaaatacaatacgaacgaagaagagaaaattccccttctaggggtaacgctgtaaacatgaaaactatagggggttttccgcaaaacgtcctagactaacaccccaatcctgaaaccctcccctcattctctccctctcctctcctcccctccccttctctcccatctctcctctctcagctcagattccggctcgagctgccatggcggcggcagttactggcggtggcggcggcggcttcaggc

SEQ ID NO: 53110 - DNA, 5163 bp, Oryza sativa
aggctcgctccaccccctagcccgctccctcctcctcaccgacggcgccatacctcctcctctaagccggccggtacgctcggccgccagccccagcttcctctcttcgtctcacgccgcctccttcctccccgtcccttcgttctacttcttcacaacccccacctccacgccatgaccaacggatgacatccgtgctcggataggtgcggatgcgcctagcgatttctcctcaccagatcaacctccactgcagcctcctcctgccggatctgacacctcctcgactcagcatgctaggtgagtccccccaccatcccgcttgcgtccactccagcatgtcagaccctcagcgtctctggcccctccggcttctagctgtctggccttcatcaacagccactcctgtagctgctagaggtcaacgctgtcgactaggcctccatcggccatcgcaggagcttcttgagctacttccctcaatctctgattcatgctcttatgtagccattcagaataagacatccaggcaaagtcaacggaaaaaggtaagctgcaggaatttctctttttaccccaccattaagcatttggcttcgactatttgcattttctaggatctgccattttccctaaggttctttgcatgtctgatggctacagatggttctgaaattcaactatatttttgtgtaaccttgcaaacggtccgctatatattgccattgtttgtaattgacatgtgtatacatcagctactcaatccagtaattgcataatagttaatatttccttgcttctatcttatcatgtaaaaaaaattccctacaaaattaggctttctcaccattgttgccttccagaattaacatggcatgttgcgtacaagaattatctttctttctatttctatgttctatggagttgatgtattgttctatggtttactagatagttgatctatcaaaatcaatcctagcattcccaaattacctataacaagaggtattcatggatcggtacaacatatatatctacagcaggttagtttcgttctgttttgtcaacacagaatcatgaggaattttagatgtgttcattctgtgatgctgtctataattctatatgtattaaatttatatgacacgtgagtgtatatatgcaatgccattacgaactgctactatagtctccctgtgttcttctctttgtatacatgaataacaaatatggcacaatttaaggcaattgcagttttacaggctctgtgcaagtagctgtttatgttttaacggtaaatatttagttttcccctgaagaggagttagcaaaaaaaaagttctttcatctgagatgcttatgatttgtggctaatgtcgtcttagtcgttcttgttaggccgaagatcctagctcaatattcaaggaatagattcccttcattactcatgttaatgttgggaggggcaacccactatactcagctcgtggatcttcatgaatggagctgccagcatcataatgacaaccaaataggagtacaagataaggtaaataggtagtggggatcgttcatgtcacttgctctctgtttttctccttagggaaaaaaagttaatctttccgattatttcgttctattcattaattatatgtacttagcaaattgttgtgttgtatatgtattgccattttgacataataaaaagattccatttgatcatttcctgaaccatgcaggaataatactccgagtctctgatccaactcttctgctcatgaaacttacaaacaccaagtcagttgactgctgcaagcagtatggtctctgtagccaatgcacatatagctctcccatgagtgtttcatgctggtggtcatatactcgtattaacaatgcgtgttagatgcaccgagttgctagcagtgtgaaggagtaatccttctcgtttgctgcttgcattgtaaaccttgcggtttcacttttaactgatgttttgttgttgacgatctcgcaggtcgactgatagatgcattgcggaattctgtgtggatgcaaagctgactcaacattgtttagcttttataacagatggcttcaataggggctgcgctatctgggttaaagaacagcagcttcaccacaatgggtgctgagaagttgcctgatcagatgcatgatctgaagataagggatgacaatgtaagttttattatgacgagaagtgcaatttcttctatgtgccatgtgaatttgacttcattgtaacatgttaagctaaatggtaaatacaggaagttcaagtgactaatattaacggcaagggagcagaaaccggccacataattgtcacaactactggtggcagaaatggtcagccgaaactggtgatttcttggtacaatgttgtgatttcagaacaaatgctatcgaccattgttatctgaaactgttcatcgattataaagcaatcttcatttctaattcatattcttggataatcctgcagacaaaatgtaaaagtgcttgggaagacatgttgaatactgagcatgcaggtaatcgaaagaaaagttgaaatggatatattatgcctcctaaggtattaagcaatcatctgttttgttctaactcacgtatgccctatgtttcagtgaccttctgaaagataaaacatgtttacacgcttgaatagcgaaccatttgcatcttgcagctgcgctgaactggtttgaagatgtttgcagacagaattgtggtttgtaatgagctctttccacttgtagtcctttatggtggagaagaatgccaatcatagcatccactaaatgacccatttgaaagtgtttgtcctttttgttgatgaaaattatagcccaattcacttttttattgttcatctttgttggtgtgttgtcttctattaagccacctaatggattcacaaggactacttatactttattgtactctgtttattaaacaaatgtagaccgtatttatcaaaatattatctactatctaaccattttatgcagaactatttgctatcgcgcggcgtgcgccgcgctctcctttctagtatatatctatgtttctgttaattgcagcaagcatggctagcaaatgcctaacactagccaataaaatggatctatttttttttataaataaactcatcggtgtcaggttagaaaaaaaatcatgtcacgagtcacgacggcgaacaactttgtcgtttctaaacaagaaaccgtcaccgattagttatctgtgacggtaccccgagaaaggtgatcaagccttatcggtgacggtagctctcccgataaagatgagttttcacataactgatcactaatccgtgaccagaccgtccgcatccgtgaccagaccgtccgccaccacagatgaggattcacgcctgatacagatccgcactagtgaatattaatagatctttataaatacttagtttgaaaacataaaaaaggtagattaatcatgaaaagtattgttataaatttattaaattttattaactcatttaataaaccaacataggcatactgcgacaaggaagaagaaaaacggcattttttttattgaaacaaataaccaaaagagtgtgttccaatatgagaatatacatatagaacgaagttatccaacaacagataagaggctagatccaatttttcacttgacacctggtgtgttacatttcattgcaagggggtcctcgttgtcagctaccacttgatccatgccatgtctggtggttttttattcatatcaactagtgttcgagtttacactagcacgggatggctcatctgtaacgggcgggaagccacatctgtgtcgggatagggtaccgtcacgaacaaaaggtcactgatgtgaaaggtcatctgtatcgggccccttgctgtcacggattacagttatctttatcaggccaatgttaaaccccgtcaccgatgagttcgacctagcagaggagtcaaactagggcccgtcattgatgagtcatccgtgacgtgcgcgcacttgaaaccggcaaagatgattatgtcacctttgtcagtatagtatggtgaccatcacggatgactgatcggtaacggattctaaggtacactcgttgcctttggtattaattagtatcgggtttttttataacccgtcaccaatgagtaatttaccaaaaaaataaatattgtttttttcgctagcctcagtcctttactagctatgttcactgcaaaataagaaagaaacacatgtttatatatttccttcatcccagcaaacccacatcccaacatttttcacaaatccatcacatgccatctataaagccatacattcacaacagcatatatgtacattcacaacgtcaaattcatttgtatcagcgtcttcaagagctaagcatcaaaacctacaaaaccgagttataaatttgaacaaatttatatgtaattagcattgcaaatgtatacagagacatcacatcacatagtattacatataatacataatgttacataatctcatgttgacaagcattgacattgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttaccccccccccctttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttg

SEQ ID NO: 53111 - DNA, 6086 bp, Oryza sativa
gaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggagatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaatgagggggcgaaatagtgggcgcgagaagcgaggagccgggcacagcgttggcaaaagtataaaggcactgaggaagggatctgtttccttcctttcgccattattccccttgtcttcgccgcttgcgccctaactccttctttcctgtgccctaccttcgccacacgcgctcgctcttaattttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccacgggggccggtgctgaaccgctacatcccctgtgccctccgcaagaagtgggacgactggaagagcgactggttctacactcccctcgccgacgaagcgcgcctccgacttccgagcagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcgacgcgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgagagggggtcgtgcttctgggtcccgcgacaggggcccggggagcagccgccctgccgacgcccgggtgaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcacaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcggatcgcctacgggaagccgaggaggccgcccaggaggccgcccgggctcgccaggccgaggaaaccgctcgggaggaggccggatttcgccaggacgaggcgatggcgacttccgaggcagctcgcgacgaggccgcgggcgcgtcgcttgggcccactccctcaggcgacactcaggcgacaacttccggggcagctggcgacgaggccgcgggcgcgtcgcttgggcctactccctcgggcgacgctcaggaccaaccgggtccgggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctagcggaccgcgaggccgccgtcaccatccgggaagcaacgctggtggcgcacgaggctgcctgcgccgaagaagagttcacgctccgcctccgcgaggacgcgctcaccgaacgggagcgagctctcgagggggccgaggccgcggcgcaacagctggcggtcaacctgtcactccgcgaggcagcgcaggaggagcaggcgcgccgcaatctggaaggtgcccgcgccgagagggccgtactgaaccaacgggccgctgagctcgaggcacgggcgaaggagctggacgcgagggcgcgcagcggcggggcggccacgggcgaaagcgacttagccgcccgcctcacagctgccgaacgcaccatcgccgatctgcagggcgcgctggactcgtccgccggggaggtcgaagccctccgcttggcaggcgaggtagggcccggcatgctttgggacgccatctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgtaggtccgggatgccgccgaccatatcgttgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattctttagttttttcttcttttctttcttctaaggccttcgggcctcttttttgtatatatcaacttaatctgtaatcaaaaatgaagaaatttttgtgttaatttcatcttgctgtgagtatgagatgaggatgatctgtgccgtggtccttttgtgtcttagcttgaataagggtttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcaccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaatggtcccaggatatcgagtccccaaacagcaaatggccacgaaagtggtatggtctgcagggcctgggccggctgatggatttgcttggtgtggaattgacacgctctacatcgccggaccaggtcgactgcatcattaagagctgtcggccaatagaaaccctggcgaaaagctttaccaaccaaggtgcgcgaggcggagtgggctccgcattcgccttcatggatatcggcaagaagcacaacgccttgttctcgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccatctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctg

SEQ ID NO: 53112 - DNA, 1519 bp, Oryza sativa
gatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctgtagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgcgttcgccagccactccggatggatgacctcacggatgaatccggcttccagaagtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgttgcctcggggtggcgggggcggaagcgccaagcctctcgtcgccacccttgggcttggatgcagcggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcatcatccccggggccttgatggcgtcaaaggccgcaggggaaaggatgttgagggccgctcccccatcaatgaggac

SEQ ID NO: 53113 - DNA, 6165 bp, Oryza sativa
  unsure (1)..(6165): unsure at all n locations
tggccttgaagctccggcgagaaacgtgagcacacgctcccccatcgacggtggcaatggtggccccaggctcttggaaacctaggtcatcatcgccgtcatcgatgtcctcggcgggggccttctgcttggcctcacttcgccgattaccggaaggaaccgccggggatttgccctctcggcgctcctgcctcgtctcctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaggctctacagccgacaccaccaaccgggggcacggagggctgatccccgcgtccgtggtgaggtgacactccggacgaggaggcgccctccgttgcgtggggagcacgtcggccattacgccagcgctcgatactgatgcgagcatccggttccccacgcagatcttcccgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctgtgcgtgctgccgtcgccgtagacgaggaggcgacgctccccatctcaccgcccttctccacctcctgtgggtgtcgaagtcgcggatccttcggccctctcgagcgccttatcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggacatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttacccccccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagattgcctgtcgccacctaacccgcgatctgaccggtctgtgactggtcacagaccggataaacgagtgcactgcactgcgttacatgcggcgtgacacgctcagccaaaccgcaataaatgtggttaggtggggccgggtgtnctgacgcacgccatgcacactcccgacaggccgagggcgggtcggcgcgcgtccgccgtaggggccagcggggtgcggcccagacacgtcacgtggactctgatcaggggtaccgcgctagccttcgccctaacgtgcgtcaggggtaccaggccacgtgtgcgattgtgtctgcctcaaacctctagtcatgatactcctgatcccatgtcaccgacagacataaatggagacgagcaatgacattaatctaaagcttcctttggaagatatgatttcttcaagtatgaaacatgctatcttctctctaatttctttgaagttgtgagatattttcttgtttgaatcagagattttttgagtgctaattcatccgactttatgtttatttaaagatcacccttttacaccgggtatgggtggttcaattgaaggaacacagtaccatacacaagaaacaatcttttactttttattctagttgtgcacttaacttgtatccctagtttaatagacttttgccattttgtgctagaagctgttagatcagccgtccaatttcgctgcgagatcgtgaaatctgtaaaattaaaggtgtttttgattgttattctgtgatgaataattggcattggagattattggttttgatatttggaatttatttttgcaaagtggttttggagatgattggatttcacaggtgatctaaaggtactgtgctggattgggtccggtcagaccgggtagtggctgccggtcagaccgggtagtggctgccggtcagaccggcgtgtattgcacggtcagaccagtgcagcccgcggtctgaccggccgactctgtgtcggtttcggttttgggttgtttatttggatatatgtgattgtttcatgattatggcttttagatggatactatgcgtatgtaatactgtcgtttgctactaatgagtcaagttggggatagcttggtctcggaatatggtttctttgtttgttctatgtataggtgacttgagatgccgggagagtatttgcggtgatggatcgggagttggcttggggataagacgacgtccagggtggtcagagatcatgcgggatactaaggctagagttcaatgcacgtggttggtgaagtttccatatggcatacgatggaggtattgtgtgcgtatgggatgcggagtcgaaattggaaggagtccaaatttgttatgagtggttatgtaaagtttgtttcttgtacgagaaggtttcctagggtgattaggacttctagtatgagtttggttcatggctttaggttgcctacctcgggtataaatagagagggagagtggggcttcctggtatcgcttttgagagcaattgaattgatagttgagttagggtttcgagtttagtcgagatttttgtaaggagtgttgtttgtgcactttgtaagcacagagagaatcaataaagtcgtcatccactttaagagttcttcgatttatgtttcaccgggtttcggcggtctaaccggcagcatcgcggcggtcagaccggcggcggcgacagtcgacagcaggcaatctcgacggttcaaccgaagtttaatctcggtcagaccgacgatcttcaggtggtcaaaccggcttgtacacttcggtcagaccgcgatccatcgaatttgagggtaacttttatttccgctaaaaattttggtttttgggtataccaactattcacccctcctttggttggcttaattattgtgtttcgatcctacaaaatcatttatatgtttgtctactaaaaaggtatttacctataatttgatcaatattgactccgctaactgatttttgtcctctttccacttaggtaacgggcaatccaagattgaagtgtctattttaacatctcccttatcactagaattgagagtaaaagtgcaaaaatcctaccgtaaattgtttcattttgttgtattaggcatgtgtttaacttataagcgcgctaaaatgtttcaatagaagatgatgtatccatcgacaaaggcatcgatgatgacttcatcaatcctaagatatgttggcacagtcttcaaaagtacttagtgtaactgtgtgtgtttacaagatgatgaacgttgcacgtatacctgagtatctccatccatactactccctccatctacttttgatagtcatattttatcttggcacacagatcaatgataagtgattctacttatcatccatttaaacatgctactagtcattcctcgtaaacaagcgattcattaatatttacatttctcgatgtccatgtagccaatcttgtgtggaagaatggagagtcacgcattaaatccaagaaagtcattaagatgataagttgttggattgaaatatgcctatcataaataaattttttagatttggaaatatgactatcaaaagtagatggagggagtatgttagaaaaaaaaataccaggacatctcgtactagagtagaatctccgagatggaaacagtgaagcaaatactcttacataaactttttcgtaacatagggccaacatatgtatgtgaccacatgactaaaaggccatccacaatgcacatacatgacgtgtgacattgttggtccacatagagaaatcgcttgcgtagaggggagagagtggactgggggcctaggggccatgccttcaccgggttcacgtgaccaaagttgatcatggtggccttgcagcagtttatcagaaaaggggaggaaagtaggagaaagagaagggggagaatggtgtccgactggagcttgccgccatcagcatcagatcgagaggagaagcttgctagagaggggtgcggaggtggtgaagcggcggcaagccagaccctaacgatagtgccctcgccgcccatacctcctaatccacaccgtcaagctcctgccagcttcgatccacaccgtagaagcttgccaaagaggggagaggagtaggggcgccgacgccaccagatccgccccaagctcgccgtcccatccagcggcgaggacaggatctcgacgatagtggttggtacggaggaggtggtgtcgagattgtcggcgtgctcgccaaggacgaagggttgccgatcaggggaggagaggaggggtggtgcgctagcgagcagcaggctagatctggccaccccgccgccgtcgcctgatactccgctttcgccaccccgccgctgctccgcctggcgtcgttgccgtcgccgcttgggatgcctcgccaccacgccactcatcaccatcgctgtcgtcgcttgggacacttttgccctaggccaaagctggcaccgtcaccccctcgatttctccacacgacgccttggctcgctcggccggtgaggaaagatatagagtcgcagacatgagagagagagagagggggagagacaggagagagattgaaagtaaaagaggtgggatataccagaagtaacctgcactgtca

SEQ ID NO: 53114 - DNA, 24467 bp, Oryza sativa
caaaaatcccacatatttgggaaattctctattaaggaaattgggtttattttttgttctagtatactcacaatgttttactatgtatagatctagtgttgcagtaaacgaaatattctagtgcaacaaaaaacccacatattttggaaacccctattaagggaattcgttttattttttgtgccaccaaaaaatgtttcacctagtgtacttataatgtttcactatgtatggattaaatattgcaatgaactgaaataattttttgctatttactgaaccattgtttttatataagatgaaacaacacccaatttaaacaagtgaaacatttttgatcaacctagtgaaacaattctaatatacctggtggaacatcgtgcaaaatttaaaaataattcaataataagctaattttttttcgtcggaatacatccatgtgcggtcttgttttgaaaatttaattataatgaatttaatggtgcaatcggatcatgatttgaataagtaatttaagagaaaaatcagtttaaaatagttttgtacgtaaatcgggcgcgacgtcatgctgacgttagcgtccgattttttcccacctaccatcgggcacctgatttgtagggggatcccaaaaaatgctgtacatttgttccctcaaaaaaaagaaaaaattgcgatacatctgcactgctatcgcctaaacgtcggagacgctctcggatctcaatccctcggtaattagctctgtggaaatacttgtagagattcttatccattcagcaggcagaccaacaccttttggtctttaaaggacgacgtatgtcacttgtcacgtctaccttttgagcaaagagtgtggtaggactcccttttccctttttgacagaatcatgtgctatctcgttaattatctgctcttttagctaagctaccctcctgtttgaaaaatccttggtgtaatgatgctgaatccaatcattcgctttctaaaaggaagcagctcataggtagattagattgcacgtaccacggcttttcagatgggcattgcaccttgtgaaattaatcattaatcctgaagaacacaaatgatcgcaatgtttatcaatggggcatccaattgtcaccgaacttaccaccaaacctcttaacatcgattggttgatgcatgcatgtacacacttctcctgtagactttgagaaacaaaattaaatttaaaacttttttttaataatgaaatggttttaaacttctatgagggtataacataaaaattctacatcctaaccaaagataaaagaatggaacggtagaatgattattgctccttcagttttcgagtaacttatacgcttgaacctatttccaaaaagtacttggcatttcatgattctggatatatcttttcccaatttatcatgccattatccttattttttttcctcatcattcgtgtgctagattattccgaggtactttggttgttttagattagtcataagctatatttatatcgtcatatttttataaaacagttagattagcgccatatttttataaaacacttagattagacttttgcacaatgtaaattacaaaacttccattgtaatttgaaaatttacactgttgatttacaaaatttaaacagaacacactgtacgagagaattaaaataaaaataactattacctgtttaaagagatggtatttacttacataaaggagttgtcctctccaatgctacaggccaaattatccgaactaatctggaccgtccatccgcacgcaagttttctccaccccaagatttcacagctgaggattccacgcgcgaagacatcgctcctcctccacccgcggccgcggagaccgcgcgcttctcttcctcgttcactcctccccgcgtcctcgcaggagcgactccccgctgccgccgctcctccgcgtcctcgccggagccaccgtggccgtcctcctcgctcgctcctcctactccccgctgccaccgctacgccgcggccgtcctccttcttccccaccgccacgccccgctgccggcgctacgccgcgtcctcgccggagacgcggccagatcgtgcttctcccactcggatccgccaccggagccgacttcggtcccttctgcatcgccgtccgcctcctcccatcgctgccccccctccccatcctcccgcccccgggggccttcttgttcgctcgcgctgccataagttcttccgcatcaatcaacgtcctggtggagcttcctttccaccggcgcagtcgccccgtcacgtccttgtgatcctgccttccactggctccctgccacgcctcttgtggccgcgacagttaaggggtagagtctgcccatatcaagcagctccgatgcttccagggcgccggtcctccctggacgctggtcctctcttgtgcaggttagattgattcatctgaaaattactctgtgattccccttttaagctcattaatcccctatatgaaaatttctcctcttttcattctcgatccattgtacagcttgatgaaagttaattattgatcatcaccactacagagaatatcttattctgttgaaaattaacagaattttgcttttttaaagatgctgatttgaacttattgatagtgagctgattgcataggggaatcactcgcgtctagcaatatcttgccctgtcggtgtcttcgtcctccattccacatgggtttacttcaatggactggacaatatacaagaataattgcatatctacaccgcaagtctttataatgataggtaattagtcaccaactttcgcctgacttgctaatacaagtttatatagtgctcatacagatcagtagaacattggttttattttgcagtgataaggcaactgatctacttttgtagtactataatagaacttttgacacaatcattgtaatgcgtatgcatgacaaacccgtttgctgttggcaggctgtcatttttttatttaaagcatatatgaccattgtatgattcattgtacggatattgtgggtatttactggctgcaaaatgtattaggggaaggactgcgttttgacatctctaatttaagtgcgctggaatattaagaagcaaatgcgatagagattttggttacaagcttatggtttgaggtaatgctaatttacttgtttttgtccagctaatgctaattcacttcttttcatctctcagggagcatcccacaagttggttgttgacatcatccaaaaccgtggagacaaattagagcccattatttgtagtttcttgtgttccatgcaatttcaacaacgatatgccggtttttctcatgacgcactcaggtagctgtgaaaatgatagccaaagatcttatttgtacacaacatcataccacaaagatctaccaacttaaatctcagcttcaaggagcttttctaagagtgttgagataactgtgcatttgttctgccgctttcttgctaaatgctaattattgctatttatacaatgtgtgcatgcctcgtcaactagcagtgtcttccatgctgaccaagcgatgtgttttacatggtctatgaatctactgtgcattataaggaaaaacgtgaaagtctaagttttttgccgtcagtacatgattttgacttcattaagttgtactaagcagtagtagcaacatggtcaggttgggatcaatcttttacttaagatgctgtagctgctagatatgcgatgcaatgggctgaaatccctgacttatttaatttcaacacaagctatgcattaattcgattatgatggactttgagcaccaaaatttagagatggagatgatgagtgatgtcatggggatgctacagatgatgctttggatggagacgtggaagaagagaaactgatatatgtttctgtttgtgaaatgaatattttgacttatgccatcgatcaatgcatggttatgctagatgatgcactttagaaagattcaagctgttgctctttgtgcacagctcttttactacctgttaggaatatattttcctttcataccatttgcttctacattttcagggtttttggcatgaccaatggtgtcaagcagggactacgccatcaacatattaatttccaatgtgattatgactctgcaacatgtactttcttactattttccctgaatgtgtgagattttgtagtcactgagttgcacatttcccctatcattttgtttaagctacagtagtgtaaaaaattttatttgttctcaggcatgcttcctgctcaccaatcaagctggtgcttgtttcaggaaacataggaaagagagaagcatatgtgattgctaaacaatttcaccccatcgatggtactaaaatcaatggcttaggatggatgatggtaacaacaaagcaaatggccaagtcttttgatgtttcatcatttatagaggtactcacaaggtaagttaagttaatgtgcaaaatgtgaccaaatttgtgttaatcatgtattctttttccagttttgtcagatattactgcatttcatctcagtcgataatgtgaataatgagaaccatttgatgatgaaatcttgaatattattaacagaaagttatggttgatccatcaatttatgatttatcatcacactaaattaggtgagcatagttgggattttttttcttggcatgaattctgctcgcaaagaatctcaaatgtatcatctcagtttctaaaaaaaaattatataaaccattattcgtccatgcttattagagttcaacttatgcacatgcatatacaaaaattatgtttttcaaatttctgaaccaatgattctgacaaataattttgttgcatgcaggaccatctactttgcaactatgaagaatacaaatttgaaaaaaaaaaggattgggtacaaatgctgattacctgaatgccatgtggaatagcctaagaagcagggggttggtgctcctcaagttgtgcaatgttgattacctcatctttctattttttatcatagcagacttacttagagaagggatgctagagaaattgcaaaatatcatgaaatacgcagttggctcttagagaatgatagttcaaatttgtgctacctaagactgacggtaattttttagtagcacaggatctggatattaggtggtatatactacgtactataccgcagcatggaaacattagagaacttttagacaatctatgtctttgcttgttataaactttttttttgtttctacacatgtcaataataacggtgagaattgatctggcaccggacatggtatattgaatttgtttcaaacactattcaagtagtctttagtgtactcctatattgttctatgacttactgatagatgggtatccaattgtaaattacaaactaaattattgagcatatgatgtacgcagtattcaggttatgagcattatggtgaagaaaatttgtaacttcaaacatcctaaacttttattttacttgttttgaacaagtttacttgtcacgagctccggcgtaagaacgtatgggatatgaatgtgtgattggcggacgtggacgagggagtttggaggaacagcgacccgtgatgaacagcaagggatgagcaaatagagaataggagatgagagaattagaaattgaatctgcttgattaactcctccgaattgtgcctctaaataggcttacaactaattaactaaattactaaaaacaagctaacaaactgataaggaaactagctaacagaacctatcctatcacaatactgttgccgtccggcacggcggattacgcgcgctgcgctgcatctcctgacgccgcatcctgctgccctgtgcagcttctgcgttgatacgttatcccgaccatgacatctctcccgtccttcggaaacagctcgtcctcgagctgaaatgccggataccgtcgccggaactccgcctcattctcccacgacgcttccgatgctgccttcccttcccaatgtatgagcacttcccagacgccacgcgcgattctgccacggactgccttcacaggaacaggcaggacgcgcccataggccattgccggcaacgctggcacaatctccggcggctctccatggaatttcttgagaacaccaacatggaacacatcgtggatgcgtgttcctgctggcaattgcagcctgcacgctacttctccaattcgttccatcaccttgtatggcccatagtaacggggcgacagcttgcctttggagaagcctggaagtgatgctgcttggcgttgcaacagtcgaacccagacccagtcaccaacaccatacgccacatcccggtgtttgtcatcataaaagagtttggcgtagtcctatgcttgcagcaatcgttcgcgaacctcgttcaggaacgtgtcgcgttccgtgagtgcttgctcaacggcgtgcacccgtgctgtcccacgatcataagcgcgcaaggcgggcggcggccagccataaaccacctgaaacggcgtcgtgcggagggatgattgaaacgccgtgttgaagcaatattcctcccacggtagccatcgcagccattagcgagggcgatcgcccgtcaggcagcgcaggtacatgccgatcacccggttggccgcctccgattggccgtccctctgagggtgaaacgccgagctcatggtgagcttgaccccggcaaggcgaaacagttccgtccagaacgcgctggtgaagacggggtctctgtcgctgacgatggagagcggtatgccgtggaggcgaaccacctcgttgaagaagacgtgagcgacggacgttgccgtatacgggtggcccaacggaaggaagtgcgcgtacttggactggcggtcgacgacggtgaggatcaccgacttgccgttgacgcgcggcagcccctcctcaaaatccatggagatatcttcccacacccgcgtcggcaccggtagaggttgaagcagaccggccagatgaaggtgttcgaccttatttctttgacagatcgtgcatgcatgcacgtggtcctggacgacttgcttggtgttgggcacggtgaagtcggcacacaggcggtgcagagtgcgttccacgccctcgtgccctgtgtgagccacgtccagcagtgccggcaaggatggcgatctcgcggcaacgaacacgcggccctgtttggtgaggaggccgtccgtgaatgcccagggcgcgcccagctcgccggcggcaattttgtcccgaagcgcgacgagggatgagtcggtcgcgacctcgcgacgcaaatcgtcgaacacagagaacgccggtcctgtgagtgccatgagtgtgggtgccatgtcctcgtcgcggcgcgacaaggcgtcagccaccacgttgttccggcccgggcggaattcgacggtgaagtcgaagcccatcaacttgctaacccaacggtgctgaggaatagtggacaggcgctggtcgaggaggtacttgaggctataatgatccgtacgaacgacgaactgtcgtccctacaggtacgcacgccagtggcgcacggcttgaaccaacccaatgagttcccgttcgtaggcagtgaggctggcgtgtcgcggcgcgagtggccgggtgaagaaggtcagtgcgccggcgccttggtggagcactgcaccgatgcccgagccagaggcgtcgcactccacggtgaatgtcctggcgaagtctggaagttgcaagaccggggcagaggagagcgccgccttgagcgccgcgaaagctgcgtccgcttctagcgaccaccggaaggcctcccgcttgagaagggccgtcagtggggcggcgatggtgccgtaattcttgatgaacttgcggtagtagccggtgtgccccagaaagctgcggacggctcggacggagcgcggcgtcggccacgcaccaatggcctggaccttgagttcatccatggctactccttcggcggagacggtgtgccccaagtattagacttggcgctcgccgaaacggcacttggagtgtttgagcaccagcttgttgttgtggatggcgcgaaggacagcttgcacgtgttgcagatgttcggcccatgtcgcactgtagatcaaaatgtcgtcaaaaaatacgaggacgaatcgacgcaagaagggagcgagcaccgagttcatcagggcctggaatgtcgccggcgtgttcgtgagtccgaacggcataaccaagaattcgaagtggccttgatgagtgcggaacgccgtcttgtggatgtcggcgtcgtgcatgcggacctggtgatagcccgagcgaaggtccagcttggtgaagaatcgagcaccacggagttcgtcgaggagttcgtcgacgatgggtattgggaacttgtccttggcggtggcggcgtttagagcacggtagtcgacgcaaaatctctaggaggcgtcctgcttgcggaccaacagtaccggcgaggagaatggcgaggtactaggacggatgatcccctggcgtaacattgccacgcactatttctccagctcgtccttctgcagctgcgggtagcggtacggccggaccgccaccggcgatgcatccggcttcaagtggatgcggtgatcgatcggccgcgcgggaggcagtccctgcggctccgcgaagatgtcggcgaagtcgtcaagtaggcggggtaggaggtcctctgtttccagcatctcacaatggggcggccggcggttggcgaggccgtgaagggtgacctcgcgcgtactgcgccaaattgacatgcgcatattccggaagtcccacaaaattggccccaacgtgctgagccactcggtgccgaggatgatgtcgacggtggagatgtcgagtgcgaagcaatcgactgtgaacagcttcccttcaatgcgaagacggaggttggcgcaccggcctggactgaccagacgatcgccgttcgccacgacgacatagagatcatggcgcactggagacagatggaggcacaggtgacgcgccagctcggtatggatgaagttgtgtgtcgacccagagtccacgagtgcgaccacgcgttcgccggcaatctcaacgggcaggcgcatcgtgttggccccgtccaacccggcgagaacgttgagcgacacacgcggctcgtcgggggcggctccatgtccccttcgacgttgtcgtcatattcgatgtagaacagacgagcgcatttgtgcccgcgcacaaatttctcgtcacagttgtagcacagcccttggcaccgacgttccgcgagttccgccggtgagaggcgacgaaattgtcggggcgcttgctcctgtgagccctcggtggtcgcggctggcgctgttggcagattggcagcagccggtccgctccggaacggtgcgcggagtgccggacgcgtgccgctggccagccgtgacgccttccgttcgtaggccctggcaagccccatggcttcctgcaggtcatccggctgatgcaactcgacgtcgatggccaattcctcgcgtaggccagctgtgaagagttgtatttgctgcgaatccatgagtggctccgtcgtccggctagccaatgccagaaacttcgtctgatatgctgccaccgaagatgtctgggacagccgcttcaactcacccagagaattacggtgaattggtggcccgaactgagcatggcacaggtccttgaaagcggaccaatcgaggtccgtgatgttgctcgtagtgaaaataccactcttgagcgtcgccggttagatggtaggtggccaaccatacgcgatcaccatctagcgtcttctgtccccgaaaaaattgttcacaatggttgaaccaattgaggggatcttccttgctatcatatttaggaaattccagcttataaaagcgaggaacacccgtgcctgcattggtgtccgaggacaaggacgtgcgatgctgcggcggcggcggcggcggaggcggcggaggtggtggcggtggtggtggtggtggtcgccagaacattccgtcgccaccgagtcgtggcagagttgaggtcgacgtggcgccctgctgctccaacgatgtaaggcgagatgaggcgacggcaaccgaatggctgagatccgccaagtcacttttggatgcgaggagcgacatgccatggagtatgtcggccatggactcacggagcttggcgatgtcggcattggagaccggagctgcggccgtagctgcggctgtggcggtggctacgttggtggaggattcgtccgttgccatgagctctgataccaagttgtcacgagctccggcataagaacgtatgggatatgaatgtgtgattggcggacgtggacgagggagtttggaggaacggcgacccgtgatgaacagcaagggatgaacaaatagagaataggagatgagagaattagaaattgaatctgcttgattaacttctccgaattgtgcctctaaataggcttacaactgattaaccaaattactaaaaacaagctaacaaactgataagaaaactggctaacagaacctatcctatcgcaatactgttgtcgtccggcacggcggattacgcgcgctgcgctgcatctcctgacgctgcatcctgctgccctgtgcagcttctgcgttgatacgttatcccgaccatgacattacttttgtttgtttgttatatatatatatatatatagagagagacatacacactagcaaaatgcccgtgcattgcacaggttaatgacaaggtggataaagtttgacctcaataatacatcaaagaatgtaagtatgatcagattgcgagatggataaggttttatctcaatgattttatcaaagtacatgtatgatcataagaaccagcgatgcgcacagttatcacaaagaaatatttgtgtttggacatttagtctattctacacatgtaggatatgaatgattgtcctgaccaatggtgacgatgattgtagcattggagaaatggatggcttgaataacacacctttgcatagaagacgatgatgaaatattatgaggacattaattattttaaattatatttttatattcgcaatgtaatgccctgaccgactaaatctaaatagtgccaccggacctaaccgttccttttttttttcttttctagaaaacctctctgagtataagtctttagcgcataattagttaacttttaattattatcttaactaactaaaagattcgtatttttctaatcgtcacatcttttcaccccacgtgttttttcgtccgtaacctcttttttttccgtcatcgcatccttttcactccatgtttttccgtttttcccaccgcagccgatttctattatgcgatttgtttgttgtgtccaactcggttccagaaaaaaaagttgagcaaaaaaactagatcaaaatcaaagaacgatgtctacatcaatgaaacaacaacatacataattcacaacacttgactcccctgccgccggatccgccctcggccgtcaccaccgctgccggatccatccgcgcccgccgctgacgctgccaccgccgccggaggaagaagagaggcagcggacagtcatcaatcatccgtcgattggcctgaggttgctcgctgattcgctaaatgtgtttcttatacggatatgtatttccaaaatcgaacaaacttaaaaaccgattcaaatacggatatatatttccaaagcgaacgaatataaaaccgactcatacacggatgatgtaccaaaataccggtaaaaacatcttcaatttttatagtagtagcctagtagagagtataatttattatgagctactatatttctctctatcatttgagacttttttctagcgagcaaaagtaccaaagcagtgtgaaaataactttggttaaaaacaaataattttagtcttaatacaccgtagcgaagcacgagcattttgctagtaaacttaaaaatagatttattagatatttcaaaacaaattttctatagaaagtttgaaaagcgtggtgacaaaaatcgagataaaaggaacggagatattgtgtgaagtttcacaccatgcacatattcagtttccatgttttttaaaaattaccagtcgaattttcttttcccagtaaaacacacactgtattctgtttccatgttttttaaaaataccggtcagtttttttcctagtaaaaaaatcaataatgatatgtttttttcctagtcaacccgatcgagatcccatcccgtttagatcgggatcaggtcgatcccctttcctctcctctttcctgtcctcgtttcctctcctttctcatcgtagccttctccctctcggccatcggcgcctccccctcaacctcaccctccacccctcccttctcatcgtagccttctccctctcggccatcggcgcctccccctcaacctcaccggcgcctccccctcaacctcaccctccactcgtgccacctccctgcctcaaccacgacgtccgacgtgctgcccccaactccaccttggcctccgccctgggccacctccctgagtcgactgcatcctccatcagcgtcgccgccaactcaacctcagccttcttacggcggccatggaggcaatggccaaggcggcagtggccgcgatggcgttggcgaaggtggccatggcggtgacagccccgcgacagctgcgacggccaaggcgtgcaggcggccacgatactggtgagcagtggtaggcgtgtgggcggcggatccggcggtggggaggctcgagggcgacggtggggctggtgggcagtggattcggtgttgggaggcgcgcaggctgtggcgaggatggtgggcggcgggggaggtgggcgggcggtggcgaggctggtgggcggcggatctggtggtgagggaggctcaagggcgtgtatccggcgtcttagttctagccgacttccaagcatacttcatcccgcctcccgaagttaccgccgtcgcctacttcctcgacatcgccgctcgtgggagccgccgctgcgaggaattgcctcatggtttgtcgccttcgtcgatttcctggctccctcaacacccggacacccaagcgccttgccggtgagggccgccgccaagcttccgccgcttgccgaggccgtgcactgccacttggagcttgacaccgcaagtcaaagccatcccccgaaatcaggttggatctcatctcatctcaccaattgctccgtagcaatcttgtggaatcctagttgtatttatggggttgatttcatccgttcttgagtccaaatcgaatccgctatgtctttcgtgttgaacttggtatccgcccttctgtttttgtttttgtttttgatttggattgtgatggtttgagattttggagagaatgtgggattctatttgtgtgatatggaattccgactaggatttggggggcggggtgtgacgggacgaaaaatcaccgcatgcacgaggtgacgaccggaaaaatccaaatatttatattagttatagatatagtgaatctattctacaccctcctcccatgggtcaaacccacctcccccaccctccctagggcccaaaacccccctcccacctcggtcaaagtgtcctcccgccggtcaaacccgcccaccactccctcccccgtccactactttgctgctctcgtcttgcaggaatcgtgcagtaacaggacggtcatcgtgcagtaccaagacaacattatcgcagtaacaacgtcaaaaagtagccatgatggatcttgtttcgttaagcgtttttttatgaacatggtgcaaacgtattggaaatacaaggtatgatgtgagagatattgctctctaaagattgagatttacctctttttagtcctcgtcttactgaaacagcgtagtaacgtgacagccagtgtatagtaccacaactgctttccgcagtaacgacgttaaaaaatagttatgatggttctagtttcgtttagaactttttttacgaacgccatgatgcaaacggattaaaaaagtaagacatgacgtgtacgttactattacgcaaccctcctgctacacgaagtagtccaagagggtcccgtaattctacaaaaagtggagacacaagatatgagggtgtggcatcctttctcattcatccattgcattctcaagtgtacaatcctcctctatactcctctatttatagccattcccttttccaccttccatgtttagtgatgggcccaattagtgggtaaccgggccgggccttcgtgggctggcggtttcttaacactcccccttgggctctcactgcgtgatgcctatgcctcatcaaaactccataaaaacccagtgggaaaaatttggagaaagagtacatagcatacgcttgcaatgtcgcatgaattgcctcgttaaaaaccttgataagaaactgctaggaaaacttatccaagggaaaaagagtacaatccacccaattctctgttcaatctttctagattgattttgggtacttgattttttatatcaagattatagaatgagtcagcgaaattctccccctgaattttgcatttatctaagtctcattattccgatttctcggacagacctattcaagagaagatgtcaataatgagttagtggacaaatctgcaagacttccatatgacttagttcgtagctcctatgtaattcatgcacatagaaaagcttggggttcatgtgcttagtgagtatgcttctcacgtaactcatttgcatatgtgcgacatatgttgcttaagtttcataaatggtggggttgagatagtttccaaatcgcgattgctgtcgcgggtaaccatatctcaaaaccatgccgaggctctgaatagttcaacgatgtttagttcggtttagttcaattagccaagtttttgtgtgctgctatggcacacttgtgtttgggaattccgtcccattttggcgataattgactaaccaaagctatgcaccatgaacatttctaagtgcggttggactgatgtagtagacttccatctatcgcttgcttttagctgcaagtgtgagcatgatttgggttcagccaaatatttcaaaattaaactcaaattcaaaacgaacgagtttgcttcttcgattcttttctgctttattctttctatgttggttcggaacctagtacttcttcatgtactattatgcaagtgttcgatccaagctcctgaaatacattcattgattctatcttcaatgcttatcaatatttaggttgagttctagtaacatcctcaaattttaaactaaaatttgactgcatcatgctggttttaatcttagattagtaaaatcaaaatttctttttaaaagttctctttttattcttgattttggttcaagtattacccctagaattcccttaacctagtttaccaataaaccataaattgttaccctatcctaaaccttagtgaatttagcaaattttcttcaagttccaaaacttagaaactttctctagattacccttctattagtgagacattgttatagtgcataatctttgcaaaactcttccaaagatctctagataaattctttctccttaggcaaaatattcaaaattcctttgggccgaaaatcttcaacttagccccttcccttggcccagccggcccaagaggcagccgcctcttttctcttctttgtgggcgcgtgtgacgtcacacacgcggcccagccgtcgttgccgtgcgccacaggagcgcaccacccacggcttgcgccgccacttttgtcgtgccgtgttcttctgcacgccgccgccaactcgcttccgtcgccgctaagaaaggagagccggcgccgtaatcctcctctccacgccactgccaccgtgctccccttctctctcctccaaaccgacatgcctagccaatcaccgaatgaagccggcgccgctttcttccgctccactccaccggcgccgtgtttcccttctccctcctttgcgaaccgacctcctccgcctataaatagtcggcatgctcgccatccctccccacaactaagctcttcgagcttttctctctctccaccatggccggctaccaccaagtcaccggccgatctccctcaccgttgccccgtcggccaagcccttgctccatcacgtatgcctcgacgaggagaacccatttcaccccattcccccatcccttccaccttgagttaagctaccaccgccagctcccaatcggctgagccaagctcttgccgccggcgttccggtctcctccctctccctctccgcaagaaaccgccctccccaggtgcgtggtgctcgggaacaccacccaccgccggcgtcaccaccttccggtcgccggaaagccgtcgccctctctccctctctctttgtgttgacacgggaaaaagaaacagaagaaaggaaggaaggaagaaggagaaaagaagaaaaagataaaatactgacgggtgggcccctgttccgtaataacctttctaatttctccatttaattcaaaatccaaactttagaagcccatatcttttaaaatataaacccaattccagtgaaacttggaccaaaattcttctaaaatctttctctatcttttgagcccctttttgctatttttgcattttattttattttctctatttttcctatttttggattttattcgaattccttttgaatttgaattttacatgcttaaccctaggtctttaggagtctcctaacctattagataatctcaatcaatctcaggacatcaagcaaggcaagttactatctaccttttgatcatttaagcctatattttacaaattatttatttatagccttctattcaatactctattttatatgcataattcaaccatagaaacccagataatttagtattgcttatcttgcttacaatctggttaaaatattttatacttagattgggacagtacgttagaattggatgatttccgggtggctagtactgtctcgatcgatatagtttttaccaggtacttatgtcgaacgaacgggtacgaccgcagtctctagaatggggacagacctagttattatgttaattagcaatgtggtacctctgtatagtggttcttatttttaagtcctcgcgtaggaggcaactatagctgcgaagggcaacttttaaccgttaccatgtacaggtaaatggtttgtgatactcgagtataaattatatggtatatttctaaaccctgatcgatatgacgtggtgtcatacgatcagttccccttaaatacctcgggaacgccagaaatcctcttgctgctgttaacattacgttcagagcatatgaggatataagttcatggaacaggtgccacaattgttaataacctaatactgggccatggctaaagctgatgattatcagcaagtcgtggactgcgggtaaagcgtacatctgctgcagtagaatatcattgaaactattcgaatagccgtgctcacggatttgagtaccgggactcatatggtaccctggttagaaacctaaagtatatatttttacaaactcttgctttaatatttccagattgtctattattgctttctgcaaagaactccactccatgccaacgcataacatatttccatggtaacttgctgagtattgtgaatactcaccctgctcttattaaccctttttcagatttgggtcaagaggacccctatgattattattatgatgactttgataacttagaaaatccctagaggttataccttcctagtcagaatgtactagaacagccgctgtgtattattagcacctatgtttaattaggtgagtacctacccttgtaaaaaccctagtattgtaaactttaacgtatgcaatgaagaaccagttgtattacatgtatcaatatttactgatccagggattgatacattaatctcagtcggatccaagttattagttttgggacccgacaggactggtatcagagaatatgtttggactataggacaaaccctaaggattactaaccaatttaagtttgagtttacttcgaacttaatgctttaaggggggtagatttgacttgcgagcacacaatatatattccatttatgtatttcaggttaatggcataaaggcatgagcgagaacatattgagatggcaatttctatccataataatgattgcactgatcagctaatcaggttaatgacgaagctaaagataagtgaataaacagaattctattcccatgcttatcagaagggagattattgggaatatgatatgaccataaagatcaacccacctaaaggagaagatgatatatactatttccggacgcgtcataggcgagatacactataagctgctttatatgatgcatgtagggaggctttcctacgcctcaaccatatttatcaagacaagtttctgcattctcgctatttatttcatcctatgcaagaaccaggcgaagactattgcaccctccagaatatagatcgtcatcaacaaccagtgaaggcaaccatgtctatatggatgaaagctgctgatgacatgtatgaggaagtcctagaacacatggatatgtagtccaaacgtttggaagaagctgagcgatgagaagctgttcttaagcacatatatcatgtgctacaagaattatatgatgataaacaaaactctatacttaatatttgtgttgtgggcgcgtcattctgtcttcaccaagtccctgggatagatagtgatgatgatgatgatgaagtggggatgagccataagggccaaatcctcaaaatgatggtgagggagttctacaaggtttaccaccatcgccaccaccattatatcctatccattccgaggatgaagctgaagaaacgccctcagctatggacatcagtgagccaagtcaggagcttgaagtagcaaggggaacccggatgtttcatattaatgacctaaatgttcccccaatttggattgaaactccagaagaagaggaggatccagaagaacgagtgtttgagatgcaagaacatatttctatgtatgctgatgatcaaggagatgatgaagatccttactcatgctctgcccctaatactgctgcatcaacttctacacctcatgctgaatttttacatttcgcacctacatcattattcactaaccccgctgaaggtagtggtgagtaatttgatgattaggagttgtagatagagtgttaatagttagaggtcatataaataaataaacttgctagtatagtttagcaaatgaccatactcctctctaacccctatgtgaaattatcccttccttggtttcttttgctttctctcttgtttcttcttttgcttttggttattacttttgtggtatgcatcatttacgatacactgtccagaaataaaatctatggttaattaaggatgttaactcccctttgaaaagacagcaactatccttttctagaggaattcagtcaatggcagttcaggttaaggtgagacaggagatatccctctaccaaatcctgccaccttagtagaattaatggaagacaaacccaactattacaggctatagttcaaaatcaagaaaataaaggctacagtgcccattctgaattcatgagagttaaaacaccaatcttttccaaaacagaagaacctatggacgccgaggactggctaagggctatcgaaaagaaattagccttagtcagaataaatgagcaagagaaaataacttttgcaacccatcagctagaaggaccagccaatatatggtgggaagcatatcaagtctttatagaagaccctacccatattattacatgggcagaatttactacagcctttagaaaaaccttcatacccactgcagtaattagaatgaagaagaatgaatttcgaagactgagacaaggttttatgtcaatacaagaatatctaaacaaatttacacaacatgctcgatatgctgcctcggacatttaagatgaaacagaaaagattgaaaggtttatagaaggattatgctatgagctacgaggactgatgatcggctaaaatcatgaaatttttcaaagcttagtcaataaagtggtcaggctagagaatgaccgcaagataatgaaaggacctcgtaagcgaggaatgaatcttcaacgacaatcaccaactaaaaatccgcaacagattcggaagccctatccttttaagccatctctacttaatacaaggccgggtatgccaccaataatccaaataccatgtattagtatggaagattccccatgctatgtttgtgggaagactggacatttcgctaggcaatgccccaatcgccaaaacacagtgcccagacttccaatcaaaaaccacctatctcaggctttataaagaaaaatcctccaatcattaaaggcggaccaaattttgaacatggttaggtacaccatatcaaagcagaagaagctcagcaggaccctaacatcttaatgggtatgcttaccataaactctaaaccagttactgtcctattcgattccgatgcttctcattcctttttatccacaaaagctagttggattcagtgtttacctatatatatatatatatatatatatatatatatatatatatataccaaaggaagaagtgtcagtggtacaagagtatttggatgtatttcctgaagaactaagtgaattacccccagatcgggaaatagaattcatcatagagttacttcctggaacgacacctatatcaaaaagaccttataggatgccaattaatgaattagaagaattaaagaaacaaatagccaagttagaaacaaaaggttttattcgactaagttcttcaccttggggagctcccgtgctatttgtcaaaaagaaagatggaagcttaagaatatgtgttgactaccgagctttaaatgaagtaactattaagaacaaatatcccttgccaacgaacgacgatctatttgatcaattaaaaggagctagtgtattttctaaaatagatcttcgatcggggtatcatcaattgtagatcagacaagaagatatatcaaagactgcctttgtgacaaggtatggattataggagtttacagttatagcatttggactaacaaatgctctgacttattttatgaatctcatgaacaagatattgtggagtatttgaaccaatttgttgtcgtgtttattaacaacattcttatatattcctaaaatgaggaagaacataaacaacatctccgattggtactggagaagttaaagcaacgccaactttatgccaaattctgtaagtgtgaattttagctagatcaagttgcagtcttgggacatataattaccaagaatggagttgtcgtatatccagagaagattaaagatgtgatggaatggaaggtaccaacatcagtatctgaaataagaagttttctaagacttatagcatatgcggatatttggtacttcgtgcggccaattcaccaatcatcaaatacaatgctagcattgtcctcgcagacttctgaagatgatttagtgagttctattggagttcacatgatcttgctggatcagtcttggcaaagacatggtgtctaagagacactggatgtttgctgcttcggaagcgcatttatgcatacagtaccaaatggaagccacatatattcttcgtaatccaattcagggatgctagaacaatatgcggtttatgcattgatctcctgtcggtgcatactggcacacaaatcttcatgatttaggaaaattatgcatatatgtgctatgatcatacgagttgtaatatttattcttataattctaagaccgaaaatggctgaaaatccattgctaaaagggtgtagcccaaatcatcacactttttagagagttcaatgggattgacggacaatagatgcttctataaagtgcacaattgttccataggtaatatgattgtggcgcattctaggccgacaaattcagttgttggtgctagcaatagtcataatgtttccagttctatgggtctggaaatacctctttctcttaaaatgttatttgtggttatgcggaccacaattcattctttttctcttatgtttgggcgctacacaaaattcaaagcataataactatgtgctagaaaagagcaacaaaatagtaaatgctttaaatatgctattttatactggaaataattctttattgcagggaaaatgtgtgctctacttgggcaagaaccatttctttgatgcaatgctctattcaagaattgcaacaattgatgacgaagtatattgatttaacaaagtattctggtacatcggattcaattaacttcatagcgagctccttgctcaacagctatggcattctgacataaattttaggaccaatccaatctagcataggagattctacgtccatggccatgcaaataggctaggagttctccccctcaagtcatgatgagtgtgctattaggattgtcctctttttttcatgttcatagttctagattgttcaccttgacctatgttctactcccccttttcctcttcttccgttaaggtaactgcaccaggctagctgctcatgttgaattcgttatcaactgtgctagttggtttttttggaagataatgcttttctagtgaacactatcctgaacgtttcgcgattctattatcgactagttatgcatacttcttgtatgtgtactagtgatacttgcatgcgactttcgtcatgttcgggtagaacattaagagtttcagcggtattcaatgcaaatgcgatgcatcgtaataccatactctctctgggtcatttgcttggtgaatcatagtcgaaaaatacatgttcttgcttatagttcttgctctacgaaaggtaatgtatataccataatactctaaatgctaatgcgctcattcgtttagcgtactcattcatgagagtagtttggaggcactggcgagagtttgaaatgctagatcaaactcatcgagtcaatgcctacagcgtgattggattaatggtaccatagagcttcttgctctattgtaatttcgacattgaataaatatgtcagaggtattcaagattcggcaaattttctaattcgcgatgcacgtcatttttctatatatgcgcaaaattagattcaggcaaaaatgcacaattgttgcaatataatggtacacaaaattcccgcaaataattccagtatattctatgcaattctatacattttatcgcagcgatattaattaaaagtaataaaaacatcacaaataattaataatcgtaaatgcgataattaaatttcataatcataaacatcagcaataaaggtactttaaatgcaaagtcggggtcgaaattcaatgtcccgtggctcttttacgcgagaatatgattttggtgatatttgcaaatttctaatgccattcaaacaaatatcccaaatgcagagggttattttcttgttttctggaaagttcagggtttaaaaggcaaagattccaatgcaggggaacatgcagttaatttccgaaaacaacaagggcatttttgcaaaatcacaggggaatctttccttttctttttctttttctttccttttctcctcctctttgcttttcttctctttccttactttctttcccccttcctccgccgatggcgccgcctgccatatgcggctgccgggcggcgccggcacggcggcccggcggccggcggcgaggcggccaagcggcgtggccgtgaggcggcaggcgcagcaggggagggcgcgggcggcaccggcacggcggcctggcggccggcggcgaggcggccaagtggccacggccgtgaggcggtaggcgcgccggccggcggtacggcgcgtggtggccagccggagcggcacacgacggcgcagcggaggggcgcgtggcggtgcggccaggcgagcaccgtgcggcggcgatgcggcggccacggcggcgtgcggccgggcagtgcaggcagcgcggcggctacgaaggcgtgcggccgggcggcgcaggtgcgacggcggcggccggtgctgcctcctgcccttctattcggtggcgcagaggccgggcgtcggcacggtcggcggcaacacggcagccggcgttgccatcgacggccttctctcccttctttttcgtttcattttttttttcttccccgttctctttcttcttcggggcatgcacgattccggccgtcctgcgggcggtgcg

SEQ ID NO: 53115 - DNA, 11844 bp, Oryza sativa
  unsure (1)..(11844): unsure at all n locations
ggtgcggcacagcaagctgttggccggcgcggcgggatgggcagccggcgtgcgggcggcgctcggattgcatctctctctttttcttttgcttttcttcttctattcctcttcggtcatggcgcgtctgtggcagtggcacggcatcttgcagaatgcggccgatgcacggcgaggtgcggccatctcgctaccgttgtgcatggtgcaaccttgctatcacacaatgttggcgtgatgcatggctagttccgatgcgattcgtcaatcatgccggcgacttcttggcagcctcgaaaggactcgcaaccaatcggcaagatgccggcgacttcaagtcggcaatggtggtgttggacgaaaatcgcaaaaacggaacaagaacgaaaagaggaattcgttttcgcggtagatcggcgagatgcaatgcggatctgcgagttcttacccttcttctttctcggtctccggtagaacatcgtgctgataacgtattacgcaaccctactgctacacgaagtagtccaagagggtcccgtaattctacaaaaagtggagacacaagatatgagggtgtgttatcctttctcattcatccattgcattctcaagtgtacaatcctcctctctactcctttatttatagccattccctcttccaccttttcatgtttagtgatgggcccaattagtgggtaaccgggccgggtcttcgtgggccggcggtttcctaaccgttactactctctaaatattaagatttaaaatattttagctctaaaaaacattactactgtagtaccactgttactatgcatgttctttgttactacaaattttgccatgttgttactgccaaaagtgtagtaacaacctataaattttgcagtaacaacctactgattttgtagtaacgtatcatgttactacctttctgggataatgttactgctgactcatagtaacaatgtaattattacagtaacataactggttctcacataatctgaatagacatacaaagcatgcaaacaatgttttctattcacaaattgtcatatggtgatttggttaagaaagcttgccatgaaccatgagatcatgggttcaagtaatgaattcatcaatttatttttaatttttataaaaaaaagaaaataatagaaggaaaaatgagagatgggaaggagagaaaaaatcaggaggagcgatcgtggggaggaggaggagcgatcgggagggggaagggggagaatcgctgggagggggagaggaaggagctgggagggggagggaggaaggagcgatgggaggcaggaggcgggaggaggaggagcgatcgggagggggaagggggagggggagggaggaaggagcgatgggaggcaggaggcgggaggaggaggagcgatcgggagggggaagggggagaatcgctgggagggggagggaggaaggagcgatgggaggcgggaggaggagagagagataaggagggagtgaggggggaggggaggggggtgtagaatagttattctaagggagagtgtataatagaactatatatatatatatatatatatatatatatacctttaaaaaaataagagatgcttccgtcgtttgtcaaaaaaccggtgaaaataaaccgggcgaaaaaaccgtaactgttcgatagaaaaaagggcgaaaaaaaaatccgattccgtgaaaaaaaatataatccgattccgtgccaaaaaaaagggcgaaaaaaaatctctatctctatctctacatctacttctatctcttctctatctctactaagaggtatttcggtcgtccgtaaaaaaaaccgggccaaaaaaccgagcgaaaaaaaccgggcgaaaaaaagtccgaccaaaaaacggagtgaaaaaaaaaacgggagaaaaaaaatgtctgataaaaaaacggagctaaaaaaaaggcaaaaaaaaaaacaattctgtccgaccaaaaaaataggaacggggcgaaaaaaacgagcgaagaaacctggcgaaaaaatagtctgatccaaaaaaaatcgaagcgaaaaagggagaaaaaaatttccgatcaaaaaaaaacggggcaaaaaaaagcagaaaaaaacgaaacagtcagtaaaaaaagagcgaaaaaatttaaaaaattttccgattccaaagaaaaaggaattatatatgacacggtaaaaaaaatcgaccgagcgaaaaaaagccgagaaaaaaaactgggcgaaaaaaagtccgataaaaaaacggggcgaaaaaaaaacaaatatgtccgacccaaaaaaaggcaaaaaaaaggaagaaaaatcgaaacgaatccgactctgccgacgcggtaaaaaaagggcgaaaaaaatttaaaaaattgtccgattccaaagaaaaaggaattatatgtgacacggtaaaaaaaatcgaccgggcgaaaaaaaaagcgagcaaaaaaactgggcgaaaaaatgaaaaaaagtctgataaaaaaaacggggcgaaacaaaaaacaattatgtccgatccaaaaaaaaggcaaaaaagggaagaaaaatcgaaacgaatccgactccgtcgacgcggtaaaaaaagggcgaaaaaaattaaaaaaaagtctgattacaaagaaaaataaattatatgtgacgcggtaaaaaaaatcaaatcctattatgtctagaaaggtccgacactataataaagtggtgaaaaaaaccgttcgaaaaaaaatgcacgagaaaaaaaataaaaagggcggaaaaaagcacggcggaaaaaagtctaatttctattcatcgttttagtagtccgtttatatctcttctttatctctaatctaatctaatctaactatagaagtttctatggtatattaaaaaagaaaaaaatgtgcgagaagattaaaacggttttaaaaaaacgcgtgaggaaaaaaatgccagaaaaaagcgcaaaagaaaacacgttagaataaaaagttccatagtcccaaaaaaaacacgcgagaaaaaaatatttccatcgtctgtaaaaaggaaaaaaaaaagcatatgaggaaaaaaactgttagaaaaaaacgctaaattgatggatacttggtcggataggctccatccacttttttccatctcttacacgacttttatttgtcatctattctcctgtagtggagaccctgcacatttttgtaggcaattatcatactatttttgtgaagtatagctattattcttgataacatattatagctcttattcttgattacatattatatggaaataatcttagaaaataaacatattttaattgttatttagagaagagtgcacagtgactctattttgtgtagacttgaccatacgagacagtgtaggatttgattggttgtaagaatgagattaaaagaatattttagattatatgcatgttgttatataaataattcaattattttaggtaaagcaaacatcgtaaggttgccatcatcgaggttgggctattacatttaagatgttccaattttctgattgtcatcgacatggttatgaatgaaaaacgtgtatatatatatatatatatatatatatatatatatatatatatatatatatatatggcaaaatctaaatcgcgtgcgctctctgttttgtcttatcgcgcgacacgctcatcggccgtccgatccaacaagcgctggtgcgtccgaacatggcctggtgattcatggacgtggcatcatctagagtaatccaaattggaagccatgtgatgctctacgctacgccggcttcaaaaataattttctcttaaactaatcatccgatctacgatccgattacaccgttgtgttcgtaagagttgaatctttataataagatctcacatgattatattttgatgaaaaattagaaattactttcataatatatctaaattacttttagatttcactaaattacttcttagatccataaagtaaattcaataaagcctaaaagtaatttacatatattaatatataagtaacttagaacaaaaagaaaataaccttatcatgacattaaagtaaatccgttatggaggtaaaaacatgagtttatatagaaattaaatttaatcagcataaattacatcattgactaaaaatgattataaaataaacaactcacaacatgaatgtacagatttcttttaatgccgtaacatgttactttactcacttttgttttaagttacttctataatataggtaaattacttccaggctttattaaattacttttatggctaagaagtaatttaatgaaatctaaaagtaatttagatatactataaaagtaatttctattttttcataaaaatatagtcatgtgagatcttgttataaagatttaattgttatgaacacaatagtgtaatcggatcgtaaatcggatggataatctaaaagaaaattccataagaagaagaaaaatacatgcacttttgagtatactagtagcaactggataagcgattgaggtagctggttatgtgtgtgtgtgtgtgtgtgtgtgtgtgtgtgtgtgtgtgtgtgtgtgtgtgtgtgtgtgtgtgtgtggttctatactcctagggagtaagtactccctctcccatccaccgttcatctgatcgatcagatatgtactccctccctcattataacgggtttggctcggtggatccgattagtttttctaattaaaagacggactgcttatcccgtaatttggggtttgctcccaacaggccgaactgcttatcccgaaaattggggttttggggggcggcgcggcgacggaccagcgcgacgatggaccagcgattcagcggcgactggatggctggcggcggtacagagatagcagctcgttccttcctccagtgatgactcctccccttcctccagcgatggctcctctctcaacagcatgtgttcctgaagcagaagtaatcgatttggagtcggctgaatgcaggagcggggcaaccatggcaaaatcgacgggccatagcagtggatttcatccaaagcagcaggttagtattcgtttatttttgtatggcaagatcaagacacgttgcctaaaattttctccttcgccgcagggtcacaggaaaatcagtttgtcaccacagtccaaggtatgcctcctgaaattgaatatatgtatgcctgtagagagggattaggtgtatagttcggttcatgtacgctctcagtttcagatgctaatttttccccttttagtgcatatgatgtttttttggttgatgaagtaaatgctgttttagcccccacccccctaaagaaaaatgtagatggtagtacgtactgaattttcaacggtatatactcattttttctttggagggatacttattggaatctgctagacggtattatgtaatgaattttggtgtggcagggttcttactgaactctctgttagacgatagtatatactgaatttttatgtggggagctttgttctcaactttgttagacgatagcatatactgcattttccacatgtatactgaatctttccacaatgatttatagactgaactttgatacgcaccagtatttactgaatttttcacagatatactgaatttttctatgggaggctttgtactgaactttgttatacgacagcatatagtatgtactgaattttctatgtggtacatactgaacttttctagaagatagcatatactgcatttttccacatatatacagaggcttttccatagtggtttacatactggaccttgttacgaagaagtatatactgcatttttacacagagaggtatatgctgattttttacatacagtagtatgctctaaactgtgcatatactgacttttctgtcagtacacatgattttttttatttagagggtacacaaaggtagaatttgctacgcagtattatgtacttcatctttccatacatatatgagtgtatgctgttttttttaaaacagaagtatatgttgaatttttaaatacactggtccatgtagtattgtctatttatgaaatgaaaaactaattatctgcaggctttgaaggtttctggcacaagaggcagcctaaataagactgttgcacgggtggtatccaggtatcggcaaagcagagttttaaatagacagaagaaagacaacactatctttggtatcaactgcaggtgtcagcccaaatgcgtagtgaatatcattaaagaattcgatgataggaagaaggagttgattggtgaaattggatttgatggacttttggatatcaagcttactaaggtaaacaggcagtttggggcatggctactaagcaaagttgatccgaaatcatgcgctactgttaaagatgtcaaccaggagttgccattcggttccaatgatgtgaatgcagtttttggcttgccatgctcaggtcaacctattatcccttgctctcaagatgaattggatgggaagaaacaaatattgtgtgaaatatttaagataccaaacttttcacacctgaaaatatcactcttaaagagaatcctaaagaagcagtatggttatcccatgacaatagatgaaaagagggttttcatggcggcttttgtgctttatgtcacaacgaagcttttggcaccgcaatcctgtgcaaacttcatatctcctaggtctattatggctgtttctgatgttgacaatataaaacagtacaactggtcccaattcgttgtagatgaggtgaagaaagcagcagaatcaatgcccacctgctttccgaataaggctcaactatccattaacgggtgtatcatctttctaatggttagcatttaaaactgacttgttaatgcagcatataatcaacacacatattgtcattgtgaatcattttttcaggtaaaatacttgagaaatctcctgttccggaaggttgggatcacatgtgttaaaacatgtcacatttctcagtttgaggatgatcaaattgctaggatgattcaacaagatgtagttagtaaacataacccaggattccccttccctcgttatgggaaactccaggtatgtacgataccctggccgtaatatgcctatttcgggctgcaaaatttagctaatttccaacatacatgctgttcagttgatgaaggatccaagagaaaacaacccccatgtgccagagctatctcccctaaacttatgctcctgttcgaagatcccatctagagccattgatggcggtaaaaatttaataaaattcctggtttcacacttctcttcgttagacgtacatagaagtgtcgggtcacaggtatgtcaaccatccgtatgctatgttacttgattgtttcttcattaagttgtaattttcatatgatcaagggattttaaactaacatgtggtatatatgataacataaaacaggcatacgaggagttgaaatcttccgttcaggatggattcgatcggatcgataagattttgcctaccatatcagatttcgtcgacataagcaccatgcaaactgctattcacgcatctaacctattcaagagagctttcaagactaatattacagtggcagttaagatagtgataagggcagcaataacgaaagttattgataccattgaggatatacaagggcctctccatccatggggagacacaactgccatgggataccacacacccacaaactactccacacatgctacaaaagatgctagtcaattggaccaaccaaccaacacggtcaaacgttaaacgtgaatagtgtaaaactgcacttattttggatggaggaagtatatctttaggccgtgtttagttgcaaattttttcttcaaacttttaactttttcatcacatcaaaattttcctacacacacaaatttccaacttttccgtcgcatcgttccaagtttaaccaaacttccaattttgatgtgaacaaaacacagccttaatatatcaccaagcttacactacaaaaatgaatatatcttcaatcaccatgtgaaaatattccaaaaatgatatgtagatatatcaggtaacctaaaaatatgtcattcgttgagacatgtcattagttcagacagtagccttcactatttgtaaatacatttccaaaaatatacatagtttttccttaaaaaatagatagcttcagacaagtacttgcggcggtgttccagacacaaaaacatcccatgtatgcacattatttgtgccatcatataattgatatttatatatatctccattcaccaaaaaatgcatgcacattaaggctgtgtttagttcacgccaaaattagaagtttggttgaaattggaacgatgtgacgcaaaaagttggaagtttacatgtgtagaaaagttttgatgtgatgaaaaagttgaagtttgaaaaaatatttcggaactaagcatggcgtaaggctgcgtttgatacttggggttaggaacccaactcgaccgcacggaaaatggagcggtctattagcgcgtgattaattaagtattagctaatttttttaaaaaaaatggattaatttgattttttaaagcaactttcgtatagaaactttttgaaaaaaacgcaccatttagcagtttgaaaaacgtgtgcgcggaaaacgagggagaggggtctagaaccttgtggaaggaacgcagccaaccatggaaataaaccaggtgcattacatccaaaaaatgagagctcattcttgatccagttgttttaggaaaaatctaggcactgtgttttccagcccagccaattggcttattcatattttggtaggtagaagctggaaaataaacaacagcattcaccgtttctatctacttgctgacaagctttgtagaaatggtatatctctattcagcaaaaataatgtttacaaacttacatacgatctattatatgtgtgctgacatttttatttttagagatgataaaaatagatgggcagatggcacagttctagaaggcctagagggtgagcatttcagcaaaaacaaatagatccatctagggaaaaaaaatagtgtcagatcaaaaaacatgatacatctgtaaatagcatttcaaaaatacatttctctgaatcaacgaatgatagatttctaattgacagtcagagcatgatgtttctaagccccataattttcaaaacatttcagagctttgacacctgttgggatacgcgtaggctacaatagtataaattaaaattttctatcgcgtaaaccaggaaccatgcaagtattagatcatagatcgttaccactcgacgcactgcgcagtggaagaagacgctgagaagtcgaaggaactctcgcgaagtagcgcgcgtcgatgtagaggaagtagtcgatcgcaccagctcgaccttctcctcctctgcgttctcctcgccgtactcccacgccgatcagcaccacaaaccagcagcgcctctaccggtatccacacgtatagggacggaacgccacgtgcagatgtgctagcacccgcgcgtggctagggttttgctcggggagggaactgatggctagggtttctcacgtgatgcaatgcctccgccggtcacacccctcacgaatatataagatccatcactcgggcctccaaggcccgtaggactcctattcggatccctatccgaattaagctcatattggatctccatccaatccccttattccggcccattaagcgtgcgaccttgtaggttcatgtatactcggctgtaacccgaaaactccttttcggtccacgcgtcaacagcggcccctagcagaacatattgacccaccgggcatacataaagatcatatcggctgaacctctagtgtatacttgtatgaacccctttgcctcacgatatcgattaaactcaaggctagatatgtgccatcctctaatagctcaatcattcaatcgaacctgttaatagattatataacttgtgattgactcctcaatcacctttggcatggccatgcacttccataatctacaacattgaccgcaacagcagcaactcttgctccattgcccacgcgaatgtccactttgcctcttgctaagtgtcacgcccagaaatttccgaatagaattccaagcagaatgtgcatttaaacccccgtccaggaccggccggggtacacaaacgacaaagttgacaaacagatccacgtcttacaaacattataaaagtcttacataaatgcagcggaaaattaaaagataaatggagctaagccttgacttggactgcagcgggaacaccactccataggcatcctcgacggcatggacgaagcctactcctcggagaagccgccatctgacacgcactcaatctttggggttttggggaaaatagagcaagactgagtacaaccaccatactcagcaagtcataccggaatagagggtatgatgcaggatataatcaaaggatagatagagcggttcatttgcataaatcgagcatttataaacagtagttgaaagcagtaaaatagttgtaataattaatcaatattaactatccactgtccaacgctacaccacgttgcaacaggcccaaccatccacctaaactactcaattccattagactaagctagggtgagactaatcacggtgaatctggttgaccgcccgtaaccgcgggcacggctattcgaatagttttactctgatcagaggtgtacaattgtacccacaagacacagccccgcgacacgtttccgtgtgccgacatgccaccatgacataccggaaagaggccgtgacaggacccttcgcataaccccctctaaccaaacacaccacaccttaggtttcacccccactcctcgcaaggcagcgggcagtcccctcttgtgcctaggtgaatccggaagccgcataggccgtcgcagggcccatccaaactccatcacgcccacccttgcctggatgcgttagctagaggaaagctacactacaagcccagccgttgcccacgctagcttgtggtaagtacgaggaattctttcagggtttcccgcgaaccggtccttaagtgccatgggcgtgactatcaaaaccatgcacccacagccgacaatttaatacattttaattaaccaacaccggagcggtggcaataaccaacatcattactagaatctgatacctatggattaatgtagtcccccattttgtactagttgaactaagcatggctaagcacttcctaatccaacagcgaatcattttacaaccccaagctaacaaaggagcgaggtacaaaaatagcatggctgtaacagtaggtaaatatcccatagtaacaatttaaaacaatgtagtatttaagggaaaacggtagagcatttgcaatatatgttcaatatgttcaagtgacaagcatgacttgccttgctctgctgctggaggaacctcggcgactatttcaaaatacaccggagcgttgggagagcaggaatctaagcgacatacaaagcaaacaatacaaacaggccataagactactgaaacagagaacaaaaccatttttaatagattctatgcattttttcttgatttactaagacttgaatgggcttaaacggagctcggatgaattttctatgaattttagaagattcactgtgttttactataaagagaaaacccttaattatttattgcgcannnnnnnnnnnnnnnnnnnnnnnnnnnnnnnnnnnnnnnnnnnnnnnnnnnnnnnnnnnnn

SEQ ID NO: 53116 - DNA, 8009 bp, Oryza sativa
ggcccgatttccccggccgacgtggggaggtggaggtggaagaagaggcgggattcgaaattcgaatcccaccatctcggggtcgcgggtgagcgggacagggggttgaggggcgcgggaggggcgggtgtggccaacgtggcgcggggaaggtgggcgcgggcggcggttgccggcccgggggggagcggctggaggttggggaaagggctgacaggtgggccccacctgtcagtgcccgagggagtgaggggggctcaggcgagcggctgggccgtggccttcggccggcccagcaagggcacgggagggggaggaaatgggctggcggcccatttgggaaaaaggagggggaaaaagggaaaaagaaaaagggaaaagaatttccagggattaaatattgcttgtgctcgtttttaattgcttaaaattatttccagagctttgaaaattccactaaaaatcttgttagtatatttcgacatgtagaactcatgaaaaaattgcacatgccaattccgtttattatttgcattaatttattggggtttctctcttgcttttacaccgatattttctctaggtgatttataaattcaatttaggcttgggaaaggaacttcagggtgtgacaaacctacccccttaaacggaatctcgaccccgagattcggaagagctggcgaagaggtgcggatgggcggccttcaactcatcttccctttcccaggttgcttcttcctctgagtggtggctccactgaaccctgtagaacctggtgaccttgtttctagtcctcctttcattggtctcaaggatgcgaactggcttctccacataagtcagatcttcttggatatcgatgtgctccgaattggcttgttctcccagtacccttaagcacttctttaactgagacacatggaacacatcatgtataccggccatgttggatgggagttctagctgatatgcaacttctcctctttgttccaagattttgtatggtcccacgaagcgtggtgccaacttgccctttatctggaaacggtgcactccccggagcggagtgacacgaaggtacacataatcccccacttcaaaagtgagctctcttcgacggttgtctgtgtagcttttctgtcgagattgtgcaatcctcagcctttccctgatagttctgactttctcctctgcctcagttagcacttctgtcccgaacaactgacgttcgccggtttgatcccaaaagagaggtgtgcggcacttccggccatacaatgcttcaaatggagccatttgtaaactggcctcgtagctgttgttgtaagagaattcagcataaggcagactcttatcccaagctccgccaaaatcgagtgcacaggctcgcagcatatcctccaagatctgattgaccctctcggtctggccatctgtctgaggatggtaagctgtgctgaaatttaaacgggtccccaattcctcttgcagcttctgccaaaattttgaggtaaactgactccctcgatcagatacaatcttcttaggtaccccatgcagacacatgacccatgtagatacaatcgtgccctgatgatgtcctgggcaaacccgtgatgaaatccattccaatttcttcccatttccattccgggatctagaggggttgtaataatcctgcgggtctctgatgttctgccttaactcgctgacaaacatcgcagagtgcgacaaactccactatttcccttctcatgctggcccaccaaaatttttccttgagatctttatacatctttgtacttcctggatgaatggagtattgagtctgatgagcctcggtgagtatcaggtctttcaaatctttctcccaaccagattgtgccatgttcatcttcatggaaatcctgggcttttccgaccctcatattctttttcagctcagctatttcaggatcatttacctgagctgctcggacctggtccacgagcatgggctgtgcctcaagggcagccacgtacccgtgttctacaattcctaagttgaggggttcaagctcttgtagcaacttgtcactcatgtctccaatacccaaggcgttgcagtagcttttcctgctcagagcgtctgctactacattagccttgcctggatggtagtgtatccccatgtcgtaatcttttatcaattccaaccatcttcgctgtcggagattcaaatcaggctgggtgaagatatacttcagactcttgtgatccgtgtaaacttcacaacggttaccgacgaggtagtgccgccagatttttagagcgtggactactgctgccaactctaaatcatgggtaggataattgctttcatgtgggcgcaatagccgcgaggcatatgcgaccacttgaccttcttgcatcagaacacatcctagcccttggcgggacgcgtcgcagaagacttggaagtctttcgtcttatcgggcagaatcagaactggagcagacactaatttattcttgagctcttcaaaactcttgtcacactcggccgtccacttgaacttttcttctttcttaagcaactgagtcataggtctggcaatcctagagaaattttcaatgaaccgacggaaataacccgcaagtccaaggaaactccaaatctgtgacactgtcttaggtggggtccactaggtaacttactccacattcgatggatccactgccacaccttgggccgtaatgacgtgacccagaaatttgacttccgacaaccagaagtcacacttactgaacttggcatataactagtgctccttcaacttctcgagtaccagacggagatgttgctcatgctcttcttccgacttggaatagataagaatgtcgtcaatgaataccatgacaaacttatccagaaattccatgaacactttgttcatcaggttcatgaagaatgcaggtgcattggtgagttcaaaagacataaccgtgcactcatacaactcatactgagtggtgaaggctgtcttgggattatcctcttcccggattctcaattggtgatagcctgatcgtatgtctattttggaaaacaccttggctcctttcagctgatcaaatagatcatcgatccgcggcaaaggatatttgttcttgatggtgacctcattgagtgcgcaataatcgacacacattctcttcgttttgtccttcttctccacgaaaatgactggagcaccccaaggtgaagtacttggtcgaatgtaccctttctgcagttgctcatcaacctgcttcttgacctctgctagcacgttggctgtcattctgtacggtctcttgtaaattggagcagttcccggtgccaaatcaatccggaattcgatctccctcttgggtggcatggtagtgaggtcctcagggaacacttctggatactcgcagacaatgggaataccttccaatttcctcgaacccttctcctcggtgaccaccggattttccacctcaatctgattcaaggagattccctgattcggtgagactggtgacttgtacaccatggtttctcccttctcattggtcaaagtgactgtgcgattcgcacaatcaatgacacccttgaacttggtcagccaatccatcccaaggatgacatctaggtctttggattcgagaaggatgaggttgggtagaaatcgtgatatttggatttctattagcacggaagggctataactgaccgaggttgaactatttcccggggtatgaaccctcattggtgtactaagctcttcttttcttaacccatgcaccccaacaaacttctttgaaatgaatgaatgcgttgcatcagaatcgaaaagtactgttgcagggattgagttaacaggaaacgtacccaatacgacctctggtgctgcttgcgcctcttctgtggacgcgtggttaacccgagcctggacaaacttgggtccagcgcgcctcggcttcgggcacttgttggcgaagtgaccagactcaccatagttgaagcaggctcctggcttgcctccggtgtccttctttgggggaacgggtgcagtctgctgaactggcgccattggcgggcgtggggctgcgccgcggttgtgctgcccttagccaagatggctgccactgctgccgggatggaagttgcttgggttgtaaggatgatgctgtcgaacaatcatggtggtaggtccaccctgttatccggaagtgaagcacggtcgctgatgacttccttggttggatcggaactgagttgcctttctcttcctatccattttgttgcgctggtcctcctgacggattgccttgtctaccagcttctcgaagttagcgtaatccccggagatcaactggttggtcagttcgtcatccaggctcgctaggaacttctcctatttctctgcgtcagtgcggacatcctccggtgcatatcgcgctaggcgattgaactcatgcaagtactcggttactgtcctgttgccttggtggagtgcccggaatactctcttcttttgtgccacatcctcgtctagcacctgagccttcctgaagctgcgacagaattctgcccaggtgacctctgtgcctggcggacgggtagccatgtggttgtcccaccaagctgacgcgggaccctggagctggtgtgtggcgaaggcgactttctccttatcactgcactgcagaagattgagtttcttctctatggcatggagccagtcatttgcctccatggggttggtggtgctggagaaggtgggtggcctgactcgtagaaactccagcagcttggactaagggggagggggaccaaactgctgttgctgctgctcagcctgctgctgcatcctctggtgcatctgctggtgctgctgctgcatctgctacatcatggctgccatcatctgggtctgatgggccatcacttatgcaagagtcggattctcggggagcggtggcggaccattgccggaggcactgttggggtatccaccgtcggtgcgttcttcgctgttgttgccctcacctgctgcacggctgccattcctagtgttgaccatctaaaggaagagcaggcggaggggatggaaaagaagaaaaaacatatgctcaggaactaagctttattatataggaatttaaactgcaattgttctgatctgaattaaaacacttaaaatagcaaacaaatccttattaagatagccacatcatagacacatgatgtcgaccgtcaactgacccataagcgaacaaacctaaacacacaactaacagacaactactaagcagtcgataagctaagggataatgggactaatgctcggaacggctcctgcggtcggtggagtcgaaggcgtcctcctgctcgtcgcctggcccctctgagcggctcctggagtactcaggctgataggtgctgccggtgcctgactccaagctggaactgctgatgaccacacgaccaccactgggagaagctggcagccatcctccactgccacctgctagacccctgtaggccgaagctggcacgaaagtgaagccgaactctagcacgggggctgaagatgctgcggtagatggagctggagctagaactggagctggcgccggagctgcaggcggtgctagaggtggaggctgcggcgggttcctaggcgcaagctggatgcgcactggagctgtggtcgacttccttggcgtggtgcggatgcgggctcctcctggcggtggacgtccctaaagcctagggacctccttcttgagtcgagcgttctcatcctgcagatctgcgatcctcacaagcttctggtcgttgagactcttggtcgctttgtggagcatggcgtgcaacttgtcgtagctcctcatcacgtcactcatgtggccgaaggtgacgtcgttctctccccacgctgacttgaaggtgctgctgttggagctggaaccgcggcaagggtggaagcggtaggcggtggtgttcaggacgccgtcatgcagctccctcagatgggccatcatcctgagggcggcctcctcacaagcatgctcaaatgtgcccccacaagctgtcacctccatgttgggcaggtaggtgggtatgtcatgaatctccaagcggacctgatgcgggaattcgccactgagggggtgaatgctggtgtactgcggctcccttggaaaaccaatcacaaacgctatgcgggacaactctgcaacgaagcctcccatagtctgaccttggtgcgtgaggggacagtcggccatctatagaagacaaaggatggagagtcaatgcatgctcaaatccaattataaaataaacggcaatgaactcaaataaaataagcgaatgagaccggaattttgtgcatagatcattttttttgcatgagaacgaacaaataagactgacttacatagcgataaaataatgagaaattagatacatactaataataacgataatagcataaataccttgcaacccatattcctgagttaggacctaatgcattcctcccatccaatcccgacttcactgtcaaataaacctcaaataattttactaaaatcctagactgacctgatttgacaaatctcacttaaacaagcgacaaagcttttttcccttgaaccacaggaacaaatcccaattttcccggagcaaatcaaattgcgaagaacatatgcaatgaaaaggattcagagggctcttaggttttccatttggcttgtcctacggtcaaggtcggctctgataccaacttgtcacgcccagaaattcccgaatagaattccaagcagaatgtgcatttaaacccccgtccaggaccggccggggtacacaaacgacaaagttgacatacagatccacgtcttacaaacattataaaagtcttacataaatgcaacggaaaattaaaagataaatggagctaagccttgacttggactgcagcgagaacaccactccacaggcatcctcgacggcacggacgaagcctactcctcggagaagccaccatctgacacgcactcaatctctggggttttggggaaaatagagcaagactgagtacaaccactgtactcagcaagtcataccggaatagagggtatgatgcaggatataatcaaaggatagatagagcggttcatttgtataaatcgagcatttataaacagtagttgaaagcagtaaaacagttgtaataattaatcaatattaaccatccactgtccaacgctacaccatattgcaacaggcccaaccatccacctgaactactcaattccattagactaagctagggtgagactaatcacggtgaatctggttgaccgcccgtaaccgcgggcacggctattcgaatagttttactctgatcagaggtgtacaactgtacccacaagacacagccccacgacacgtttccgtgtgccgacatgccaccacgacataccggaaagaggccgtgacaggacccttcgcataaccaaacacaccacacctcaggtttcacccccactcctcgcaaggcagcgggcagtcccctctcgtgcctaggtgaatccggaagctgcataggccgtcgcagggcccatccaaactccatcatgcccacccttgcctggttgcgtcagctagaggaaagctacaatacaagcccagccgttgcccacgctggcttgtggtaagtacgaggaattcttccagggtatcccgcgaaccggtccttaagtgcgaagcccaccatttaatacattttaattagagataatcccttatataccactgaaagttgatctaatcccttatatgccactgaaaattggctcttcccttatatgccattggtccaaatttgcgcaccctctcatgccactaccgttagttgaccgtgtgttgaccgttaactctcaagtaaaaaatacatatttgccctctctgagctgttaggcatgcg

SEQ ID NO: 53117 - DNA, 922 bp, Oryza sativa
taaatatgtcttttttccctgagaattaacggtcaacacacagtcaactgacgggagtggcatgagagggtgtgcaaatttggatcaaaggcatataagggaagagccaattttcaatggcatataagggatcaaaccaattttcagtggcatataagggattctctcttttaattaaccaacaccggaacggtggcaataaccaacatcattagtagaatctgatacctatgcattaatgtagtccaccattgtgtgctagttgaactaagcaaggctaggaacttcctaatccaacagcgaatcattttacaaccccaagctaacaaaggagcgaggtacaaaaatagcatggctgtaacagtaggtaaatatcccatagtaacaatttaaaacaatgcagtatttaagggaaaacggtagagcatttgcaacataggttcaatatgttcaagtgataagcatgacttgccttgctctgctgctggaggagcctcggcgactatttcaaaatacaccggagcgttgggagagccggaatctaagcgacatacaaagcaaacaatacaaacaggccataatactactgaaacagagaacaaaaccatttttaatggattctatgcatttttcttaatttactgagacttgaatgggcttaaacggagctcggatgaattttctatgaattttagaagattcactgtgttttactataaagagaaaaaccttaattatttattgcgcaatatatcccagggctgacgtcatcaaggagggggcggcgccgacatgcgggacccccgggtcagtgacttcgagagagagggaaggggccccggcacttcgccccacttgcaaaggcacaaagcgggagggacccggttggtggctccgctcggcttcaaaacccgccggccca

SEQ ID NO: 53118 - DNA, 719 bp, Oryza sativa
ccccgaggagtcctaaccctacggagcgacatcaagcaagctgtcacatgcgacaaggagagttgcgacatggcccaaacccgcgagatggcgtctgcccgagaggaaatccgactggctgcaaccacggcgagcgaaggagaagtgcccgctgccaagatttcaaaaagtggggaaaccgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggctaacccagtcctagttcggaagaaaacagggcaatggcgcatgtgtgttgattacactgatcttaacaaatcttgccctaaagatcctttcgggttgcctcgcattgaccaggtagttgactcaaccgccggctgcgagcttctcagttttttggattgctactcggggtatcatcagatccgactgaaggaatccgactgcttgaagacttc

SEQ ID NO: 53119 - DNA, 1248 bp, Oryza sativa
ttgaagacttcattcatcacgccctttggggcatactgctacgtcaccatgccgtttggattaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaacctttgcaagcatccgtgctttcaggatgaaattgaatcctgaaaagtgcaccttcggagtaccgtcagggaagctgcttggttttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggctttcgaagatttcaagcaactcctcaccaagccaccggtcttagcttcaccacacccgcaggagccgttgctgctgtatctatcagccacctcccaggtcgtgagcacagtcttggttgtcgagcgtgaggaagaaggccatgtccagaaagttcagcgaccaatctacttcgtcagcgaggtcctgaccgactccaaaacgaggtaccctcaggttcagaagctgttatatggcattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcaggcactggagctggagtggttttaatttccccgactggagaaagactaagttatgtgctttggatacatttttcggcgtctcacaacgtcgccgagtatgaggcgctccttcatgggctacggattgcaatttccctagggataaagcgtctaattgtccgaggtgattcacagctggttgttaaccaagttatgaaagagtggtcctgcattgacgacaac

SEQ ID NO: 53120 - DNA, 943 bp, Oryza sativa
atttcaaattcgagttcaaaatttggcttgaaagtcttaaaatttgggtttgaaagttttgacatttcagacgaaaattttgaattttcagttgaaagttttcaaaaatttgagttgaaagcttcaaattttaggttgaaagcttcaatgttttgagttgaaattttcaaatttgagctgaatgtttaaaaaaaggggttgaaagttttcatatatgagtgcatatgttaatcacgttacctaattaaaaaaatagaactaataatgaagaattataacagtagtcacattgtagattgatttgcctcacatgccgtactgcctctttgcctcgattcctatactagcacatatgcacgtgcatgcgccggcgctgccggatgaaaagaagatagaagtatgcttgggccttgggccttgctaatgatggccgaaactgaaacactcgctagatatttatccagcgcgtctgcaccaattagcaatttcgctagaaaacagccacaatgctaacatgtactacctcagtgtcaaaataagtacagctataggtatttaggtccaacgtttgaccattcatcttatttgaaaaatttatgaaaaattttaaaaaatagtcacacatactccctccagtttcattttaattgacgttttgggcaatgacatggtctacaaaatatatctttaaccttatttttctattataatatatacaatcaataaatacatgtttatttttattatagtgttttgaaagataaatctatatatgttgatctagtttctttaaattaaatatttttaaagttattgttggtcaaagttgtaaaagtttgacctcaacctagtctaaaacatcaattattatagaaccggaggggagtaaggtactatttatgttttatctgtaggatcgaacaacaagaaactatctacatta

SEQ ID NO: 53121 - DNA, 2661 bp, Oryza sativa
tactgctagatataacaattatacccctccacatgtttttttacaacaatacccctccgcgtttctactaccaccaccactaactaggatggtagcataaataaatctaaaccctttgatcaaatcgcgatcaacggctcaaattgctagagaacatcttagtgggactactaatattccttttaccttgatgctttcttattgggtctgacatattgcatgttgcactaggatatgcaaaaataaatttcttttttctccatgttatgccatgatatctgagtgaaaccttatgaaacttatgtggagctttgaggtactccataaatttttaccatgcctttaacaggaggtatgttagcgggtagctgatatagggtggaaaaattatgctaatatgtttaagcgattacacactttgtggatggactaatggcaggaacgaatgattttagagtgaaataatgattgcatatatgtaacttgtggaaagactattttccccagtgcatgcatatcattcaagagccaattgactttaatttgctcacctggtgagaaaactttataaacttggtctgagtaacttgaagaaaaaaaaagaattacttaggttcttaggaaaacatgatcaccaacataacaacctaatattcttcttaattttgttattttatttcttgtggtattcaatgtggaacaacacgacaattcatattggacgttctctcctgtataattcggcagattattgatcagcagtttgcttgcggtgtgcagagttcatcactcagggtccgatcgagagtgagggacgaggaataatccctctggcaccgaaaacatagcaggccattagcgcatgattaattaagtattagctaatttttttaaaaaaatagatcaatataaattttttaaacaacttttatacataaacattttacagaaaacacaccgtttaacagcttgggaagcatgccctcaacctgtctgcggcctcgaggagatgctggtggcagttgatacatcatacaatgcgtgagcacacgacgacgaatcgcagtgctagctgccggtgttgctacagctgcaagctgatcatccgctctgaacaattgcggagctagcaatgctgtgaagctcgggcgactagtagtgttttcgggtgaccgatgactgaattttatgcgcgtcaatggctaacagcaatggcgatggcagcggcagagctcaggtgactgccttacctacccgggagctatctctcgctggtggctctggatggcgatgatcgagtcactccacttactctctgatttaccatgctgctcctctcaagtactcaggaacatcctacatgtttccagctacctctcattctcagtgtcatcccctttatctaaatcaaattgatacatgggctgaacatgtaaaaaccaaacttgatctaataaaaaacttgtgaaactaaaaattattttaagaaataacaaagaaggtgaacaaggatatgcatacatgagtagttgatcactaagaagattgcatctcgccgcttcttccctgtattttctatgtttatttgtagtgataataatgcatgcatgcaaagatatatagatgttgttttactagtaagctaggagacaagtttaatctaaagtaaaattcactgttggctctaaatgttttccgcatcatccacaacgaatcttaaagtcgataggtcaaataatcacccctccactctagcaagtcgttgtccaagtctagtggtttcttgatatcaccagcaaccgccatccctattatacccagtgaatataatttcggttcgaaatttcgacaattttggaccccttggaagtcattatctcagccaaaattttcgcttttctctctcttttttaatttggttaaactttattcaaattcaataaaattgtgttgaaatttcaaaaatattcagttcaaaaggtgccgaaaatcacaaaattctgggaatttttcagtgctaccgaaacggccgaaattttaagtgaaatcaaaagtacttgaaaaccctgatttgtacctgctctaactaatggtttaacgtggctacattgagcaacaaacacaaagctatgaagcaactcctttctttattactcgatccattgttctatatatgtttggcagccatctagatttaatgaatccatgtgttgtccaagtgaagccaacacacacaatatgaagaagaggctcaactagtagctgccgtctcacgctgaggtaacatatattagtgtgaataataacggtgactcttcctctctggtgatcctatgttatggagctcttttgctgtccataaaaaaaaatctccagttttccctggtgcctctcgttcccatagtcacccatattgaacacaacaacatgtacatataatccatgtcctataaaaaataatatttagtttatttcgaagtcaataacttggacagcacaatactcaaactagtcatgtagctcatgatatgatgcatgtttgattctttaatgtcacccaatatatgaatgatgatgaccagttcatatagggaacacatgaggctacagttttcggaacagaagttatatggtttacatttagactgatgagtaatttgt

SEQ ID NO: 53122 - DNA, 725 bp, Oryza sativa
ccattgcgaaggggagaaagaagacggaccgccccgggtagtctggcgccgggcgtccctcacccagcattactatctcacggccggtggcagattccggcatgaagcggcgcggcaacccagcctgcttctcgctcacaatgcgagaaggcggcagcacgctaccatcaagcagtgcggagccccgtgccatggcgccggacgaagagaaatgaagagcgagcgcgtgtggcgaaagaagggcgcagggaagaaggagttaggacgcaagcggcgaaggcaagggaaatgatggcgaaaggaaggagacaaatcccatcctcagtgcctttatacccttgccaacgctgtgcccggctcctcgtttctcgcgcccattatttcgccccctcgtttctcgcacccacgcttccactaatcccattcgcccgcttgcggcgcgtgagatggatatgcggttgcggcagtcgagatagatcgtatcgtgcgcgcgttaattacgctcgccgaccgaagcgacattaccgtatctccaggcgaggcaaatcggctcgcccagattcgtgcgccgctcaggtgatgtggcagtcttgaagagaccgcccattattgacagccaattaccattaccggtgtgcatggtttgagaccgttgggtttttgcccaaccatggagaccggtcccacctgtcaccaggctttaggagtggcgtcacgcccggccg

SEQ ID NO: 53123 - DNA, 1095 bp, Oryza sativa
gtggtttgaagccgactcggttgagatggtcttgaagtggctttcagccgcgttcgggaatccaaacgggaccgaaagccggttctctcccgactggtctgattccgagtcgaggagagaaatcttgccgaagttgttggtgatgaagtcgaggctgccgaaccgaaacgtctgcccgggtgggaagacgaggtcgtcgatgccggagacggaacccattgcactgatcggcgagaagcttgacgctacccctacctggcgcgccaactgtcgaaactagatttcggcaataataaaagggggtggctatcaagctaggaaagtgtatgggtttggagacaaaggatttatacaggttctggccttcttataaaagaagtaataccctactcctgtccggggatgaatccgccgagtgtattattgattgtatgattcgggaaaaatcatcatctgcccctagaggcgcccggaccccccttatatatgggaaggagtccggattacaaaagataatctatattcctaacggaatatgaagatacaggtaaaatacagtcgtaaccgactaagtctctgggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcatagccttctcaaagataataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaagttcacgaatgaacacacttgacaggcatccgaatataaaaactctaaagattacccatca

SEQ ID NO: 53124 - DNA, 712 bp, Oryza sativa
gctaatattttggctgtggccaaatcaacaaatgttcgacctgccaattcaattgctttccaaaatatggctcgacaaaatgaacaactactccgggagaatcaatacatgcgcaaaaaacaggaacgaactgacaagttgttattggtatgaagttacaataatacttttactctcagttttactctcagttttagtttttagtttctaaacccagttggctactttttaaatgtaggcactttatgaaaagttgggtgaacaagtaccacaagaattggactgtccagtagaagaggaagatccatttgcacaggtaagcggagttcaattattttagttatttacctaagtattttctcctatactgctgcggttactcatagatgaactagctgaatatttatattgtgccagtacaatttggttgccctattgaaatagcaaactaatttgcattggtatgtcagagtgagaacagacaatgcagcacttacagtgagggattgggctcatgttgattgttgtaacagttggccttgtagtcacattctcaaataattgagatggtaagacaaaatatattattttaatttgagatgacttgcatcttgcacaaaacagaaaattggtttagaaggttatagttactccaacatttgttcaatatagtacaaaaggattgcataggaactttgatagaccactgtgt

SEQ ID NO: 53125 - DNA, 1069 bp, Oryza sativa
tagtcttcaaaactaatatctgacttcaaattactcgtatgctataatatttctagcaataaaattataatcatataaaagtaaatttacatgacatgatattattttcatcaaataaaacttaatctataataaaatatttattgatcaaatatttaaagagttgaattttaaaacgcgtgcgcaccatagtgagtgggacggaggaagtatatatttattaacaaattttatcctaaatattttatggatgtaattatagtacaatctagtgtaattacattgtaacttatatgtaattaaaatataacttgtatgtaactttcacataattttgaatcattagatttgttttaagatttgtgcaagcaagcaagaaaagaatcaaagcgcgcgcacacaagagaggattaagtctcacgacgtttgctttacggaaatagcatgttacaaagcgatttttagttatattgtagttacaacgtaattatattataattgtactataataatatctatcaaatttatggaggaaaatttatcaataaatgtatatgtagtctcaaatcctttattagaagtttgactgcttagtaagctttctctcttcattgaattgcttcaaacaatgaaaaatggtacggttagttctattaaattttaagagagtgacaccttttactactcgtcttcaaatatacttcgcgttgaagatgtactccctccgttttacaatgtaagtcattctagcatttctcacattcatattgatgctaatgaatctagacatatatacctatctatattcattagtatcaatatgaatgtgggaaatgctagaatgacttacattgtgaaacagaggaagtattatttaagataaaataagctttattaatctgagacaacgacacgtaaatgctacaattaatttaagaccactctcgaccttgtatagtgagtgtgtacacaacctggaagtattgagaaaaaacggaaagaaatatgaaaaagaatgtcatgacaatgaatatcatgtcgctgccaactataaagatgaccttcaact

SEQ ID NO: 53126 - DNA, 1586 bp, Oryza sativa
  unsure (1)..(1586): unsure at all n locations
catagcaaccaaatctaacaagtgaagagaactaccccactcccgagaattaacatagtcaaaccagctaacttttccatccacataactgcgattgactcccattccacagaaaaatccaccatgatgaatctcaattgtgaaatgcttcgaattagggcctacccatggcaaataaaacaaaacgatcaacaaccaactaaaaccctagctgcaaccctaactacccaaatagcatttcataaaaaaccctacttcccagctacaaaccatgcagatgagtgctacaccacaaggaagtgcggtacttacggtacacgggcgccgcctcagcttctcccctcaagctgaggtccatcgtcgcctgtgcgccgacgccagcgagggagccggagcacgccgctgcctatcgcccgccgacacttgcgcaggtggatgcgccgcccgaatcgcagccgccgccgatgatccccggagtcacctactcgccgcttcccctccctcctgagctgaggattggggaaaaataggagagaggcatcggatttgggattttagggtggtgtctaggctttactgtagcaataaggggtatattgcaattattccaagcctattggttgcggaggagggtatctgcaaaacgggtgcttgcgtggcatgccacgtcggcagtctgagccagaagtggggtttgaacctgccatgtatcattaaactaagatggtggatttgactctgcaatttacaagattgtggacctaagtaacacccgcgctcaagtttaaggaccggccatgtattttactcaaactaaaaatatacactggacggcacagttgatccatcatcctctaaaaaatatagcaaaaatgttggagaaacatatcgtcacgttcaaaactaaatttcaccacgaagaaattgagaattcactgcttcaagagttgaaaataggtagaaaactaccaagctttagtgacaaaggaaaataagcagtgaaatcttaagagcgtcagccataggtttactcagaattttacatttcagtgcaattgaagtacttttgaaagaaaatagaatagatcacatgttaacttgatcaaagtccaatttccatttattctgcattctgaactttttttatgttgtatatctacagtaatgaacattggaatcataaaaaaaaactgaaacaagctggaatgctgtaaaccagtaactgagccatcacagtagtatcaaatacacaagacctcaaacataagagagtacttcaatatttgatcacaaagttagttcaacaacctcatggttcccatcaaaacttaaacatgtttaataggacggtactccgaacaaaagctaaaccacataaatgtagtattatactaaaagatccatttctctggttcaggcggagttctcaggctcaacggcgaggcaaaatggccttcagcggtactgcaaggagaagacaagaaatttagagcattttcatttaaaaaaatttctagactatatgtaagttgattgannnnnnnnnnnnnnnnnnnnnnnnnnnnnnnnnnnnnnnnnnnnnnnnn

SEQ ID NO: 53127 - DNA, 1918 bp, Oryza sativa
tttaaagtgcctctataaagtgtctctacactataaaacttctgattttagaagcaatttgcaaaacgtctctacaaaagtgcctctatacgaggtttttgttgtagtggatggatggtcccaacaagtgtaaaatacggaaagaagtccataaaaaaatacggcccatatggaatccaattcatgggacattattttggggaagcaaaggtcccacatatttggaaaaaaaagggggaaaaatccggtccatatgtgatgcgtcaacctaccctttagcagaagcctgataagataaatgttcttgagatcaccaaacttcactattgcaccagtgagaaggaaatggtaaatttattgcatatccaaaaaaattacccctgctctgccctcacattatatttcctctagcttcttacatttttttttgacgaagtcaatatatatatgctcctatatatgcatggtagaagagcaaagaaaaaacagttaataataccgagcaaattgctaccacgggtaaagcttttatatatatatatatatatatatatgcattttcgctcttctgccatggcaaacacttggagaaactgaaggctatagttaattttatttaaactactcgcatatactaccatggttggatttctacccattatcaagaaatccacttgcatatacatgcgggggaagatgagacaggaggatgagaatgagaggcaaggaggaaaaatgaagtgcaacagaagctaatgcgtcgagcaaacctatgcaatattcagcaatgataagcatctcatgctgttgataattggagaaatgcacctaatgttatctttactgcagttcgaggtgcctctaaagttggtctaatttccccatggcagcaagacgaaagttgtactgccctgcaggcatctccagaaatatttttattctaaccgaagaaaacaaaacaagtggaaaattccaaagatgtacctctgtggaatctggtactaaagtgtgaaggaagagggtgggtggcaacgtcactggcagcggcgaggtggtgtgcgcggaggaggagcgggcctcggcaatggttgcctcccgggtcgccctgcagagagcgacacgggagtcttttcttctctttcaaatagtacttaattaggctgtgcatactcttttgtgatgaaaaattgtatagcataaaacatacacaccgttcaagatatattaatcatcactatagaaattgtgtatatagccacccaagtgtacgggactaactggatgaaagaataggcgagtcaggttgtaggtgttcacaaattaaatgctttcactatctagaaacaaatgaaaacgagttgttcttttaatttcccagctggtagaattaatagaccgacaaaagaaattctctccatgcatggccctaaagaaaatcacaccccaaatggcttccatgcaaatacctatatcagcccatgcgattgatttgcacacctgaatactacctccgtttattaatgtgtttttttaatatatgatgctattgactttttaattaacatttgatcattcgtcttatccaaaacttttgtgcaaatataaaaatatttaaatcatgctttaagaaagtttgatgataaatcaagtcataataaaataaataataattacataattttattgaatagtcatacgtatctcgaacagtgaacgccatcatatattaaaaaaaaaggaggcggtacatgagatatatatatatatatatatatatatatatatatatatatatatatatatatatatgtgtgtgtgtgtgtgtgtgtgtgtgtgtgtgtgtgtgtgtgtgtgtgtgtgtgtgtgtgtgtgtgtgtggttctccatataaccagcttactagctggtactatttgtt

SEQ ID NO: 53128 - DNA, 1642 bp, Oryza sativa
atactatacgtatgtaatactattgtttactgctaatgagtcaagttggagatagcttggtctcggaatatggtttctttgtttgttccatgtgtaggtgactcgatgtctcgagagagtatttgcggtaatggactgggagtcggcttggggataaaacgacgtccgtggtggtcagagatcatgcgggatacttaggctagagttgatgcacgtggttgatggagattctatatggcataccatggaggaattgtgtgctatgggatgcggagtcgaatttggaaggagtccaaatttggtactattggttatgtaaagttttttcttgtaataatgggtttcctaaggtgtttaggactcctagtatgagtttggttcgtggctttaggctgcctacctcatatataaatagagggggagcgtgaggcttcccggtatcgctttagagagcaatagagttgagttttgagttagggttttgagtttagtcgaaatttttgtgaggagtgctgttggtgcactttgtaaatacagagagaatcaataaagtcgtcatccactttaagagttcttcgatttgtgtttatcgggtttcggcggtctaaccggcgatctaccggtggtcagactggcagcataagggcggtcagaccggcggcagcagcaggcacggcaggcgacttcagcggtcagaccggtgaatctataccggtcagaccggtggcatccgagcggttagaccggcagatcaatctcggtcagactgatctccgtcgatttcgagggtaacttttatttccgctaaaagtttttcgtttttgggtataccaaccattcaccccccctctggttggcttagttcttgtgattcgatcctacaagtggtatcagagtcttgttttcttctttggatttttatcaatctagagtttttgccatggctactcccgctcgtttctcaactgagcctcatgttttcgatggaacagatttttctcattggtgtagtaggatgcaatcttacattatggctgaagattatgatatttggagaaatgtttctcatgcttatcagattcctgaagctattaatactgctgctgaaaaaactgcttttgaacaaaattgtaaagctcgcaacattcttttgagtagtatttctcgttctgattatgatcgtgttgcgcatcttcaaactgctcatgagatttgggttgctttaagtaattttcattaaggaacaaataatatcaaagagcttcgtcgagatattttcaaaaaggagtatattaaatttgaggtgaaacctggagaagctttggatgattatctttttcggtttaataaaattttgagtgattttagatctgttgattcttcttatgatgctaatgatcaacaatctgagatttctcgtcactttttgaatgatctcgacatgtctatttgggagatgaaagttacatctattcaggagtctgtaaacatgtctactttgactttagattcactttatactaaattgaaaactcatgagatgaatgttctttcttgaaaagttgattctaaatctagtgctttggtttcttcttcttcttctttggatgttgatgcttcttcatctaagtcttcttttctt

SEQ ID NO: 53129 - DNA, 1081 bp, Oryza sativa
  unsure (1)..(1081): unsure at all n locations
gatgttggtgctagaagtggtgagattttgattaaacatgatactaataaaactgtgtttaaatctgctggtatcatgtctaccatgaatgcatcttcttcaaaatccaatgttgtgcatgcaaaacctcctgtttctacttgtgttgctaaatcttcttcctctaacaatgtgtctaaacaacgtgaaaaatatacttgttctttttgtggcaaagatggacatattgttgatttttgtttcagattagctcataaacagaaaaaggagagagagattgcttttgcaaaatcaaagtggcaaaaatcgggttttctctcgaggaaaccggtcagaccgtagtgggtcccgcggtcggaccggcgaccggtcagactggctgaacagcctcggtcagaccgagcaccggtcagaccggcggtacagaggcggtcagaccggtccccggtcagaccggccactgtacctcggtcagaccggcctcggaggaatttttctgaaaattctaaaattgattttgcatgtggatttatgcctattggatcttctggtcgtgtgtctcattactggattcctaaatttttattatcatctaaccccagtactgaggcttcgacttctgcttgtgtgtaggctttggtggcaaggaaggagaacgtgtggatcgtggattccggttgttcgcggcacatgaccggtgataaaaattggttctcctccctaaagaaggcatctaagattgaatcgatcatctttggtgatgctgctacaagtgccgttctcgctacaggtatggttaaggtaaatgaaaaatttgaattgaagaatgtagctttggttgaggacttaaagtacaatttgctttcagtttctcaaattgttgatgaaaatttaggttcactttaaaaaactggaagtaaagtttttgattcttgtggtaattctgtgttgaatatttctcgctatggaagagtgtttaaagctgattttgaaaatcctgtttcacctgtgataacannnnnnnnnnnnnnnnnnnnnnnnnnnnnnnnnnnnnnnnnnnnnnnnnnnnnnnnnnnnnnnn

SEQ ID NO: 53130 - DNA, 861 bp, Oryza sativa
gatcaggggcctgcgtccgactggtttccagtcgggggctcttgagttgttgccgtttcagttgttgccgactggtttctagttggcgacaggtcactcggatcggccctatcgcccgaagcatgggtgccagttggctggctttcagcggtcggctggttttcagcagtcggctcggggtccttgggtatattttgctctgtcatggcaggatcggggtcttttccagatggatctatatcagatggtttcctgcagagtgttctttcagtatttagcattatcttcattggaaaacatgccgaagcggaaatcataccgagagatctaatacctggaagatgttctgatctttggcatcgcacggccagccagttttttcctgggcatggtgcgctttgggggtttattaggcgagcccttatctccagatttatcatcgtcgccttcatcatcatcaagtaccagctttctcttgcgaggacctgtttgaccagttaatttggaagtctgaggttgcggatctggtctgatcgttggccctccacctccctgagcggtgtgttggcaaggagaccggcgctgagtgactggtggatctgacttcatcaatgcatatccctgaacaagatgcttccatagttagtcaactcagcatgaagataaaattatgctctgatcacggtttgagggtttctgatgcgtacctgtggaggcggattgaatgcattatatggcacaactggcagttgatgagagtagctgactacaattgcatttgagaagattttatacatcctctccttcatgattttgaaatccagggaatctggttcttcacggttgggatcatgtttgccg

SEQ ID NO: 53131 - DNA, 1302 bp, Oryza sativa
ccccgagatggccgggattcgaattccaaatcctgcctctctctccacctccacctccccacgtcggccggcgaaatcgggccactcccggctgttctcgacctctccgcccctatataatccatccccacatcctcttcctcatttttcctttttccgccagcctctcccaagctctccaccgctcccgcaccgtgcacccatccgccgccgcctcttccactactccggccacctctagccaccgctagggcctccgccgcaccgcaccactgccaccgtcgggttcgcgtggtcgaggtccacctcgtccacccctcctccgtcaaagtccgccgccggagcccgcctctccccaagcgtcgatgagcatctccattaccatcgcctttggccggctatgctgtgcgccgtggactccctctctccctctaacctctctcatcgtgttccctatgtctctcccgacgctgcccgctgttcgccgacctccctccatcactagtcgccctcgttcatcgtcagtaaggccctccccttcctctcctttctctccgccgctcgccacttgtgcaccgccgtcgcgtcgcggtgccgtgtcgccacggtggcgccgctagccgcggtgccgtcgcgtgccgccgcttgccgtcggtcgccgccggttgccgtcgccggcgaccgcgcgtgccgctgccactcgccatgctgggccggccggttttgaagccgagccgagccaccagccgcgtccctcccgccttgtgcctctgcaagtggggccgacgtgccggcgccccctccctctctctcgagtcactgacccgggggtcccgcatgtcggcgccgccccctccttgatgacgtcagccctgggatatattgcgcaataaataattaaggtttttctctttatagtaaaacacagtgaatcttctaaaattcatagaaaattcatccgagctccgtttaagcccattcaagtcttagtaaatcaagaaaaaatgcatagaatctattaaaaatggttttgttctctgtttcagtagtcttatggcctgtttgtattgtttgctttgtatgtcgcttagattcctgctctcccaacgctccggtgtattttgaaatagtcgccgaggttcctccagcagcagagcaaggcaagtcatgcttgtcacttgaacatattgaacatatattgcaaatgctctaccgttttcccttaaatactgcattgttttaaattgttactatgggatatttacctactgttacagccatgctatttttgtgcctcgctcc

SEQ ID NO: 53132 - DNA, 1190 bp, Oryza sativa
caatgttttgtcagtgtatatgtactactgaagtacaagttacagagggactgaattggctcaatctgtacccgtgtggaatcattatttctacaagtacattatcagcttcttttttgaatctgacatcatgcacgttgcaataggttatgtgaaagctaattcataaattttgatcttgttccacaattttttcatttaaattgaatataacagtgtcgatccaaaacaaaaaattacatagtaggctctggtgcaaaaatgagtgtctagtatttcatttagattgaacgtaactaggtaattggattggtaagaccaacctagctaagttcttgttcctcttcggccagcccggatcgagctcatcctagtcaggaacaaaatattatgcatggatctaggtgctctagtagagaccgacaagttttgcacacacttgcatttgcatgccccaactgagctgcatcgatcgatagatcctgaactcaacgctcatcaagagtctatgaggttgttgcattgctaccaaacgtacgtactgagtctcacggatgagggaagacgactgagctgctttcttaggtagcacctaaccttgttacaattttcttacattatgtcttcaaatttcaggacatatcaccttctctgccacttcatttttcctagatgcctctcatttccatttgcccttatttactatttatcgtacttccctattaattagtaattccagcataaactttggaagctcctagctagccatctaaccactattacttcaggacataggaatttgttagcaagtaactagccaatcctctagtactaccctttgacgcctctcacacaaattgatgttgaattagttgatacgaattgaattagtcgccctctggacatcgaagacctgaatttttcattctcatgatctaagaagaagatcgcgccgagacaaattcaaacattaattgaattggctctgtttcagttgaaagaagttcaaactgcgctagctactgctatcgagtgcggttatgacgtcaacagtggggaacgatcttcctaattcctctcagcctcatcgctcatcatctccatgcctgccagtagcatccacactttgggatgttgttcacctcaaatatcgtcttatttctcgtgtgtgtgtatataggattgaaatt

SEQ ID NO: 53133 - DNA, 2443 bp, Oryza sativa
  unsure (1)..(2443): unsure at all n locations
cgaggaaccatgccatagctggtactgtggcaaattctgcaagctgatcaaattctgaacgccggtgatcgacacactccacttgctcttgctgccatgctgctcctctgaacttcacagcaacagcctacatttttccagctgcctctcattcccagtgccatatatatccttctttttgaaaagttaatactagaccggatccagtcatctgtgacgggctctaaccctcacctttaacggatttggttctggtcaaagacaagtggtcactgatgactacacctcatctttgacgggtgaaagcccgtcactggtaattaaaacctttgacgggctaaaaaatatagccgtcacaggtgactcacacctgtgacgggtgactctttgcaacctgtcaaaggtgacgaaacagctgtgactggttttagttctcacccgtcacagatatcaaaaatcacccaaaaaaaaagaaatgcctcagcccaaatgtacgaaatgaagaaaaatcaaatacatctcaagatgcacatgatacaacaactttgtattttaaatcaaatacatctcaacaaacaactacacatgaagcaatttgacaatatacatcacacaagtatccatgtccattttaacaaactacacatccacacaagcaacaaacatgagcaaatcaagcacaaacaacatcaagcacaaacaaattcggcagccggcggtcggtggcggaggcggccggccggtcgtggcggaggggaaaggccgcggacgctagatccgcctcccccgaccttgtggaggccggatatggcggtcatcgcactacaacaaaaacctcatatagaggcacttttgtagagacgttttgcaaattgcttctaaaatcagaagttttatagtgtagagacactttatagaggcactttaaaaattgcctagaaaacttttactctagagacatttttagatcagtttgttagattttatctcgtagaggcattctttcggtactataaaatgcgtctaatatgtaaaggcatttcgttgagacattttaaactatgtagagacactttttagaatgataatatgtactaaaggactaaatataagtaactagaggaacaagcatacaagtaatgacatggagttgagttggttagtgtattgaagattaaaatgatttaatcaagagatcataagttcaagacttgtcaaaaccaaggaaactattttattatcttttttgattggttttatatgtttgcggtacaatttaatgtctctagaaaatgcctctaccatcttatagacattttataaaatgtctcttcgtttgtagagacaattcaccataagacacttattagacattttttaaaatgcctctacattgttgtaaagtcatttgataagtgcctctacagtactagaaaaatgtctctacaaagcatttttgttgtagtgatcctagctagcaggcctttaattaattgtttatttcgcatggatttacactggtagtttattatgaattttacatgttttatactacatggatttaatatgctataaaattttctctatttaagctgttgctcatttctagtaggagaaatgggagctgcaaagccgtagttaaaaaaaaattctgtggaattatcagagctagttttgtcaaattattgtgcacaggattaaagagtagaaatcatcggtctaacaaaatttggtctgtctcatttggtgctaatatgtttcccacgaattttaaaagtttgcacattttttagttcagcagaatggacctgcaggtcagtgaacgtacggcaattacgcaggaaatccccttggctccatggaaagttacaggaagcacgtgttaaaaggaaaccaaccaatgtatatacaattacaattaagtccttggatccacatgcaattctaagcactcttacaatataaaaccctgaaaattttaaacactcgctaagaccggtcctggcacactaagcacagtatggcccacttgtcaacgacacaacaccgaggtagaaaaaacctctagcagatttggggatgaagacttggggctcctcggcttcgagtggcaggtctcctagaccgatttgaggtggcgatcgacgaagactgctaagctatcatgtggtggctgcatccaccaagctaggccgaaagcatgaaacacagaagcgaggcggcgagctcgactagagactgagtggcggtggcactcttggttctccgcggaacgagatgcaatgagagaaagaggaggttggtacagcagcttgctaaacaccgaggtcgggaggtagtcaacggtgaggtggccggctgacggcatgcactactacagaagnnnnnnnnnnnnnnnnnnnnnnnnnnnnnnnnnnnnnnnnnnnnnnnnnnnnnnnnnnnn

SEQ ID NO: 53134 - DNA, 3517 bp, Oryza sativa
aagaaaggcttagtgacactatccacattagtatagaacacaaaaagtgtttagtttgcaccaattaatcgtttcacatggttaaaattttacttaacttgggccaaggctactgttagtaaagcaaaatttggttaacactgagaatggagttatgattgaattacagtgagaatgtgaagtacggcgttgatcatggtactgaaattatcgaccaagatttctgctgggttaaagaattttgttaaggtgccaaatggaatggcaaaataatcaatctaaaattacagtgtgttacttttgttgcataatatttttgagaattaattttccaatgagtttaagttgaaccaattattttttataattttcttagacactcaaatgaatatatgaatcctagtgcatataagagccaaaaacaattaaaataaggcatgcacatggagaggtgctgactttatttattgccacattttcatacacataatttactgggtacacctatagtggtatgttacaaatataaaagtacaagtgttttaacaacgataatacatgttttctaatgcaaacatgtatatttggaccaacgcttgtaattgggcagtgaatgcagcaagtttgcaaattatttatttaactgcattggttcaaacttgtgtaaacagagtagccctccaagatgtaaatcatcaagctactgactgatagctattacatatctaccggtaatggatggcgaatgactggaacaagcgaaagatcatggagccgtcgtgctattgcccccatctcctccttcatatcaaggttcccaagctccgtctcatcaggaagctcccagttgaaatggtacaagagacttgctagcacaagctccaagttcactagaccaaaagctattccaggacatatccgtcgacctactccgaacggcatgtacttgacatcggttccatagtaatcaatgttgacatgctcgaatctctctgggatgaactcttctgcttggtcccagtacatagggtccctacttatagcccacatgttaacgagtatcatagttccttggggcacatcgaatcctaatacctggcttgtggttcggctttctcgtaggagcaatggaagacctggagggtgcagccggagcccctccttgatgaccaagtgtaggtaacttagattttttagggcttcctctgtaactttgtgatgtttgccaagcgctcttcgaacctcgtcttgtgccttttgcatcactctcgggttcctaacgagctcagccataatccatttcagcgtcgtcgccgttgtctcgctgcccccattgaacaagtcctgtatgacacatagccgaattttcattttttgcttagtacatgaattttgaacttaattagcttggtaaattttatggttttaggatgcttactccgattgttgtcttgatgttatcagtggatagcgggaagtcaccttttctctggatcctcaggagtacgtcaaccaagtccaagtcctcctggtcatcggaggaagatctgttctcttggtgctccttgataatgatgtccaagaactcgtacacttcgtcgcgatgccgcctcatctggcgaggccttctactgatcagctcggcgaggcgcgacgatgggtaaagatctggcaagctcggcgtggcgaatagcttcacaccgcgctctagcagcatcaagaacttgtcccggtccttgaaccggctccctatcagggcgcgcatcgtcgagtcggccgagtaggccgaaatgagctcgctaaggttcacggcgcgccgcgccggcgaggccgccgccaccgcccggagcagccggccgacctcctcctcgcggatcggccggaaagactggacgcgcttggcgctgagcagctcgacggtgcagatcttgcggaggttcctccagctatccccgtagggcgtgaagacgatcccctgcgagtaggggcgtaagtggctaacccgcgaaacccgcttataaactaaaataagccgcgagcccgtttattttaacttataagtgagttcgcggctgacccatttacacccctacctgcgagccctcggggaagaccagctgcattactcgggtggaggggcgcgtcgcgaaggcgaggtcgtgcgtcctcatgacctcgcgcgcggcgtccaccgaggaggccaggatgacttggaggccgccgagccggagccgcacgagcggcccgtggcgcagcgcgatgttgcgcatggcgtgctgtggcgggagcgcgcccatgaggtggtgcaggtggccgatcaccgggagagcccacggagatggcgggagccggacgctaccgccatcgcgacgacgcatggaacggatgaggaagaagaagaagaaaggggcgatgaaaagcaagagaaccagtagctgttgggggaggtgaacaagctgatccgccatggcttgtgttgtcttgcaccagatcgatacaaagttgccaaaatttttgtatctaagcaaaagagagttcacttgcatttggtttgctcttgcagttcagcagcttggttgtttatatagtccattcttcaatagctcgatctgcaccatcaacttgttgggccacaatttggtttgatgctagagtttttaaaaaccacactttgcaaccacataatcgcacatggtaaatacttaattatttgcttgtgtcttgcctatgttgtggctcacaacttatattagaagccacaccgtacaaaattagtgggttattagcaagtaaaaaatagctacttccttaattattagtcgcccggttttcttttatatatgtaccagtatctaagtacacttctagcattcacgcacaaatgtcataacctacgcacacttacacaatctaaattaaggtttcaagtttaattaattattagtacaaatgatcgaagtgtaattttcagtttgcgttgttttttttttattttctgaataattatttaagcattattatcctgcttcatatatactgataagaacttatgccaatacacttttttaagttttaggacagaaccttctcgctccttcaccacgagataattacactacgccagatcctcacacctctgacggcatatctctgacgggcaaagaaaacggtcactgatgaaggtcacctttgacgggtcctacgggatgccgtcatcggtgagccatccggccgcggcccgtcacaggtaactagtcatctgtgacgggccggaagtggaaaccgtcgaaggtggtgtaaacctcacctatgacgggtttcattttcaacccgtcacaggtgattagtcacctgtgacggatcgcaacccggatggccgtcaaaggtgaagtaaggccggcttctccactacttctctcgattttctcccaacggggcccacacctagaggagataagaccggttctccacttctctcgattcttctctccctctccactcgctctccctctccctc

SEQ ID NO: 53135 - DNA, 2758 bp, Oryza sativa
gggagattgcaggcgccggcgggatttggagatcatggccggatcccagccccaaccaccggatctggcggagccgcatccatccccatcctcctcccccttctttgtcctctcctccccattctctaatttgtagatccggtgattcttgcagcgacagtggcacggtgcggcggcgaggtgaagaggggcagcggtgcgcggcggcaaggcggatgtggaggagacacccctctcccccttcttccctcctccccttagaaaaatttgctcatgtgtgtgatggattttgtgaatgtgtgatggatttgtgcatgtgtgtgatggatttgtcccttactgtcatgggtgatagatttggaatttgggaatatatgtgatatatttggaaatgcagggaaattttgttatgcaaattaggttgatggatatattgttgatgagaaatttaggttatattttggctaatttgtgatggatatattttgtgctgctgctgatatataatttctaaatattggctagcaaatcctagggctagccaatatttagaaattattttttttctggatgtacctcctcactaacggttcatattgaaaaagccgtcacaggtaaccataccagtgacggctttgcacatacatgccgtcacaagtgacacacctgtgacggtttttactctccgagccgtcacaggtgagtcatctgtgacgggttgcaaaatggcatggattagcgcatacacttacctctgacgggccgtagagttctagcccgtcagaggtgactgtcattagtgacggtcctccacccgtcaaaggtgactggacccaccagtgaccactgatcactgaccaaatccaaagccgtcaatggtgagggtttgggtccgtcacaggtgaccctgtccagtgtagtgttaaagaaacacataaatgtgtgagttgttgatacatattgatctagtactaaaagagtgtctcataaacaagacaaaaatctcaactgcttgacaaatagagatagtctcaaatattagtgaatagcatctttggttttcttgatgacaatatatatatatgataaagttatgcatgtacaatcgtgtatgatctgtcaggatcattttcatgaattcagtacgatttttctgttgacgttgtgattcctaagatgaataattaatttagcgcgtgcgatgattgataagccatgcatatgcatccggcagtctcaattattggtctaatcgatctacatcacataaagaatactatctccatattttaatatatgacgccgttgatttttttatctaacgtttgaccattaacgtttgaccattcgtcttatgtaattatcatttattttattatgacttgattcgccatcaaatattctttaagcatgacataaatattttcatatttgcacacaaattttaaataaaatgaatggtcaaatgttgatcgaaaagtcaacggtgtcatacattaaaattaaaatacagaggatacagagggagtatattatactatcaacaaaacttgaaatgaacgaaccacattgaccgtagagggcataaaaatatctattttgtcttatcattacatattacgaagatagctcaaaataaaactggcactatattcaaagtggatgttcaagggcatggagaatagtgtgatgactgagatgtactgtttaggacagctatctgaaagcccgtgcttagctatgggtaaaagataatatattaatgtgttatccatcttttagctgtgattttttttatgaaaaagttgaagttttaactgtcattaatactatctttaaattttaaaggagtatgtatatgcatcatatcatgattatgacactatcacagcacacaggtggtaggtaacatgtttgtgcaagcatctttttttgaaccgcttacaaggtcctatacagcagcagggtctcgcatgtcaatttcacacccactcgtaaaaatcaattttaagactcgactcttttaagtaactgcccgagacaatgaatttttgggtttttttaattttgtaggtgcaaaaaaaacttaaatcaaccgttttcacccatgtttttttgggccacctgtgaaaaagaaagctaaggtctgtaaaaattatttttgtagtagtgtcatggaaagagaaagagtagagaggtgattggtgtttgttgattaattaattactatatggtctaatatatagcttaaatccacctatgctattgtagaatcaattcattactctaagaattaccacattaatcaatgaaaatgagatcaatcttatcatgatgtggaggttctatttaggcgtatacaaaagttttggacctgtaatgtggaggatctagctttttacgcaatgttttttaaaaaacatggtataaatgcagacgctcacaacacgtgcacacactcactcctataaatgtacgcactcacatccagtgacgaattcaggataaaaatagatggtgggcttaatagaactgaaatcagagggtgtcggttaaattgttgttaaacaattaataaatattgctttcttatgctttgcaatttgcaaatctaccaaacaaatgaaaactacgagacataaagatctttttctaataaatcccaatggccccatcatgtcattcattaaatagacaaatagattaggagtagaaaataaagaataatcgcttagaggcacaaaatcacagtagctag

SEQ ID NO: 53136 - DNA, 1043 bp, Oryza sativa
aaattcttgcttcaccttatctgcctttgtgactcctgagtcgtcttccttttcatagtaatcaaaccatgaggttgctggacggctgctgatgattacaccattctcatccttctcttcaataatgccagggtattctcgtttaagaataattcccatatgtgtaccatatttggggtctgatttcaatagagggtatgttacgtactcaaattgcctaaagaaaacacccatgtgagaattgttccattaagaggagaaaaacatagacaacacatgtacagagcttttgtatacatacacatattagatttgaagaacttgtatgctactcaatttatcacgtcacaaacatatcggctttgaacaatataaattctacagaacagaaataaagacagcctctaatttattggagcagttaacaaagtaataagcattagtagaaaatctgtagggttctagaaatgcagatacttactcatcaccccgaggtttcagcgcgatctttcgaccccgcggaggtacttttagtgcagttcttgagcccttcttcctccctcttttatttggtggcgcactgctcatgccacttccagcaatattggtggcttgggaggcattatcagtattgctactattaccagcacaaagtctttgggaggagttagcaccggagttactactgccacctccattaatcatttccgggactctgttttttgcattagtagcactagcattgctccttgtagagatgttcctgcattgttgctgtcttgcaagccgcttccgatcaatgccgttcatttcttgcaatgttatatccatttattagttttagaagagcaccatcggtccataaaaaaagaagaataatagcatatattttcatagcatggaatcattcaaacaaataataatccatcagtgcttaatataaaacctttataaagtacaaaatgaccttaggtacttaaagcttaaaaagtcatatgaaagttggcagctgcattaatataatttacagaccccaaaatcca

SEQ ID NO: 53137 - DNA, 2134 bp, Oryza sativa
attggactcgttttgttgtacatttcaaatagaaaataatggttcgaatagaattcaaatttgatgcaaaattgaagagatatctaaagtaatgaaaaaactaaagttgttcatcacctagatgtgccacgtcatgggaaaattagaaccgttggatgcagccagatattaaacaacagccgatggttctcaaaataaccaaagtaaaaagcttggtcaagggacttcggaagtcaactggaagactcgtgaatccaccacggtaatatccgaagacccaccaatattaaaagcccacgtgtccagcataatatatagggcatcacggatatagcccaaaataaaagaataagtcgaatttcatggatacctcttttaatgaacgaagaatgtttatttcttccatcattgagccaggtatacttatatagcataaacctttggatttggtgtgaacggttggattaataatgaagatcgatcgtaggaagagtcaggagacttccatcggagagatgaaacagaaagacaaaagtaataaaaatccattcatggggtaccgtcacgtaagagaaataaaaaaacaacacagttaaacttaattaaaataaaagctactactactaaatactcccttcattccaaaatataaggcacaaccacccttaacccaaagaccaagaaataattattatcatcttgtagtttgaatcatcctaataaatataatgcatgcatccaataggattagataacatgagagtggaggatttaaaaaagtaataatttaatggagaagatgtcatagttaattgcatgcttggaacatctaagacaagtggttgtgccttatattatggaatggagggagtatgaaatacaaattttctggcgaacttgttcaaggaaagtgtgtgtggcagcaattgtgcataggatatattccctaatttaaattcatttatacaagatggatgtaaggtgattgcactgggaacagattttgttttgggtacaatcttgatatgcatttgtgaaacaataacaaaaatccaaaaacaaaaaaaaaataattaggaagagatactaactttcagaatatgagaaaaattgaagcattaaaagaatttctaagaccagtcctcttcagtgctcatggctgcatcaccttcctgacttcctctgagctcggaatggcagatcacaattctgcctctctggtgcttcgtacgccagattgattattatttcaatagaagattacataacatggcaaggaaaaacgtaatcaccacaaaattgacactatcaagtgtgaccaaaagaaatttccctgttgccattcattctcaaggttagttgagtccacatcaggagcagaacgattatattatcacaatggctatggatgaaaggagaagatatatatagacaggaaagaagctatgaagaaatgatgcatagaaaaattcagtgtattgaattgatacccgttttttttctggtatgtgtctgtcaaaagcaattgtagctgttttttttttgtttttttaaaaaagaatttatgcagtgaacaatgaattcatacagactagttttattcctcttgtacaggttcaataacaattctttgtgggtacaaacatttcagttcagcattgtaaatacagatgtgctgatagaaaatgtttattccaaaataatagcggggaaagtaactcgcaaacacaggaagcaagtgctatttttcaaaagggcctgactttgctacagcatctggaggtacatggacaaattcacaatcattcaactctctagttctgaaagaatccattggcttcaagatatgacactacttgatcagccattgatttaggtgaagggcagtccccaactttgcactgtatcacaatctgcaaagagtaattcaaggtcacaatcagagaagttacaaatcatcctcataattttttttattttggaatcttttctcagagtagtactgatactgatgtttttattttattgagaagctgatgttagtatgaatatgaaagatatttggctaacctcacaatctgaaggtgtttcataaggatcatctatttccgtaaagcctgcatgcatgtaattt

SEQ ID NO: 53138 - DNA, 918 bp, Oryza sativa
aaaaatgcatatggggagcatagtgagatttgcataagttaccttggcaatcatgtgttcatgtggtacaaaaggtttgtggcaaccatttttaaccaggatttaactgattaaatgcttctgctgcaacttatgaaaaacaacattataaagacttacaaaagcatcaatttaaaaattatcaagtaaatattgtaccacctgcacattatctggtgtagaatgtacatgttcacatgattcttcaacattggattcatgttggatatcattaccaacttgttcagaaatatcaacctgcaaaaaaagcataatccatgcatatgtactgatcacatagtgtattcgttaattgatctttagacaggggaagatggtgtacagtgacacttacttctttattttgttctgcaaccacaatatttctccaatcctctccagggaatttttgttctatgaaggcacgcatcagagtcatatcaacactcatagcctctattttattttccattgcattcatttgtaacttaagcattgcatattcctcagattgtccaacaacatctagtccctgagaaacccttatttggctccaattcttatgatcgtagtaccctcgaagttttgtctcttttccaactacacgtcgaaaaacttcatcataatctttggatgaaagaccactgcaactagtagatttctttttagctaattcatggtaagccgattcctacataattaaacatgcatgaattagtttatcataaatgaaccaaactacatttgtgataacaactagcaaggaaagaaatttaccactaccgccttaatgcgctcatcctttttcttatgtgcttcatcccatacgtcaatgtcatggaccttccctttaacttttgcttcctaggcaacaaagaa

SEQ ID NO: 53139 - DNA, 743 bp, Oryza sativa
gcttggtggatcttcagaataacgatagctgtgcattgatgaaatccaatttacacaataccaggatactcgcagatcgggcacactacaagcagcaacaattgcgaccacaaagacgatgacccaaggaggacttgccggccaccattgagagtttcaaccaagaaattagaaaaatggaaatggaaggtagtggaaccctacccctttaggtcttgttctgctaatccctctctcacaagtggaccgagaggatttggaagggatttattccacacctattatggtgtggaatcgttccccctcaatcctctccaaacccccctttctcttagggattaaacgaacccttatggcagtgatgaactgctgttgatggaggggaatagggggccaaactacagagaagctaggggggattttgaatttgcctaacttgttgattgactgaaattaaggagagaaggcgatgtactaacctagatcgattcaatgcgcaacaaagaaacagcaagaagaatcagcagaggttaattgacccacctgtgtgcaaggaagaacggaggaacagcactgccgggcgccggcggcgggcagccgtcgtgtgcaaggaagaacggaggaacagcaccgccgggtgccgcggcgggcagcagtcgccagattgggttttccaattctgttacaggagagtactatggagagggagaggtttagggatgtggcgtggaaaagtaggtccg

SEQ ID NO: 53140 - DNA, 1066 bp, Oryza sativa
  unsure (1)..(1066): unsure at all n locations
nnnnnnnnnnnnnnnnnnnnnnnnnnnnnnnnnnnnnnnnnnnnnnnnnnntatattcctgctaaaaatggttgccacaaaccatctgtaccacatgaacacatgattgccaaggtaacttatgcaaatctcactatgctcaccatatgcatttttacattatatatataattaaattggccttcaattgtagcaatcaagcattggaagctttgctagaaggtctgaagctagtcagagatacatggaatcaactatggcacatgaccatggaactgataaggtatacaaactaagcatgcacaaagattgaaaagattgatacaagtagaaggtctgagttattttttggttacaggttgatatgtttgatcaagttgacattgactgtacaaatgaatttgataataactttgataattcatttgccaataccaatgctaagtcaaatcatgtgcaggtgcggtgtttacttgaaaagttttaattgaggctttcacaatttctaaatattgacatttatcataagttgcagcaagtacattctattagttctgctaatggcaatggtcgtcgtttcaatccatctataccatatgaacgcacaaatgctaaggtgacttaggaaaatctcactacataatgagttctgcttgatttaaacaacaatacctaattttaatgaatttcaattacagcaactaagtggggaaagcttaggcaaaaggtccataacaagtcaaatgaatgtggaatcaatggtgccacgtgagaatgtgaccaatgaggtatatacaactaagcacgcaaatatcaattagtaaacttatttggcaatactgtgatttgtttgattttttattcaggcttatgtttctgaacaagatggtactgatattatgaatgggtttgttcacaaccgtgaggaaccacatgccaatgagaatgctataccaaataatgtgcaggttctggaatgtctactttaaaaatgttgaatcaaagtttgccaatgtcttaattctatcatttattattacagcaattatgttctgttagttcaact

SEQ ID NO: 53141 - DNA, 1420 bp, Oryza sativa
cgcaaagatatctttattattttgaagaaaggtgatgagcgcgctttcctatttacaatctaactcggcgcctattacagcagttttggtaggatcagaaggatctaagggaatctttttagtctcggcttcggtttccccactttttgaaatcttggcagcgggcacttctccttcgctcgccgtggttgcagccagtcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtatgtgtagtgcgggacggccatgaacttggctaacgctgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccaccatcaatgagggttctgcgaagcttgacattacggaccactgggtctagtaccagggggtaccgccccgggtggaccactcggtcatgatgatcctagcggtcaaacctgattgcgatctctgaccatcgaaaatattggggcgtgtcgggctgaacagcattgatctcccgttcggtcagcttttgcttccttttagactcataagccatggggccgccgaaaatatggttgagctccttgcggtggtcttgaaatccagccggggtgtcgccgtcgtccttcttccttgacgtgctttgttcctcgtcggagttcttccgagtagacttggtgtactgctccgcgaactgcttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggttgcgcccgaatttgccgaccaattcttcgtggcgaatccctttggtgaatgcggcgatgatgacgtcgtcggtgatgtcggagatcttgttacgttgttcagaaaatcgccggatgtaatctcgaagagattctccggacttctgaatgacgttgt

SEQ ID NO: 53142 - DNA, 1160 bp, Oryza sativa
gcaaacagagccaggttacagctgattctccctccaaggattggtaaattagtatgtgctcatctctgctcttagaaacaggaaatcagcgaactccatgcagtttcaattccatccccagtacgctagcatgcgcagctcaccaatcctgtgtaaatctcagctgatttttctcagtgcaaacctcggccgtctgattagtcttaccacattgttcgaatggcattgtaaatgaccactgcaggccttttaactatttccttttttaactttttaaccttacccaggatgcctagtccggttgatctatgttatgctgctaccaaagtaagcaaaccagcacaaactatataattaagaccttcaactgtccacattaattatctctgtttgctatctctgtataaattactgtgaaccgtgtatattattgaagaattaaacaattcgtatatgcgaatagtcagagagcccaaactcttcgtattggttctttgtgctaccgtgttatccttctgtttcctcaaaagtcaaaaaccaaacgaatatctgaaattattggtgcattgttaagtatttgattcacctaattgtcacattgcagtttaccactgaccaattgcacattcattgtgtaggagtaatatttttctgaacgtttcgcgctctctggagataaatttcataaccacccgcactgatccttccctaatgtgattcttcatccttcatctgtaatatatttctaaatgtgatcgttcatcactaatctagaagatagaaaaaaatgttaattgctcctcccatcgtcaaaaagatatagttacctttagcattcaaaatttatctcaaaatatatttacgtcttcacatacccatcatcttaaccaaaccacacaaccattttctatttaatttcaccacctactacattatctcagccaatcataactttctttctcaattttatcgctcttcttaatccattaaagaaataaagatactgagagagtgcctaattaattaagttgctcaagttactaccaagcatgcttacatatgtgtttgggtgagcatctttgaatgaacaattgaaaacgttgattatgtatacataaatctataatatttaaatctagcagttttcacgatgtgtcggg

SEQ ID NO: 53143 - DNA, 1339 bp, Oryza sativa
gtcgatgacttggttgtaaagacgcgcaaccagaaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctacagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggggagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggaccc

SEQ ID NO: 53144 - DNA, 789 bp, Oryza sativa
  unsure (1)..(789): unsure at all n locations
gcgccaatgcggaaatcttcaaaggctttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggtgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaannnnnnnnnnnnnnnnnnnnnnnnnnnnnnnnnnnnnnnnnnnnnnnnnnnnnnnnnnnnnnnn

SEQ ID NO: 53145 - DNA, 774 bp, Oryza sativa
  unsure (1)..(774): unsure at all n locations
nnnnnnnnnnnnnnnnnnnnnnnnnnnnnnnnnnnnnnnnnnnnnnnnnnnnnnnnnnnnnnnnnaattggccatcgacgtcgagttgcatcagccggatgacctgcaggaagccatggggcttgccagggcctacgaacggaaggcgtcacggctggccagcggcacgcgtccggcactccgcgcaccgttccggagcggaccggctgctgccaatctgccaacagcgccagccgcgaccaccgagggctcacaggagcaagcgccccgacaatttcgtcgcctctcaccggcggaactcgcggaacgtcggtgccaagggctgtgctacaactgtgacgagaaatttgtgcgcgggcacaaatgcgctcgtctgttctacatcgaatatgacgacaacgtcgaaggggacatggagccggcccccgacgagccgcgtgtgtcgctcaacgttctcgccgggttggacggggccaacacgatgcgcctgcccgttgagattgccggcgaacgcgtggtcgcactcgtggactctgggtcgacacacaacttcatccataccgagctggcgcgtcacctgtgcctccatctgtctccagtgcgccatgatctctatgtcgtcgtggcgaacggcgatcgtctggtcagtccaggccggtgcgccaacctccgtcttcgcattgaagggaagctgttcacagtcgattgctttgcactcgacatttccaccgtagacattaccctcggcaccgagtgggtcagcacggtggggcc

SEQ ID NO: 53146 - DNA, 6839 bp, Oryza sativa
tcggcccagcaagggcgcgggagggggaggaaatgggccacggcccctttgggaaaaaggagggggaaaaaggaaaaagaaaaatggaaaagaatttccagggattaaatattgcttgtgctcgtttttaattagttaaaattatttccagagctctaaaaaattccactaaaaatcttgttaccatatttcgacatgtagaactcatgaaaaaattccacatgccaattctgtttattatttgcattaatttattggggtttctctcttgcttttacaccgatattttctctaggtgattttaaaattcaatttaggcttgggaaaggaacttcagggtgtgacactaagctcctacttcttttcagcccttgcaacgatttgcatatgtgagcaactgacccggtatcaaatacccaagaatcagtaaaggaagtagcaagattaatttctataacattaatacctgaggtggaactctttccatcctgctgcttctgcttgagctgctgtaggtatttcttacagtttctcttccaatgacctgtctccttgcaaaagaagcactctgcatccttagcgggccctgtcttttgaaccttggtcttagagctgcttgtactcgtgatctcatcagagtttagctttctcttttgaccactcttcttgttgttgggcttgcgcttatgcataaccatcacatggttggagtttttcttaatgctttcctcgacagtctttagcatcccatgcaattctgtcaaggtcatgttcaggttgttcatattgaaatttattatgaacggctcaaagctgggagggagcgactagagaatcaaatcagtagccaactctcagctaaggggaaagccaagcttatccagactctcgatgtaaccaatcattttgatcacatgtgggctcactggattaccttctacaagcctgcacgcaaacaaggactttgaggtattaaaccactcagctcttgcttggtcctcaaacatgttacgtagtcccgtgattatcatatgagcatccaatgcctcatattgcctttgaagctcaggggacatagtagcaagcatgagacagcttatatcaaggtattcattgcatcgcctttcatgctccctacgttgagcaacaggagcattgttgggcaagtcagctggaaaaggttgtgtaagcataaactctttgtgctcttgcctgagaacaattctcaggttgcaataccaatccatgaagtttgttccagtcaacttctctttctcaagaatagactgcaagataaaattgtatggtgcaggagctgccatgatctacaatagaaatatatgtatgcaaaatcagcaccatgtttacatttaacctttcattaaaaaatttaacaaaagatactgccactatgtattgtgaaacaaaattccctctagtaacatagtgagtcaagatcatcattttattagtctctagtgagctttggcatcacagctagacaactatcaaaataggtaagcaacaccttgctaatcacatcatatgtgactcttgtgctgttgaggtgacatctccatgtccaacccaacctatgccccaaggtccaaaactgttttgataaccttgtcaagtaaaccaataatctccgcatatagatgtccgacatctatcctattttatcatgataaaaagttacactttgctatagcaaacccatcacttatgatcacaaccactacaagaatctatttaatctatgacgaaaaaaaatcgtcatggatcactgaaaattcgtcacaggaatttgtctgtgacgattatacttattgtcatctattgagcgtcacagattaaatgtgccgacgttttctctgaaatcgtcacggatcagcacaatctatgacgttttttaaccgtcataaaacgcttatgggctcgtgtagtccagcccaggcccaacctttgtgatgaaattaaacgtcacggatggttgccacgtggcgaccaacatggcaggtgacatggtcgttttgacacgtgtgcgatgacatgtcaatgatgatgtggcagctgacgtcagcaacttttttatacggctcattaatttttaaacaacccattattttttttacattggtccattgattatttaatgacggcccattatttaactgtaaaatttatatgatcataactatttttatttatattggataaatcatcgaagttacagctcaacggtacatttaaaccaaaaaaaaaaggtgcaatggcaaaaaaaaaatgaagttcacacaattgtctcactaattaaagctatctacagctttctacatgtagaactgattaattggccgtttctcttttcccctgtaatctgtaaatcatttagtcttctatatcctgcaaaaacaaaaatcaggcaaggtatattaatgattcatttgaggtagtgaccatgtcgaaagtcagtgttcacatttcaacagaaatattcaaaatccaagtaaagactaagtgttctaaaatgatgtgcatgtcatcaaggaattactagatagcatgctctataccaactttttggaactattcaactcctgaataatttgcatacttaactgctcttgatgaatattctctagatagcattggccattggatgttactagaagaacaagcgcggcttcacgctgcgcacgttaatatgtggatgatggtgctgaaagtgcaaaacagatacatgttaagcaaaagaagagaagaacaacaacggaaggggaagaaaagaaaatggaggcataaaaataacatagagagcatgatcaactgttcttttcagtgcccacttctccattgtcattttggaattaagacctagtcgcaatattaacacattttggaaacaagaacaaagtaagcttgttagtgtcccatggcttcaaacagggaaggattgatggcatcatattacacatcagcacaagtaataaatgtcacccatctaacataattcattacgcttgggaagatcattcggactgaaaattgagctgtttcttttatggcaagtatgttactccctaacaatacatgcttgcaagagcttttatcatttcccacaaacctaaatagatgtatgatggaattacctctcacagttgtaggcaagtgaagcctctgctaaacgtctcttttccccctctgtactcctgatgcttccagttgtcagagtatcatccatctgcaagcacaagaataattcatagtgacaaacaagaccatcttcaaccatacgaggaagaccatctttaaccatacgaggaacaagaaataacaaatttgcacttatttttcttttctttttttttgacggcaagtggatatggttttgttccaaccacatctggacaattgtttcattgttgtttaagcgccacttaaattactcacatgacaaatagatgagattatcaataaaataaggaatcggtctgagttaagctagattacagaactgcgttctcgcaagcgaaaagcaacagagttgcttgagggtggggggtcaagattaatcattcatgggtcagcaattaaaacaggatgagaatctttcttgctaagcctgagctgatgcaaaagtaagggcgtccatgccaaatgaactaataaggcacagtaaataaaaatgcacattatcagtaaacataattctcccattcttcattgaacctggttacctgaaaaaaatggcatgcaagggaatggtgagaagaggaaaagaacatcagtatcttagtgtttgaggatacaagagatgagcacaaccttggctgaagaaaatcaacccaccatatgccgaaacacaccaacctgatgcacatgcgcaggtacatatccatcgagtatttgacaacccgagcaaaaccaaattagatggaacatcctgattcacaaattcctggcaacacaaccattcaccgattaagatcagcattagcgcacaaatcagggtgaagaaggggcttacttatccaaatgaggaggctgacgatgtcaagtttgatatttttgcggggatgaagtgctgcaaccggccggggtcctccagccactgtcaggaccagagcgatggagagacttcctggatctggtcgtcgtggtggcttgggtggagcagatcgggaagggccggcggggagggcgtgaggaggagctcaaggcggcgacgtcggaagggaagccggtggaggccgagggcgaagaacggcgcccgtcgttgtggagctggcttccaaatccggccgggggcagcgggctccggagtagccgagggcgacgacgtcatggaggttggggacgtcgccgcgaccgcgaacaaagtggactgccgccggaggaagtcgtcgagcacgccggcaccggcatacaccgccgagcccatcctgatgagcgaggaggcggcgcggggcgtcggcggtcggcggtcgaggccgccgccgccggtgccgagcccgccgctgccgtcggtgaagagagagaggagaggaggaaagagtaagggcaagctcaatgtatcctacccaaatcggtaggagggtgggcccaaacagtacatagcaatagtatatcacaggaggccacaatgcttatgtgtaatagggaggaataaggtagacccctcttgaaaaaacatcatccatcactcaattgtacacctgcacgtggcaaccagttgctttcatttaattttttactccatgtgtcaggcatacagcgcttcttactaggtattagctatatgactaaatagtagttatgtatcaccctcacaatacttcttaccaggtagtaaggatgtattgaatgtctaatgcctggtttctagcaacattatggatgccctaagaggcagagaggagaggagaggataagataaggatggggaagtgaaaatataggagagaatgggagagagaagacgagatgaaaaaatttgaaggagggaggagggaaaaaaattaatttcaaaatattaaaactttgaatcgaatttatcatactaaataaacttatgtggaaaagttgtcaaaaacaaacttgtataacttattgagatctacctatcttattttgattatttctccatctgagtttaattgacctatataaaatttgaatttcaaattataacaagttcaaacaacattttcaaatactaaacgatttcaacttaaaaagtccagaacaaaaaaattgtataaatcatcaatatctacaacttttgttttggtcattttgctatatgactctgtttcaataatttgaatttgaatttcaaattataactacttcaaacaacattttcaaatactaaatgatttcaactgaaaaagtaatcaacaacaaagttatataaatcatcaatatctacaacatttgttttggtcattttgttatatgactctgtttcaataatttgaattttaattttaaattataacaacttcaaacaatattttcaaatactaaatgatttcaactgaaaaagtcatcaacaacaaagttatataaatcatcaatatctacaacttttgttttggtcattttgctatatgactctcttcaataatttgaatttgaatttcaaattatgacaacttcaaacaacattttcaaataccaaatggtttcaactgaaaaagtcatatacaacaaagttgtataaatcatcaatatctacaacttttgttttggccattttggtatatgactctgtttcaataatttgaatttgaatttcaaattatgacaagttcaaacaatattttcatatactaaattatttcaacggaaaaagtcatcaacatccaagttgtataactcatcaatatttataacttttattttggtcatttcttcatccgataaagtgatagtaacattgttcacaaaatttacatatctcttatatggttttgaagtatttaaatcgtgacgaaattgctataacgtcacaggttttgggccggtttatgacgaaatcgataaactgtcacggtattatgggccttgtatccatagttgcatatccgtgacaatctctgaaaacatcacgaaaatttcgtcaaatttcgtcacagattaaatagattcttgtagtgaaccgtaataggtgcaattactggaagagcataaattacacttaatttttctgagagaatctatcctaccatgtcatatcaaatatataacagcaataaagtaagatagatataaaaaccccaagcgaaatctaaggggcaacgcacacggggtacatagatctcatctacgattcgccatgtgaaaaccttaacggcgtaatcaaattatgccgaaacagagtcaatctcattggctcgttttttctcattggcgtgcggttccagtggacatcagactatccgatgaacacaatcgcgctcagccttggtgagtactagacattctagtgaagtcaccaacacacataccgattgatctcatcaacccatgcggctatcggttcatctcacgttccgatcacctaagaactcatgtacaatataattgatcttatctactacacctgcatatcaactatatgcaatgatctagatcataaactatacaaggcggctctgatacgactgttgggatatgcgtagactacgatagcataaatcaaaattttctatcgtgtaaaccaggaaccatgcaagtattagatcatagatcgttaccactcgacgcgctgcgcagcacaagaagacgctgagaaatcgaaggaactctcgcgaattagcgcgcatcgatgt

SEQ ID NO: 53147 - DNA, 1051 bp, Oryza sativa
  unsure (1)..(1051): unsure at all n locations
nnnnnnnnnnnnnnnnnnnnnnnnnnnnnnnnnnnnnnnnnnnnnnnnnnnnnnnnnnnnnnnntctcattggctcgttttttctcattggcgtgcggttccagtggacatcagactatccgatgaacacaatcgcgctcagccttggtgagtactagacattctagtgaagtcaccaacacacataccgattgatctcatcaacccatgcggctatcggttcatctcacgttccgatcacctaagaactcatgtacaatataattgatcttatctactacacctgcatatcaactatatgcaatgatctagatcataaactatacaaggcggctctgatacgactgttgggatatgcgtagactacgatagcataaatcaaaattttctatcgtgtaaaccaggaaccatgcaagtattagatcatagatcgttaccactcgacgcgctgcgcagcagaagaagacgctgagaaatcgaaggaactctcgcgaattagcgcgcatcgatgtataggaagtagtcgatcgcaccggctcgaccttctcctcctcgtgcgttctcctcgtcgtactcccacgtcaatcaggactgcaaaccagcggcgactctaccagtatccacacgtacagggacggaacgccatgcgcagatgtgctagcacccgggcgcggctagggttttgcttggggagggaactgacggctagggtttctcacgtgatgcaatgcctccgccggtcacacccctcacgaatatataggatccatcactcgggcctccaaggcctgtaggactcctattcggatccctatccgaattaagctcatattggatctccatccaatccccttattccggcccattaagcgtgcgaccctgtaggttcatgtatactcggctataacccgaaaactcctttttggtccacgtgtcaacagcggcccctagcagaacaaattgacccaccgggtatatataaagatcatatcggctgaacctctagtgtatacttgtatgaacccctttgcctcacgatatcaattaagct

SEQ ID NO: 53148 - DNA, 1036 bp, Oryza sativa
tttcattagccaaatttaactgatttcaaggggggcttagtccaatatcacattaactatataaaatcttcagatctccatgatgcaaagatggagtacactttgacaatatagtgcaaccaagaaaccagaatgcaatgccaacttgcaagacaataaacatgcaatctgatgtagaaaacagaacagagaacagaaggaagaagacataattatataaaaaagacattattagaaaaaaaaaaaggtgtcaacttaataggccaattagcactttattcaattcaactggactgtgttctgtcagtccatagtaaatggatgcaagatcatttatgaaatgacagctaaatttgtggtcttacaacaagtagagattagtattatgctttatatgccctcaaatagaatcagccagtactctagtccaacaaaaaggcactaaattcccaaggtttgaagtcacatcaaagcctgaatcatcattatgcacgaagacaagaaacagaaagaactccgatttcaccaacccaatgaactctgtttcatgcaagaagaccacatcaaatgctatgctttcatactcaaaacgttcaatagccttgtatgccaacaaaatagtcttaaaagtgtcaaaattttatggcgcacgaaacacaatttccttgcaagatctatacatcaagagtatgacagcaatctcacacagataagtacagcttcaagattcacgctgataatgtaagaaaataaagtgcatctaaacagtgagtagacagccatcttattccaaacatgcataacaagattttatcacctcagcacacttctttgatagaggtgatatagcattatcatatattgccatctgtcatgcaagctgcagcaaataatgttttttctggaccaccccagatgacaaaaggaagaaaagataacatttttcctcacagctatgtggctatgtgcatggctacatctcattgcagaaggccaacaaaatctttgcaaatgggatgcagcttcccatcctttc

SEQ ID NO: 53149 - DNA, 1107 bp, Oryza sativa
ccaaagggcattgtcgtataaccaataagttcctatgggagtaatgaacgcagttttttcctcatcttccctagccatgcgaatctgatggtaaccagaatatgcatctagaaaacacaaaaggtcgcaccccgctgtggagtcgacaatctgatctatgcgaggcaaggggtaaggatccttaggacatgccttgttaaggtcggtgtagtcgatgcacatccgaagcttgccgttcgccttgggaacgaccaccgggttcgccagccactccgggtggatgacctcgcggatgaatccggcctccagaagtcgcgccacctcctcgcggatgaaggcttgacgttccggggcctggcgccgcactttctgccggaccggccttgcgcccggtcgcacggcgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggatgggccgtcgcccagggcaacctccttgaccgggacctcggcgcatgtgacaatccgctgcctcggggcggtgggggcggaggtgccaggcctctcgtcaccaccctcgggcttggacgcagcagcgaggtggtccgcgcgctgctccatgcaagcgagcgcgactttcaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggctgatccaccaaaggtgaccggtaggtcgatgtgacccaacggccatgtgtgccccggcgtcacaccgataatcggttgggacggctggagcaccatccccggggccttgatggcatcaaaagctgcgggggaaatgatgttgaggcccgctcccccatctatgaggacacgccccaacttcacgttgcagatggtgggggaaaccaccatcgcaatctgccc

SEQ ID NO: 53150 - DNA, 939 bp, Oryza sativa
  unsure (1)..(939): unsure at all n locations
nnnnnnnnnnnnnnnnnnnnnnnnnnnnnnnnnnnnnnnnnnnnnnnnnnnnnnnnnnnnnntcctaactactctagctaaaatatcgcagaaaccctccccacaaattaattgatctgcttcctcctcccctcctctcatgtcattgtcctgcaatacacgaggagcaaagagttgtgtgtaatcctcctcctactctggtcagctcttaatcccttcaacttccgtcggttggacgccaccggaagccaatccctgtttggtgttttacccccaattttgtcagattttttggagcgaaaccacgagctgtttgaagtgttcggcttcggaatctctttcttggagttctaggaatggggttttgatacaaagattgaagcctttttgttagcgttggtgcaaagattgtattgtattgttttttttttctgcgatgggtggaggcgtcacggagcggctcccggagggcagcagcgagccgctgctcccgacgaagcgggagggcggcggcggcggcggcgagttcgccggcgcggtgttcaacctgtcgacgaccatcgtcggggccggaatcatggcgctgccggccacgatgaaggtgctggggctcgccccggggctcgtcgcgatcttgctcgccgcgctcctcaccgacgcctccatcgagctgctcgtccggtccagccgcgccgccggcgcgccgtcgtacggcgccgtcatgggggacgcgttcgggtggtgggggaggcggctgctccaggtctgcgtcgtcgtcaacaacatcggcgtcatgatcgtctacatgatcatcatcggtaaaaaaaaaattcgatacaacaacctgaattttgacttcaatattgctttcactatttagttggtcatgtgactctagaattgctgaatatttcattttcttttttacttataaccatt

SEQ ID NO: 53151 - DNA, 809 bp, Oryza sativa
  unsure (1)..(809): unsure at all n locations
nnnnnnnnnnnnnnnnnnnnnnnnnnnnnnnnnnnnnnnnnnnnnnnnnnnnnnnnnnnnnnnnatcctcaatctccctacatggctcgacgccgttttggaaatcacccaaaggctggtggataccagggaaagggtgattgatcatggctccaagattgcctccattgtagcaaggaaaccccgccgtggaatctacaaacccgggagtagccacaaacggtggcggcgcgccggccgacagcatccccaacaaggatgaaaaactggtttcgcctaaacccatgttgtgtgaaggtggattccacaacccaggagggatagggaaaggattcgccatggaggtcaatgcattatttgcagctgcaggagaagcaatctgagcctcttgcaagaacatggcaccaccatggaaactcagagcttggccgtgctcactggcctcactcctctcctccaaatcagtggcgtccttctcattcatctccttttcactccctgaagaccaaaatctgggtggtgaacaaaagcttctagggtgagaaagtagcacggatgagcaccaaatccacctaactccacaaaagatggttcttttgagggaatcctactaatttattcgacctaatctcacttaaacaaatgtaagtacagtcagtcagtgaaagcaacaagggttgagctgagttgagtgagatgactaacacagatacacataaacctaatccactgaccccctttaattaccaaaggaagggaaattaaaatccttggaaaggggcccccaaagaccaagaagatgacggaca

SEQ ID NO: 53152 - DNA, 812 bp, Oryza sativa
agtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtccgatcatattcgattcttattcgtattcgagataatccgtatttgtttccgtattcgttttcgtatccggtaaaaaatatgaaaacgaatatggtatgaacattatccatccgtatccgctccgttttcatccatacttcgaagtcgatggtaacctcaatctttttccaaaacaacctgcatttcgtcattaattccaagagaaattattgtcagcttttgtctaagatttttggtacggattattcgctccatgcttcttagatttttttttaaaaaaaacttctgctgtcatattcacctgttctaaactattgtgaagtttatttctcaaaatattgatttattgtgttaaataagtataaaaaatctgcctcaataattcacgcaaaaatcgtatttcaaatagggtgtacacaacattttaatataaaatttgatatctcatgacatctgaataataaaaacccaccaacattcacgctagtggtaccttccaaaggaccataaattaaatcactccaattttgaattcagacaaggggtattacatctctaataaatttgagtattaatgttaatagactagtgttgttggttttggttgggaaaaaaaataaaaaattgcagagcagcagattgagaacgtgaacct

SEQ ID NO: 53153 - DNA, 743 bp, Oryza sativa
attcaatataaggaaatgagacgactctttcttgaacaatttcataagcagatcttcccctccacaccaatcacgagtttttttttattcctctcgtatatcgtcgtcacgcccttaatgataggttttgaaaaagtggttattttggccgattaatcttccaatatgctagttttaaaaactctcgttctttacacttcttcttggctgcttggcctgtagtagggatttggttcactgctttaggtattagtactatggctttcaatctaaaatatctgagaaagcaaagaaaaaaaaagagagacaggtggtttatttatcaccaaatagagatgagtattatatgatagcagcaggaaattctttgatggatcaatttctgtaggtgggtctcaactcggatcgagacattcggatttgccgatgaagagtactgccttggaggggtaggggttgtaggggaagaaccaaccttttcgggttacgggaagtcctatcgagcgactggattaaagcaagaagaaaaaagtcaaaacagcatccgttcctcgcgtatagagctagaaattcttgaattagatccatcctaacattggatgtcctttcttccattaggaagagcctcagccgcttcaagcaagtcatctcaagtttgaaattctagagaatagctccgatcaacccattttagtttgggtctgcaattcattcgcataaatgaaaaaaaaagcgagatgtgc

SEQ ID NO: 53154 - DNA, 945 bp, Oryza sativa
  unsure (1)..(945): unsure at all n locations
nnnnnnnnnnnnnnnnnnnnnnnnnnnnnnnnnnnnnnnnnnnnnnnnnnnnnnnnnnnnnnnntgggatgaaaactaggtcaacaccgccacatcctccacacaatttttttttgtaggaatgacaaatgggtcccataattctaatgccacataagcgttacgtcaatgccacgtgggatgaagacatggtcaacaccgacacatcagcaaaaccgtcatgagagtcaaattgcactggttttaatagttcggggatcgagatatccggtattatggttgagagatacgaataagattcggccactggttaagggagtcaaagtggacttactaaagaaagactggccacgtgcaaccaaaaccaaaccaaaaggaataagtttattttatctccatcatcttttcccttggtcgaatcgcatccctcaaccgaaaaactagtataatgtatccgccagctagttcgcttgaggacatattatgaagactcccgtgtcgcttgggaggtgaccgttgctgaggcccgctccccctacgcgcacaccacctcgccaccgctggcggtgccgccggcggcgcctccctcccatcacgacctccctccatcctcaccttcttcctttctctcttttccttttccagttccaaaactctttttctcggcaactcgtctctcgaccctgttgcagccaacggcaatgacaatcggccgtggtggtgggcggccgatagatctgcctcctaccacgcccctcctcccctttggtcccgtcgaagttggagcctgtcaatagtttgttgctttcgccctatatcaaatacaataggttcctcaactgacaaaatcggtgctaataaggtcccaaggtggtttcggtcgatatgacatctacatggctagtttgacttgatccttgtcatacgtggcgacgacatggcact

SEQ ID NO: 53155 - DNA, 6022 bp, Oryza sativa
cccctgtatctattgttggtgcttggttcaatgccagatgatttctgagctggatggattggtgttaccaaaatattgataagaatcttgaaagggtgtttacttttgctaccttatgaatgtcttggcattaccattttggtatgttagcaatctgaaccaaccattcatactgtaagggttcttgcgaaatgaatttatgaattttgtaaaatatatggtatgaaaaggtttatgtgtaaagtaccatggtcgcaaagtttcacctcgttatcgcctcctccaaggagtatagtatccttccctaactcttcatgtgtaaagaagttttgcccgctaaccagggacggatccagaataagatttaaggggggattcatctccttcttccttctgtagttcccatactcttcattttcttcttattcttcccctttcatctcctcttctatcaatggtgatctagcggggtagggggactcgagtccactttgactcccttaactagtgaccgaaactgatttgtattcctgaaccacaattttcagatatctcgatcctcgaactattgaaaccggtgcaatttaactcccttggtggttttggacggtggttttgctgacgtaatttttttgtgtgtgaatgacaaatgggtcctgtcacatcaacaccacatgggatgaagaccaggtcaacataaaaaaattgtgtcccataattctattctaatgctacataagtgccacgtgggatgaaaactaggtcaacaccgccacatcctccacacaatttttttttgtaggaatgacaaatgggtcccataattctaatgccacataagcgttacgtcaatgccacgtgggatgaagacatggtcaacaccgacacatcagcaaaaccgtcatgagagtcaaattgcactggttttaatagttcggggatcgagatatccggtattatggttgagagatacgaataagattcggccactggttaagggagtcaaagtggacttactaaagaaagactggccacgtgcaaccaaaaccaaaccaaagaataagtttattttatctccatcatcttttcccttggtcgaatcgcatccctcaaccgaaaaactagtataatgtatccgccagctagttcgcttgaggacatattatgaagactcccgtgtcgcttgggaggtgaccgttgctgaggcccgctccccctacgcgcacaccacctcgccaccgctggcggtgccgccggcggcgcctccctcccatcacgacctccctccatcctcaccttcttcctttctctcttttccttttccagttccaaaactctttttctcggcaactcgtctctcgaccctgttgcagccaacggcaatgacaatcggccgtggtggtgggcggccgatagatctgcctcctaccacgcccctcctcccctttggtcccgtcgaagttggagcctgtcaatagtttgttgctttcgccctatatcaaatacaataggttcctcaactgacaaaatcggtgctaataaggtcccaaggtggtttcggtcgatatgacatctacatggctagtttgacttgatccttgtcatacgtggcgacgacatggcactggaagcaaaatgtaaaaattaaaattaaaacaaaaattgtggaacccacatgtcatcgagtgtttggttaaaaataaaagaatgacagtgggacccatggccacccctctctttcccctcttctctcccctctttctctctccccctttccttgtcttcgtcaccgtagagctaggacagcgcctgcggctgccactgcgagcgaggagagaacgttgacggcgagaagtaagctcgcggcgccggagactcggtcgcggggctggtcgaagggagcggcgaggaaggtgacactaaggcccgctcgtcatggtcggcaagccgcaagcacggcatgcgggcgacagaccaaggaaggcaatgatgagaggaggtggaccacgaactggcacaacgagcggcggtggtggagccggtcaaggtgaccggtgatggtgttgcaggcgtcgagcagcgtgacccctcttcccctccgccgtagcaaccttccctgccgccgctgtagctagggctggatccgctagagagtgcactgccgctaggcatggtgacgtcaatgccctttgtgtgggcatcggtgctagatccgatagagaactcgacaaccctccttcttcgcacgtactcactggcctcctaacctcctccctctctgcgcactcgtcggcctcatcaccgcctccctctccgtgcgcgcttgctggcctgcccgcctgctcgtcggcctccccgcgtcctccctctcctctcgctcggaccagccgctccacccccgacggtcgccgcaccccgctccttttcccgccctgtcactaaagaaggagatgaagcaggctcagcgggtgattggcaatacaacatgcaaagaggtcgctcctccttgaagcagcggtcgtcgacattggagccccttcctcgccagtcgccaacagcagccaccgacggccaccaccagtccaccacagccgtgcgcgggggcgagagaggttggggacatgcgcatctagcgttcatccgctgcttgggttagctcctccaatctatcctccattgctgtggggaaggaggaggggaagaggggagaaggagaagggaggagatagagaagagggaggatgaggtggaggaagtggacccattgacatggatcccactattttttaatcttattgtttcattgatatatgggcccacatattttgttttaattttttaattgttaaaatttgcttcatgtgccacgtcaatggctcgttagatggactgagtcaaattagccacgtaggtgttatgttagctaaaaccactgtccaaatcgctttgatacctatattgcactagttttgtaagttgggggattggttgtgacatatttttcagttcaaggatgaagagaaggaccgacaataaacttattccaatagaaaatggaaaaagacgacccatctgcatccaaaacaaaagtaaggaataaagggacccaaaatgatcttattgctatagaaaaaaatggaaaaagacgacccatctgcatccaaaacgaaagtaggaaaaataaaaatatcagagccaggtttcgatcctgggacctgtgggttatgggcccaccacgcttccgctgcgccactctgatggctgtgatgttatttcaattcttagtattaagtatatgaccagcacgcgtccagtaaaagaagttgcttcaacctatcaaataaatacatttttaaaatttacaataattaaatttaataaattatgtgctaatagcattttttttgttttccatattctacctttatgttcaattcattggaaaagaacgtcaccattttttctccaggataaacactccaacagaactaggaaatttttagtaaacttatgcaatacactttcataatatgaaattagtgtttataagtatttttgtaaaatatatactccctccctgataagttctaaataaaaaaatcatacacataaaacacacacacacaaatcacaaatcgactatataggacttcctccgtttcatactataagacgttttgactttttttcctagtcaaacttatttaagtttgactaaatttatagaaaaatctagtagcatttttaacacaaaacaaacttattatcaaactatattcaatgctagatttagtttaactaatttgataattgagatgttgctaattttttagtaaattgcatcgccgatacacgaacttggtaggtgggtgcaatctagtacacgaacttgtaaaatgctcgttttggtgcataaacttgtctggtgcgtgcggaggaaggcgaaaaggaaataacatggctaatcttactgacttaggggctcatcagaatactatgtaaacatatatctaataaggttgctattagataaacacatcttcaataaaaatagaatgggatatggtgatcgtagaaaatgataaaaaaaaaccgagcaatgatataagggttataaatatatgaaattcatcacttccgtgatgaaggataaagtatagatcaaatttataaatattacatgtcttatgcatactcattacacgtatgcacatcatatcctaatcaacaccagctttgcaaaattaacattgtgaagctattttagtcctcattcgcacaaactagacaagttcgtgtaccaaaacgagtattttacaagtttatgtattaaattgtacccacctattaagtttgtgtactaccaatgcaatttactcctaattttttctataaacttagtcaaactttactatagttgcaataaaagaattatctcctttattatattgtgttcgtagtttatatactagttcactagttatgtgttccagaaatagattatacttcattaatacaaattcacttgattagactagtcgatttacgttacgataacgatctaatgatcttaatgggctgcactagttctaacttgttcatccgaagggtttcaaaggggaattagtgatattatttattaacataagtatgatgcttaggttagttaaatgtagttggatgcgggtatgtcccacagaaaatgagataggcggtaggtggtgacagccctgtctgtcctttatactcctccaagtctggtatgatgaaagagttcgtaaaatgtcataaccatactggcggaccaacagggagtggtctctcggtagtatctgggtatatagaactaagtcctagcattgtaaacatgtatgtgctaagtgtacagtaaacattagcaatatagaagaatatatgaatcttagctttctataattcttctccactgcctagtgtaccattattagatgaatcttcgtcgtcttccctatagaaatataaatacgatacatttggaatactcctggatgaaatgttacagcagtattcatgcgcttacgaatttatatgtgattgtaagaaataccaacattaagtttgcgaaaggaaagggcaatgagattggagcagtgataggaagggcccccactccaccactgccaccattgtgggtcctgagctccacctctgtcggcaccgagctatgctgtcgtccaacttatctttctctaggagaaaggggagagagaagaaggtgatcggacgggcaaaagagatatttcaaattgttacagtggaaaaaaaattaaatacgtttagaaaaatgacatttgaagagtggctatccgtaagagtggcaaactgttaaatttgaggctcatggaattaggtttaggggttagagctctaggaaacaggtcaaaaagaacataaaatttccctagtactttgcatttcaggacgtagccgcattcctcgtaagggtgaaaatggtcacggaatttccccgtggatcgagagccatttctatataaaagttatcatttccatctctcatcatttttatataaagtggtcacggagtataaatttaattttttttatttttctttctgcttagtattggtaccttttgataccgatgagaactccctccgtcctataaaattataaaattagatatacctccatctaaattcattgtattagaatatatcgtatccagttctaaatattttttaatgacggagggagtagtttaaatgatcgtcgtttcatgctactgatcccgacgttttcgaccgtttttcacccctagcgggcggcgtccataacgatgtgaaatatcgccgccgatccgacgtgtggtgcggcaatgcggtcaaattgcggccggcggacagtccgctcgccggcggcttggtgttcgaggtggctcacgcgcgtctccgctctccgccgcgccgctcctcgatcgcttcttcgtccgcgccggagaagaggtacgccgcagcgccccccc

SEQ ID NO: 53156 - DNA, 19114 bp, Oryza sativa
  unsure (1)..(19114): unsure at all n locations
cccccccccccccccccgcccccaacccggcccgcgccttttacatcgttggttccgaccgaggaaaagaacgaacatctcgccatctcgcgtttccgctctccctaggtattaggtttccgccgctacatttttgttgcgtaagggttaggttcaaattcaaggtggagtggagaatttctttttttaatctttattatgtacagtaagggcgccccaatttagaacatcgtggaaaatttggttaggaaacccgtatggaaagagcgagtagtatttcttttgctgaaaaattcacgcgtttcgaacaagtgtaaggagaacacctgaaattagtgtgtgttctagtatttgaatatggggggactggattgggatttagacatttagttactactctgttccttgctgaatccaatcccctttaccaaacaaacaagtgtctccaccggtcgaatcctcatttctcatcctcgcaaaagaaaagaaaaccttcattttcttatccaaatatctaccgagatactgtgtccttgttcgtttgatcctatcaatttgggcatgttgtggtacggatagcaatggacaactgggcatgggcaaaggttaagtacaaacgccgtgacttgattctttcccctcccccagaaaatgcaatggtattatgggttgtagattgtagaattgaagaggaaattatccgattcacctctaggacaatggtgtttactgttttaccatttccctcctttatctagtattgctcaagatttacccctaaagcctttatgtgatcttttatggataatataagcctaaatttattaattcttcgattcctcgaaaaaaaaactattattcttctaaatcatttcatctgcctaattaaaaggatgtagctatattattttgttacattcagtaagtacaaaaatggattctgatgcttgattaattccacgttaatcaggtattctgatgcatcaaacaagaactgttgccagaaaaataccttcatcatacttccatgattattaaatattacttcataatatgatgatgtgctaggagctccctccatcacaatcaaactgcttgcttgctgttctgttctcagtgctgatgtggatgaaatatcaccacgagttttatctatttgcttgatagtttcagtgagaaagttcaggaatctcttctgttactagtcaactatgtctagttttatcttctgcagaactttgatttgttctctctatccatactagagtggtatatgtcgtcagtttcggtcaaaatatggatctgtatctcccgtgtgctttatttcactttacttttttgacctctctttgttgatatttgaaatgaaaagttcactttccagtttccaattaccatctcttagggcttaattcctaactctgttttttgtgcaatatctaaccgatacagtcaagcttagccaaaaacgattagatgtatcctgtattcctgtatatgcggttggtgccctgagatgccttagatatttggtgaatgctccatctcaaaacaaaaggcaataagatccatgccactagttgctagtgaaagggaagaggaatgcactgagaatgagaaagagcttccttatttatgctctcttgattcacaaaataatagggaaacttttctgtgagtttgttgtacttatatcacccaaccacaatggtgtacctatcagtatcaggcaatgttcctatattccctacaactatcattcgagttactgatcaccgatagctcatggtttagtgagaagataggccgtgctggaaagatatgattctcatggttaaagcaacagtaaattctttgtcactgcttttcttttcatccagaatgatctggagggctgtaagaataatggatatttaaaagctgagtgaacaccatcaccttcacctctgctgaaattccaaccggatacaatgatagcccatcactaagatacatcattaagaaaatggcaccgagatccaagtggaatataaaagacttgaactccagttcattattatactactatgatactatctggccagtggacacacttaatcagggttccatcttttattttgtaatgaaacgagctttgttttcagtcaacataggctggttagacagcagttatatgtcatgatggaacgaaaataggaatatatatgttccaccattttggtgctacttcatagtaaacaactaaacccccaattcgtcacctaaacccctaaagcattgttgctactgtgattgttggccaaggtaccctagaattatctatatacagttatacacatactcatttcatctcatcactgctctttgcttacttcaaaaacttaaagctactgagcaagtaccaacaatatatatctgctatccggaaattacaaagcaaaactttaaaaagctaaggtacttgatcaattttaagtcgcaaacaacacactattattcataacacagattgtctagaactactcccactggatcgatgttattgctactcagtaagtccccatatatatgcctataagatagcgtctcatgagtcccatcagaaccatggaacagtaccatagctaccgtcagatagagctgcagtggagaacatctggtccacttcgatctgcacatctgatctcttggcgaaacggcccttgatccggggtcgtgcctctgcatacgcctttcttgtttcataacgtattgtcttctcaaacttcctggccttcttcttctccctgtacctgagcaccctggcctccctgtccatggagctgaagtgaagggacatctgaagcgagggacctgagaagagattgattgctccagcaggtgtcaggattctggaatttggcatatctatcaccgtgctgtctggtactatacccgcctccattgatgagaaagatatctgagatggaatcggcaaatggtcactgaaatatgcgaatcataaggagattgcaggtgtcagagaccctgcaatgatatatagatgggcttaatttaattttacatacataagaaaaacttccaatatcttttttactgtcgcaaaagtaagatattttaaatttatgcactgggataaaatatgaattacacttacacttatcctacttttcatgaggtctttcgtgtggtgattgctgtgtacataaaaggttaacaaactcacttcttttcaattagtgagttagcatggatcgtatatgcttagaaatacaggaagtagtcaactggtctgcctaaagatcaattgtgtacttttctttaaagtattttttttatcggttccatttaatcagcctaaagatcgcagcttggaagtagaaaagtatctttgttttcttgttgagatctgtttatttatcccttcattttgttagacagtagcttttgtttggagaatgtttttccactcaaaagtactagtatgaactctaaaacattgacaacgtggcatgtagtaacaactaactaacaacagtaatagatgttcattctctgaaaaaaaaatagttgcagctagtaatagatgaactcacgctgttgctgatggaatctgtgtaagcactgacgccggcggtcatggaggcggcctggtctgctcccacaactccataaccactatgctgctgctcactcagcattgtgatctgtgaaggtaccacacactcgctcccttccttctctgcaaactccttttgcatctcctgctgctgctgctgctgctcttgctgttcatgcatcccatactgccgatcttggttgttttcgatgcggttgtcgtagtacgaattgtacccgacaagatcaaagtactcatcgacttcaccaaaatacatgccgttgttgctgctgttgctgttgttgttgtcgttattgtcgttgtcgttgttgttgttattgttgttgttgttgtcggaatctttggagaggagaagccaagagtccacctcctcgtccttgtcgccgaggacggtggcggtggccaccaccgcctcagcgaggacggaggtggccgggatggtgatggccgggagcgggttcgcggagtgcacctgcacgtcgcacgccacgcacagcgcggcggcgtcggcgcggcacgcgagcgcggccggggcgcgctcgcaggcctcgcacacccgcacgcgctcgtggcgggacgccacgcggttggccgcgtgcacccgcgcgtcgcacgacgcgcacaggtacgccgcgtccgcgcggcagtacaccacgctcgcccgccggcacccgtcgcacggccgcgcccatgggcagccgctcccctctcctcctcctcctccttcgcctccaactccaacctcctggtcgaacacgttgccaccaaaattataattcatgaacgaagtagccttgcttgtggtagtagtagctttagcttgcaccacatggacaagtctatcgatccaagctattgtgtttgtcctctctctctatgtgtcgtgtgtgtatgggtcttctcctgttcctctacctcgcatggctcttgtggaattttgtgagtgttttttggaaggagctagggaggggaaagtcacggtgtttttgtcctggggagtttgagtgtagagtatactaatagtaagggggtgtcaagtcgaatccagcgattgacacttggcgcgatccccgggggggnggggggggggggcgagcggcggctgcaatgcctgtcttgtggttgcctttggatgtttgctgcttcagcgtttctcttctcaccccctgatgccaatcctcaatggaggggtcgttttcagataaagattttgtgcactttggcgggtcctatggagaattggcgcccttgagctaaatctaagtatctaacctgaactgatgtcaataccttttaagccaaagcaatcgcgcttttgcgcaaaaaagctttgcattttagtgatgagtacactgattctcttttgtcgtaatcatgttccattttaacttaggactgtccctaaagagattttacagggatcaatagaatcctcccatatgcattcctaggattgtccctaaacaattcaatggacatctcttagatggaactaagcccaaagggggagaattggaagccactgtgatgatgtacaaataaagggaaaaacaaaaaagagcagaggaaagatgctgcctctctctctttatgcacattcttttgcaaaagagaaagggagggttgggttctctgggattccaaagcatgcggttttgtgccagtcattggcactcccccttagccgttccgcctttacgaacctccggtgtgaggtagccagtgcagatacatgagaaaagttccaaagcggcctgccatgtcactaaatagtttctttgccggcctccctcatccaaaaatatctattctagtggagaagtcaaattattaccaatgtgttttttttcttctgttatatgatttctcaactgctgaaggaactattatttccttgcataccttttttttgtttgtttgcaaggcctatctatatatgacatgggtcctttatgggttatttgttgcttatcattttctttgagccatctgtttcttattatagccctgctataacgttaaatatgcctctccatagagaatctacttttttttttgcaataaatttgtaaggagaacagtccacctctgttcatctttgcttttgttgttatctagtattttggtagaatctagctacatggtttgatatatgtcttgttagtaccaagttcaatgcaaccatatatctatcgtgttgatgaattgagtttgttatgctgtggttgaattaagtgttatgaaaaacataggagtaactaacaaaaagaagtggtgctattagagcaattctcctttaacactatgccatgctacacaaattttatcaacaaacttgtactacactaaacaaacttccttggtaaattggcatattgacatcatttgtttttactgtatgttcaaaattgatcttcttacccacaagtggttctttatttactagtgaaagcacaagaaatatttttctcctgcagtcctctttattccatttgatgagtgcgtatatatacagcagttccgtagaggcagtgactggtgagcttatggcagcctatgtgactgaagagtgggccccacggcccaggaattgttgaagatggtgacaactaaagttaactcgtcaggtaaggactgtgactgagatgccatatttggctttcacacctggcatatacatcttccagaattattggcttttactatattctaaaggaagaaatgcccttgtttcttcaaacagttcgatggacacgtggagttaaatgcacaaaatgtcttcgttggaagctgacctaacaacaagaggctttgcagtaccacgagccaaaatgtaagttcttagttcgaaattgtgaggtgcagagtatggtacaacgttttgaaatgctgcagtgtgctccaccccaaccgtcgtcggcgccctagccaatggcacccactctcctccgccacccacagccctaggcgcctccctccgctgcttctggccaccgaccgcctccccatcagccaacacggtgaacccaagccacggtaagttttgggaggactcgccgcctcctccaccacctagatctggagcgccccgaccgatggctagtgtcacccacgtctctgcgaccccgaagccaccgctgccacgaccccttttgtcgcttgcgaggctcccccgtcgccgatttcaattcgaaaattgctcaaccaccgctgctcccaaaattgaagtgtgcaattaccatgccgtcgccatgacgcgacgcctactggcacgcctatgagccgagagcaaggggatggataacgtctcctctaggcgtacgatgccacatcgtgccttcaagctgcctgagccaggttatctagtcgcgtcggttccatcgcccttgccactaacacaccgccaacaagggcctgagtcccttccgcctctgctataggccacgggcgttatggcgcaacttggagatctgaaaacaaggccagtggagggcgtcgtcttcatctcgacgtcacacatcattgatggggagctacgcgaaatggaaagtacagttgttgtcacctgggcgatgcgcgccccgccgtcggtcacggcaaaggacgtcgagtgtgctattgcctatgagttcggtctatgcatcagcgagctgacggtgtcgctgcacttcccggaggctttcctcctcaagtacaagcaccgccgccattgcgaggagacggtgaagcagggcttcgctaaaggccacgggatcgaggtccacttcatccaatgttgtagcttgaaaaatgccaccggctcggccctcatgtacagagtcaagctctgtctcgacggcgtgccgatgcacctgtgggcactggacattaacattcaagagagtaattggatacgggacattgacattctccgaatcacaacggtggaacatatccaacaatttgtgcatttatggtcaatgatcagaagaatgaaccagctgaatgatgaacaagacggcgtatggttgaacctaacagcaaacaggcaatacttggcaagatcggcctacagactccaattcctcggggcggcgagatccgctttcaatcaattgatctagaaagagtgggcgctgccgaaatgtaaattcttctcttggcttatttcccagaatagagtttggacggcgaatagattagagcaaagaggatggcaaaaccagaagatctgctgtcatgaggggacttaggtacgaaagacggtgcaacaggccacggcagcaacaaccttaagaggaatagtaatatagttggttttgatttagaattttttattagatcttatctctttgagtttgttaggattacatctctgtaagagctacttaagcagattagcggcaaagcaatagaatcatgcaattgagatcaatctagtctattttcccctgccgcgttcgtgcgttgcctatcacagctccgccgcgccgacgaggtccagggccgcgtcctgccaccgccttcaaatataatcttcgacgtattcctccttccaattctctagtctgtgacatctgcccgctatgctatgtacaggatgagacagtggtccacctattggcgaaatgtagagtcacaaagaggatatgggccgagatccagagatggaccagcagtgacttacaaatgaacaaatgggacgactgccactctactgtgctttggtggaatctcgtgcttgaagcccccaataacccccatcgaccactccaaacgatggtgatcctagtttcatgggaaatatgatgcgagtgtaacgtaagaatcttccgcaataccatctcaatgatagcatcaatcttagctaagattaagaaggaagcaagagcatgggtaagagcaggagcaataaagctccatgagtttggaattttgggagatatcacctagttttgttctcttccaagtgtgtcgttgttgactagccctgtacatattgttgtataattttctccatctctatctctactatctattatattattaaaggaatggaaaaaggagcctccacgttcgctctcatggcctagaaattctcatattaatcggagaaaaagaaaaggcagagtccatatagaaatacaatttagaaatagttgaaattcggaattaaaaaaaaaggaatattagaagaggagactagagtccatatagaaatacaattaggaaataactaaaattcggaattaaaaataaggaatattagaagtagagtatagagtccatatagaaatacaattagaaaataactgaaattcggaattaaaaataaggaatattagaagtagagtatatagtccatataaaaatacaattaggaaataactagaaattttatcaatatgaaacaaagtctactcaatacatgatagaaaagttacccctaatctttcacgtacataatgagcatacatgtatgttggatttctaatagtactatttggtcaaggatgttttccgattgggtgtggaataaaaggaaaaaaaaacagatgcacagtccatggaagagtccatctggactcaagttcacttagcccaaataatcttgccgtcccgctaaagccacgtgcattaattcatcttgatatcaacacctacacgacatattactgggaaaaaaagaaataatcagagaaaaagaaaagaagagtccatgtagaaatacaatttaaaaataactgaaattcaaaattaaaaaaaagcactattaaaagaagagtccttataataacctaatacgagattaattaatattcagaataataaaataaaataaaataaaatatgaaattagcaaaaaaaggaaaaagaagagttcgagtagaaatacaatttaaaaataactaaaattcggaattaaaattaagcaatattgaaagaagagtccatataaaacccaatacaagattattaaaattcggaataaaaaataaaacaaatcaaaattaggaaaaaaacagaaaagaagagttcaagtaataatacaatttaaaattaactgaaattcagaattaagtacaagcaatattgaaataaaagtacatataaaaacccaatacgagattaattaaaattcagaataaaataaaatccaaaattagacaaattaaaaagagagttcaagtaggaatacaattttgaaaaactgaaattgaaaacaaaaataaaaaattaaaagaacccaaacgatagtagttaaaattcgaaaaataagtaaataaaatctgaaattagaaaaagaaaaataagatttcaactaggaatacaatttatatataactaaaattggtgtaaaaaaataaagactattgaaagaaaagaccatctaaaacacatgacaagattaattaagtaacaggcttataaaggagtagagtggtggcggttgatgggacatctaaaaactattaataaaataccaaatagaatcctaaagacgattaaaaggaaggacgacgggcaggtcgtgaaacaatcggtcaaggcggttcccgggacttttagaaagtaaaagaaaaaccaatgataatcatattcaatttttaaaatctcaatgacagtaaaaattagaggtaacgggcggatcgtataggagtacaatggcagcgccgtcgatggttggtgagacttctagaaagtaaaaaatgaattttttttttgaagcaaaagacggcaggagctctgccggatatattagaaggagaagcagttacagaggtcaagaaagagcagaccactaggtgacattttcagttttcattttcagagatttacatatatgatgctatcaactagagctaagcacaagcctttatgtatggcgcaaaatctgaatggcatctatatttcctttactaagaaagctacttgggtggcacttagttgcttttgatggaaaattcttcgattgcgctcaagccacacctgccaccaggttataagaagtgcccctatcagttttcttcttctccttccataagttgaatgtatgattgaggtccaccattctaaaatgtttgtatcctgtagttgatttggggtctgcatgatgtccagccagctacaaacttgggaccaaaccgtgttagtgaaactgcactcctttgccaaatggtttgcgtcctcaaaagcatctgtacataagctgcaaatccaatcgcatggccaatgtcttaaaaggaggttttcagctgtgagagttctttgatgtaaaattaaccagccaaagaaccgatgcttaggttccgcttcagctctccaaagtggcataaaatttgtgttggcaactgatcctacaaactacatttcataagcgctttttgcatagtattcaccatgattagtccacttccacgtgatactatccaaagaattggggtgtaatatgatctcatgcagcttactgcctaggtgcaccagctcattgatctcatttattgaagtgattgttcttagggaagtgatccagtgattattgtgcagctcaaaggctacgcagtttgtttcctctttcctcttttaaaaaaatgaattccaacgacagttatgttcgactttgacaatcctaatgacaataaagagtaggcggcggatgggtcatagaggagtatagtggcagcgtttgacgggatttctcaaattatataaaatgaaacccaacgagacaataaactttaaaaactataatgtccaatttttaaaggttcgagcttctaaaaagtgaaaagataaacaccaacgataatcatttttattttaaaatctcaatgataataacaaagagaggcagcaggcgagccgcagaggagtacaatgacaaagtcgctgacgttttagcggaacttctaaaaagtaaaaaaaataaacctaaacgataattatgttcgatttttaaaatatcaatgaaaagagaagaggcagtggacgaccatagaggagtataatggtagtatttgatgggacttctagaaattataaaaacaaaaccaaggataataaactctaaaaactataagatcaaaattttaaaggttccaagaagaataaatagaaacaatagtagaccgagcaagcaaataaataaggatatgacagaagtaaggggtagtagctggtgtaactttttaaactataaaattagaattacaaggatggtaaggtttggtctttcaaagtcttaagacaatgagataaatatttaataaattttaagtaaaatcatattaaaaaaatatataattttgtatgggtgctagccgcgcaattgcgcgggccacccagctagttataaaaattgaagatgtttttgccggaattttggtacgtcatcagtatttaagtcggtttttaagctcgttcgtttttggaaatacaaatccatgtttgagtcggattttaagttcgtttgcttttggaaatataaaaaggagtcgcataagaaatttctttaaaaaaactcacatgctaacttgagatggaagtcggactcctaattgtagctcatgattttataaaaaaatatccaagcgaattcccacagcgaatttcatcgtagctaatccacataacaataataagattaaaataacattcacccattgcagcgcacgggtattttttctagttaatatacaaagcaaagcttttgcgctcctttttttaaaaaaaactataggttcttaagctgcaatttctgggtccgtgactcagtgttgaaggtctgaatttctctgccaaagacagcaccaggaacgtccagaaacgattaataaaatgcatgggagaagaataatttgatgcacctgatcttctctgaacatttttccaagattggtgaacctgaagccaccaaacactgctactactgcagagagagagagagagagagcctttgacccattagtttccatatcataatactctttactttctgcttgcttactctaccaaccacatcagagttagttcatctcctccttgaccgcgtttccatcactgatcaccatggaggcctcgcctcactttgctataaagcccatgcagagtgtgagaatctacccacaacaacatctggatcatccaaagaaaggaacagctgcaacttttttggtcagaaaatggctacaggtgttctgtgctccagggaatttgctctctgcctggcttgtgtgctcctggccgtgccattgctagtggctcaggacccttcaagcctgagcttggagcactactcaaagacctgcccgaattatgagcatgtcgtccggactgagatggaatgtgctgtgcgtgcggattcccgcaatgcagctctgatgcttcgtcttcatttccatgactgtttcgttcaggttagcattcaatccattttctctcttttactttgcacagatgctaatcttgttcatctgaacttcaatgtgcgtagtgggagttgcagagttttctctgaaaaaatgtgaatatatctgttgcagggttgcgatggatcagtgctgcttgacgacactgcgaccctgattggagagaagaaggcagaacagaatgtcaactcgctgaaggggttcgagctggttgacaagatcaagcagaagctggaagctgagtgccctggaacagtttcctgtgcagacttgcttgccattgcagcgagggacgcagttgtgctggtaaacctaacgatacctatgttcagaattgtgattcataagcagtaacttatgtcagacagagtttgtcatgtgttgtgcaacacattagctcattttcgctactatcaggttcatattagacattctattcaagaaaacatgaacaggcagacatacatttcaggaataactcaatacaccatcgagaaattcaagcacccgtttcacaataactatctattacctcataaaatcattgtctccattagcatattgttttgcctgcaatcatgccagcatgtagaacttgcaagcaatcaaagaacggtgcgtattccacatcaatgttattacagaatggaaatttgtgttgcaggttggtgggccttactgggatgtcccagttggaagattggactccaagaaggcaagcctggacctagcaaacagggacattcccactgctcaacagggccttgtcaccctcattgccaagttctgggagaagggcctcgatgccactgacatggtagcccttgtcggtatgttcttcttctctcttcaatgctacaattctatcattagttcaattcaaattagcacctgccagtggccttatacatgaaaaatactttcgaaaagttgacattatatccagggtttttttttaaaggagggcaaaagctttgcctcgtatattaatagagaggaaacaaagtacacagctgtatatacagggctagtctaaaaaaacgacatgcccgcaacagaaaagagctaagtgatatccagggtgaaatttgatcatataccctcctatcccctccttttagattgaaatggagaattcaccctcctgacttacatgccagtgaaattagatgacccccaagtatgaatcaaatcctcaaattgtgaactgaaaccttgttgaatttgtgaatttgatcgaaggatcccacacaatcggattcgcccggtgcgccaacttccgggacaggatctacggcgactacgagatgacgaccaagtacagcccgatctcccagccctacctgagcaagctcaaggacatctgccccctggacggcggcgacgacaacatcagcgccatggacagccacaccgccgccgccttcgacaacgcctacttcgggaccctcgtcaacggcgagggcctcctcaactccgaccaggagatgtggtccagcgtcctcggctactccacggccgacaccgtcagcaagtactgggccgacgccgacgccttcttcaagcagttctccgactccatggtcaagatgggcaacatcaccaaccctgcaggtggtgaggtcaggaagaactgcagatttgtcaacacatgatcatatgcatgctcaatcaaaaggactgcacatttgttctttttaatttgatggctggcttgtcctagatagaaataagaaatgctttgatgatgaggcccttgtactggtacatataatacgcgttgttgtcattttgtcatcactctacaagtatgttacatggagatacacatgataaggtactcctggcttttgcacaaactttttatttatatacatgatgaggaatggattatgaattgtgatgaggttttagcaacatctttggttggtgcaccaactattgtgtacgttgacaagaaaaaaaaacactaatcttcaagcaagctggatagtactatatattactcctagatggttaaggttgtcatctcttctattgtttaatataaacttgtcatgttttagaaaagagtgaaatatatggtgagtcccatatcttgtgtggtagtgtcacttaggttcatgaacttaaaaattgcacgtttagatccgtaaacttggtttaatatatcaccctagtctactttgactatgtttgaccgccaatgtggcataccacgtaggcaacacttttgctctcagccccctcgacatcacaacatatcgcatatatctccttgtagctatataatgacaccagaatcccaaaaaaattctcaaatcgttcttcactcttattcttctccttgcatgtatggaaaaatgtgatcccgattagaaattgacattgctctgcgctccaaagtgatcttatccttgcgcaacgggcacttaatcaacaacgccttctttcggtgacttcaagacaaggacgagcttggagaatccatggggatgcctagcgtgcaagccgtgttgcgttgcctcccgccgcaaatccggccgcactgtgccaccgctaaccccgctacactgcgttgcctcctgccgttaatctcaccgtcgaggccgccacagccatgtgcgaaggtatatgtggaggaggctaagcacaaaagtgttgcctacgtggcatgccgcgttggcggtcaaacgtggtcgaaggacaattggactgtgggtggtacattaaaccaagttcacggacctaaacatgtaatttttaagtttatagacctaagtgacaccacctcacaagtttaaggactgtccatgtatttcgctctttagaaaaataaaaaggactactagagtatggaatgccatccggacgagacacttaatgaatctaattcccacccccatctccgcacattcgagctcccatgcatgtggaagtagcagcaattccttagctccttgtgctcgttggttacagcagcaagaagaggaggcaccggcggtacgtggctccttggtcggccaaacaacaacaacgtggtccctacctctgtgccttgatctagtacttgatagttgatatctgcatgtaccagaccaggtacttgatgctagacatctcatactcacaagtattagagctcccccttcccatgccttgacccggtaactaatatcaggcattaatttgatactcacaagtacttgttatcttatattcgatacctatgggtatcggccggtaccattgtaccaagcctggtacccatgtaacagaccctaaagctgatacctattagttatgacatacatgcatacaacactagcaagcatagcgatgggctagcaaggagcatgacagctttcagcgtcaccggtgtgataatctcaaggtttgcacaaagaactcgacgactctcctatccacttcgtcaactccgagccctccacgccaagaccggccgcctccaccttctagttggtgccccggaccttgtctccctccgcttcgccacctccctttccttcctcctcgcacatgacaacaccgatctcaccaccatagttgactccttccttgccgacccactgattctgatgatccccgatgccctcgccagtctccactctctcttatgcccttaaatttgggttagtatgggagaaagatgataggggatgccaccgatgttgggaagatggttgaggagtcgagagagggaggaggaagacgccggttggtcctctagtgattagggaggaggatgatggagtggatggttggcttggtggtgaacatgaagggaatcggtgggagagaaacagatctagagataaacagatctaagtcacttaaatagtgttcaccccttaatttatcatgtgcctccgaggggatcctgtcttctagattttctatataaaaggaagattgaagaagaattcagtaatacatacctgcaggagaaaaatcctcaaaagcttcaagaggtggaagcttgttactgcatctcacttacaatcagtcatatatattgtttcaactaataactaaacctacaataataacactctactattattaacatcaagtatatatggagacacggaaaagtacaagtccttgtcctctcctcttgtgtttgtacagttcatctaaaatgatataaatatatacgcatcactaattagtaattaccttagtaaaatataattattactacctccatttcaggttataaaactttctagcattgcccacattcattcatatagatgttaataaatctaggcatacatatatatctagatttattaacatatatatatgaatgtatgggtaatgctaaaaagttttataatatgaaacagggaagtatttcccaacctagctagctacattaatattcagacagaaagacagagagctccatgcaagcatgctgtacaagaagagccacacaccacagctactcgatcatggtggtgttatctggggccggagagctcgacggcctggacgaggagggaggagtcgtcggtgaggtcggagaagcagcggccgaaggcggcggcgaagtcggcggcgggcggcgccgggtctgaggtgcggtgggagtgggagagggagtcggcggcggcggtggagtggccggaggccttctcccagcggtcggcgaggccgtcgccctcgagcatgcggacgacgtcggacatgcgggggcggtgggcggggaggtactgggtgcagaggagagccacctgcaccatctcctccacctccacccggtcgtaccctccgcctaaccccttgtccaccagcacctccaccttcttctccgactgcatcttcttcacctgcattttttttctttgcatcatcgtcacagtttctctacattatgccctcaacaacacacaatcacatttggtggtgttcggattaagatgtagattttactttcatttttgttagcacatttttaaaactgttaaatggtaggtttcgtgtgaaaattatatatatattagttattttaaaatatcaaataaatctattttttaagtttgtaataactgaaacttaattaatcaggagtaaatggttttttatttcgtgtaccgtaacttcatcttttatcttcgatagaaaagcacaccgctgatcttagttttgtgattgatcggtttacatggggattattcgaatagttatgaaaaatttcagtgaatattatttttacaaatttccctataaaaatgagtaaaacaatctaaaaaaattaagtacatatattgtggtgctgaacttcactctaaaaaatgtattgaaaatgcgaggctaaaattcaatctgagagaaaaaaacaaaatcaagttgcgaatagttccgcgtttttcctagccgagattttatttttctccatgcctagattgaatttaatgttgcagcatctagaatgaaataaggtataatacttgaatagttacatttgaaagttttttaacaaaaagaacttgtgacaatcttttagcaatttcctaatatatcacacattctcaattttttttagaattttggaaagtattagtgtcatcttctaactcttaattacttcatccgttttgtattataagtcgctttaactctttttctagtcaaattttgttaagtttgattaaattaatagaaaaaattagcaacatctaaaataccaaatcaattttattaaatctaacattaaatacaatttgacaaatatatttgtgcagtgttcaaaatgctactttgtttttacataaacttgatcaaattgaagttcgacttaaaaaagatcaaatcaattcataatataaaatggagggagtaatcttaaggtgtttctaccgattagaattatactactccagattgcacaagctaatcgatcaaacgaattaacggatcgaattgaaatcagtagcacatatatttacccagtccagcatggcgcccttaaatttgaaggtgtttctaccgattagaattatactactccctccatcacataatacaagggatttta

SEQ ID NO: 53157 - DNA, 16135 bp, Oryza sativa
tatgcttaaagtacttgggataataaagtaagtaaaaaaaataattccaaaatttattgaataagacgagtggtcaaacagtgcaaacaaaaacttaaaatcccttgtattatgggacagaaggagtactcgagattgcacaagctaatcaatcaatcaatcaaacgaattgacgaatgaattaataatagtataaaataatacttacccagtccagcatggcgcccttgtggttggacgacttgccgaactcgagcgccgtctggccggtgacgagctccagcagcaggatgccgaagccgaagacgtcggtccggtccgacgactgccccgtggacaggtactccggcgcgatgtggccgacggtgccccgcaccgccgtggtgacgtgcgactcccggtggtccagcagcttggccagcccgaagtcgccgacgacggcctcgcacgcctcgtccagcagcacgttggcggccttgacgtcgcggtggatgatcttggggtcgcactgctcgtgcaggtacaccaggcccctcgccgcccccaccgcgatcctcctcctcgtcccccactccaacgccggcttcgctgcatgcgattttatagtagcatgtttcattaatctgcccaggttagtttttggaaccgcgtcgtcagttcatcatcgtcatcattcatcatttggtcagagtttcagagtttcagagtgagtgagggagtgaaaggtataaggtaaagatttttggtgttggtttgtgtctaattgggtatcacactctacttcagggattgaaaccggcggtttttcgggctccgtcgtggtagcttaagttaggttagctgttggtgtggtgttgtagctgtggttttcgctcagttttccctaattaactgagcattgtaaggtttgatcctgttttctccttaaaatgggatatcttcttcttaatataaaacgttggcaacggtccgaccgttcgaaaaaaaaaaaaaagaaaccagcagtttcgctgttcaggcgccgatcaccatcatttggtcagagaaattcagagtttcagattgagggagtgattcggacagaaaggtataaaggaaagaacttttttgtgtttgtttgtgtctgattgagaatcacattctacttcagggattgaaaccggcggcttcgctgttcatgcaccgatcaccgtcatttggtcagagaattcagagtttcagagttcggacaggaaggaataaaccaaagatttttcttttttttttggttgtatctaattgagaatcacatcctagctccctcagcgaacggaagcacatcaatggcgtctgtcgtcgtcacaatttgtttgcaagttaattttgaaagggaaaccacatcaattcatcatcatcatttggtcagagattcaaagtgggtgagtgcagtcggaaaggaaggaataaagctggagttttttttgtgtctgattgggaatcacattctcctcttcttctcttctcgtcgtgatagataaatttagtctcctttttttaattatctttcagggcaatggaatccaattccgagctcttatcatgctccacttgtttctttgccggcctgaactgaaagcttcagtctttcgattctgcacctctcttttaggtccggtatgatatgaaaaatccagcaaagaacatatgctgctgctgctgttccactcagatttctgctgtcatatcgagtaaagaacattcgagctgcagcagattggaggaattctaccggactttctccgtggtcattgtctgaatcttgtactgcctctctctcaaaatgagttattttactgttcttaatgagatattgagatgtactatatttttcagtgtaaaatttggtatatatacctaggagttacggaaatttgcaataaattttggtacattttcatacctctcaaaaatggtaaaatttatctcttaaaatatagaattctagtagtagatgtgatatatcataatacttcaaatctgaacataatgtctgtttcaatttatagtattataatgtatcgcatctcgtactattttactttgttttaaaatagagagagtaaaatatagcaacttagtactgagatgagacatatcctaacatcacgaatctaaacagaaaatctgtttgaattcatattattatgatgtatctcatctcgtactggattgttatatattttaggataaaaaagagcaattcataatcttaagaagaaaaatagatacagtactagaaatattaatttacgaatttggtttggttacctttgaggcgggaggcgacgctgccgttggacatgaaggggtagactaggaggcgctcggtggcggtcatgcagaagccgtagaggcggaggaggttgcggtggagggcgaggctgatcatctccacctccgtctggaactgggcctcgccgccggccgcgttgccgtccttgagccgcttcaccgccaccagcgtcccgtcggggagctgccccctgtacacgttcccgaaccctcctttccccaggatgttcttcccgctgaacccctccgtcgccgcctgcagctccctgaagctgaacctcttcacgttccccaggttcacgttctcaatctgctgctctgcaattttttattttttttcccaaccaaaaccaacaacactagtctattaacattaatactcaaatttattagagatgtaataccccttgtctgaattcaaaattggagtgatttaatttatggtcctttggaaggtaccactagcgtgaatgttggtgggtttttattattcagatgtcatgagatatcaaattttatattaaaatgttgtgtacaccctatttgaaatacgatttttgcgtgaattattgaggcagattttttatacttatttaacacaataaatcaatattttgagaaataaacttcacaatagtttagaacaggtgaatatgacagcagaagttttttttaaaaaaaaatctaagaagcatggagcgaataatccgtaccaaaaatcttagacaaaagctgacaataatttctcttggaattaatgacgaaatgcaggttgttttggaaaaagattgaggttaccatcgacttcgaagtatggatgaaaacggagcggatacggatggataatgttcataccatattcgttttcatattttttaccggatacgaaaacgaatacggaaacaaatacggattatctcgaatacgaataagaatcgaatatgatcggacacgaatacggaaacaaatttttctcggaacacgaaaaccaactcaacttctaatagaaataaatatcaacatatataattagctcattttatataaaatgaggtataatttataaatattttttaaaatttaaataatattaatagtatggactagtgttaagagataaactactattaaaatctataaaggtatattgaaggttatagagttagaaagaaatagggtatgtctcatgggtcctgcggatatccgaatagcactgttcaccggatatccgaattattatccgtatccggcggaaacctgataccatattcgtattcgtatccgggagaaaatatccgtattcgtatccgtatccgaaatatccgagaattatccgatccgaaaggtatccgtatccgtttttgtccggagcggacggaaactatccgctccattttcatccctacttcgaagaaggccctagcgtaaaattaaggtattacaaggtaccaaaaagcttagaataaatagtcttttttttacgaaaaatcgtttttttaaagaagcgtggagcaaataatccacaataaaactctagacaaaggcctgaaaataatttctctaagaattatggatgatgaaatgcaggtaggttagctgcgagaaaagactgaggtttaccgtcgacgtcaaagaggatctgccggttgcggcggtggcgccaccagaagaggaaaccggcggcgaggaggaggaggcccatgcagccggcggtggagccgaacgcgacggcgaacttgtgccccctgtccctcgccgccggcggcagcgcgccgccccgcgagccgttcaggctgtagctcatcggcatcggcgccgtcccgtagcaatcctgctccctgttggcgtcgcagatgaggggattccccactatgctgcaagaaaaaaaaaaccatgcaattgttgatgaaccaaaaaaaattggaagattttttttcttcttgttggaagaattgatgaacttgaaactgcagccttacttgtaagttcttgccaatgattctggaatcgggccactcaggttgttatatgacaaatctctgaagaagaacacgagtgtatgcagagtgatgagacaaaccaaactgaatagtacacttaaaagaataagttaatatagctcaagaaagagcagggcaagacaaagcatctctgaataaatgacacaagtaagcaggttgagacaaaatcgaactgtttaattgcaacaacccaaaactgagatgaatttactcacaggaaaacaaggtgtgacaggttagctgatgcagaagggaatggaccagacagggtgttgttgttgagcctcctgatcaaatttcacagcaacagagttaactcaaacttaattaacatggcaacaaaaaaacggagaacaaccacaataactatgtgtagatatgatatgatactgctacatatctagatatcataatcaagaacagtgtgcttataattatctttactacaaaataaatggaacagtattcagaggctttgaacagtggagctctcgactcacaagtactggaggctctcgaggtggcccacagagctggggatttcgccatagaagctgttgctggagagatcaagcgtcttgaggttctccagcctgccaatctctgctgggattggcccggttatgttgttgttctgcaggagactgcacccaccagcacatcaaagaaaagagacactctgtttaagtacaagaactgaccatgataaggctatggattgatgtgaagtagaagaagaagaaagaacactactgacacagtctcaagattggtcaggttgccgatgcttggtgagagcaggccagagagatgctggcttggagcttccctgaaaaaacattcagagtattcagacaagcagcagagaagagaagagaggtgagattgagattgatactgtgaagcaatggaaggtgagagctaacatacaggccagtgacgaggaaatccggggagcaggtgatcatggcccagctgcaggggtcgacggagttctggtcccagctcttgagcacgccatgggggtccttgagcaggttcttgatcacaatcagagcttgcactgccaatcaaccagccaatcaatcaatcagcacacgcccaaatgcaagaaacgatcagaggaaacaagagagaggaagggatgaactgaactgaaccttaccttcgttgttgacgcccttggcggagaggagggcggcggaaggggaggaggaggagaccacgagcagcagcaggaggaggaagaagggcggctccattgctgagctcaggtaggaggagacgacgaagctagcaagcaaaccagcaactacaacctcaggtggtcaggtcaggtgagctctttcctgggagaagaggaggaagaagaagcagtggctgcgtctgcgcgtgcaatgtgtgattgtgtgtgtgcgctcgaactaacatggaacaagcgtgaggccaaggaaagcaaagcagcatgcagcttggcattggcattagcagtggcaggttgcctctcactctctctctctagagactagagtctagtctctctctctctctctctctctgtgtgtcttggccgcgcgcgcgcgcagtcacaccacacgcgggggcaaagccaaaatggcagagggccggggggatggggccgtgtcagagggggggcaaatgacacaaaaggcagagaaggggagagagatgctgatgctcggcttcgctcgcgcgcgaaatggagggatggaacaaacatgcctcctgcgatgcgatgccatgccacccgagctgagcgagacctgactgctgtagcctactggagtagcagcaaacgggatcagtaaaccatgggtgtttttcttctactcttcttttttttttctctctgtctctctctatcctcttttctatcctgggagcttggccgtttgtgtgatgaagtcacaaggtctgttagattttttgtacgcgatattattttttcttttgcgattatacaatagacatgcatacatcactacacttgtaataccactcatacactcgtgaatgtgccttcgctcaaagaggcgaaaaccactggatttttgtgctgacatcttttttttcaataaaatctttttttaaaaacagtagacggtaggagatctaccggatatattagaagaagagagttgaccctgtttataaggaaaaccgggcccaaaaatcatataactgcacagtttgctaaaggaaaaccggcaaaaccttacacagaagacacgaaaagcctgcgacaaaactacaaaccacagaagtgaccaaagaaagagcaagaccttcaaagcgaagcctccaaggaggtgaacaatgacagaagccgttgccgacgctcgcccaaaggattgggcttttcacccgaagggggagagagtccacaatgcaacacctctaaggaggaaacagcgcccgcaggcctcgatgttgccgatcctggaagaccagataaggctttcgcctaagactccctcaaaggggtagaacctcttagaaaccagagccagagtgataagtgttatcgtttcccggctcatcggctggacccaatgcagcaggtccgactccgccttaacacaaaaactctagcaacatagaagacaagcaccatgctcaaaactcggcactacgacaggttcacacagacacaggacacttgaagcaccggcgagacccaagagccctaacaacagacagactgaaccacgagcacggctgaacacttctcctcaactaccgaaaggctccacggccgggtggaggcggccaaaaaaagggaggagcccaaaggagtgaaaggagccgtggccgccatgaggaggacgtgagagctgaagtcaggggcaacaaggaccacgttgtcttccatgattccggcgaggaactccggctattgcaggccatttcttacgactgcagcaaccaccaccaactttaccaccagtgcagagagggggacactggggtgagcagaagagcaactaaggagtgttggcgagaggaagggaggaagggatgtggggagggggaggaaggaaatgggggagcgggattcaacagctaccggcgaagggtggccggaggaagagagacaacacagagaggaacagagaaaggaggagggcaccaaggaagaagaaaagggtggttgtaggggcggcgtctgcagatgccggcgacggggagaggtgaccggaggccaaactcgccgactcccaacgagagccccggaggaccgaccaccaaagccgactggggccgctaccccggcacgcggacattgggaattcggcggccagcaacggggcccggaacaacgggcggggttggccgccttgcacggctgcgcaagccgcctttgcgacggccccgccgcctcacaagccaccagacgccgcagcggtcgcctccagccgcgcctcctccgcttcgcaccgccccacgacaccaccgccgcaggcgcactgcccagatccggtgacggcggtgccagatctgccgccgcctggccgggatccctcgccgtcgccactcctggccgccggcgaaaatctccacctcccctacgcctgagaggggggcaccaccgcggagaaagccccgccgccgccttcctagctcgccagccagctttgccggcggtgaggtgaggggagacgaggggggtcggtgccagcggtggggttcgccccctatgtcgcctgcgtgtgggcgacgcgggggtttgcacaccttagtcaactagattttgatccaatggccgaattgtcattttctacttccagctaggtgaaggcaaagagatggtgaggaggactcaccagcgatattgacagcaacttcctcggcaagcccgatgcagagacgtctttcacagtaatggcgacatgttgtatctctgtcaaggaccgccagattaggttttcgggtttaggaggaggtaggagggggtaggggatggtgagggagggtttagagggaaggccagggtagtagtgggaagcggagatgggagggcggagaggcggcaacgtatgagctgtgcggatggacgacactgggtggggtcgatagtatgggcgagagagtacatgtggttagaaggtaggggcagtcgttgaagatgacgaagtaaatgtggagcaggggaaacacacacaggagctaataaagacggagcaatggcttcgacgcaaaggaggaaaggcagaggaagggcaaggccaatgggcatcattggtgctggcaacgcggagacaatgcacggagggtcagggagtggagtacatgcggtgtttcgtagtcgcaaactcatgacgcagtaggggatttgtttagggtgaaagaagatgtgagcattatggttatgcgctagcatgaattgtgaagtaatgcaagccgtccaaaatatgcagatagttagccaaaaataaggtgattgattgatagacaatcccttgtatatataattttaggttgtttattccttttttactatctattgatcgttttgaagattctatatatcgattttagattcgtgcagcttttcaaaactctattttgtcccatactctctccccggcgcggttttcctcctagctggtacggccactcgtcaaaccttgtattctaccttttgccacccatgaacccctgtcaatctagtggtgaagccaggatttaagtacgagggacaattttgtaagtgattctgattaaaaaatgccgtaaaaagtatatgtgaattccaaggttcccaataggtaatatatcatatcaacggaaaaaacacatggtaatttaaaagatcaaccggtatatttattcactttaatttacccttatgagcaaacagataataagcagcgataataccattcgaggtaaaagcagacaaaccacaaaatacacaaaaagctagattacggcaaaatgagcaacaaactatctatcttttgcaagtattaactagtattttagatattcaaatttttaaattgaaatgttagccacctaatgatgtataaaaattaaatacacatgattatcaaataaaactcagtattctataaggaaaagaaaagtgtagttgatatgggcttatggctacggtaacaaccctttgctgcttttgatcagggattagttgccatattcttgctaaacatatgttcatgtcatctgaaactaacctagcttaaccaactaatcaattggcagaatttttttttcgcatgatcagtaccacatttgttagtttaactttggtgaaaccaaattataaggatttgtccttctaatcatattactcccatgttaattttttcacacgaaacgagaacgaaagtgtaaatgggtccacccatcgaataggccgggttgtgcagttcgggaggacgtgttgttacactcagccccttcttcttttcatttacctccatggtgacatctccgtaattcatctccgctggtgatagatgcctgatccactggccgccacctgaccacatagtcctctacattcttgcctacggcttcacatgttgccctcatctagatatacggcttcacatgttgccctcgtcttgttacccatcccctttccttctaccgaaagtatcaacaaataaaaaaaatatccactttaacaaatttgactacaaaggattttttttagataatggactacaaaggaattacgtatgtgatcctctctcttattaagacaggtagttacataaattatacgacgaagtgattagatcccaagagacaaagtgtttgtggtggtggttcgaacgacgaccgactcacttaactctgttttaattgtaggttttcattaagagatttgtaaatcacttatatatatggagcatcctataataactcaccttgtctatgagatcgaactaccaaatctgctgtgcaagatcaaactgatctaccatatagtggtatctttagtcacgaccgagatgaaaagttggcggaccatatcatttctcgttaatttggccaaaagtaattaacacgagttgaccgcacgcataaagaccttatttggtagcccaggatggcaatataattttcccccgtattaaaatcaaaaccaccatttgcccccataaaaaaacaaaatttgctagaagacgtctaaaatttgtgcagtttgctgctggacaccttgaaaattgataatttattggaggacactttcgggcgaattaaaatgagaaaagtttcaaatatatgagaataccctggggccacgtgcttctaacatggtgttgtagtgaaaatttagaaactatacaattataaaatctaccattacctaaagtacatcgctaacatgcatcatattccatgttctcgtcagccttaggttaaaagatattttagccctaaggatattctcatcttttcttttaagaatttttctttttaatcaggctaaaatatatactctagcaaattatcagttttttaacatattattcaactataacatgtttttacgatgtccaccggtaaattattcaaaattctcaaaagtgtcttgtagcaaaacttatcaaaaagaaaaaaggcacaactttattggattgtgcatgtagccatgcccacgtaccgtttgaagccctataattgagggttctctttgcaacaaaaggatcgccaaaggtgagtcgctgttgagacacttgcctcgagaaaaagcttgacacaaactcgatcacagtttctacggaaatggagggggccaggaagaaaagccatcatccatcatcaaagggtgaagcgaaaagcgtctttttagagggccggccggcatggatgatgactgccgctggccccggcggcctcaccctgagaactcaacaaagcccaaatggagaaagatatcaaggggagaattttggtctgtgtatttggttactactccctctgtaatattggtttgatcattcatccttttttaaaaaaaattatgtaattattttctattttattttgatttgatttatcatcgaatattctttaaatatgacttaatttttttatatttacacaaaatttttaaataaaacgaatggtaaaacagtgtcatatattaaaaaatgaaagtagtagatgtgttcctagtggatggagaatccgagcaagaaaggccttgtaatcatctccaatagagaaaaatgcccagctctcaagaaaaaagaaacgatctcgccacgtaattgttgcatatggtgctatttgaaataggattgtatatatttgttgtatacctcatcgacaggcctttagcttataagccgcagccaaattcttaagctgctcttcttcttcttcttcttcttcttcttcttcttcttcttctttccattttcccattttctaggtttttttaagattgttaagactacaagttaaacgtcttaccctaaaatccttttttttttggcctagaagccgtatcctaatttctgaacacgcattgtactttctagatgtttgtagctagctattgatctactagtatttcgttgcagtttgatcccattctctgtttgtggtgataagctgaaaatgactgctggtttgtgggatgagaatcgtgcactcgtttgtacaaactcttttgtttgcaacttggctccttatcctcccatgatcctgcttctcacccctctttgatagacacctgccgccctattgcaggcactagtacctgcaaaaaatatgttaaaagtttttgtgaagcatataatgatttgtccacatgctacgcactttgagttggtggttttgctttttttttttttctgattctccatgcgagctccccgaatttgattctgcgaggtcaagtcttgttcatctttttgtaaaaaaagaactggattttttttttaaccaaagtgcccgtagccattgtgagttgtctccgaatcgcgaaatagaacggaataatcgtaaaggaggtagctcaattctcgtagacgcaatattaccaaacttacgcatttcacaatggttcttattaaagtttagaggcaataatcatggtgatggggttttaaaagacttctttttggatgcaggattttaaaaggaataaaacatagtagaatgtcataccgtgtgccggtttgttaaaaaaatagaaagggaatatctatatttatggcgccatattattcaccaaaaaatagtcggcatgtatttacattgtaagttcctaaattacatatgtaattttagtgtatttgcaatgtaagtcttgaaattacatatgtaagtatctaaattacatatgtaatatatcatattattaaaggaatagaaaaaggagcctccacgttcgctctcatagcctagaaattctcacattaatcggagaaaaagaaaaggcagagtccatgcaggaatataatttagtaatagctaaaattcggaattaaaaaataaggaatattataagaggagactagagtccatatagaaatacaatttagaaatagttgaaattcggaattaaaaaataaggaatattaaaagaggagactagagtccatatagaatttcaattaggaaataactgaaattcggaattaaaaataagaaatattagaagtagagtatagagtccatatagaaataaaatttggaaataatagaaattcggaattaaaaatgaggaatattagaagtagagtatagagtccatatagaaatacaattaagaaaaaaaatagaaattcggaattaaaaattaaggaatattagaagtagagtatagagtccatataggaatttaaaactaactaaaattcagaataaacataataaaattaaaagtagagtttagagtccgtataaaaatacaatttataaataactaaaatttaaaattaagaaaaacatgggaagaagagtttaaagtcaatataggaatagaatttagaagtaactgaaatttgaaattaaaaattaaagaatattgaaagatgagtttatatagaaatacaatttagaaatagctgaaattcggaattaaaaaataaggaatattagaagagaagactagagtccatatagaaatacaatttagaaatagctgcaattcagaataaaaaaaataaggaatattagaagatgaggctagagtccatatagaaatacaatttagaaatagctgaaattcggaattaaaaaaaaggaatattagaagtagagactagagtccatatagaaatacaattaggaaataatagaaattcggaattaaaaataaggaatattcgaagtagagtacagagtccatatagaaatacaattaagaaaaaaatagaaatttagaattaaaaaataaataatattagaagtagagtatggagttcatataggaatttaaaactaactaaaatttggaataaatataataaaattaaatgtagtgtttagagtccgtataaaaatacaatttacaaataactaaaattcgaaattaagaaaaatatgggaagaagcgttcaaagtcaatataggaatacaatttagaagtaactgaaatttgaaattaaaaattaaagaatattgaaagatgagtttagagtccacattgaaatacaattagaaataataaaaattcagaattaaaaaaaataaaagatgagtctagagtccatataggaatatataatttacaaataactaaaatttgatattaaacataattaataactaacacgtatataaaatacaatatgaatattacatattagtagtttcgtaaagttattgcaaaatttaaaattatgttgtcattttaatatattagaataatataatgagaaaacatatatgctattatatgaaagaaaatataatgatgctagccgcgcaatctgcgcgggccactatgctagttttactgtatttacgatgtaagtcttgaaattacatatgtaagtatctaaattacaaatgtaattttagtgtatttacaatgtaagtaccaaaattacatatctaagtcctaaattacacatgcgtaattactgtgtaaatagagtaattacattcgttgatgaccaacacgtttcatgcaaagcaaaaaggagtcgggagcaagttgttcgatcagcttatcagatgtactttgcacgaatcatgaagaagattagatggcagatcgtcaaactggctgtatttagcccagaaatatgtcggcataattttagcaaagccgaaatagaaaacacatgctccaaatagccatttcgatggcacacacgaaaaacatataaatctgggcatagaagagaaaaagaaacatgagacatgaccacatgtttgtctctccaaaattcctattgaatgtccattctgtaatatttttaaaggaatttttagagcaaattctttcttttaaagggctctaaggaattttatctatatgattcaagtcctccagaaacccttcaatttttctttgttccaaagtcaaggaaagcccttctttttttacccgccaaaggcctcaaataaaccaatatcaaattttgcgcttttagttttcttaggttatgctctttccagcgagtttccaacgcacctctctcgttttccacgcacacgcttttcaaattttgcaaaaaaaaaaattatatataaaagttgctttaaaaatcatattagtccatttttaaaaaataaatacttaattaatcataagaaaatatgtcgctccattttacgtgcgagggaggtgagttcccaatctcaccttccgaaaacagccaaggccacttgctgcaacagttgaccaaattggattagggtgaccataatctggaacttcatgtattcctcttctagaaccataacctgaacatatgcactcaaagttgtccttattccattaattattttaaaacatgcaaaaaatgaaactttgttgaatcgattactagtaataacttcactcacaaagattgattctgaattgattttaatattttcagcctttctttttttggggtgggggaggggagggtctttttccacctctcacttcctctatcaattttgctcatctctcttttgcccctattcaattctcttttgccattaccataataccattggtcaaagttagttcaccataagagtagcccaaaaaggctattatacccttaatccgttatgtaactaaaattataagaaattccaaaaaaaatatcaaggaaaatgtaattatatatttagtttttaaaggttgagtaaacaatttatgatggaccatttcagttagttcaaaatatttataattacagctaaaaaactatttaaatataaattatttttgcttatccacatgtaatgtaagcatggcatacctcacaatatttggaacaaaaaatgaaatagcgatgcacatcccaagtacaattatttcgtgaaacatttaagaaacatatcaatcccaagatgcatttttaaagaggtaataaatataattttcctttttagttattttttctgaaaatttaatacattttaagttcccataatttattttttttatgttttgcgttcacgaaaaaattttcatgctgttttatggtatttgctaaaatttgaagtgtttttttttttggaacaatccttcgggcctagtaaataaaccagactgggctgatggttgaacccgaaaaaaccagacccaccatccttgtggggtc

SEQ ID NO: 53158 - DNA, 2255 bp, Oryza sativa
  unsure (1)..(2255): unsure at all n locations
ccctcctccttatttccccgaggggggggtcgggtgactccagcctcgcccccgagggccgaggcgccccgacccctcgcgttttttactccacgtgtatgggttaggtcagcacagcagggctcacctaaccgcatttattgcgcctcggctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctgagccgacgtgtggtggacaagaatgaccgatttgtgaccggtctgacactgctcatgtcgtcagtacacagccaccttcccacgacgtgcccgcctcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaagtgggttggttgattctttccagattcagagcctagaacgagggagaggtcggctcacactttgtagttccttcatacacagatccaccaaaacacaggagtagggtattacgcttttcagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagtgtgtgttttctgagctctcgtactcctccgtgtgcgccaagtttttcttgttcagcctaatggccgagcaagcaaaggtgcacgacctctctccgagtgcgagcggcgacgacggggagccaaacccacgccgtcgagctcgtactcccccacctcctccacaccaagatcctaagcagggggaggcgctcgagagggtcgaaaaatccgcagcatcgccagtcgcgggtggtgcaggagaacggcgagatggggagcgtcgcctcctcgtctacggcaacggcagcacgcctcagggcgcgcttcaggctgttggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcgtcaagacggagggcgcggcgagcggcggctgttgcacaccattcggctgccactccctcgtcggcacctccgactcgggaggatcagcatggagagccggatgcccgcctcgacatcgagcgccggcgtaatagccggcgtactccccgcgcaacggagggcgcctcttcgtccagagtgtcacctcgacatggacgtgggaatcagccctccgtgcccccggttggtggtgttggctgtagagccttcgtggcgagtcttcggaatgtccgttggcccccaaggttccggcccgccatcgccgaaaaatatgatggcagcgtcaaccccgccgagtttctccaggtctacacgaccgggattgaggccgccgggggtgacgacagggtcatggcgaatttctttcccatggccctgaaggggcaagcacggggttggctaatgaacttgccacccgcgtctgtccactcctgggaggatttgtgccagcagttcaccatgaacttccaaggcacgtatccgcgccccgttgaggaagcggacttgcacgctgtacagcgaagggacgatgagtcgcttcgatcgtacattcagcggttttgtcaagtccgcaataccataccatgcatccctgcacacgcagtaatctacgcgttcagggggggtgtgcggcacaaccgcatgctcgaaaagatcgcctccaaagnnnnnnnnnnnnnnnnnnnnnnnnnnnnnnnnnnnnnnnnnnnnnnnnnnnnnnnnnnnnnnnn

SEQ ID NO: 53159 - DNA, 751 bp, Oryza sativa
cctcctctcctcctcccacttccttgtccgctcagccaaacttttgactgcgcgacagtccgcaaggtcatggagggaggtgttgtggacggtgcaccacttgccggtagggcgctccctgctgggaacgctggcctccttctttttgtcgctcgcagcctcccctttcgggtggcccgtgaagtgccctcgacggcgaggacatgaccctcgtcgtcggaacggactgacctcttcttcctcctcctgtcacgccgccctgactgagcggcggatccgggggcggccgaagctgccactccggaaccggagggttccaagtccaggcctcctccttgcgagccactcggtccgcgagctgaaaaagctctgcggtagtctggggctctttggaggcgatcttttcgagcatgcggttgtgccgcacaccccccctgaacgcgtagattactgcgtgtgcagggatgcatggtatggtattgcggacttgacaaaaccgctgaatgtacgatcgaagcgactcatcgtcccttcgctgtacagcgtgcaagtccgcttcctcaacggggcgcggatacgtgccttggaagttcatggtgaactgctggcacaaatcctcccaggagtggacagacgcgggtggcaagttcattagccaaccccgtgcttgccccttcagggccatgggaaagaaattcgccatgaccctgtcgtcacccccggccgcctcaatccccggtcgtgtagacct

SEQ ID NO: 53160 - DNA, 1997 bp, Oryza sativa
  unsure (1)..(1997): unsure at all n locations
nnnnnnnnnnnnnnnnnnnnnnnnnnnnnnnnnnnnnnnnnnnnnnnnnnnnnnnnnnnnnnntgaccagaggaagagaaaaagagagaaatgtcgataagttaattcctgtggatgtctacttgccgggctgcccacctaaaccggaggcggttatagatgccctaacaaaacttcataagaagatatcgcgagaaatagttgaggatcgaactcctttcttttctatttcttctattggctggtctggggaaagcggatcacacgaagatctatagtgtttaagtccatctttctcttcctgcaatctactgagatatgcctcagctgcaggtgctttgtatctctggtcaagagttggcaagggatacttaacccatgccatccctttcaaccttggaaagtgttatcctagaatctatcattctccaaaaatccctaaaggccccccgggcttgacaagttcagcaaaaccgtagagaaagcaggttacacctagcttagcctatccaatatccgattcaaaaagagcttggattgctgcctcccgggggacaaagcaaagtcaaagcgcttgatcctttgccccatacttttagatcttcctccccaacaagcaacgggttgagcccggaagaagcagggattgaaccagggcttgttgacagagcagatatcaaaagcctatgttatctcattttcagggaccgagcaagggatgagcgccctctgatctaacgaccaaacaagcaactgcctcaggttttgaataaatcactgatggacggaagggagcgggggccagctcccttcctatgaaagacccgagcttactgggatgatacccctttacatactaatgggtgtaaacaaatagtacccccctctactaaagtgggttggaaagcctgtatgcctaatctatgcagggtaggtgcgccgtacttatttctttctcactcactacttttttctattttcttttgtctatcgaaacagcctagattcaatttgatttatcctagtggtgacagcttatgcttgtccttggaaccgggcgcggccctctttccgctattatgagcgggttttgggttagccagagcgggccaatagggataaacaaagtatggaagtagttgtgaggtaatcagatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcatagagggaacctcactgacgcattcagggctctgcagttgaagcgttccttcggaatacaccacaaatacactggtggatgtactgatggacacgacgagtacttcttctggggggccttccgtgaatcagtcggcgcgtgttagcgcattcggaaccacacatttttatacgattttcggatcatttgattttcgttttgaaaactttaaaaccttatcagagaggggccaccccaacatgatcaataggctgatggccttaccaaaccgctctgctcttgagctttctttcctcccttatggcggcgcattggggcactagaaatcaaagaaatctgctatgttatgtgttatgagtttgggacccagctgctgatgttagagctcttttcgaaagagcagcttatccaagtagttagtttccagaacagagcgagaaagaagagaaagagaggtacgcactgtgaaagaagcccacgttcccactcttctttcccccgttgatcgggttgttaaaagggttagtcctgttgttaggaagagttagcggtgtttacaccggtgtcatgtgtacggggatacgtgtattaagaaaaaaggcccagaaggcatgttttcgaagcttcccccgaagaatcgtcaccaaagacattcttccatgggttttttacatgggggggggg

SEQ ID NO: 53161 - DNA, 46172 bp, Oryza sativa
aattctttttgtatagcttagttacttcttcagcgtagcaggcatgcccacgggaggcaccctccaaatcactaaaagcagcactataccaccacaagtagaggcttcgcagtgacaaccttgatcgaatgtgtaggataggtgggaggtggtgacacacaacgaccaatcctgaaagaccactctttcgtctaaggatgcctaaccgccgcaccctggatccattctgacctaattggatgaatgaagaagagggcgagcagatacgacggatggtccaactacagaacttcttctttttcattacttccatggtcgtgccccgtggcacggaacggctgtttggagttgaagccggactagaattgggagcaaattccggcaacgaatggatgtcctcttttcttcttgtacggccctggtctgcatcgggagaatgggaataacgatcttttatatgatacggaaagcgaagagaatagactgctacatactaagttggttattcgtagatttttaatcgattagttaacatggtggttaaccgtattatgaaagacggaaaaaaatcattggcttatcaaattctctatcgagccatgaaaaattttttcaacaaaaatgtgaattaggaaggattggtcgacgaaatatgaatcgaagactgaatcttgatatacctcataacagcaccttcttgttaccgcgaaatgcaataggcaatcggctagatggcacatccaacctgttcacagttttatgctgctggcacttcagaaaccagagctgggattggtagcggttccacttctcaagtttgcatattctgatcacacaatggaattcaggtggaccagggtttgggacactaatctttaaattatagatgcattataacatgtcaagggaggcgccgagatatgatatgaccaaaggccttgttgttgttgcgaccactgagtatctagggtcattccctttaccaaacattggagttgctgctcgctcgaaagcttttgctttcttcggtactggtacttcggtcaaagtacctaaacctcactaaacctatgctctagcttcgaaaacaggccttctgggtcttttttctcaatacacgtatccccgtacacgtgacaccggtgtaaacaccgctaactctccctaacaacagggtatggggaggggagagaagagtgggtatgagggcttctctcgccatccatagccccctttctttaaaatgcaaagtggacgttcccgcacgaacggcgtgaactctgattcgatccgggtattcaatcccaccgctgagatgctcagttgactccattatcgaatggggcagacactcccatgagctatttcaaccacttactaacacagggacaccaccattttaaagctgaactatgatcttctttcgtgcacatctcgctttttttttcatttatgcgaatgaattgcagaaccaaactaaaatgggttgatcggagctattctctagaatttcaaacttgagatgacttgcttgaagcggctgaggctcttcctaatggaagaaaggacatccaatgttaggatggatctaattcaagaatttctagctctatacgcgaggaacggatgctgttttgacttttttcttcttgctttaatccagtcgctcgataggacttcccgtaacccgaaaaggttggttcttcccctacaacccctacccctccaaggcagtactcttcatcggcaaatccgaatgtctcgatccgagttgagacccacctacagaaattgatccatcaaagaatttcctgctgctatcatataatactcatctctatttggtgataaataaaccacctgtctctctttttttttctttgctttctcagatattttagattgaaagccatagtactaatacctaaagcagtgaaccaaatccctactacaggccaagcagccaagaagaagtgtaaagaacgagagtttttaaaactagcatattggaagattaatcggccaaaataaccactttttcaaaacctatcattaagggcgtgacgacgatatacgagaggaataaaaaaaaactcgtgattggtgtggaggggaagatctgcttatgaaattgttcaagaaagagtcgtctcatttccttatattgaattccttctatggttccacatgagaaaccagtacgaatataacctacatgtccaatcgaattatgagctagaggtcttttgactttcgttagattatcttgaacataggtgcgagtaagttgtattgtttggtctttatagctacagtttgatggtttggtcgttgcttcctcgttttctatttattcatctaattaatctccattataacctacgagacaaagtgattaactatatgattaacgagtaatatgctgcatatgcattggagcattgtggtgttgtacgcatggagcccgggcaattgcccatggtggccaggcgctgcatccgccaccaacagtcgacgtcgcggctgatgagcgtggcgtggagcgcaatgcggccggctctccggcccatgagcttggtgaggccgacgccgttcactgcgccctcggtctccacgtgcccggtggcgatggcatgctgcgccgcgtccaccgccgtgtggaacccgaacgagccgccgctgctggacctcacggtggattgtcgccgcgccgcgcatcatgtcgtccccaccgccgttggggtgggacggaggaggagcagaggcggcgcagggggacgaggatgcaggaggtgggccagcgagggaggagcctggaaggtgaggtagcggtggcggtgagggcggggagaggaaggcagcggctcgaaggtggagtgcggtggtggcgcgcaaggtcgcctcctactgcccacctcgctcacctgcgggaagagaagatgaagagaggcgggagggtagaagagagaagtgaggatgaagaagcagagagagaagggagagggaagaagggaggtgaggttgacatgtggggtccatgtgtgcctcatcatttttaattattttttaactgacatgtggggctatgatttttattatttttccgggatcaaattgtcacgtaaacgccacgtgggatgacgaccaacctaccacgtggcgccacgtcaatcaaaattaccttctaacccgccgagggaacttgtttgcaccggttttgacagttcagggatcggttgtatctttttgggttaaggacaaaaatcggattcggtgtaaagttaaggacgtcaaatgaacttattccaatcaattggtatgtctcatattttggcgcagaaaacccaaacttaggcccatattttggtacctcgggaatgggccgggtacagtgtgaacacgttccagccatatataaccccttcgtctccagtccccatcccccccttccctttcctccacccacgccgcgacgacgagtcgccgccgcggcctcgccggcgaccaggtctccggcggccccgccgcccgccgtgacggggctccggccttccgccctcctccccgcaccgcccgctatctcggctccccgactcctgcattcccccgactctcccccggccgccgccgccgccatttctgactctttctccgcggcgcgtctctcctccgagagcacgccgaccgcctcccgaagcggcgtcgcggccgcggcggccgccgccttctcccgcccctgatggctggcgattcccgaaatgaggcgggttctttctcctttgcctttttttactgctcggatgaaatttgaatctgtgtatgcttgtggttgtgatgaaatttagcttgttctgtccccgcagccgatgttttgcgaggaagggagcagtgaatcgggctatgttctatgtgttattgattcgctgaagaagaaaatcacatcggaccgctttgtttacatccaggtgatttgatttgatttgattgtttggagctgcaaatctcggtcattttcttgtattttctttatttaccagctgattagttttgttccccgtgatctttttttccagaaaagggtagaggagaatagcattaagcttagcccgattacactgcactctcacaatttgtcaaaaaataggcaaactagtacatccaacagtacagatttagtctcgaatttgctcacaaagaggaaagaagatgccctgtgtgctgtgaatagtcgtgagtcatctcctgatgaaagtgaaggtgccaattgccaagatgagtgttcatcgactgttattgtgggtggaaatctatccgcgaggaattctgtccgtccgattagactaccagaagtggcaacactccctccatatacaacttggatatttttggacaggtgcattttcttgacatccctaagatccctgcttaaattacatagttatcatggaaagttatagcgtatacactttattatccattagcaacaacatagcaatactatttcatttctcttgctaaacagtaaacacacgctcatttgtggtctttagttttttgtgcaacaatctattcagtcaaacatagtttttccgacctaatgctttatgtctctggtgattttttttctcttcatgtgtaaatgtgtaatggagatattgcctttcgttcttactataagcttgggaaatggtatagtataaaaatggaacaagtccttatgcggccccttgctacgtgccccacctctctcttaatcacatgcagttgcagacttgcaggctgggagtgtgtgttaaaacaagagcagcaaatgccacattgactgccttgaattcatcttcttggctttggtagcaaagctattgtgccagaaccattggctttgcctgctgcagtgtttcttttgcttttgctgtttcatccgctttatgcttcttagtgttctctttgctattgcgtgattttgtggagcagcaagcaaaaaatcagactgaaacatgtttttgatgaattgtttgttgatatgaatttaacagtatatctcatatgacaaacttctatttttctaaataagtaatgcaaaacatgcatggtcacagttacaatccagcatacttttagtttggagaggtagggcatcttaaggtttgttgaaatataagattttacaatctttcgtgcaggaaccagcggatgcaagaagaccaatctgtacttggtcgtcgaaggatttactatgatacaaactgtggcgaagctttaatttgcagtgatagtgaagatgaagctgttgaggacgaggaagagaaaaaggagttcaaggattctgaagattgcataattcggtaaatatgctttggacatgcatttgttttcttttgccttgaacattcactaaggatgctcaacttgtttgaccgttacaggctcatgggaccaagatacaggtgcagttaccatagcacctggagcttgggctcagtccatagaataacagatctgatgactctgtagtaatagtttcatggagaaatgctttcttctgtaagcattttgtcatattctctgtttttcttttgactgggaaaactaccaggactttgcctagtagtgtaatttcattaaagaataaaaaatagtaatattctctttttgaagtcacaatataacatagtacagaagcaatagagaaatgatattaaatatactggtcaagtaacatttggtatgaaatattcccaagagattatttagtaaaactacattattaaaaacttgtaagaaaaagggtttggttttggggcatatgtcttatatcattaaatgaaatggtcattaccagttttatctacattgttccaggggaaaaccttgagctggtcacactgcatatttgacctggttttgttttgtgcaacccttgcacaagcaagaaaagtatggttacagcattaatctgagttgtttgtggattaatttagaccttaaacatcatagatcacaataatttggtttctcctgtatggaattcttccacttaagggtgattttgtgcaatgattgccaggatgaccattcaagaatgtggcatgtctgatgctgtgcttgaaactctagctcgagatatcgaaagggctcctgatgatataaaggttcatacaacatttattcaatctcacgtcacatttgcatttgatccatttgggattttcctcttccaacttattgtttcatttctgaaaaattaaattacgtgtctattttccaggccaggtatgagatcctacaaggggagaaacctgagggttcttccaagaaagtgtctgaacttaatgtcaaaatggaagacgtgtacggtgataaagatctggatgcagcattggattcctttgacaatctcttttgtcgccgatgtttggtacgttttctgttaattgtcatgtgtgttttacataatatctctggtttactgatgaaacattctgctcattttgatgttggaaggtttttgattgcaagctacatgggtgttctcaagatttagtatttccggtaattttcaaaccaatgagttatttcctaaacttgtgtgttgttctaattagtgtccttttcgtatagactgaaaagcaggcaccattgtgcagctcggatgagggtacaccatgtggtattcactgttacaaactggtctgtattttataggcatatgactgtggaaaagcagctcttcttttatgatgatttagatatccgaaacataagcatatgccgttttgctgatctttacctcatttataatctttttgtcaggtctctaaaccagatgctatcatggagattgattctcatttgcttgttgatgttgaggagccaacatcggacaatctaaaggatcagatagggtcaaataagaaaaagcttggttctagtgggcagaaaacaaaatctcaacaaagtgaaagttcttcaactgcaagggtttcctcagaaagcagtgagtctgaagtacaactgttaagcaataaatccccgcaacactctcctggcctctcaaaaaataagcttggcgcaaaaggtggaatcaagaaaagtactaacagaagaattgctgagagaattctaatgagtgtgaaaaaggggcaacaggaaatgtcaccggactctaattctattgttaatggatgccattggcctagggatatgaagcttagatctgatactaggagtggaattaaggattctgttgtatcctcacagtgtaattctccaagcacaaggagttttagaaagaagggcacacttcaaatggagaataactcatcttttgtggatgctcagagtgattcaatggaggatacaaataatgaacattcagcaacagatggttgtgatagttcaaggaaagaggaatgtgttgatgagagtatatgcaggcaagaagctcatggcaggtcctggaaagtgattgagcaagggcttctattgaaaggattagagatttttggaaagaacaggttggtcccttgaaatgatcagcttcatatgaattatttcactaccttctacttcatcttaatatttgtatactattgcacaactaactgctgtatctgttcaggacagagtaaacgttaatgtgtctaatccctccgtcccaaaatataaggcgtgctttgacttttaattgtcaatttctcacaagtatactgtctatactctatagtggaaccaacatcatatgaaagtacattcaaatatgaatctgacaataccatttttatatcactaaacctatatattgtcagactagttgtgagtcaagatttgtaaaatttgaattttaaaatgcgtgcacaccttatattttggggtggagggattaacctttcagttcagcacaagaaactgactatgctttcttttaatatatctgtattactaaaagtattcaacacaaatgtctatatttaaagcaaatgctcttgcatcataattagacatccccgaaactatattcttatactactacatttcaagtaaaagctgtaacatgaagatacaatctacaatttgtcatgcataacgtattggaatgcggaattaactggaatttctaatgtttgcatcatttagtatctagttgtgttagttatagcgtttcatgtacaagaaattctgatgtatgttcatttcaaatgccttaaaaactcattcctgttttctttggatgtcttgcaagcatattggaaatgttctttatcctttctataatgagtagaataccttgttttccctaatttgaatagtcatactgagcccttgtttttcctatgttgaagttgtttaattgctcggaaccttctgggtgggatgaaaacatgcacagatgtttttcagtatatgaattacattgaaaacagcagtgcatctggagctcttagtggtgttgattctcttgttaaaggatatatgaaggtaggattcatcataaagctcatttacttgtattttcccaaggtttcatcttactttaatgcttgaactcccagggtaatgaattacggacaagatcaagatttgtgagaaggcgaggaagggtccgccgtttgaagtacacctggaaaactgcaggctaccattttataaggaaaaggattacagaaaggaaggatcagccttgtcgacaatacactccttgtggttgccagtctgcatgtgggaagcaatgtccatgtctcacaaatggtacctgctgtgagaaatactgtgggtgagctacttcaattattcatattgcagactccgagaacattttttcttctagatattaataatgttgcttatgaaaacaaaactgtgtagatgtatacaatttcaatattgtttggttagtgccgaccaattatgtcgtatgatcacatcttagttttgcaatcattgctgcttactgaaaaggaaaggaaaataaaacctaggaggaactaggcaccctttcaattaagaggaaaacaggcaccaaatttctagttgaagaggacttgaaccttgatggtgggagagtgagggtgtaaactccgcatttctcacccaaatggtgaatcaaacacatgcttctcttttgttctgtgtgctcttttggctattagctattacttattttgataatttataattttaattggaataaatgatgcaaacacatggagtgcaaatgtttgctgtccgcatcctgctgatgcaagttgaagtaatcctttctgcgttgcaggtgcccgaaaatgtgcaagaatcgcttccgaggttgccattgcgcaaagagtcagtgtcgcagccggcagtgtccatgctttgctgctgacagggaatgtgatcctgatgtgtgtagaaactgctgggtagggtatgtattttaaattctgatgaccctttgaatgattttgctagttaatgcacatttgtatatcttagagaaaggcaccaactataatgtgcttttcattctttgcacttctccaaccttacatctaccttgaaagttgagaaattaccacctatgcctgcacttgaaggatggaattttgatggatgatggatttatccttaagtgcaggaagaatcttgcatatgtatattccagtatctgaagatacggagttctgcagtaaaatatcttaatggtagaattgaatttaattaatataatcatatcaattgcttgcccaacagtcccaataggcaatagctacattccacaattaaaaaaatggtgcaataataataatttgacatttccttctcataccatttgctagcatacttgatagtgtgtgccagcacattgacaattgatattctatatctaaattatttataacaatatctgagttttataggagtgtttaccaggagttaatccatgaaaaatgtatcaatgatgggggagtttaatttgaatttgttatgaacgagcttctaatggtaggaaatgaaattttagatactgtaagttgttaggcaaacaccaaagatgagtatattatccggccagtgtgtaaatccaatcatgatcctttttcactccatggaaccttaaatatgctttctgttattcattgttgaaatagtctgttattcaatttcaattactgtttcttcatccctaatttttctagaacaaagcgccagtacattgaacttctatttttctacctgtactttctattgtgcaggtgcggtgatggtacattgggagtccctaaccaaagaggtgataattatgaatgccggaacatgaaactgctgcttaaacagcaacaaagggtaaaccttttgcactttgatttattcatgctattgcaccttggttataatttcgtcaagcctatcgattttttatgcctgcttggcccttccatttgcctttattcgatgctttgatatttttgtgtgaggaggcttgaggtctaagttaattacccagcagtacttctcaatagttttattctttttttttaatatttttcacgtgagttcaaattccagttgtctaaatacaaaagatcttaagtttaataccaaagaaactagttagagtaactatattccaaaacaggcaatgaactatgaaccaaaaaacttcccattagcaggaaaataattgcataaagtatctatcgattatgttggtgaatttatgaaacaccagggggtgttacttcattttctattacaggtcctattccatctctaaatatctgtaaatagtattgacttgctatgtgcactcttcaggtcttacttgggagatctgatgtttctggctggggagctttcctcaaggtaagatttctctattgacccttttcctccctcataggacgtaccctcatctaactagtccttttcctaaatcttcagaatagtgttgggaagcacgagtatcttggcgagtacactggggagcttatctcccataaagaagctgacaagcgtggaaagatatatgaccgtgagaattcatcgttccttttcaacttgaacaatgaggtgagtgcaaagacaccccgcaaattacggtctgcaagcattcaggattgcatactgtactgatttgactagcctaatgtcatccttttgcgtgaaccgagttgtttacatccccaacccactgttgttcaatatcgcgcgatttatgatccgctgcagtgttttcgctgttttcgccagtaccggatgctcactcactcactttaccctctcgatgaatgcagtacgttcttgatgcctacagaatgggcgacaagctgaagttcgccaaccattcccctgatccaaactgctacgccaaggtcatcatggtagcaggcgatcacagggtggggatcttcgccaaagagcggatcagcgcgggcgaggagctgttctacgactaccgctacgagcccgaccgggccccggcgtgggctcgcaagcccgaggggcccggtgccaaggacgacgcccagccttccaccgggagagcaaagaagctcgcccactgaagaagaagaagaagaagaagatcagccgttgattcttttgttgtcttggttgattctttcgttattggtgagggggaccgagaactctgacggtgattagcgccgtaaggaaaactttcctgccattcgttggccccctcgattcgattcgttgattttccctgaattctgtaactgctgcacctgtcgccagttcaacttcaaaagatttttctgattctggatcagttgttgtgttcttatgtgttacttttcgaaaatacaatcaccatctaaaatgcatgcatgacactgttgacttttcggataactttggcccattcatcttatataaatatataaaagtataaatagttttttattgataaaacaaatcataacaaaataaatgatatttatattttttaataaaataaatgatcaaatgttttgaataaggttaacggaggagattaccgagttgtttccttcgtgaaaagtcggcgagagctggaagccagcgatggctgggaatggcgtggtggcgttgttgccaagggcccacataccatacaccgtgcgaacgccgcggcaaagcttgatgcgaggcttgtttatctcgtctagcagtagcaggcatgggtagggtcaatgggctaatctgcgtccggcctatcctgaggcgttgtttcaaaagatctatacaacaaaactaacactccgttttgtattataaaacgctttgatttttttcaaacctttttaagtttgatctttgtaaaaaattaacatcttaatatcaaattagtttaattaaatttaacattaaatagattttgatagtatgattattttatgtttaaaatattataatgttttttataaactttgtcaaacttcacgaagtgacttaaattaaagttaaatcgtcttataatataaaatggaaggaataaagagtatattacatttgttgtacacaaatttatttaggtgggtataattctatatatgaacttattatgaaacattcgctgtaatacacgaactcgacatggtcagggtggcgaggagctccgagtgatggcagatggactctccatagatcgaccccctgtgatggtgcgggaaggtgcaagggtgagcagccacaccgtacgccggtgaaggagctccttttcctcttcctcctcctcttcttcttcctcctcctcctcctctctctgcccttcccttctcgatgaacaaaggagccgaagttgcagcctgtgagttatatccctccttccccgaccactactactttctgtccctccatccccagctccctccctccctccgctcccttgacatggattggagaaggagcaaggtgctcgcagcggacgcagggctcaagctcctccacgtgcaactagcctcggtaggtgaaacctctctcactttatcgatgctcagctcctccttgcccccaacccttctcactaccgctcagtcgacgttgaccgcctcctttgcttccgaatagaccacctcttctgccaccaacctccatcttatttagatctcattggcttcgacatagcctaggcagagctcctagatgtcgaggcaacaaagctcggggctcgcgaggaaggcggagcttggtggcagtctgacgagatcccatggagagcgaacccgttgagttctggtgagatccgttacccttgaagccttatggagctttgcctcttgttggcgccgtccttgaagccttgccaaggcctgcctctcaccaacaccgccattgaagcctcatcgagctctcttaccaacgccgatctaaagcttcacctctatcggcttcggctcagcgacggaggccacaccatggggaagagggaaagaggggacacaaagcagaaagaagatgtaagtagcaatgacaggtggaccctctctcttatgcaaccaatgtggatctattgtataggtcaataggtggcatccacgtgtagtacaatcaccgtaaaatagctcgaaggtggtaaatcatttatactaatagttggcgtatcatatctggttttataatttctaagtatattttagaccaccatacgatttcaagagagtaaaatggataatcccccataataaatctcactagttgtgtgatatagcggcgtatggacactaacaaaacattaatgcagccaaagcaaccccccatcatatctctcttggccccccatgatatatgaacagaagttacagaacagtagcagtgggggtacaccctataccctccctgggggacctctgaatacttcgatcagagtaacggtgcggtgccaaactgatcagatcacacacttcagactacagtcaaacagagcccttgcttgctttgcttgtgtcttcaacttcagagaccccctcctaccctcaaaaaatttcccctttcttttcctccgtttcttgcagcgacaagagaaatactaatactcctcctcctactactgctactgtgcaaggggaaggacacgacgacgaattggagagcggcgtcctctctgatccttttttttcctttattgcatctctctctctctctcgccatttttcttctaggttggtctctggatcaggccattgagggggaaagaaaaggtgcgggttttggggggaggttgttcttgcgggaggccgttgatttcgccgtgtgatcggaggtgaggttcccagaaaaaaggtttacaatccttcttgtgtttttctagcctagtagttcttggttcttggatgctagtacgcgtgtccgtcatcttcttgttctttgtgtgcgccttccgaggatttttattttccttccctttgttatttaatggtgtcagtggattaggtttatgtgtatctgtgttagtcatctcagctcagctcagctcagccttgttgctttcactgactgactgtacttacatttgtttaagtgagattaggtcgaataaattagtaggattccctcaaaagaaccatcttttgtggagttaggtggatttggtgctcatccgtgctactttctcaccctagaagcttttgttcaccacccagattttggtcttcagggagtgaaaaggagatgaatgagaaggacgccactgatttggaggagaggagtgaggccagtgagcacggccaagctctgagtttccatggtggtgccatgttcttgcaagaggctcagattgcttctcctgcagctgcaaataatgcattgacctccatggcgaatcctttccctatccctcctgggttgtggaatccaccttcacacaacatgggtttaggcgaaaccagtttttcatccttgttggggatgctgtcggccggcgcgccgccaccgtttgtggctactcccgggtttgtagattccacggcggggtttccttgctacaatggaggcaatcttggagccatgatcaatcaccctttccctggtatccaccagcctttgggtgatttccaaaacggcgtcgagccatgtagggagattgaggatattgagattgaaggatccaagaatgtgtcacaaactggtgagaagcagcaaggggatggtgagacaacgcatgccgtcgattcctcctccaaggagctaagcatgccagggcgcaatggtggcgctggccatgatgaggggactagggtgtcttgttccaagaagaggaaaagatcaggacaggtatttgcttgatgtacacatatttacagagctgaatctccgcatatttaggtggagctaagaatatgaaattttcttgattcttgaaggatggtggggtgaagcatgcagaaggtggtgagcaattagcaactgtcggttcagcgcagaagaatgaggatgatgaaaagggtgaaccaaagaggtcttctgtggcgtccgggaaatccagtgggaagcaaataaaggataatgcaggttcaccaaaggaagactatatacatgtaagagcacggcgcggtcaggctacaaacagccatagtcttgccgaaagggtaggtcctttttttcttctctctaatgatctcttcataaaatggtgtatctagccatctggtttgactgttattgttcgggatgcaggttaggagggagaagatcagtgaaaggatgaaatatcttcaggatcttgttcctggttgtagtaaagtaagtgcttcctaactgtcccctgcctccatactgaatgactgttaatctgttatgacatcaattgtgaaatgtaatctaggtaactggtaaggctgttatgctggatgagataattaactatgttcaatcattacagaggcaggttgaggtatgatgtttgtaaaacttgtagggccattttcagttttacttgcatagtcctgctgcgatgtaatctggtatacccaatgtgtgcatgttgggcagtttttgtcgatgaagctagcaagtgtcaatccaacactggacttcaacatagaacgcattttatctaaagatgtaagatagttctcacctggtctttatagattttgaccctttagatttgtctttctcatgatgattgtttcatccacacagatttttcaatgtcgaggcactactgcatcatctgcctttggcttcttcccagacattgttcatccccgattacacccaccaaaatatacacaagttgggatgcccagcattgtgaaccccactgatgcatttggaagagtaatccatgctccattaggaactaacagtgcattcaaagaacctaaacatcaggtttgtaccatcacttgcatttggctaaatggccattttcatttcatgctctttataccaaatactgtgttcatgaaaaataggacaagtttctgcaagatgttccaagacctaatttagtgttatatggcttggtgtttcgagaatactgctccacagatagtcgttgaaaagaatgtccacataatattttaaaccaagaaaagctagtcccctttatatccttttgctgggtcttgcttcactacccatctttccaaaaagttcgtgggtcttaaaagcaaagcaaactagataacataactaaactgagacattttagacaacaaacaaaattcctactatctgtttttcataactagccagattgtgcctgattcttttggccatgcaagctgtttgaacctagtccatcaatcagtctctttagcttctgactcattaaccctcttcaacctgattttagtgggaagagcattgttgatgttaaccgacattgtaacctcagtagcactaaccatttcactagtaaaccaactaaaaatgtacaaatgcagcttgttatatatctaattgtatcttcatcactacatatttgccttcacagttatctaaaacatatgctttcatattcataaacatttttttggaaagcggagtaccaaagcactgttttagtattttgcaatcctcttattacttgtgcattggacagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacagctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcatattggcacagatgtttttattccagcaaagctgtgaattctgaaagagaagaaaagagaactgtgatctagtgttactggtgaccttgtgtccttgttaagacataattcactacacactggtattggtgaccttgtgaagcgataatcatctgatctgaagctgatggtcatggcaaaagcagccaaggaaattaatctcatgaaactcttgctcattgtttcactgaatctgataaaacatgacatggcacgtttctgaagcaatctgaggtctgaacactacatttttgctgcatctatatgcaaatatttctttctccaagcaaaaacaccaatccacaaaagacaatttctgaaacaaattatacatacatgaagaaaaagaaactactacctatgtcaaagagcatataatcttcccctgctataacaacatgtactagctacattgcatctgcagtgttctttcttttcttcttctcttttccctgtgaacttgttcagtatagttacaagaccaaaccaaatacaccaagcccatatgatgtagttctagtagttacagccaagaacatggcaagaaactatggagatgaagatgaagatgatatgctacaactcgacggagacgtaggtggcggagtagtccggcatccggtgcaggctccggagcacgctctcggcgacctgcttcgtcgcggcgtcgcccttgtggaacgcgctcaccagcgcgctcggcagcgcgcggtccgccgtcacgtcgcgcacgcaccgctcgccgccgtgcgccaggaacctctccacggcccagaagcagcgccgcgacaccgcgccggcggtgtcgccgccgacgtcacggtgctgccgcagcgcgcgcaggacgtgccgcgcggcgtcgtgctcggcgagcacggccacgccgcgttccacgtcgacggcgtcgtccatgagcgtgcagagcgcgcccagcacggcgtcgaccacgcggccgttctcgttgctctcgaggacgccgacgagggcctccaccgcgccggcctccgccaggcagaacgtggtggccggggagcacacgccgcggtgcaccgggcagaggcgtccctgcgccggcggcggtggcggcttccggttgttgtcgtgcacccgcccggtgtgcgcgtcgcgcaggcgccggaggatgttcttcttcttggggcgccgttgctcctctgatggcggctgcgagaggttcaccgactggtggctaaggttctcgaggccgaccgccgcgagccgctgcaccttgtcgctgcccgctgaccgcacgagcagatcggtgagcacccccgtgaagttgtgatccatggccgccaggagcacgtcggggtcgtacagcgtcatcgtcatccggacgagcgcgccgacgaggccctccatgtacgtcttggcatggcggctcactcgcatttcgccgcgctgcatctcctctatcttggccagcaacgtcggcactgctccctgctccagcagcgccaggttgagcgtgatgttctggtacggcagcctcgccagcagcgtcgccgccacggcgtgccgttcggtgacacgcccgggctggccgatgctcttcaccagccttcccggctgccctggcgccttgcagagcttctcggcaatggtgtgccccatctgaggagacaatgcaatgagcagcctcgtcgcgctgatgcctaacgcctccgtcttcgagcccatgaactcgatcacggtcaggctgctgtcctgctccttcatgacggaccccaccgtcatgagcggctttgggagcgcagtgagcgcgagcagcacacgtatgatgctcaggttgagatcatcaggcatggagcacttgagcatgtgggtgaagttgtacaccgaatactttgaagtgatgacatggccttccttgttgacgacgatggtgtcgggatcgagaccggactcgacgatgttggcgagcactgcagcagcctctgtcttggaccccataggctcgtcgtcgatcttgcggatgaagagctcctccaccatgaccggaacagcaccggcgtcgacgagagtcttgctgttggggccatctgaggagatctggacaaggacatcaagggccgccttgcggatcacagtgttgccgctatgcaccatcttgatgaggatctctgaagcactcccagcaatgttgatggtcatttcctgcttctggaccagctcgccgaggtagctcaccatctccatttgaacatcttcagaccctgttttatatggtgtttcatgtcaggtaatggactaatggtagtgtcatggtgttaagttcacgctagcgaatttcatattagtcatcagagcaatattactatatctagttataactgcttgttctttgttaatgttcaccctgtactgaagtacatgtattcagaaattgattgatctaatgttaagcacactatttacacaaataaataagttctctattaatagtccacgatgttgacttttggcaatataaacttccttatttgatattatatatgataattaacacatcaaagaaagtcgtgtatctttctgcataggcaaaatttttaccttccactaaatgtctttggagaggatccaggtaaccactttcagccatgtacttaatgttctttgggcagttctccaggttcttgagaacctccccagccttctctgcagcaaccggatcatctgaatcattgaatttcattgtggtaagcatcaatatgcttccagaagttgatccgatgttttccaacaatagctccgatttcgaaagctctagcaagaaagagatggctgcatgtctttcatcaggactattactagaaagcagctttattgttcttgtaatggctctggtatttgctatgacttcctgtacgtcatgaaggcatgaagaagaatttcagttttgaacaaacacgcagggtaattgtttcagcatttaaataagtttcacacaaccaggccagcgaaaacattgaacatgataagggtcaaaacgtttcaggcttccttacctttcctgtttcatcctcagccaataagcaaaggagatccagcgaatcacagcgtatcagaccatccttgtgctccaacaaacgagggaggaacttagttatcccgattttgtgcatctgttccctgttctttctccttatcttggccagcagcttcagctcttgtatggcctcaagcaacattgcctctgtggaagccatggagagcgcggttcgtgcaatcctgacccttgtggcttcatttctcataatccattctgcaattgtgctcttcagtggaacattgctcctcagtgccttgctttgcatcgacatctttgtcacagggcataccacaggttcagaaccatcagcaaatttctcaaagtactcctcaatggctttcctatcatatgtcacaccactttctgttgtcactggatcaaccatgaccttgtttgtcaatggacagaagaacgaatcatataatggctcgacatattctgcaacttcagggagcgaattgaatgaatgtgcaccgatatcatgtgattcatggtacattccctgcaggaagtccaccagccttggcatgtcactattgtgcaatgttcttctccggggcctgctgtttgccgggattatcgacatatcggcctcagagtaaccatcgcaggaattctggtcacaataacgcggccgatgtcctgcaatctgaaggtttgcatctgctctgccatctggaaacctgctgctaccaaatgttgaagcaggtatcctgctgagctcatgcccaatgttctttatgacactgtcaaggtcctcggtcatgcccaggaggtcatcgttcttgagctcccgcgcaacggcgctgcacctcatgacgaggtccttggcgaggtcgacattggcagccagatactccatgacgtgcatcacattaaccgtcgaattctgcactctctgcagctccatcgtgaccaggggtgcatggtagaggtggctgcctacatccatgaagttctcatgctcggcatcggctgccgcctctggcggcatgagctcagagatcgcggcctctatggactcaacgagtgacgccttcctcgcctgcgctccgcttcgctgaacaagagtacatgtcaatcaggcacccaagcaaaagcatccaaaaacacagataacacacagactgttctgttgtgatgacaactacagtccaaaattcatacagtccaattataaagcaataatacaggctcccttggctgcaatcaatctgaggttgacccaaggggttgagttctacacaagcaaattgacttcccccaattccaaatttttaacagtttgttccaagaactactagcatcttatctactgtacagtgaaaaaatcaccaggaaaattgaatagaggacacaaataacacaagggggggggggggagtacatcaagaacagcttgatgcacattctacctggaaatcaacatcgtttctccgttccatctaaccaaagtggcaaaacgtactaccaccaccataaatttgctcacttcaagcagggttcgccatctctagcgcaaagaccccccatgaatccatgattcctcgccttaccaaatcacgaaatacaaacagaaatggcacaagaaccgaggaatttgcgaatcacagcctcactacccacctttacaaaaaaaaaatccatgaaatctaccgaaatttatggcagcactacgaattagcagcaagcgaacaagccagcttcgtccccccaaaagagagatgcagcaaacagcaagctcaactcccccacgcttacctgcatccaagaactccaagaacttgaccgcgccgctgcttctcctcctcaccttccgctccaagctcctcctcctcctcccgagactgagaggacggagacgctacgactggggtagcattctcccctcctccaccaccgcccccgccatggcctccccactcctcaaacttacagcgccaccaccaccccaccaccgctcgagccgaggaataataccacctcgctcgcgtagggaggaagagacgagaacaaaagagggagagagggagagggaaaaaaaatacggaggaattacggaagaacgcgcagtggcagcgcagcacggagactcagtcaagtgaaggtcagtttgttaatcgttataagcaacctctccctaatctttttttgttttttttttcttgaaaaatgtaaacctcctgttttagactttagagatcggtaataaagcgacgttttctttttggatggataaaccgataaagcgacctttcttttaacaaccacctttctaatggcgttttaccttgggagatgttgactttttctttttcttttttttcttttttgtttttacagtgatggtgcttagcttagctgcaggagtcaagacttgcagtgcacaccaatgtatgtgtcaaaccacagactaggcgtttaaatttttttaaacttggcccaaagattgttttttacggcaagcttaagcagatgttttgtttaaagaaggtggttagctatgtgccaactgtcataaatttttttaaagtataaactgatggtttcttccctatttccaaacagtttctagctggtatgcaatattcggtcaaaattcggctgagtttggttagactggaggatgtaaaatatatttttggttgctgtattagattttgagcctgggctactgtttagggttaggggactcccatgcgaaggttaggctgagtgtttgggaggcctctctcccacacgcaaaacagtgtatgcattaactactttctccatctacttttgatacttatattttatcttggcacacagaccaacgataagtaattatacttatcatccatttaaacatgctagtcattcctcgtaaacaagcgattcattaatatttacatttctcgatgcccatatagccaatcttgtgtggaagaatggagagtcacgtattaaatccgagaaagatattaagaggataggttgttggattgaaatatgcctatcaaaaataaatttttcagatttggaaatatgactatcaaaagtatatggagggagtaattaattaaatattatttattttgtaaaaaaataggactaatatgattgtttaaaataatttttgtatatttttttaaaaaatacactgtttagcagcttgaaaagcgtgcgtagaaaattagataaatgagttgaaaaggtggagaaaagagctcagccttacaagatatttctggtagaagattttgtttgattaattggttatataaattttgagtttatttatctctttatttgaatggtgcggttactcctacacctccaatagatataaatatatatatccacaacactcgaaatataatgtgagatagtgtggtctatttgcactgaacaagtactccttccagtcacaaatgtatgagacagtgtggatcatgatatggttaccaatatacggagtagtattttataagagctactatgggaaagttataatattttgaaactatttttaagataaatctaaccatatcactttcaaaagttagatcgaaatatttaaagagaataatgattcaaatttaaccatgtttaccgcacacattccaaatcgtcacttatttgtgaccggagggggaaagcctaaatatcacaaggtcaccctcatcatttccatcgcccttcgttgcaatcaccattgagctggtcaatgcgttcttaccacgagtccaagggtaggggtgggcattcagaataaccgagaaattcggttcagttcctcaatcttttggaaaattcggtcttcagaatcacaataccgatcggttttcatgaaaactcaagaacgagcactttggtcttcggttagttcggttcgttctcggtcatagaccgaactaactataacaaaagttttaaaagcaaaaaaaaataaatactccatacaagatcaatgaatcaaagcaactcgcatgaaaaagtacatgatgccactagaaaatagagcacgattcagaaaaaaaaaggaagaatatcaaagcaaatcgatattgccatgacttggatcctgtcgctttcatccccgaccggcctccatcatcgaggtctccggcacagcctctttcgccatcgtggtgcggatagccatgagcgtcaggttacagcagggtcgccggaaggagcacgatctcttccgccacaccaggcgaaagggcggctcggcgcaatgaaggtcgtcgctagtggcgccgttgcatcgtgaggaggcggagggcggaggcggtgccgacacggtggagcctggaagcggcgagatggagacggaggctgagcgcgaatgcacgatggatggatgcggcgctgaagatgagataaggatgcgggagatagggtggctaatttacagggtttagcgttttactgggcttattggtcctcctagatctattgggccacaattcggttttctcgattaaatttggtcttttgatggctgggactgaactactaactaaatttctcagtcttggtcttttcaattcggtctaatgctgcccgcccctacccaaggcaactaaatcttttcaacgtcaagcttcttactgtttaagaagttacatactttctctgtcaaagaaacaattcttgaattgatttgttttatttttaggacagatggagtacgcgtgaactatatagttgtgtttgctacatacattttaaatcgttatttatttgtgaccgttatggctactgatcggtcgtaggtcttgcttctgttgggcctagagtcggtcaaggtaatgctgcaggggtggttgcataagacagttggtttgatgcaactatgggtatgtttagttccacgtcaaaattggaaatttgattgaaattggaacgatgtgatggaaaaattgaaagtttgtatgtgtagaaaagttagatgtgacattttagggttcaaagtttggaactaaaccgggcctatatttgggagagaattttaagaatcatatatgggctgtgtttagttcatactgaagtttggaagtttggatgaaattggaacgatgtgactgaaaagttgtgtgtgtatgaaagatttgatgtgatggaaagttggaagtttggaaaaaaaaacgttggaactaaacggggccatggtcatagtacctacatggtctctcaaaaagtgggaaatgattgaataacaaacgatttattgaaattttgtaactccatgcaggaaatggtccacgttttctttgaaattgagagccgacacttccctttctatgaaatttatgcaagatgtcatgcaccaaaacagcatgataactgtttgcacattattcatcattagctctacccttggcctgatcaaaatatgatggaggttgaaggaaaacattattcatcattagctctacccttgacctgatcaaaatatgatggaggttgaaggaaaaggctagctactactactagagatcgagtagagacaaaattatagcagtagtattttttgagttgtcactcaccctgattgttcatgagttcttcaatatcacgtctcggtcttttaattctgctccatttccctcatcatgaaggcgtctaggcattgatggcctcaggctgctgctaaatcactttgggaaaaaaaaaaagccaggtatgttcccttcaaacttctaaaaattccattacattaaatatttggacacacgtgcatagagcattaaatatggatgaaaaaaatcaattgcacagtttatatgtaaattgcgagacgaatcttttgtgtctaattacgccatgatttgacaatgtgatgctacagtaaacatttgctaataacggattaattaggcttaataaattcatctcgcagtttacatacggaatctgtaatttgttttgttattagtctatgtttaacacttcaaatatatgtccgtatatttaaaaaaaattggcatacgaaataaacacggccaccatcaagaactggtccagtggaagctcattaataagttttctgatctcggtctgaattttgttaggtggtactactactcctaattaagaaagccagtgatcaagggcaccttggtagtaccagtttgttagggcaacaaaatgttgctgagatttcttttgcattgtgttagaattctacgccattaattcttaactaacagtacttcattagctgtacttcttggtagtgttagaagtacaatactaagcatgtaccctagctctcccggttaacgcagagcacgttaaatatgatagtatcaacttgttaattatatctatagtgtctcaatatatatattttttgacttgcaataaaataaatcaacactttttgtataatagaaacattcaggcctctacatccagatgtgtacttgaaaaatccaaaaaaaaaaaacaatagattatttgcatgctatcatgattctttaacacgttataaattaaagaatacttcctctgttcttttcttgtattgaactaaccatcgttatatattaaaagatagagatagtataatatataaagattaacgcgtctatttttattttaactagaatatgagcaaattacaaataaaaatgacatattcgctccttaccattacaaatgactactatgttctttaaaaatataactactgttgacagttagatttggtacaaatttagggtgtgtttagttcacgctaaaattaaaagtttagttgaaattagaacgatgggatgaaaaagtgaagtttgtgtgtgtaggaaagttttaatgtgatgaaaaaaattgaaagtttgaagaaaaattttaaaactaaactctgccttagaaaggagtcagagccttttcgcaaaggtcggtcggacaacaattcataccacggtctgactggatgccttgtgatttttttttgtggggatctgaccagttgcctactgcagttgaccaagggtttgtttagtttccaacttttttcttcaaatttttaatttttccgtcacatcaaactttcctatacacacaaactctcgatttttctgtcacatcgttttaatttttttaaacttttatttttggcgtggaactaaacacagcccaatatggtttaaccagcagccccgagttttaggctaaggccttgcttagattccaacttttttcttcaaacttcaaacttttccgtcacatcgaactttcttacgtacacaaacttctaacttttccgtcacatcgttctaatttcttcaaactttcaattttggcgtggaactaaacacagcctaattgccttttgtttgtgtgtgtgttttctcgcttgggattggatttctcaaatcttaatgtatatctccaagcctaatagagctgtttcaagagcaaaaccggcctccgaaatacaattggcaagcttgatcttgaccctgtctagcaagctcatccattaccatgctagctagaatgcactaaaccttgctctgattgatacaactcagcacagatcattcttagcagcgctggtagaatattcaaaataaaaccgtagaatcattctaatatgtccataaaataaacaaattaaagcataattgcatggtagaatcattcagatttctgtaagcacaaattaatgtgtaagttctcaactcgaaatgcagtgtacacgtactatatataaacttaaacatcatatatcgatggagatagctagctactcctagatacgtacggaggagttaattaatctgattgggggcaaattaaaatcattggcatgattgttcgttgttggaacatgggcaccacatgcaattgatgatctgatagcaatccatataaccgtgtagatatctagctaacaggggtttaatcaaccgcaggccggtacagaatttaaaataaatcaaattagcaatgtggtcatctaatctctggaccctggcaagacatatatttaatgaatcaatggggtcacgaagaaatggagtactgtgcctgtatgtgatcttaaaatgatgtttggggagcacggaaagcatgcatgtttggaacacatgaatatgaatgaatgaatagtagtacaagtaatggccttgtcgccaaaaatgactcaaaccgtaccatttcatctgaaactaatgcaatttaatggtcggtggtttattaactcatcgagcaaattttctgtccaagggcccggagtatatattgttaacatttcaaaacccaatacaaggatttttgcaggactggaactcttgttaattatggcggaataggagatttaatttccatgtaaaatcttgtcgatttctccaaaatttgtgtgtgcaagttcaacaatccagttgaaaattgatctcatatgttgtctatactcttttaaaagtaaataatcgtggtgatgagtggcgaatctatcaccactctcatcgaaaaatgaagctagagggctcacatgtcattgcacgacaaattctttacttttgtggaaaggaaaaatgattgtctgaaattagatggctcacatatcagtaacaaataaatgtcgaaactaagagatgatatatacatatacagaaaatgataaaatgatactaataacggattaatgacctattgtaacacatgtgcaatatggtagtaattttaaaatattactgacaagtcgatttatgctataataaattttggtactgccatttttttaaagtttcctcaactatattaagtcaatactagagatactattgaaattaccaagtgttcactgttccatattttattactagatgttttgggttggtctcaagtcagaaattttaagtttgatcaggcttataattcttttagcagcatttgtaaacaaaaacaaatatactataaaatatattaaatggtggatttaataaaactaatttagtgttatagatattgctatatatactttttatgaatttagtcaaagaagtttgacttaaaattaaaaaacatcttataatataaaatgatggagtatatttttagcaacttatgttttggtgttaaatcaaatcagcattgtgtcaagctctatacgctcataaatatttgacattacgataagatttggtaaaacttttgaagctttggcccattaacaatttcccaaatgcttagtttaattcataaaaaaagatgtatgtatggatttgccttaaaaaaatactaacataatgacataaatttattgtttcattcgtttcaaaatataaattaaaaaatatattagtacataagtatttttaggcacagattctaatacacgagaatctatatattttcagctaaaatgatatgcttaggtaggtaatttaaacaattcaatttgaccactaagtcgattaaaagataacattttttctctatcttagttttttgctaaaaatcatagaaatggttatatttttaacaaagggagtagattttgtaaactcgtttcaatataaaattgatggttaaagctataaaaagtttgactaataaatcggatcattggaagcgaaatatatatattgaagctgaaattcgtttgtcatggatcggagctgaccgttgcaaattctctatctgaaagcgttcattcgaatttgagtagctagaaacagagggaagggtactttattatcaggcttacccaaattaagtcgagacaagaacaggaagtagacggagaagaagatggccggagagtggagacaccgggaaaaatacaaaggacgagctaccgccgccggccagcacagcgccgcaatgtactggaccagcgcgaggcgacgagcacagcgaacgacggcgtaccttttttgtttgggaactcgtcccggattctcttaagatttggagcagctccgtcaaagtttaatagcatagcaactgttgaattaaatttaaaaatatattgttcattcaattttttctcatgaatattcgggatgcaaattttttttataaatataccgtcgatctcgcacaaccgttgcgcgaaaccgagatgggtgtgacgtcatgggcggtatcgcgcgttgaaagtgcgagagcgcacggtctcgcgcggcgaaggcacgagagcacgcggtttcgcgcaatggaagagcgagaccgttcggtctcgcggaatcaaacagcgaaactgttcaccggttccatttaattagtgcttaattacttaattagcaattaactaataatgattagtaactaattatcctaattagcgactaattaattattaattaatagttaatcaagataattagtcgctaatcgaatcagcatggcaccggtctcgctcagtgcttgtgcgagaccgttctgtctggctgtaccattccacgagaccgcgccgtcgtcccgcgagactgcgcggtctcgcgccttcgccgtgcgacaccgcccacaacgtcatttccacgtcattctcgcgcaacgattgcgcgagatcgactatatttacgcaagaaattttacatcccgaatatttgtaagaaaaaattgaataaacagtatattttcaaatttaattcagcaactgtcgacaataaattgtgtgtcatatcattttaaaaatgtacacaaaaatagagcatataatagttaactattaacacaataagggggtgtttgggaactagggactaaatttagtccctctcacaaaagcataagtccctatgtgagagggattaaagtttagccccactttaatccctccaaccaaacaccacctaagcaatacacatattttactaatacattttaaacaaaatctctctttccatacacaatactcaatcccatgacttactatatgtgttactattggatctcactttcttagagctcgtgtgtagttggctactagttttaggctgtgtttgtgttcgggaggaggggttggaacccttcctcttggcacgcaaaacaaaacatctattattgtgtgattaattaagtatttactattttttaaaaaaataaattaatataatttttaagcaacttttgtatagaattttttttacaaaaaccgtaccgtttagtagtttgaaaagggtgcgcgcggaaaacgaggaagggaggttgggaaagtgaggaaacgaacggagccttagttgcccactctctctcctccacatgggcattcaatactacatgacatctggataaaacactatgatagacattagactatagcttagggtatgttcggtagagttctaaggctgaggggctgtttgtttggaggggctaatccataagtccctccactctagtcccttttagcccctaaaataccaaacaagagggactaaaagaggctaaaactacctaggtcataagtccctgcgggaggtgctaattcggactaaaggcctatagcgcacctaccattaaatggatgaagcatgtaggtgctggataaagtgctactagataggtcatttaacgaggttttagtcacttttagtccctccaaacaaacaggatagaactaatgaggacttatgttttagccctggaactaatttttagctctaggacttatggaacaaacatgacctgagttatttcttcaactttcccaactcacattcctcgtgttccgtgcgcacgcgttttaatctgctaaacggtgtgttttttaaaggttgctatacgaaagttgcttaaaaaatcatattgatctatttttaaaaaaatagctaatacttaattaatcacacgctaatgaatcgctccgttttccgtgcgcagaaaatgtcttcccaatacaggctgcagaacacaacctaacttctaaggccgagtttagtttcaaactttttcttcaaacttccaacttttccatcacatcaaaacttttctacacaaacttccaatttttccgtcacatcgtttcaatttcaaccaaacttcctattttagcgtgaactaaacacactctcagggctggccctgactttttggtggcccattgtggatcaaaaaatgaaggcccccattcaccataaaaatacaagataatatttaaaaactcattgtcattaacgaatttcacactaataagtttaaaataccaaaaagaaatttctctagctcatttaaaataatttcttctaacagttctacatgcaaaattagttatgatagtgtcaataataatctcatctatatcttctcaatgcacaaagtagcctatcagggtatatatattttggaggcctctaatttttggaggcccagtacggtcgcactacccgcactgccctagggccggcccttcacactctaaatttaacttgaagatttatgtctggtacgggcgtggcggagcagcctcaagcccactcactttgattcagtttattttaatagcactttactctcctctgttttatttttagatagactctgagacccggtttagatgggactaaaacttttaaatccctatcacatcagatgttcgaacactaattataaatattaaacgtagactattaataaaacacatccataatcttggactaattcgcgagacgaatctattgagcctaattaatccatgattagcctatgtgatgctacagtaaacattatctaattatggattaattaggcttaaaaattttgtctcgcaaattagttttcatttatgtaattcgttttgtaaatagtctatatttaatactctaaattagtgtctagatacagagactaaagttaagtccctacattcaaacaccacctgaaaccagagtctgaagctgaagctataattgtgacaaacagatttcagtagcatgaacacgagggagggatcctgcatgtattacatagtactccctccgtttcaaaatgtttgacaccgttgactttttagcacatgtttgatcgttcgtcttattcaaaaacttttgtgagatatgtaaaattatatgcctacataaaaatatatttaacaatgaatcaaatgataggaaaagaactaataattacttaaattttttgaataagacgaacggtcaaacatgtgataaaaagtcaacgccgtcaaacatttcgaaaatgaaggagtagtcggtttcgtgcgtcttatcttgggtgtcgtcctgtctgcctagcgcctaccatgacaccgtcagaaacagtgagacaaacacgatacaagacaagcacgtactgtaccgcgcatacgtacagcaatacagcagcacatgagacaagaagacgacgaaatgaaggaaattaatcagccgcgttccgttcggcgtaggccacgcgtgtgcgttgggccacacacaactaactccttcggctacagacgtactctctctctctctctccgttccctaatataagagatttttatattttatttgtattgtttgactacttatcttattaaaaaatttatgcaaatataaaatacgaaaagttatgtttaaaatactttggataaacaaataataattctaaatttttctaaataagataaatggttaaacagtacagctaaaatgtgttatattagggagtactagcggtggccttttgttttgtgtacactaccaaaccggggtgttcatttctctctctctcagccgcacaggcgcacagcacaatcacacaaacacaagatcagctttcgcaaccgttgagtgcgtggagaccctctgcgttcgataaacatcggcgccgggggaaaaaaggcgtgcttcgccttgtctcgtccggtcgcggccgctgctccagccagcctccaggcagaagcaaccggtcaacggcgcaggcaacgccaccgaccgaccgaccaccggtagtgctcgtttctcgccgagcgcagcagtcgtggaggagggcctaaaacgccgcgcttttgaagagttttcatagaggcaggcggcggcatgggctttcttggtgccgcacacgcgtgcgtgactgcacacgatggagttaagccatgaattaagttcactttaggtcccttgatttgttgccgaatctgatatacgctccctgaaccgcagcgtcagatatggcgtgtccctcaactcttcgaaccagtgctaataagattccaaaatgatttggactgtggtttcggatgacttgcgctgcccaccgcagagctgacccttctccttccctacctcgtcgttgacaccacctcttcttgcatgtgcttcccacctacatccttcaccgctaagcgagcacaaataaaaccctatgtctttgagctatatagggctgcctacttgccccgatccatcttcctctcttgatttcttgctcctatgcaggttcaattcttgtggtacgagatttgggcgtacgagataaaaaaccctaatatttgcttggttctttcacgcccgaaatttctatccaaaattccaaacgcttacatgtgtataaatcctcgtccaggaatcagccgaggcacacaataacaaattgataatagagtacaaattattactctaatcaataagcgaacaaaatgtcattacagaggtagatagttcctctcaatcaataaagtcctaagcagcggaaaaaataaaagaaacagcgcagacgactcctctccacaggcagcttgaccagggctacgcctaatcatcaactccatcaacatcactgtagaactcctcctctgattaatgattgcaaggtgagtatatgacatactcagcaagccacacagcaaatatgcaagtgcacaggataacaaaggatggcatagtatagtctcatttgcataaacaacatttaataaatatttcagaatttcataaaacagtagagtattaaataaacagtattaaaccaacgctatacaacataccctgttgtataggcccaaccatcatgcacaaccaatcccggctgcacaagtctatctccaaaccaggaattaaccattccaaatcaggagctaaacaagttaataacatcatcatttaatatagtgtgggggtgagactaatcacgaaagacattgttagacccgcccataaccgcggacacggctattcgaatagtttaaactctgatcagaagtgtaccactgtacccacaagacacaacctcaacatcatgtcaaccatgcgtcgcgatacttgacaagtacccgaatagagagattgtgacaataccctctatataatacaattcaaagcagtgcaccgttcccggatcataatcacccccttataaacaaggtatggactccccagtgacccccgtgggcttatctccgccacttcacagtctggtgctctactatgaaccatactatacagaaagtaaagccgttgcccacgctggcttgtggttggcacggtaaatgtttcacaaccgaaaatcgtgaaccgatccttaattgtcatgagcacaaccatcaaaaccatatgctcacaacccaccattatcatattttaattgtcaaattaattaattaaccaatcatgattaaccatcatgagctatcattaagccatcattaaataatagtgaatcttaaattatcccattagtgaactaatgtttctaagcatggctaagcaattatacctaacatctagctgaaccattatatgaagctcaactagtcaaattataatagcccaaggtatcaaagaataaagtaaatatgtacaaaagggccataacaaagaataggttacttccacccaatgacattcgaaaatagatgcaatagttgaatagaaacaatagctttaaataggatcaacatgctcaaagggttgtttgggatctgtgtgacttgccttgctggccttgaaaatcctcaaagtcttctcctgcaaaatcggactctccgggaacgtcggaatctaaagaaaaaagagcaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcgatttaaatcatttatatggattttaattgaattatgacgcaataatgaattatttttgaaaaggaaaaaggggtttattgcgtcagcgggctcggctcacggtggaccgggtgcacagcgacggttcacgagattggacggctgagatctatcctatctacaacggacggccgagatcgattggatccaccgcggctcacggatggacgacgacgatgacgtcagcgacgacgtcaccaccagcggcgaccgaaccgtgcgagcttgtcggcgaaccacggcacgtgtaacgccccgattttcgttcgggtttaaaaatcattaaataatgcattttctagaaattaaataaaagttaaatcaatttaatcaagtgaaataatgggagaattaaaattttcccttaaaaatcattggccgggaatattttgtaatattctttgtgccttaaaatactctccggatttttccgtgaattttcggagttcaagaaataattttaaagtcacaaagttcattaaactaatttaaataaaaagaaaacaaaataaacttccccttcctccctttcgggctcggcccaaaatcctctctccttcccctcccgcggcccggcttgcctccccttttggcgcaagtctgcttttcatccctcccggcctctcctctcactcaggccgacaggtgggacccgtgggccccacctgtcatccccaacctccagcccgggccggcaactgccatggccgcccgagccgcccacgtcgccgcccctccccgcgcgtcttccgattcccgcgcgcgtgtgggcgcggtccaccccacgtcatccccttcctccaccatttcccccacttctcccctccaaaaccggcgccaaactgcccccactcacccatgtcgccggcgcccctttcccccttcaaatccgtcgccaaccggcctccccgtcgactctcgaggctataaaaacgatccccgggctcccctcatccatttcccccattttccccaagccgccacgccctccctcgctctccccgcgccgagcccttgcaccgccgctctccggcgaactccagcagcgccgcgccgccactcccgtccaccccgcactgcgccgtcgccctccccggcaccgcagccgccgtgcgcaccccggcatccactccgttctctccttccacccccgcagcaccattcccaccgcgaggccgagcttccaccgccgttcgccgccccagccgcccgctactgccgccctaggggctgcagcgccgcgccgtttgtgtcgtcggcatcgcggtgccgagctctaccccgacccctagtccttttcccctccccaactccgaaacaccgccaccacgtgcaccacctccctccgccgtcgccgctcccgcaccctgccaccaccgcagccggcttcgccgccgcgaggacaagcctgtcggccgctcccctcccccaatcgaccgccaagctgtcacctccactgccaacccgaggccgccgccgctttcgccgccccggccaccgtttaccgccgctcccggccgtcccgagccgcacccgtggccatcctcagcgtcgccgcgtcgtgccgcacctcggttgccgcccctcgccgccgaaattccacgggagcccgcttttccccgttcaaggtcccggaggcccccggccgtcactcgtcgcccgtcggccgccgttggggcgccgccgtcgtcctcgcccggggagctccgccgctacctcgcctccgtccggtgccgtgccgcttggtgagcatcccctttcctcctcttctttccgccgcccttcgcgcgccctctcgcgccgccgctcgccgccggtggccgtgcgccgccgtgcgtcgtgtctcgaccgggccggctctgagccgtgcccgtgctctgggcgccctgcctcgtggccgcccgatcggctcgagctgatctgggccatcggttcccgtggaccggcggtggaccaccccgtggtcccggtccacggtggaccgattcccttgacccgctgacgtgtggggcccgcctatcggcgccggcctttttgatgacgtcagtacttaagcttttcctttgaaaaaataattaataattgcgcaataaatcgagtttaattctagaaattcatttaaatggctcaaaacttctaaaatccatatctaattcattcgaactccgaattgagccgttcaacttgcaaaattcatctaaaattgagctctacatgtttgtttactttttatgtactatttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcctaatttacaaatgttttactgtttgcaaataaatatgcatgttttgctaattacacgggatcagggtttacctatctgctcgcttgtgccatgtttacttgatatctatcctttgtcaacattgggtaataaatcgactagctcatgttacttatgtgacttagctagaactatatgcttagccatgcttaattaccactagctcagttgataggataattacagtattagacctttttagtatcagagtgagctgcgtgctcgagacatctggccatgcttcatggtcgtaattatccaactaaaatacaactgaatggtgggctgtgggtgcatggttttgctggtcgcacccatggcagttaaggaccggttcgcgggatgccctggaagaacttatcgtacttaccacaagccagcgtgggcaacggctaggcttgtagtgtagctttcctctagtcgacgcatccaggcaagggtgggcgtgatggagcggggcgggccctgcgacggcctctgtcgcttccggattcacctaggcacgagaggggactgcccgctgccttgcgaggagtgggggtgaaacctgaggtgtggtgtgcttgattagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagtccaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttacccttgcacgtctgcatcgttggtgtggcttgctgagcatggtggttgtactcagccttgctattattcccccttttcagaagtgtagtgcttctgagttgaagacgaagttagaagaccaaggctcagaccccagttgagttttgcctgtggagtggagctgaagccccgctaggatcgcctttttccgctgctgtcgttctgtttcagtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacagcacgacagcgcgaacggaaagcacctacgggttgcgggcggcacggcgaactcaccggcgaccaaagcgacggcggacgatgaccggacgacgtcggcgacaaggaagaagcggcggcaaccttcggcttgacgacggcgacggtgctccggcggtcgacagcgacgacgaaggggcgaacgagaacggcgacgagacggcgaccacgacggcgacctccccgagcgacggtgacgactggagcgacggcggcgcacggctggagcggcggcggcgacggcggcgctagactgcacggggctagggcgctacgggcggcgagggacgaaggcgagggtggcggcgggtagcggcgggcttgggggtcaatttatagcggctaggaggcggcgacggaggcccacggcgaccggcgacgagaaggaaagtctagggttcggaggagagagaccgatccgattcaaccttgaatccacgaatttccaaacgattttagccgatgattccaaaagagaaaagatagaggagatcgagaagatcatttcccctctattgatttcatcggaaacggaaaggatcggccggattggaatggcggcggcggggcgcggctagggtttcgccgggaggaagacgacgggccggccccacctgtcagcgggcgaacgcgcgcgcgcgggcggctgactgggccgattgggccgagggagagagagaacggtttgggccgactttcggcccaaagcctaaagaggattttaagaacttttttcaatttaaattattcattaactgcaattccatttattaaaaatacttctttagctcaaataaatcccagaaaaatctaggaattatagaattaagcaaagtatttaataaaattttatctggccccattttatattggaatttatttattaaaattagatcttctcttctaggctttttaaaataaattctaataattccaatttaacaacaatttataatttggagatttttagggtgtgatagttctccctatcttgatttggctttcctcaccgccgataagaggatgttgggggatgggaaggagatgctcaaattgcggggcagggcggggatttcaaaatcaggcactatattgactgggacctcgagtacatcggttttataagttgagagatgcgttatatctagtattgttgttcgaggatgtaattcaaactcgccaccaagacgagggacctaaagtgaacttattcctttgacggctacaacaaatgttgctgctatgggaagaattaagggttaattgaattcatgtcactataaattttacaattttaaattctactattattattcatgtaattaaaatcatgccatcacaacaaatctaatgcccctatctctttgctttaatggatgaccgacatggatagcgctagtggaaacactgaccagcggcgatggtggaaagatgacagcgactggggaccaagacatgcacatggtgaggagggagtcacaccaaggattgacgaaggtaaggtagaacgtagaattggcagggatggtggccctttccttctcggtcaccgctaccaccttcaggatagctgcatcgatcaccacccacggatcctcctgcttcgctagtttcggcgccgtaacaaacgaagactagttgttgcctcaaccatcagcgtagaactgtgtcgaggcaaccgtaatagagctctaccaccggttgtacacaactatgcctaaacctgcccgccagggatacaccagggccgtttctactggagtggtggtgcctcttggctcgagcaccgccacaagtggcttcgcccagatttggagagagcgagagagggggccgccggatttgctagggccgaaccctagcgccagaacaagattcgagccctagcggcattgccgttgtttggccgtcgtccttgcatcattagcgtcttaccatcctccacttgcccccgcgtaccgacatcctctgctcattctccctgcgccgctagaatcaggctgtgtttgaggggaggagatataggagattgggaagatacgcaaaacgaggtgagccattaacacatgattaattgactattaagtattttaaactttaaaaatggattaatatgattttttaaagcaactttcctatataatttttttacaaaaaaacgcaccgtttagtagttcggaaagcgtgcgcgcggaaaacgaagcaaaactcactcacaatcacccagatcacccaggaaagaacacagcctcagtcttcattctcgcatcgcatttggctgccgtcatcctcgtgatgtcctcgtcccaaggctgacaactcacatgatttgcttggacattggtgatggcaaggacagctacggcatgagggcagggacattttagtacatacaaaaatattgcctaaaaattatttgaaacttgtttcaggcgtacagtgtggtatggatcaaattttgtgcttcttatgatggtatggtttcagttatataaatagtaatagattttaaaacctcaaaagttataatattttataatgatatagatcaaattaacgcaggattaagagggcagaaattgactcggcacgtttctgcatactgacacgcaactgtctgtcagcgtcaaaattaaacatattctttttttacgcaaaattaaacatattcttatgcagcacgtggtatcactggcaaattaggctgttgctttctgaagcggtgctgtgtgttggaatcttggagaggaggtggatatgtactaaaaaactgacctcttaatatcgtgctcatttagaacgtagaatctgatatagaataaataaataaatgctgctactccatccaattttctctactaggggttatcagttataaggcgtgctcgtagtaaaaaaacaaccgtaaaatttgaatttctttagaagacctaaaatttaaattctattaggtatatactcgactgcaacggattcatatgactatatcattgtgaataggtgcacaaatatgattactccctccgtgttttaacatatgactccattgactttttaataatgtttgactatctgtattatttatttttttgcaaatataataatatttatgacatacttaatgaatatttgatgataaatcaagtcacaataaaataaacgataataacatatttttaataaaacgaataatcaaacattggtcaaaaagtcattggtcaaaaaatcaacgacgtcatacattaaaatacagagggagtattttctttaccatcacgcgtgaggggaggcaggctaatgcgacattatctttaaaatcgaatggaagtaaaactcaaaatttacaaagtagggcaggtcaaacagttctctttcaataaaacttgcccaccaaagtttaagttctaaacttgacatgtgtggtcgtatttgtcgattaattatttttccagtagagagcgatgaacgatacaattatgacaacatacttatagggtcataaagattggtagggtaaagttacgctgttcaattaaatgtggtttttattagggataatcctaatctacgttatatgtaatatgagagagtatgagcctctgtggcacgaattgagatcctctgcctttaaatacatcatgccttttattactgacacgtgatcccatatagtttatcggtttcacatgccaatgacaaacacattttgaaggtagtggagcctgatccccgtggcacccctctggcatcatgccaaacttgccaagcgagaaaagcgatcggtacacacatcgtggtgaccacgaaggaggagccagccacgtggaccgcttcaacgccaggagatccgcgcgccacgtcgctgccctgtggggccatccctcgagggcatctcaatctctatccatcaatccggcccggccccacctgcagttggagagagcgcgtggcagcgtccacgtcaccagtggggccctggaacgtactacgccagatgtgacctgatgaggttttgctaccctcctctgtcatctcgtcattactgacatgtgggcccacgcttcaccttggcccaccggtcattggcgtcctggttaatgtgcgaaaatcaaggagagtggccatcaacaggcaggagccatgagctggcccccacgagaagttgttggtgttgggattgggaatctgttggctattgcttgggatgaaaattaaaggaaaatctataaattttgttctcaaatgaaatgaagggttgatttggtttgtggcctaaattggtcttaccaattcgtcaatgtcaaattttggtaacttttagcatggctaattttggcaaaagtaaaattatgtttggattgaagccaaaatagcctaaattaactgttaaaatggcatatttttttaggtatgtcaaaatttggctccaaaccaaatagacaataaacactattgaaattgccaaatattggtaaggccaatataggcctcaaaccaaaccaacccgaagttaacctgtgatcctcctcctgatcatgtgctcacagaggttaatttctctgagctcagcaaaccatgttcagttaatcaatttttgccatcaagttagagtgaaaacatggtgaaaccctgaatacacttggactgggttaacgagatgataatcgtcccatgacttggaacaaatggccatcatgacagtcacatcaatatattattagcactacatcatacacctaccaaataataacaaataaccttaagtccttaacaaataataagtgcacaaaaacacggagaaaaaataacaaaaaagatatccactcgcaaatcaaagaaagactggcagagtaaggctgtctttagatcacactgaaattttggttgaaattggtacgatgtgatagaaaagttgtgtgtgtatgaaatgtttgatgtgatggaaaattggaagtttggaaaaaaactttggaactaaggctatgtttagttcagcgcaaagtttggattttggttaaaattggagatgatgtgaccgaaaagttatgtgtgtatgacaggttgatgtgatagaaaaggactaaagtttgaatccatctaaacacagcctaaacaggacctaaacaaattcctaactactctagctaaaatatcgcagaaaccctccccacaaattaattgatctgcttcctcctcccctcctctcatgtcattgtcctgcaatacacgaggagcaaagagttgtgtgtaatcctcctcctactctgggtcagctcttaatcccttcaacttccgtcggttggacgccaccggaagccaatccctgtttggtgttttacccccaattttgtcagattttttggagcgaaaccacgagctgtttgaagtgttcggcttcggaatctctttcttggagttctaggaatggggttttgatacaaagattgaagcctttttgttagcgttggtgcaaagattg

SEQ ID NO: 53162 - DNA, 10515 bp, Oryza sativa
  unsure (1)..(10515): unsure at all n locations
gaatatttcattttcttttttacttataaccatttctctagaagttatatcatcagtatcggttcgtgtggaatgtagagtagattgcaaattctgaactaactcaaatgcaattgagtaatcgattgaggaagtttggccttctaattgtgaactgtaggatatgatgccttctgaataaactcggcagttttgcttacatgtgagatttaagttgcgttctgcattgtgctgtagataatcgtaactgtttatttgaggccataatttcgtgctgaggcatggcagtgtatctgacatacacattggggtacttcactctaggtgatgtgctatctggaacctcctctggtggtgagcaccattatggtgttttagaaggatggtttgggccacaatggtggaacgggcgtttctttgtcctcctggttacaactcttgttgtatttactccactggcatgtttgaagcgtgtcggtaagtagtctcttcacttagccttatactttcgtgagattttattttgtaccattttgtcgtactgccaattcatgacatcgctatgtttttgtttgtttcttgcagattcactgagttacacatctgccatatccgttgctctggcagttgtttttgttattattactgcaggaattgctattgtcaagttgataaagggacaaattccaatgcctaagttgtttcctgatgttcccgacttggcatctatttgggaacttttcacagcagtgccagttcttgtcactgcttatgtttgccattataatggtatgagacaaattgaagttttgacttgttggtgcattataaaattttattttagtagggaagactttctttcaattttcttttagataatgtcctgatgtcttataaaagcccgaatagggttgcttacttctaagttttctaaagagatttgattgatattttgcagtccacccaattcataacgagctgaaggacccttctcagattaagccaatagtacacacatcattggttctatgctcaactgtctatatcacaacaagtttctttggatatctcctctttggtgaatctacgctgtctgatgtgctcgccaacttcgactccaatcttggtattccatacagtcagatgctaaatgatgctgttagagtgagctatgctgttcaccttatgcttgtgttccccatgatattccatgcactacggcttaatttggatgggcttctcttttcctcatcaagtcctctgtcttccgacaaccgaagattttctgtaatgacagcggtacttctcctagttattttcctatcagcgaatttcattccgagcatctgggatgccttccaatttactggtgcaactgctgctgtgtgtatcgccttcatttttccagccgcgatcactctaaggtaagttaatggattaatgttcattgtgatgcttttattttgttccacctctacatatattatgaaaaaatggctgggatatttattccgttatctcaaaaaaaaaaagtgttatagtacttctgctaacatgcacgaagagaagtgaagaattctacatttgcagatttccacactgtagtaattgcttgttttgatatcaccttttcaatgttgtgatgttatggctgtctaatttattttgcttctaattttgcagggatccacacagtatagcaaagaagtgggacaaaatcctgtccatcttcatgattgttcttgcaattgtatcaaacgtagtagctgtgtatagcgatgcatattcaatgttccacaggaaaagttccccttccatagcctgatattccaaaatcctattggcgagtcagtggattctttatctgaaagatggcttgtacattagctagcaaataaaatcattatttaggcaagtatttacgggatttattttacggtttatttggcaaacaacccttgactcaattatgttgagttggatgtatctataggatgggtgtgtaaactttggtccgaagtgttttagtccaatgtacaattcaagatcaatttgaatcaaatgtgaattatggagttattattgtaacaaaagataaacaattattttttcgaatgtaaatcactgaaatggcaactctgttcatgcatttgcacttctgtataaacatgctactaatctggtttcttggatacaataaaattggtgctttttgttgtttcttgttgaaggtgtcattccagctgtagccgttggcttagcagaacagccttatccgctaatgctgcgtttcgttgcagcagattaaaaaaaatcatatttatctatttttgtatttaaaataatcagtactcaattaattatacactaatagctcatttgatatcttttgaatcttctcctttcttgagacattgttttggagatggagatgaaacactagctgactttatacgacaactgcacacattcgtcgtatgcttcttgagacattgttttggagtagttgtggaccttttttccttagatttgtttcggttattttgattacttttctttactgaccgtgtgcatcctaatagatacagaagtggatagtgtaatttcatttctcaacaaaatcttactattatatgatggaaacgaaaaatgttagcaacagatgatgaagtaaaactaaagatagtagctgcatttttttttgcagccccatcgtttggttgatttgaggaaaaagcgaaacgacgtatgtcggtgatatgggcctggcggtatgcgaagtatgggggagtcaccttcccgtccatccacgcggccctacagcctggccctcccccaacacctcgggcaacgcagaggcagccagggggcctcggggtgccacgtcacgcccctcgagccctcgcgttgcctcgcctcgaggccctcgcccaaccgccacgtggtgaggggagcgagtggggcggagacccaggctgaaccatcatcaatgcgcggcgcgccaaccgtccctcaccgcatttaatgcagtaagggcggacgtgcggcgctgcccgattgacccacgtcaatcgggcgtgaccagactgtgaccggcctgtcgccggtcacgtctgatcggacgggcggtagtgcccccacgttccgccctgtacccggtggagtgggggcaggtatgccccgtcccatcgaagcatcatctagagccctctccacatgagatggaccgccacaagtctccattcatttaagagggaatgacaagggtgtcccccgtgtcaggcggggggcggcgttgggccccactcgaggacggacggctgcttagcttccgggcgaaggcacgaatcgtggtccggtctaagcggagtgggtccccctttcgtgaaggagtaggtagaggtggtgtatgtggtatccccttgaattataaaaggaggaccttgcccaccgaggaaagggacgactctcggtgagcctaaacctcaggggaagaagagcgagagtactctctggagtgtaggaacctttgtaacactcagccataaatcccacacacaggagtagggtattacgctccatagcggcccgaacctgtataatcccggctctcgcgcgtggtctcagaaaactctaggctgatacatgatcttgatcagcgcgccctttcccccggtcgaactcataaaaggggatctctcgatcacccgctagagagggtcacccctcgataacgtatttgcaaatgaaaaatagtttgcgaataaaacttttatatacgtattcttaacgatataagagcaaagaccaaaaatatactacaataaaaaaaaatcccaaaatcaactccgaatttaaaattgaaaatacaaaatttgactcataagctttaagcgaaaagatgagccgttaatcttgattccggaccgctggttgggagatggacggcgtagattgcccaacccgcaccgcttagccaacgccccgccgacttggccgcgctctcgccgccttcttcccccttgtcgccgtcgccgagccgcctccgcctcaccgtgccgaccaccacctctcccaacctcgccgtcgaatcctctctctctctctcgtctccccgctttgcttccacctcgcactcacactcccatggacccctccatgcctccgcctccacctcgaaaccctaacccctcctccgcctccatgccgccccccccgccaccgcccaagttggagccggcgtccaagcccgaatccactaaccctaactcctccatgccgccgcctccgcctccactcccggtggagggtgcgagcactagctcctttatgcctccgcctccgccgccacggcccgcggcgccgccgcagccggaggtggagggggcggacgcgtcggccgaagggggcactagcgctagcgattccgaggcggatgaggcggcggggaacttaggtaggggctccagggatattgagatggcggaggcggcggcgccgccgccatcacagcagcagcagccgaggccgcgtgccccgtacgccatacccgagtggagcgccgcaccgggccaccccttcttcctcgaggttctcaaggacggcaccatcgttgacaagcttgacgtgtcagttgctgtctctcttcacccttagcatgattgtctattgtctatagaacaattgccactacctctttgctcgtagcctcatattttggttagcgctcggggttatggattgaaaatggcatgaatgtgtctgcttttatattcatgtttggtgttacatgtgacaggtccaggaaaggagcttacatgtttggtcgaattgatctttgcgattttgtattggagcatcccactatttctcgctttcatgctggtatgttactatgctttcatcattgtcttttcaattatgacataggtaaaactgtagaagaatcaagattcaaaatcctggtgtttaacttagtggctagcttgcatgttccgaatggttttgcattcttaaaaattgtcttgtccttgaggggttttgttgctgatgttagaaaaggaaaatggcattcagtctcaggaatagctttttgcatcatctttttaccaattgatcatatatgaaatgttgacaaactggtaaccagcctgtccttgttcttttcacattgaggagaacaaagcataattgctattcatgatgctgtgatttccgtgaacatatatgaaatagcattgcatgaggaaccgatgaaacttacccagtaaatttggcttgaaaggttaaactttcacttcaaactctacaacttgtgaataccttcagccctaaatagcagaaaaaaaacacaacaaaattcaagaatttgagagaccaggttatgagattttcttgtgcagagctctattatttttaacttacaaaaacattttatttcaagtgtttatgtatgagcacttgttgcctttcttgggaggtatccgtctttaatattcgaataatctctcaactccagtgtcactatcatagtggacattatttgctagctagagaaggaaatgaatggattaggtaaaattggtactattagtttgtaatatagaatattttcttgtttagtgcttaaagcaagacattcatgaactgcttttatgctattttagttttgcagtttagaaatgatggggaggttttcctttatgatcttggaagcacacatgggtccttcatcaataaaactcaggtaatagtcttctgtcatatatcttacttcagagaaagcttcccccttatcaaagctcaacatatctttataccttaaagctttataagcttttgtcatgagtgcattctgtcgttgctcgtgctcttttatttaaaaagcagtgatttatgtcagtagtttcttatcctgttgcgttttagttccatcatttatctcaaccttattgtatcgcattgtaaattttaagaagtcacctgccacattaattatttatatggaacattgcagtaatatttacaatttgttgttcatattatattctctgatgttatttgtgaaaatactaggtcaagaagaagatatatgtggaaattcatgttggagatgtaattcgatttgggcagtaagtgatcttgttaattaattgtttaatttttttgttgcctaattctatggaacttactggcccttctttccttaaatgtttctattttttttattgagttggtgctgttgttacttagtacaattggactaatcttctcgtcgtatttgccagatcatcacgtttgtacatattccaaggaccatctgagctgatgccccctgtaagattcatctgttctttcatattttcgttaccttatttggatcgttcaaccatccacaattttgtcagtgttattgatgatgtagtatgctgtttattcttatcaaattctgcttttggatgtcatattgaaatgaagatttttttctaccagttaggcatgttcgatttcttggcagtgatcttgtaatactttctgaagtagtgccaattgagtgtggctagtaaaatcatagcatgctatatcagatctgtgcttatgttggatttctttggagctctgtttctttttgagaggttcctttatgcaatgggtcacacctataaaagcttctaaaatacttatttttttccagaaatagttctcagagaaattcatttcaatacgaagatatattatcatgtaacaagcaaacatacatgaagttgaactagttattcttcattctaacttcactttgataattttaactgttaaaaacctcataatttgatcatgttctttgttattacgagggacattttcacatccagtgaatagtccagtgaatcaaattaacctatcctgttgtttaaagttgcttgaatttacgtatttggcaggaaaaagatatgcagaagcttcgggatgctagagttcagcaagatatgcttgatcgtgaagcttcccttttacgtgcaaaaaatcaagcagctttagcagagggtatctcatggggtatgtctgaggatgcagtcgaagattctgcagaggttagttgtttttgcaagaattatattttgtatattgataaatttacataaatatttgtgatgcgtgtaatcacgtaaactgtgttttattgaaatttccaaagttcatatttatatttcagcattacatcatttgttgcatttatattaggatgaagctgatgagatcacatggcaaacctacaaaggtcaactcactgatagacaggagaaaacacgaagcaaaataataaagcgattggaaaaggtaaacattacttgtgctgactactgagatttgatctctatgcaatgttctttgtgacttagcttaaccaactttcttgtggatttataacttcattttatctggaaaactattatttgtgaatctgaaatgtgtgcttcttgttacatggactgtcaattctgatttctattgttctttaaaaagtaacttcaacaagtactgaagaccattgattaataatatctggatgctggaaatcggggatatgttgttgaaatttggggggtggtctagactttttccttcccatggatgcatatggtttgcacctctgcttgtcttacaagtttatctttctgtctttgtttcagattaccaacatgaagaaagaaattgatgcaataagagctaaggacatttctcaaggtgggttaacccaaggtcaacaaacacagattgcacggaatgagcaaaggacatctcaggttagtggatcaaatgcttcataccttcttgcactaccttttcatatcatattaccagtccaccaccaacgggtatcataacaaaccttttttcctcagcttatggaggagctggaaaatttagaagaaactttgaatgacagtatacgggaaagtcttggtgctcgcactggaaactcaaatcgtggtagtcataaagcaagtcttgaggaagaagatgacattcttaggtttgtcttctaataaattttgcctagcctgttatgcattttttgtttacgatatttgttggttgttatttgaaatgatattccttttcttttaatttaaatctagttagatatgaactgcactgctgaatttggttgatcaagcttggctactaaatttcctttagatagttactgcaaactagaacacggataaatgtactaggaacttctaccttgcaacctattatcaaattatttatattttatccaattgcataagttttgtcctgtctgctggtagacgcttatatagctgtacattgttcataagtatgatttaagaaatttatctttatatatgctcattgtcgtgtactgattaatggattctcaaataatttagtgacgaagatgacttctatgatcggacgaagaagaaatcttctagtcataaatccagtgagcagcaagtggagactgctgatagtcttcttgataaaaaagataccataaccagcgatattgaaagtaaaaagaaattggttgaagaagagaagaataagttggcaaaaagtgagaatgcggatgttggggacgaccttgatgcttacatgagtggattatcatctcaattaggtatggtgctgtagtgcctacaaggtttatcatctcagaattttgacatgcttcaattttccttaagagttccggtcaaaaaattttccttaagagtgtagtctatggtatcatgtcactaagaatctgttgctgcctgttcacctcggtgtttattgttgagtcattgaaatttgttgagtggtagttttgtatgtagttctttccatggtctgtaattgcatctggggaagtagtggtgaatgaaaataaggtaaatgagcttcatatagttctggtttgaaagttcccgtgatctcttttggaaacttgacttgctatttggtaacgacactggcctcaaagcaacatttgcaactgaaatgactcgacctctctgtacgatttgataatcatcaactctattttgggacaatcaagttcatctgagtacagttgcaattacccttcagcaatatgtcttgtcattttctctactactaaaaagaggagttgatggtggttgtttgcctatgcatcctcagtttagatcatttgtattgtagtatccattttctaaaaaatcccattatttacacgtgtatttagttgcctgttgttttgataaagttatacttgtatgtaatatgggtgcaatcaattagattagagataactattttttttacttcatatttgtggtgtgtttgtttttagatttggcataatgcacaggtactgtctagaacaattttaatgtagttgttaatcatttggtttggtctaaaaaacatggtcacattaatatggatattttagcttgtttgcgttgaggaactatgatcaatgttatttcccagcaatacttttagcttctgtgatagtgggaactatgaaatatttcccttttctttgttttcttctttacttattcttgcattgtacttggcattagttgataacttaatataaaccacgaatccatgcaacacttgaagttcatggtatgcaacaatttccttctaattatatttgtagtgctattttctgaacatattgatagatgtgtgagtagatatcctacagcactgatgcatggaagagattctttactctgattggacgttggagcagaggatacatatgctccattattaattttcccttgtataatacttccaacactcaaattattacaaaaatgacatgagtaaagttactaccaatatgctttcatagtagtattacatatctgaatatatagtaataaatattggtcattaataaagtggtgatattgttgactttgaagtgtagggtagagcattcaatgaccgcaagctaagttactaaagtatacgtcattgaaatatgactttcatttacagaacaatctgatattgcatcagtttttgtaatatttactttgtttaacccctgattagttttagacttcactcatggaaaaacaaagcttgaaaatgatgcatgtctgtatgcttgttttccatatttatgttcagttttatgcttgccacttttcttcactcactagtttgaactgttctgcagtacatgacaagattgcccaaatccagaaggagctttctgatcttcaaactgagctgggcagggtggtttacctactgaaaatagctgatcctatgggagaagcagctcgcaagagggatctcaagcccgagaaacaaaatctccagcatctaatgatagtctaagaccagagtccagaaagcaaaacaaagttgcacaaaacaaagcctcaacagaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53163 - DNA, 1264 bp, Oryza sativa
aaaaacagggatccacaaatcgacacatatttcagggggacgaacaaataggcatggtctaagatccacaaatcgacacatatttcaggggacaaacaaataggcatggtctagtttattactgaattagctagaaaaaactcctaaatggctgtgcatttggaaaatgtcatatatagctacattgctgaacatttggcaaatgtcaaaataaataaatcaaagaccagattgtaaatttagaattgttttaccaaattctggattaaatgccatctgaattccaaaataagaaaaaagaacttcagaatcaaaatcccaacaccacacataaaccaacaccattctgatctttgactccattctgatttaaaccaacaccacacattcctagtgccgaacagccccactacagaaatacaataagaagcagcagatgcacatgattaagtacacacaattcaaacatgtgtgagcatattctggttctgtttttgtcagtgattttacgaatttggatttttcttcagaatcaaggcacaacatttatacgcaaacatgcatatgaatatgctagaacagtattactatttatagtaattatgtcattcctgatcaaagcagtacagggttagtataagcaaaaatcaaaacacctgtccagtcagcaaatagttagtctatgtaaagtctagcaaaagggatcaaatatagaacaattcagagcctagcaaaagtattcaggaaatatctagttgtaacacatggatggagtttgactgcaaattaaggccagttcatgcaccaataaaccattccatgcatgaattacatcatccactattcagatacttgaagaaatacagatacttgaagaaatagggttatttgaaaagacagtgaacaatagaatcagttggaatccatctccccgtctagattgaagtagtaaatatagatatccagggatcatacctgagtggggcagcctaaccgtagaagactgtgtcgatgcagattgagcactggagcggaccgtcgccgacgtggaagagataggagcgcggcataggggaggggacctaccgtcgaccggttgtgggctctgaggaagaggggcgtcgagaccttccccagctttcggctgtgggcggtggttccccggcgatagggcaacgcggttgaggaaaatgcgttgaactatgggcggtggcagaacagcttgaggggagcgacgggagaaatttgggcctgtttggttgct

SEQ ID NO: 53164 - DNA, 791 bp, Oryza sativa
aaagcatattttttttaaagaagttaactaaaagcacgtgaaaagttaaatgaatagtagcagctcaaaaatccaatttaatgcccttagtctagagatgaacgagcaaaccattattgacaatgaacacatcatttatggagggcaacagctgcaggcgacaaaagctggctgcactattgtcgccaagctgaacaatagcagccacttatgaccaaaacaaggaaaacatagaacaccaaactgttgtctacttttctgaaatattgtctaaaatcacccacatgcaggaccttgttggctgggataaaatcacccatatcctgaatatgggtgattttagccgagacgccaccaaagcacaattctgtaaattagacaatagttctgaatattcaacccactcaagacacatacaagctgctagtggacattctggacatatacaagctcctatatcaactaaaaatcacaaaagtttgtagagatgcaacggtttatcttaccatgacatagcattgtgcaacatagctccgagatcctgtcatctggtggtattgaactaactcacggctatctttgttttttatacatttttcctatagaaagacaaacattactggacagaccattcatattttgtaaggcaacatttatgatagatattaaggaaagatataccttatgctgtggggtagaccacatgtccacgagttgtttccactcattgtcagtcatagagcttagcggtgaagttgttctaacttcatttgctggtataccattgaaat

SEQ ID NO: 53165 - DNA, 825 bp, Oryza sativa
atcagagaaaaggaaaaggaaatagctggttttaccagtgccctataaatcatagtaataactagtaagttcaatcttacaactaccattatcaaagcatatcacacagttaagtcacccctacagctgtctttaaagtggtggactgaaagctcatttagccagctcgtttgctcggctcacagcagccctgattatactcgtttatattccacaataaatcagtcgatgttaatttttgaaagtagactctcaaggagggattgattggactaggatggcgcaatctttattctttaaaggtgatatctcctgattatgctctggaggccgcgaaaccaaccagccataaatatatctcactcgaaagaaaccatgtagttttgcatgccttttcgatcttgtttgtactgcatgtatgctcgctccccttgcatccttccggttcccacatgcaaaatcacatacaaaaactgtttgcaccatagctcagtggaaagatgtcgtgacggtggataccctcctgtggcatgtgcacaagaattgaaagaaatactcaaataatcagtaggataatttgggatgtatcagtctgatcgttatctcatttctaaatttgctacaatgataataaatcaaaataagtaaaacacggtgcaaaactaagaaaagtaaagttgatccaatatactccctgatctttgaactcttgtagccattattgccctttgccctttgattacttccatattattttgcctttcttgatgtagcaattacctccagttttgcgtattggaatttagaaagaatgtgtacgataag

SEQ ID NO: 53166 - DNA, 856 bp, Oryza sativa
  unsure (1)..(856): unsure at all n locations
annnnnnnnnnnnnnnnnnnnnnnnnnnnnnnnnnnnnnnnnnnnnnnnnnnnnnnnntatcaagtttttggattgttggaaatttggtcataattcggcatattttaatccaaaatattaagacaataaacatgacatttgaaatttgagtagatctagcgacagtgctagatgtgtaatagtgaaacgttgtaccccgagaatggccctccgttggagtttgaggcagtattgcctccgttggtgttgacgagaggctccttctccttgtctccagtgttgttgttgtcaccggttgtcgacatgttggtgaagatgatgtagagcagtcgcgcttgaagcgctacctaaaaacttgatcacccgcctacccgtgcaggttctcaagcggacggagtttcggaggtacctgctcgttccgatcacccgtgcacgcgggatgaacagaaccggggaaacaaagagacagcgcaggaacagaaggagagtatcgccaaggaacaatagtaggaggaagacacacactttgacagcctttgccttgcgttatatgtagagagagagatctccattaccacacaaataaatctcatttgttgtgaaggttaccacaaaattaatctcatttgttgtgaaggttaccacataatgaatcttccatttgttatgaaggttacaacaaataaatctctcatttgttgtggatgttacaacacaatgaatctctcatttgttgtggaggttacaacacaatgaatctctcatttggtgtggaggttacaacacaatgaatttcatttgttaatggtgactttattctcatcttgtacaaaacgaaagagcaacaggcaggct

SEQ ID NO: 53167 - DNA, 1445 bp, Oryza sativa
  unsure (1)..(1445): unsure at all n locations
nnnnnnnnnnnnnnnnnnnnnnnnnnnnnnnnnnnnnnnnnnnnnnnnnnnnnnnnnnnnnnnnggggattgttagattaatgggttaggcccaattaaatcctaataaattccattggcccacattaagtgctatgggtaataataccaccttggaaatctatgtgaagaggtctcaacttaaatacggaactagtgaaaagtctctgttgaccggttgagatggtgtgcggacagccaggtggggtgggacgaggcgaggcaggcagctacagctgttttctctctctcactttgtaacggacggtaataaacatggagaattgatttcgtattaatgagcgcgtcggttacggaattaaacgccgtgaattgattccgaactaacgagcgcgtcggttacgaaattaaacacggcggttgatgactccgaacgttactctcgcgctcgcatacacacacacacacacacacacacatatatatatatatatatatatatatataggtaatttaactggtgctacatggagtatgggctcgaagattaaaattgagtatatacccaatttgaatgagtatgaattttttttaaatatttaggtatgaactttaacttctttactaacaagttcaaacaagtttgaactgagtttgaacttttctttttgttagattttggttctagttatataacatcaaagcatataattcgctaggtatgtaataatgaattgtgaaataaagttgagtttgagttattttgttgttaggtattggtatgaatcaaattcatatacctaagtatatactcacaatttatttttttaaaaaaatttcaagagattttgtgtgttttataccttggagcccgggcaccatggagtcccatatgggtatatatatatatatatatatgtatatactctgcagcgacgtgaaggacgtggagaagttcttcccaactcttgcacttcgagttcctcctcctctgttcctgagctgcagaatccttccccggttctgttcacctgcgcgcacaggtgtacgggacgagcaggtgcctccgaaactccgtccgcttgagaacttgcacgggtaggtgggcgatcaagtttttgggtagcgcttgaagcgcgactgctcctgttcttcgttcttcgacgacaacgtttcatcttccactacttctggttcaccatggcttctacttgagagaacggaggagacaacatcaacggaagcaatacgaatgcctcaatatcttctgcaccattctctggatataagattctaactttatttgattttcttcttgttatttacatgttcacaatgttatccataggatttcaatcttatgtgaatgtcaacgatggtatgcttattttatcttaagcatgctcatgtttatgtttagccttatcacaagatcgcttctaatt

SEQ ID NO: 53168 - DNA, 2282 bp, Oryza sativa
ttgtcttaatattttggattaaaatatgtcgaattataaccaaatttttaacacacaggagggcgccatgggctggggcgcgtggggactcgtggaagcaaacgtcaggagatgggcggcatgggcgccgccgggtatctgttccgggaatcagcggcgccatggcccatgggataggaaggccaggctcactgctcgcaattggtatccccccaagcacgaacgacggccaccgccatgcccactgttcatctccaaaatcgatccccacacagtcgacggcaggtgcggctgcaggagacggactcgcggttatggggagacgatccgacaaaggagacttggtgtcggcgacggactctcgccgtggatgtcagcggcgtgcggagaagctgcgtcgtcgatagaggccatcgtaaagaagcggagccgtcaaagcaggtgacacggcggcggcgtctcgccggcgtggagtgccacaagcatgacagtgttgggctggttggtcgtgtactggtgtgtcggtgtgcgcggttggaaaggaaagggaaatccgggagtgattaggggaaagagtgaggaaggaaaggaaaagtgcgggtggacaaggaccgatctttgccgttgaatcaacgcagatgaatgtaagccatcggatttgtccaatgatggatgagtatgagtaaaatgagttgttgaattatcaaatccaacgatccagaatcatctaatctaacggctgaaatcgtccacgcaaacaccgtccagaatcgcgctcccccatctccgcccgaatcacgcgcttccccgtcgatgcccgacgccccacgcagcgccgcccctccccacttgagttcatcccaacgccagttcgccgtcgatcccgcgtccgccgctcctcgatttctctcctctcccgcgccgcccctctgcctctccgccgtcgtcgcatctcctcacccctaccccgcgcaacgccggtcgccgcctaaccctaaccgtcgccgctccactctttccctctcccgccgccgccgcgcgccgccgtcgatctgtcgattccgacaccccgccttcgcgcgtgacgccgccggcgcccctccacgccgaccgtgtatattattgaatgctcttttctattagcttctcaggtaggagtattattttacctgttttattgataggacaattttttttcagggtttctattactctctaaggacagccatatatctttgagaatattgattttatccccttatttgagccatatacagagactgacttctttgttatgtttgttttgacggattttggctgttactgttgtgcgtgttgtagtctggatggagactggcggccatggacgttgacaaccgctttaatagaatcatggttagtgttttagaattacaatacattatatattcttattatgaatagtaggacaaccggtgctttttgtgaggttctgcccaaaaatgctgcctggtcatgtttttacctcactctgaactgagcactttccctgtattagcatttcattcatattttctattccagttgacagcgggttcttggacatgatccatatcaatttaccatacagttcaattgtgattgttattgcgtgaatgatcagtatctgttgctattttctgctacaattgagtattacatgccaagaattaattctgaaataataaaacatatcggatttttagtcatgctagctctaatttcttttagagatccacgatagtttttcttttatcagtagaatgctaagtaaaagaagctggatgggcagctaccttgaattgctgggtgttggaataaatacctcaagttatttagtgtagattcagattatggaattatggttgggctctaatatgtattgaattggagaaggatgagaaaacaaattactagacaataatcagtggtatattttgggatgaaatgttataggctcatatgttttttatttgcatttcccttttcattcaagcttacaccaatatagactaaacatatgttggcgccgattttcgcctccagatcgccgatgccaactaccaggactccttgcccctgtgcccccttctctactgcgacaccacaaagtgatctccggaaccctctccactgcacgacagagaaggtaatactattcaagtacaaatgtagatttgctggtaaatagtggatgtgattgtgaactatagtgtcacatatctattacgtgtatatgtgcatatccacatattaaggagctg

SEQ ID NO: 53169 - DNA, 4612 bp, Oryza sativa
  unsure (1)..(4612): unsure at all n locations
nnnnnnnnnnnnnnnnnnnnnnnnnnnnnnnnnnnnnnnnnnnnnnnnnnnnnnntaatggattgtgcaacgggactagactaatggttagagcttttcaagataatgcaattgatgctgagattgttggtggacaacatgccagcaaaagggtgtttatcccacggatccctttgtctccctccgacgatatatctctacctttcaaattcaagaggaagcaattcccaatacgttttagtttcgtaatgaccattaacaaatcacaaggacaaaccatcccaaatgttgggatctatcttccagagcccgtgttttcacatggtcacctatatgtcgcattgtcaaggggtgtgtcaaggctaacaacaaggattttggcaaagccaaagaaagaagttgattcaacagggaagagcactagaaatatcgtgtataaagatgttcttgactggtgagcaaaggtaggttcgcatgatctaaattaattcaaaaaaatattgcagaatatagtaaattgctcatcggaatgttactcaccatcgtcctcttgttttgtacagcacgccatcaccttttatatggaatgtcgtgtgattatcttctacatactatctcgcactagatgcgtcagtttgcactaggctgtcatttgagattgtaattatggtctgtattatatatatatatatatatatatatatatatatgcttacaaaattgttctggattatttttttatatggttatccatacaacttaaatggataatgcaccgcagacagcccgcaccaccgccatcgccatccaccgcaccactgccatcacccgcaccactgccatcgccgccgtctccgcttgctctgctgtttttttgggggaaaggatagagagggagaatagggctaacaagtgggccctacgctttttagtttttctcttatcacttacatgtgggcctcaccttgtaaagttttattgtgcccacgcaatatcatagttctgcactttacatgaaatatattttatgtacgatatgaattgaattaaagttcaaatgcatagatcatataaaaatatttttttgctaacatgaaattctaaaaattattaaagagaaatgaaattgcaccgtagcgtttagtacgggcatattactagtttatagaagtgaattaactctatcaaactccccgttaattcacttcatgcatactccaatcatttctcaatcgtggatgaatttttctttggataaagaattggcaaatatatctgccaactgctcatgactgactggattttcaccgatagcaatttaacttcctagcgatcaactgtttcccggatacaatgtgttttgtcctgtcatgattgactggattttcaccgataacaattgcaaattgaccgtcacaataaatttgtgtaagcctctcgtctatgtcttccataattcttcttaaccaaacagcttgtgacacggcttttgatgttgctacatattctgcttcggctgaagataaagcaacaatattttgtttctttgttgaccaggagcatatacctgagctaagtgagaaggcatatccggatgtgctcttcatatcatcaagacatccagcccaatcactatccgtgtagccaattaattttaattcttaactggcttgtaccatataacataacctgtggtccctttgatataccgcaaaactctcttcgcagtagtaaaatttaactgacttgggctaaacatatatcttgataataaacttgccgcaaacataataacataatatccggtcgtgttgcggtcaaatataataaacttccaaccaagcttctgtaaattgttggatctgctttatcagcaccatctcttgccttttgcttttcatttggcaacaaggggttgtaactgacttgcagttatccatcttaattttcttcagaatattttctgcatattttctttgtgatataaatatcccttcagtactatgatgcacttccattcctaggaaatagtgcaacaagcccatatcactcatctcatatgtattcatcatgtcctttttaaaatattgcatcatcttctcactattactggtatatatcgtcatcaacatatagtgagagtgtgagacaattaaaatgtccatatctagcctcttgacatatagagtagcctcacttatgctcttggcaaatcctttttgaataaagtacttatcaatttgactgtaccatgctctaggtgtttgctttaatctgtataatgtcttcttaagtcagaatactttgttttctcccccttgaactaaaaacccttcaagttgtttaacataaatttcttcatcaagatagccatttaagaaagccgatttcacaacaagttgatatatcttccacttgttttgagctgctagagtaattattgtacgaattgtctctagccttgcaacaggagcatatttctcatagtagtcaatatcaggcttttgcataaagccttttgccacaagtcttgctttatatttctgaattgagccatctggatttagctgtcttataaacccatttcaactccaataacttctccatctttagatcgatcaaccaactcctaggtattattcttctcaatcatacgaatctcatcttccatggctttaacccaatttttatgttttttttgcttcttgaaaacagtgactcaacaacagaataattggaaaattcatattgttttgtccctctttgttgagaagtagattataataatttaaccatacttcttacacatcttggagctaattccggtgtagaaatttgctcttcactactcgggcttgaatccgaactgaagcttgaccttgaccttggacttgatgcatcttgacttggagtttgatcttccacttcatgattgccatacatatgtggttggcctagtgtgattgtagtggttggcaataatggagtaccggaggcttctggagacttccagttccaaatagcactttcatcaaaaatcacatctctgctgatgataatgttctttttctccaaattataaagtctatagcgtttgataccatcagcatagccaacaaatatggaccaatcacttttattatcagattttactttcttttgtgctagcacttgagcatagcaaatgcaaccaaatactctcatatgtccaatgataggctttttaccatactaagcttcaaaagatgaacggtttggtactgcctttgtaggactactatttaaaatataaactgcagtgttaactgcttcagcccagaaagatttaggcatagctttgtcttggagcatagagtttgccatgccattaattgttcgatttttccttttagcaactccattttgttgagcactatagcctgtcgttaattatcttcgaatgccaacattttcacaatatttctcaaattcttttgagatatattctcctccttgatcgttgcgtaatactttaatttttcgattactctaattttccaccatagccttgaattttttgaatatccagggctgctgatttttcttttagaaaatatacccagatcattctgtataatcatcaataaatgtgataaagtaccaatttcctccttctgagattgttggcactttaccaactatataagtgcgcactagttccaacggtgcacttgctctccaagctccactgcgtgggaaagaagcttgtatttgttttccaaacacacaaccttcacatgggttggattttagagtaataaatggaaggccttgaaccatgccttttgccctgagtagctttagtgctttgtaattgagatgacccattctcttgtgccatagattagaaatatcgacttcacttttgagagccatttgagttggatggttcatccttaatagaaaattcctattcttctccatatttattttggcaaccaaatgattatttttacggtccaatattttgcaagaaaaatcctcaaaataaacagagtacccgtgttctagaagttgcccaatacttagcaaattttgccttagatcgggtaccagcaaaacatccgttataaattttggaccatctgttgtttgaacaacaaccgtacattagccttcactttgcactatagagccattacccatgtgaatctttgcatgatatgataaatccatttcttgaaataaatttggatcagatgaatccatttctcgaaataaatttggatcagcagccatgtggtttgtacaaccactattaataacccaaacatcattattttcttattgagcagtatggcaagagaaaaccatttcttcagattttttttccttttcttgtgaaaaattagcccgattaatttctcaagacctgcaatattttgcaatatgaccctttcgtttgcatttgttgcaggtcattttcttccagcacatatctgcagtatgactagatttttgacaaatgtcacaccacaaacttgtcatatgctgccttggagttcttggccccgataatacgcggaaatagactttccgcaactccttgtgggatctaagaacaaggccttgg

SEQ ID NO: 53170 - DNA, 2660 bp, Oryza sativa
  unsure (1)..(2660): unsure at all n locations
nnnnnnnnnnnnnnnnnnnnnnnnnnnnnnnnnnnnnnnnnnnnnnnnnnnnnnnnnnnnnattattttcttattgagcagtatggcaagagaaaaccatttcttcagattttttttccttttcttgtgaaaaattagcccgattaatttctcaagacctgcaatattttgcaatatgaccctttcgtttgcatttgttgcaggtcattttcttccagcacatatctgcagtatgactagatttttgacaaatgtcacaccacaaacttgtcatatgctgccttggagttcttggccccgataatacgcggaaatagactttccgcaactccttgtgggatctaagaacaaggccttggcgtccgttatccgatactctaccaaagacttcttctgttccgccgtaagagtgtctctaccagaatactccttgtagccattctcaacaatataccacaatcctttagatagcaacaacgtctgcatcttgatgctccatatatcataaaataagcaattactacatatatgtgcaatggaatgtcacgtggaccaatggaatgtcggcaaaagtgctggctttagattagtagactagaaaaagggtgcgcctttggcgcaccaactaaaaatatcctgtgaatatttatatttttcgttagaatacataaataattatttggaattagtttgatttcttagatatatatgagatggagtataaattaactaagtgacaatgatcggtagcatttgtgataacttagataaatgaaaacttgcaaaaaaaaatctgagctcaaaataacatatgaaaagagacgtggctttgccgcataatgggccaacaagtaaaaacatattaatgtgctaaaatgcagaatgttttattcggtcaattatgtaaatgtttcacatgccgtactatttagcaagtcttcaatataataagggtaatgaacagtttttggagaaggcaagagccagctcttcggaaaaataaacgtgctggttggcgtgctctttgtatggcttgtataattgctaagggtaattaatgctaatattttggtagagtttataggaattagctcaatttttcattgaattcttgtgaagatcgtgtacttttgagatattcacaatggaagcacatatgtttcaggacacacgataatcttaatgtaccgatggtagattttgtatgtcagctctctacctcttctatttaagtcctcttattttattaattaatattcctcgattttttaccttatgaactatagaattccttatatgccactccaaattaactggttcccttatatgccacttcaaattggcttctcccttctatgccaccggttcaagtttgtcctcccttttatgccattgccgtcactccaccgccagttgaccgctaacttcatagtaaaaagacgcatttgcccttgagagttggtatacaaccaatggtaggtattttagtactaatatagctactggatacaacatatgaaaattgatttttttttcatcacatgcaattttagccatcaccatcacaaataaattttcaatataagcacaaaacatatagttttccaacaatacttatacaaagagcatttttcactggttctgacaaaattttgttcactcaaaaaagatttaaaataaattagttatgatttttttgaaatttacacatttttttagttgagagggcatattggtcatttaaaaaactaacatttgactaacagtcaactaacgctatagtgttgggagcggcgaaaaacttgaaccagtggcataaaagggagaagctaattttgagtggcacataaggggactggccaatttgtagtggcatataagggattctctcgaaaagtaattacgtacagctatgggcccacttcacgatctaatttactccctccatctccaaataactgcttatttcggtttaaaatttgtcccaaattaactaacccttagggtgtatttgagcgaagagaagaatggtaagatacgtaaaatgagacaagttattagcatatgattaataagtactaattattttaaacctaaaaaatggattaatatgttttttaagatatttttttctataaaatttcttttagagtaaattttattttggaccatctttattactgatgtttcgcttttgatcacccttaaaccaatgtttttactttagaccgggtaatcttgcctctgttaatcttttctcatgcatatgaatgacctcgagtactcctgcccttattcgtcaataaactccgttagctgtatgtaaaccgtttatttgatatatgacaatttagatgtggatggataaaacaactgacggtggtacaaagtgctataaaggtaaaataacccggtcaaaagtgtaaaaaaatggttaaagggtgatgcaaagcgaaacaacgccaataaaaaatggcccaaagtgatttactcttcttttcatttgcaaaaaacacacggtttaacatttttttatcgtatgaaccatatatgagaaaaacaattacatagacaccctgtgggcccactttgcattctacannnnnnnnnnnnnnnnnnnnnnnnnnnnnnnnnnnnnnnnnnnnnnnnnnnnnnnnnnn

SEQ ID NO: 53171 - DNA, 2091 bp, Oryza sativa
catagacaccctgtgggcccactttgcattctacagccccatcgttttgcttattcacgttgaataagtgaaacggcatatttgcaaacgaaaagtgatatgcaaataaaacttttatatacgtgttcttagcgatctaaaataaacttcgatgaaaaaacctcaaaattaacttcaaatttgaggttgaaaattcaaattttggttgataagcataagcataagcgaaaatatgaggtcgctaatttactccatcccttccaaaaaaaaaagctgctattttgggtttaaaatttatcccaaaattaccaccacttaggctgagttagtttccaagttttcccatctcacctctctctttttttcgtgtgcacgctttttaaactgctaaattatgtgttttttcaaactgctaaatctatatgaaagttgctttaaaaaaatcatattaatcattttttcaaaaaataggattaatacttaattaatcatgtgttaatgagttactccgttttgcgtgtgcgagggattaattcccatccctaagtgccgaacacaaccttagagtgtttgagtaaatgagaaaagataacaatgataagatacaaaaaactaagtcattacaatatgattaatgagtattaactattttaaacctgaaaaatgaattaatatgatttttaagtaaaaaatctacagatttttcttttgaaaaaacacgtcatttatcaattcgggtaacatgcatgcagaaaacaagatttattttcactttctcacaccgtcgaacacagattaaggtcctcattggttgtcagtattctctaataagtcaaaaaaacaacttatttggagataaaaattaatttatagctaaaacatttatatatgtattgctagcgacttaaaatttaatactaaaatagaaactacattgaaaatatcttaaaatcaactttaaaattcagtttgaaaatacaaaaattgaagaatggtgaatgggaaaaaaaaacacaaatcgaacaaaaaatccagtcaccaaacctcaccagagacatgagcagtatgagcttgccaccgtcgagcttcagccctcgctgtcgctttcaagctgccaccactgcctcctatggccagattcaacgagaagggggcgcggagtggctgccggcggtggctcggtcgagctgcactgccaccgcctcctaaggccatatatggcgaggagcggggaggcagcagcacccgacaaggaggaaaggggccaacggtggtgggagggagagcattgatgggggtagtggggaaggcggaggggaggggaaaatgtgaattagggttagggttcttgtcatcgattgttttgatggattcagcatcaatccgtgccgtccatcaaaatgaacgactcggatcgatcccccgtcgggtgggcctccattcttgggccgcagcaccattgggtcctgtggtttacatgggctgcatgcgcaaatgccctagcaggccggcggggtacaaagtggcctttttttattccttttttaaactttcttaattttttaggaatatatttgtttacacccaaatttggcacctgggataaaaataggaaagattgccaaaatttagaaatctaccggtttcctccgagtgggccagtctgaccgccgtgtgttggccggtcagacagccggttgagggccggtcagaccggccacacaccgccggtctgaccggcaggtccgagtccgactgtgtttcgtcaggtctcgaggtttccttgctcgggaaggcatgtttcgggtttcctttggtttctaccctgagttggacgtggaggagggcctgtagagggcaagaccaacccctataaaagggacatggctggttcattgtaaaaaaccaatctacaatcaatcaatcgaatcattttttcatattgcttttagttttctcttagtttgtccatctttgtcggtttgcgccgtaaaccgtccggcgccgctgcgagagtgtgacatctctttgtaggtttgtcctgaaaacctttcgttttgcccacgagacgggtagttatctagacatcag

SEQ ID NO: 53172 - DNA, 1014 bp, Oryza sativa
  unsure (1)..(1014): unsure at all n locations
nnnnnnnnnnnnnnnnnnnnnnnnnnnnnnnnnnnnnnnnnnnnnnnnnnnnnnnnnnnnnntttcctttggtttctaccctgagttggacgtggaggagggcctgtagagggcaagaccaacccctataaaagggacatggctggttcattgtaaaaaaccaatctacaatcaatcaatcgaatcattttttcatattgcttttagttttctcttagtttgtccatctttgtcggtttgcgccgtaaaccgtccggcgccgctgcgagagtgtgacatctctttgtaggtttgtcctgaaaacctttcgttttgcccacgagacgggtagttatctagaaatcagctccgctagctggtttagttatcaaaacccatctaggtttagctctttgctagatcgaggtggttggcgactctaggatcatcgcaaggcttaaggtgctgcgatcatgcttgtcaacttgttaaaaaaagttgccaacacgatttttggcgactccgctagggaggagatccgttcatcgtcaactcaacttcgacttcgccatgacgaagccgccatccaagacggaggtagagccatccaatgtgatactggtcacattggaggatttcgaaggagaggaccacaaagctatggaggagtacatcaacgaactcacacgggaggcgttgatgagggcaagcactaggactcgtcaaggcgtgatcatcaagcccgggccacgtcctaagctcgcccccgatttggtaagtaatgatgaggtaacacaatctatccaacaacaagtagcatctacaatagattcatctatgatttcttttaaagataagttagatgcaacttttgagggtaagtttgatgagtttttaagggttaaattcggccctcttatggccgattacatgtcaaaggataaagcctttaccactgctaaccaacctcctannnnnnnnnnnnnnnnnnnnnnnnnnnnnnnnnnnnnnnnnnnnnnnnnnnnnnnnnnnnnn

SEQ ID NO: 53173 - DNA, 4507 bp, Oryza sativa
  unsure (1)..(4507): unsure at all n locations
taatcatattgcgccacaaacacaacctattaggccaccaaatccaccgccaaatcaacatgggcctaataatatggaggatataattagtgagattattaggaatagattcgggattgaaactaggaatcgtgctaggatttacaaaaagccgtatcctgattattatgataatgtgccgtttccccgtaattatagagtttccgaatttaccaagtttagtggtgaggatggtaagaccacatgggagcatgtaggtcaatttttggcgcaatgtggtgaggctaatagtgatacttttaaattgcgcttgttttctttatctttgtccggtaatgcttttacatggtttacttctttaccggcaaattctattcatacttgggctcaattagaagaaaaatttcatgattatttctatactggagaaactgagcttaggttatgtgatttaacatcggttaagcaaaagtataatgagcctgtcattgattatattaagagatttagggatgttagaaaccgatgttatagcttgaatataactgatagagatttggctggtcttgctttaatggtttaattgctcctcttagagaaagactagatggccaacaatttcttgatgttagtcaacttatgcaaatggctttggctcaagaaagccgggtcaaggataataaaaaacttgttagaacatatgacaaaaagcctaatgttaatgtgattgattaccctgaggctagcgatagtgaggaggagggtgatcatgatatatatgttgctgaatggtcatggactaacaaaaacaagccttttgtttgctccaacctaatgccgactcctcgcaaagattggcaaagtgaggttaaatatagttttgatgtggccaagtgcgataagatttttgattatcttttacaagaaaaacaaattagattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccgatggctccaagatgaagcttgatcatgatccttttccggtgaacacaattaatttcaatgataaggagttgattcggccggagcaagccaaatctgctaaggaaaaaggagtggtcattggcgaaccaaggcctaagatgatagtgccaaagaagccggaggttgacgtttggaaggagaataagagtggagctaagcaaggtggtgagagggctcgcaacaaagggaaaagaccaagatcacctcctagggagcgatttggtcattcaccaagacggtcacattccccttcatatcatcatccacaagacatgtcatggggttcttatccaatgccaccgctgggttatccttatccttacttcatgccatggggggcgacgccaccaatgttcaatcatatgcctccaatgcaattcaatcaagggtggggaggaccgaggaggccaattcatgagcgtttgtcttcaccaaacaatagccggttttatggtaagaatcgggctaatgaagaaaaaagggaaggaaagcgcgtcaaggtggaggtgaggacttcggaggtgattactatcaaagtggggtctcatgatgtgccaataccttctggagatggagttggagtgtccccaaacaaaaaatccgaagccgataccagctcatcgcagtcggccggtctgaccgggtcctctggccggtctgaccgcagccatgtggttggtctgaccgggccatcaggccggtccgaccgcccaaccgacaccggtctgaccgacgcttcaggccggtctgacccgcaccaaatgtcggtctgacaggcgcatctggccggtctgaccggtggtctacgtccggtctgaccgggctccagcgccggtttgataggaggattgcaaagggtgatgtgagggcttcatcgtctctaagcaaaatcaatagaggacattatttacctcctggaacagagccgaatcctaggtggatgcctaaggatttgacggctactcaaaagagaaggttgcaacgtcttcgggctcaagagataagagagaaaaaagccgaagaacaaagagataaaaggtttaatgagttacgaccaccacggtatggaggcataaatccatagagaaggaaaagccggttgttgtagaggagaaggaggagcaatcggttgataaaggtgaatcatctccagaagaagacatggatatcaacatggtatgtatgttgcctatggagttttgtgctatggatgaagccgaggttgctcaattctcattaggtcataaagacgcggtttttgagaagcccgatgagtcaaaccgtcacatgaagcctctcactacaagaggtgtgtggctttttgacattttattatgtcataatatgtgaaatttatgtcaaaaattacaatttgtgacaaacggttgacgtaatttcaaacgtcaaaaagccaccgttataaatttagtatgtgacgtttgtacatctattgtcacaagcatatgacattgctttattgtcacaaaatcctagggcttgccacgtggcagctgacttggcagttgacatggttgaaaaaaaacgtcacaaaataagattcggcctgctaaagcccatgtagctcatgggccacaaatatttttttttctggggttgtttctagttggcccagcatattatttgcttctttttaatgagtgcagcctgtacaaattttcagcccacaccaattcggcccatatgatttttctagcccgcacaattcagcccatatgatttttccagcccctacaatttagcccatatatttttccagcccatataatttttttagcccacataactcaactaattttttttagcccatacaattcagcccagatacaatatttcagcacatacaaaatcagattcaaatgaattaacattccacaaatgattgcaatgtcacatgcatttcacattccacaagtcttaaaattcaatatcagtacatctatccactaattcaatacatatccaaagtatcaaatttcatcttcctgctacattgagagcaacaacagcatatttgcaatagcttcacagcagcagcagcagcacaatggccaaaagcacagcagcaacagcacaacggccagaagcacaacagcaccaaaataacatcccacaatcacaatggttgcaagttcagtgttaccaaaatatcatctagaacctaattgagtatgagagcttactgctgagcatctgatgatgcaaacttgctgccaaacaaggagcgaaggaagctttggatttcacttccttgatgcctcagcttctcagtttcttcttcattcttccttgctacctctttctggtcctctaattgcttatgtagatcagctatctgcaattgcattctggctgatcccatcttctcagcatgcaattcactctctagctcacgtacatgatcattcattgcagcagctttggcatttttcttcatctctgtggactgcatgccaacattgcgaagaaaagttgattttggcagaacatgagctacagcttcaacaggagtctttggatctttgccttcttctgttggttgagcaacataggcctccatttgagcctagcaacaataaaaccaaaaaaaaaatcagattttctatgctagttatgtatgtgtacccagaacaatatatgtgtaatgatgtccatatagaaatgcaacctagtggaagaaatgaaatgattggaataaaaccttctatgatagtgtccagaatatatataggtattatctgatgtccatatggagatatgtagtaatctattgtgttgttcatagtaaccagatagggaaaggtactcacaatggcatcctttgcgttctcattaaaacctgacttgctactgcagtgggtgtccttgaaaatatcaatcgcagttggtggcacatccttaaatttggtttgcttttgaaattacatacaaatagaaaaataaataactaaaagcatattttttttaaagaagttaactaaaagcacgtgaaaagttaaatgaatagtagcagctcaaaaatccaatttaatgcccttagtctagaatgaacgagcaaaccattattgacaatgaacacatcatttatggagggcaacagctgcaggcgacaaaagctggctgcactattgtcgccaagctgaacaatagcagccacttatgaccaaaacaaggaaaacatagaacaccaaactgttgtctacttttctgaaatattgtctaaaatcacccacatgcaggaccttgttggctgggataaaatcacccatatcctgaatatgggtgattttagccgagacgccaccaannnnnnnnnnnnnnnnnnnnnnnnnnnnnnnnnnnnnnnnnnnnnnnnnn

SEQ ID NO: 53174 - DNA, 1316 bp, Oryza sativa
tatattattagagcatcatacagcatcagctgcatctgtagcagcaaaatagcaccagccacaaaacagcagcagctgcagcaaaatagctgtatctgcaagttttcagtagcagcaacaatttcaacagcatctcagcagtaccagcagcaatttcagcagcattcgcagcaaaccagcaatttcagcagcaaaacagcatcagcaacacagcagctgcagcacagcagcacggcaacacagcagcaggagcaacacagcagctgcagctgcagcaacacagcagcaaaacagtagtaccagcaacacagcagcatcacacaacatcagcatcaattgcagtacaggctatttaaacaaaataatccacatagtccaagtcatcattcatcgacaactaaattgaaaccacaactaaatctactcataattgctatcatcgtcatcttctagagggaatgttggaccttcattatcactcacatattgccatccagtttcatcttcactgtcgcccgactcatcttgttgcccttccgcttctctttgtatacggaggtcatcaactacactagcatcaacacgaaaaccaccttcactaactggctggtcattttctagacatccttcagtaagttgaacatgcacaccttcacaatcatcgtcttggtaggacaataccacagcattgggtatatcctcattgtcattttcagccacactccacaagtgtctatgtgaaaatttttgaacaactcgccatttctcatgatacttggtgtctaacaaataaaatacctttgttgcttgtgttgctagaataaatggatcatctttgtaccacaagctgccatggtttatgcttttgaagaacccatcttccttcattcggaacttctttccatgagtgtcaaaccaatcacatcgaaatagaaccaccgtcctatcgccacttgaatctgcattgtatctaagctcaattatttctttcaaggaaccatagaagtcaatttcctggttatcatgtgtaccctcaaccataattccgctattttgtgttcttctatttttctcacggtctacagtgtggaatcgaacaccgttgacaagtcaagctgattaaattcgaactcgcagatcaggctcacatgacagcgcaaatagctcatcatttatgtcttgtctatccacgtaacgaagttttgtaatctgcacaaaaaaataattgacataaaaagtttgctttttaaaccaggaagaaaaatgatgaaataaagtaatagagatcaaactcacgtgcttcttaaaccagcgag

SEQ ID NO: 53175 - DNA, 1429 bp, Oryza sativa
tatagggcgaagtcgagctcggtacccgttatatatacttagggggtggcccctctctcccaaacacccccttatgtgcatggatgcatgcatcaatgtccatttactccaatgcacaaataacgaatagacttaatgaataaacataaatatatatagatcatttaggaataaccttaaaaaaacctatatgtagatcaatttggaatggagggagtaacgtgtatctcgatcgttcatgtttttccattacatgtcttatttgatgacaatataacttttttatgaataatatactaataggattgataatccatatatggattcattactatagtcatatttcatcttcacaatgacctaagaataagtaattctatttattatccatttaaatattctactagttattccttgtaaacacgcgattcattaatatttacgtttctcaatgcccatgtagccaatcatgtgtagaagaatagacaatcatgtgtagaagaatagagagtcacgcattaaatccgagaaagtcaataagaggataggtggttggattgaaatatgtctatcaaaactaaatttttcagatttggaaatatgtctatcaaaagtagattgagggagtataatatagtacatttttatgtaaattgctttgggatttgcgatgacatgccgatgaagaagcacaataggaagattaatactattgtttaaaagcaatgaatttcaagtcgtgtcgtttatggatagaaattaatgcaatcaccgaaatgaggtgtgctatgaaacctcaaggatatatgctctcctctttagaaaactcttggtcaaaaaaaagttagaaaactggaaaagaaaacacttagaaattgtgtcaaccacctattgttttagaaacatacactgtcaaaatactaaagttgtggatggtatttcacattattaattatatggtcgtactcacaacatgagtccagttgtggatgatatttagaaggaaaaagtacgaattacctcccccgaactatcacagtcgtctgaattacccccctgaatcacaaaaccggacattcttcacccccaactatgcaaaccggacgaattaccctctcgacccaatccacggtggttttggtctacgtggcgtacgcgtggcagctgagtcagcattctattcattaaaaaaataacgggacctacatgtcatactcttcctctctctcactcttcctctctcttctcttctctctctctcactattcctctctcacgggcgggaggcggacacggagctgcggcggcggtggccggcgggtgacgctgaggcggcggcggtgggggatgagggtgacacggagccggcggcggtagcgcggcctcgccggagtcggacgtcgctacggcggaagaggagaggtcacgc

SEQ ID NO: 53176 - DNA, 2630 bp, Oryza sativa
agtttctattaatctacaacatgcacttctattatcgagatatgatcaaactgttaaaaaactaagaaaacactttgaattgcagcaaccatctattgttgaagaaacatgcaatgtttgtggatgatattttgcattattaaccgtgttcatactcacaacatatgagtcaagttgtggataatatttagaaacaaatctatttggttttctcaatgttggtggccagtctacaccaattcatgagttgtaactatatgaacaacaccatgaactatctaataccgtctaaataatcccaacagtagattttgaaggttggtttcatagtccacgattacgcttgtaagtgcaatataattcatttgactgtatggcttgcaacatcctcgtggatctatttttaggctcagttcggtagtacaggtacccaactcctcgttttccgcgcgcacgctttttaaactgctaaactgtcagggttatgataccacatacctaatagtagttgactaaatctcggcaggatccaccacataccatgtcctatacagaagcaaccttcggatataggaggagttctggataatgaaagacaaccagagttctacatgaaaatgacaaggactactcggattgtatccatattggtttccctagttctacttggacaaggggacaactatgggtataaatacaagcccccctaggaggacagggggacaaccatcatgagacgatcaacacccaatacaatcgacatagaagccacaatatagaagcctacatatgccaagacacgccgccggatatcgacttcagggataagcacgactagtaccctacggtgtctccagatactgtcaggagagacgaaagcgttatctctgatctcgccgggcgcggattcgaggaggaagactaccctgttgttgactacgagtcagatcgtcagaccgccatgtcgataacagttagataggctaccccaaacattgtactggtgtgattatcatgaataaaagcaataccggctttggccaacaggatgtagggttattacctaacaattcaggggcccgaacctgtataaaaatccctgtctccatctcttttgcctcagtctcgcgtatatcctagcaccaacgatccccatactgtccaaataccgtagtcgtgacatcaaacgtcgacataaacggtgtgttttttgcaaaaagtttctatacgaaagttgcttaaaaaaatcatattaatctatttttgaaaaaaaagctaaaacttaattaatcacgcactaaaacgttgcttcgttttgtgtgccggggagtgatggttcccaaccctcactcccaaacagagccttagagagttcttgggtaaatgagatatgatatatagtcatagttcctgatttgttgtatatcccccccccccccaatgttcatgtatctaaatagactaggtgctattaatctaccacatgcctttctattactaggatatgatcaaaactgttataaaactaaaaaaaaactttgaattgcagcgaccatctattgttgaagaaacatgcaatgtttgtggatgatattcccattattaactatatatttatactcacaacatatgagacgagttgtggttgatatttagaaagaaaatctatttaaccttctcaactttgtggtcagtctactccagttcataagttgtacctatataaataataacatcctgaactatctagtactatctaaataatcccaacagtgtgtttgaagtcctattttataggccatgcttatgtgcgcaagtgcaatataattcagttaccctgtaaggcttgccacccacatcttcatggatctagagatcaagcgtaattgagatagtcattgttctgggttgtactatatggcttccaatgttcacatgtctaaaaagggaaactctattcatcactcgaagggatatcctctcgattttcatgctacttaaaaggtcataaaaatattaaataaattaataagataaataaatatatgatatatcacttcacgaacatgtatattcaaattcaacttatataagtagaaacaaaaataacaaatttgattcggaatagaactttcaatttgcagtcaaatttgttatttttctttctataattgtttaattccaatttgaacttggcaactttgtgcaatgacatctatcttgccaagtttttaaatattttttgatgactttttaaataaaatgcacaaaacaagagaatattctctggatggataaaattccatctctgtctaaatatattactagttcttactatttctacaacattcggttctgtttttaaggatggctctaatattaatttatgtatgtgttgttgtaccttaatttctatctccatctttgtttcaaaatataagtattaaaatataagtattaagtacgaaggttagttaagttgaaaaggtggtactgtgcactagaatttcttttattttgtatacttgattttggatttaaaattttttatgtcttactatatcgatgttgtcaatattcactattccctctgtcctaaatgatgaggtttatatttttttctacacgat

SEQ ID NO: 53177 - DNA, 1028 bp, Oryza sativa
aaccttgaggcgggagccatggcagtagcagaaggtgtcgccaccaacaacgtcgccgacaacacttgtccggagaagggaaccgtcgacatcgtcgtcggcggcgagcaccacgccgcagcagatcggcgagttcctcgggtgcgcgtcctgcaacgtgatggcgacgtcggagagcggcatgaggctacacctagccggaaagaagcacaggaacaaatcgatggctgaaaaggcggccatggacgacatggagattgtgaaggccaggtcgaaggaaacggcggccgccgccgccgcctcctcgccatcgtctgcgccgcgagctgtcgtcgctgcacaaacgggcgatggctctgtggcgcccatggaagtcgaccaaactgcagaggccagagatggcggcgcgccggtggccgccgacgccgcggcggcggcggctgccaccggcgggcagcagcaggtgaaggtccaggtggaggggaggatgttggcggtgctgcgtgaggcgaacggcgcgctgctgtgcgagccctgcggcgtgcgctgctccggcaagaccgacatggtgctgcacctctacaccaaggagcactcggacaagtgcggcgcgcatccaccggcttgagtcacttcacgcgaacgtggagtggatttttaaacttttggacgtcctcacattatttacatattatctaaatgaatttcttttaaaaaatttcctcttatagataggacgaacaaagaacaaagttttttgatcacttacttcgctcgccctttttgatcggggaagataaattaatatgtgatgtatcgctttataaataataagttaaaatttaacttttaaaattaagaaaataaattaaacgactgttaacatatatttattgttaaatttgttttttaacatataaaatttaaggaaaaagtacgaattacccccctgaacaattgcggtcggacgaattaccccccttaaacccaaaaatcagtcattgctcatcctgaactttcaataccgg

SEQ ID NO: 53178 - DNA, 4559 bp, Oryza sativa
  unsure (1)..(4559): unsure at all n locations
actctccttcctctcttcctctctttctatcttcactctctctgtgtcacggtgacggggagtgcgagcggcgcgtgggggcggactggcggtgtgcggcggcgcgagcggcagagacggcggtggaatggcggcgagcggcgcgcgggggcggacgggcggtgggcggtggcgtgagcggcgcgcgggggcggactggcagcgagcggcggcgcgagcgaggcacgggggcggactggcggtgatcggcggcgcgagcggcgcgcgggggcggactggcggcgagcggcagcgcgagcggcgcgcggggtcggactagcttctcccctccgccgcctcctctcctagcctcccttccgccgccgccgccgcctccacgctgccatctgccgtcgagagccccggttctccacccacgcggcgacgatggcgggcgttctgcgcggccacaacgacatggtcatggcaatcgcggcgccgatcgacatctcgcccctcatcgtctcctcctcccgcgacaagtcgctgctggtgtgggacatcaccaacctgtccagctgctcgtgcccgccgccgcagctcgcgccgtcgcccaccgcccgtccgccccctcgcgccgctcgccgccggccaccgccgtccaccgccgctcgcgccgccgctcgcagccagtccgcccccgcgcgccgctcgtcgctagcccaccaccgtcctccgccgctcgcgccgttacccaccgccagtccgcccccacgcgccgctcgccgccagcccaccgccgtccaccgccgctggcgccgccgctcgcagccagttcgcccccgcgcgccgctcaccgccagcccaccgccgtcctccgccgctcgcgccgccgcccaccggcagtccggccccgcgcgccgctcgccgccagcccaccggcagtccgcccccacgcgccgctcgcgctccccgtcaccgtgcagagagagagagtgaagatagagagagagaggaagagaggaaggagaggtatgacaggtgggtcccacaattttttagaaagaaaatgctgaccagattgccacgcgtacaccacgtaggacaaaaccgctctgaattagattgagagggtaattcgtccggtattgaaagttcagggtgagcaatgactggttttcgggtttagggggtaattcggctgaccgcaattgttcagggggtaattcgtactatttccaaaatttaaatacgatcttgtattgtttatggagtgatttatcatatattaatatatcttttttttaaactgtttggataacatataacgagagaattttcttttcgagagtttaaaatagtttcgtgatgattccttgatcgtctcatgttaagatgactaatgtgatcgtttagttccggtgatataggctgtgtttagatcaggggtgtaaagttttggcgtgtcacatcggatatacggacatatatttaaagtattaaacataaactaataataaaacaaattacataatctgcctgtaaattgtgagacaaatttattaagcctaattaatccgtcattagcaaatgtttaatgtagcaccatattgttagataatggagcaattaggcttaaaatattcgtctctcaatttacacggcaatctatataattagttatcttttccatttatatttaatactccatgcatgtgtccaacattcgatgtgacagggtgaaaaattttgctagagatctaaggcccaaactttttcttcaaacttccaactttttcatcacatcaaaactttcatacacacacaaacttccaacttttccatcacatcgttctaatttcaaccaaacttttaattttggtacgaactaagcacaccctaaacagagccatactgtttgtcttgttgggatggatttctggccatctgcgatagtctggacgtgtggcggcgcactaggccatttggttggggataatgccggtggaagtaaattacttgtttctaattgtgagatgtctgtcaatcgaaagtgctcgttttaaattgtgtttgtggatattgttccatgattcactattatgtgctactaaggccctgtttagttaccacgcaaaatttttttatcatgtcacatcgaatgtttagacacatgtataaagtattaaatatagaaaaaaatagttacacagattgcatgtaaattacaagaagaatcttttaagcctaattgcacaatgatttaacaatgtggtgttacagttaacatttgctaatgacggattaattaggcttaataaatttgtctcgcagtttacaggcggaatctctattttgttttgttattagactacgtttaatacttcaaatgtgtatccgtatatctgatgtgacacttttaccctggatctaaacacagcctacatgagtcgataaaatctgcacattctccattcatcgtcgaataattcattgatggcgatgtcttaagataatcgtcaaatgattatgccgtccaatacggtttctcagtactaaaataaatcaatccaaaattattctaattgtatatcacatcttacctttgattaatttattataggaatgaggctcactgacttataggccccacagaccctcaaacccatataatagcgagcagtactgcagagaggatcaggattgaaactagaattgcatctaccactgattccagcaacacgagaggaacagcatgatagtaggtgacatgagtcttcaattgcaataatctcttgcccgaaatcatggcgacaagatgagacaaacttgtagaagcagccataaatcataatgccaccacatgcggacctagagccgatcagcagagatgcagtattcctggggttagaatcctgctgaactacactacctaaacatcagttttaaccagcaccacagttgtactgctgcatcttactgtaatactaattcttaatgaaagaccaggaaaaagaacacatatggctgccagaactagcatggcattgcatcacagtagccaattagccactaccagaaatataaaacatcactatggagtgaacatatatgctgacattactatagtaatattcacacatggatataatctacaatggtgatgggttccatgacttccattctattccctagtgtctacataaaacaagattgagctcaagaatgaattacagctctacaagaatataaacatatgcagctgcagcacctactacaaggcatcagacagcatttgtattaattattcatttgctcaaatactattagccctagagtagttgttgagatggcattcacgctaacaaaacagacaagtgattgattatacacgactacgatctcaacaagtgccaggagcattacacccatccaccgattcctcttaaggattcttttacaactcgaggaacagggatgaacgaaattcagttcctcttcccaactatctcaacactgttattattaacctatactctgagagctaactgatcctgccatgatatcttcctcttcccagctcgggaggaggcggcgttccggacatcccagaatgccgccattttcgcatcactaggaccggcggcaaaatcaccctccattgggtacctcatgaccctgccaaccctaacaggttcctggtaaccatgaagctcctccatctcttctgaactctggaaagagcaaattcaaccacattcagatgataatttcttcagataacggaacttaaccgagttcgccccaaatattaccggctcgcaggcctcgttgaggtcaatcaccggagatgctcttggagcagcattcagcctccggtgcgccgatgggcctttgctagagcttccgatagcccgaaccgtgtggtactcttcaccatgagaccaaccaggttgccgcaatgtgggcggcaatgccggattctttactctatagacaaacgtctgggatggattttcggacatggatttgtaccttttccgcaaaaacctacagcgcggcacaattatgcgcaggataatgagacaatatcaacatgtttgcattgtcgtagagcataatcatccaggcatgtaagtcacgctggagaagatgatgagttcaggcccttacttgacttcagccaaaagcctctgtttcttgagcttctccatctgtaatctcttcttctttgcttcagtttcctgggtaacccaacacagctaatcatcagctaacatcataataaagtaatgagatggacactaaacaccatcaaacttgcaagaaccacatttgtggaaatcctcctagattaagagagttgcgatccttggaagaaagtttaactacgaaccagaatgaactgatgcgcgtgattaggtgacttgggacatatccagacatgctaattcgttcaatgctaggagacgaaggataataaatttcagcgccccccagatctaannnnnnnnnnnnnnnnnnnnnnnnnnnnnnnnnnnnnnnnnnnnnnnnnnnnnnnnnnnnnnnnnnnnnnnnnn

SEQ ID NO: 53179 - DNA, 3258 bp, Oryza sativa
cacatttgtggaaatcctcctagattaagagagtgcgatccttggaagaaagtttaactacgaaccagaatgaactgatacacttattagctgacttggaacatatcaaaacatgctaattcattcaatattaggagaagaaggataataaatttcagaaccccacagatctaacccaaaatattgtcacaagtaaaaaaaaatccagatccacaaaatacaccaagaaaacccctcgaataatcagaaaaccaagaacaccgaaaataaaatcgatcaagaaacaaagccgccaagatccaatcggaatcacaaaatccccaaataccgagaggaaaatcaaacatcacaaaacccccttccggagagaaaccgatcgaaaaatcgcaaaacccccaaaaatcaagatcagatcggcgaagccaccacgacggcatgactccaagaaacgccatgaatccacccacccacccacccacctcgaggagctccttgtagtcctggagaagattcttgtacttggccctcgccctgtacgcctcttccccgccaccaacgccgccgccacggctgtgccccggcgccctcggcagcagcggcgacggcggcgccctcgccgccggctgagccaacaccaccttagccttcttcatgtccgcctcacctcacccgcgaagaaaccaacaaacgccccgcaagagcaggagaccaagaaagccagggagagagagaggtagaaggagataggaacaagcaagggaggaggaagaagaagacaatatagaaataaaggaggaggggaaggtggacgtggggagggaagtttcttgcggccgctgcttcttggtgctctcgctgctggctggctgcagctgcggcgccgtggtgaggtgtgaaggagacccatggatgtggtgccaaaaaaacccgaaaaggcccatgcatggtcatggatggtgctagagtagacggactggacggcaagatagagagagagagcaagggaacaccaaccaaaccaaaccaaacaatctctcatgtgtttctctctctagacttgtagtagtagcggtggtagcggagagggagggagggtgggtggtggtaatggcgtggcgcatgtggtaatcaggtaatggagtggtagtggggcgcttgcttgctgctgctgctgctgctgtctgcagcgttggcttcgtcgtcggtccagctccgtctccaagaccaaggagaggagaagagagagggggggcattcttggaatccgttggggttgagaggtcagaggtgtccaccatgagtgaatgctgctgcagctaccccctctctctgtgtacacagatgtcatggtccatagggaaaaaaaagcgagatgacgatacgggacatggacatggacatggatgtgtgtgtgtgtacgtctctctctcctggcgtccatggctgggtggctccatggatccattcttttgattctttcgtttcgctttcttgctgtcctcttgagagagaggccgaacgctcccgggtcttgtgcgagtgggtggtggcagcagcccagcatactacaagcgttgcagtggttgggaggaggatgatatgatggcgtttgcagtttgcacgcatttgatgctttgatagtgtgggcggaggaggaggaggagatgatggatggcgcagaccgtagaggcggatgggccagtgcgtgcggttggtgtacaacggcgtgtgtgcgtcttgcagaggctctgcggcgttgctgtttgcttgctgatgttgttgtggctgtggctgcgagtgaaatggcgagattgccatcccattcccaaacaaacaacaaacctacctgggtttctctccctgccgttgacacggtcgcctccgctcgtttttaagatgggggatttgggaagagaggagaattcttgtgtgagatgaagatggcgatgaaacgatgataggtggggtgggtgactgggacgtgtagagataagatgctgtggactttgtggtcctgtggtttgctcgttgcatctgtctgcccggtgctttcgtatgcataatataaagtactgtatcatattaggtaaattttactgtatgatattaggtaaatcgtgatttcatagttttagctctagaacatggtaaaaatcgatctttggaaaaagacacatccaacatgtgattatttgctgttgtatcccgtccacattaaaatattaattttcagttcactaagagagataaacatcgtgaaaggtcaaagtacctctagccccatttgtcatcttcttcctctttctcatttccctctttctcatttcccctttctgggagccgatatcgaggtggattcaaggtggcttggaggaggcgaggtggagcgacatggacgagtcggggtgaagaagatcgacacgtcgagtggtgagctggtggggtggtcgatggggtctgtgtggaagccgaggatgagccggttgatggcgcggttgcaagagagggcgctggccggaattggaactgaagaggatgacggagaaggcggtattatcctcgatccggagaagcggtggcaaggagtgctaggcagagctagggtgccatgcggtgatggaggcggaagaagacgacgccgtgctgccaagactgatttagagctggcgaagcctagcctgaatggtttgcatcaaaaggacggcgtacccgaaggcggcccttgcaaacgcggcgaagaggggcccgtcagaggcatgcagtgcacagaccaaagttagcagcggtggttgttattgatgcgcccacaacgcgaggtagtgtgtcgatgacgcgggagaggcttcgcccacggatctgccaccccacctcctccaggcgggaaatttaactatttgccactcttgtgatatggcaattaactatttgccacaccctgtcaatgacatgtgggccctcatgtgtttatgacatctgggcctagtgacaaatcgttaagcaacattcgtaagagtgcaaatagttaaaagcccccctctaggccaccacctcgatgctgactcctctgttccgtcaacactggggtgggggggaagaagaatggaagagaaacgatagcgatttggtcactccgtgtaaatagttgtgccccctatcaccttgtcagaatgaatacattattttaatcgacgtagttgtaggatcgagatgtcgactagaagggggtgaatagacgatattaaaaataagagaaaattg

SEQ ID NO: 53180 - DNA, 3717 bp, Oryza sativa
agtaatccaattccttgaatagtttaacttctaaatgttcaaaataaaggaagcgccatggaagtcaaattagtgaaaatcttaggtatcttgcagtgtgtatgggggcactgtgcaatatgatgttgcatgcagtatactatcattcttttaaaagtatcttctcggaataatttcttatttccaaatattctcagatacactttcaataatgtagatatgagatattatgtgcgaatggccaccccaagataatatacttcaggatatgcaaaatcagttggagaatgcaaattcggttgttctctttcatccctcatatatgcatatgtttcttaaataatttacaaaattactgttcagtagtggagtaaataaatatgaatgacggtacctgtcattatgcacatgttctctaaacacatttcatgaatgacaaggtaatttttggtaatattgtttggcagcgagtatttgggtacaatgtactaaagttaatcaatatgtgtggcatatgcattgtttttcattgttaaggttcgaacaactgaaggcaagtaagatgaaagaccttgtttgaaaagggaaagctgaactggaagagcatagaagatgcgctcatctaattagccaggaaggttatgcagctgagtttagcattgaagttattgaagtgcaggtaagatattctcctatcttactgacttccattgttcttgaaaattgtcattccaaacatgttcatgttttggccaagatggccgaatgatccactttggttctgaatattttgtttgtcgtttttgcaatggcagggacgtatgcgttttgcaggctgagcacatgaagaatcccagttaatgtctctttaacttccatccataaggagactcgtgcactttcctgacaccctagcacaagttattacgctgtgcagacttttggctatacattaagcaagatgcagcaagtattttggattgatgatctgtaagatttgagttcagctcatgctcgttgatagcacatgacacatcggttgaataactgtgttcatttaactctggacctacatatacataatttcctcttactttgattccttggctcaaaaggctcacagaagcctatattttgcaattaagcaacaagaagcagggcttgatttgcattccgattcaggtaaggtaacagctgacttcgagtttttttttaattggtgcattatccatgaaacccttttccagtttccagtattcttttgttaaattttctgataacttaataggaaagacattaattaactatgcatcacctgctctatatataatataactataggacattgaatattttatttcattgcactaaaatataatcaatgttggcctatttttatgaatatattattctggcatgtcactacaagatctaagtaatactgatattttgatccatgggtgctttataagatctaagaaattaattatacttgatctcagggtctgaagaaattaaaccttaacaacattgtgaaatatagtgagactgaatcttggagataaattactgaagaactgaactattattatgagtataatttactttctgatcttttaacaaataaggatattgtttattagtggttctagatttggttaccttgcgtccttgccttttattcatcagtgcaattagggccaagcttttgcgtggccttgtcagagagatgaaaaagtacatatgcagtgcatcacttataattggttgtgcaacctcctcatccgcatgctaagtacaatgagttgaagatgatgtgctgcaagtacgccctttccaccatctgattatgtacacatttttatatatttcggtacatccgattatatacacatcaatataaattgtttttacgcattcttatatatttccgtgccacctactatgtaaatgagcaaaaaaaataatttgtttcttacatatattatttacaattatttttctccacttctataggattgacatattgttttccaaaggaaacataatagatcgggcagtttctgtgagctggatcagtacgggcatatgtgctaactgcctcctatgcagttgtgctttgcacaacgaagtgagtgtggttcatctttagagccatgttcaaagagagtttgggtgttgatcaattgtgagaaaatcatgtgtagaaatgccttgggatgatgtctaaaatagggcattgtattcatttcccgtgaattgctgcacaaatattttttgatgtactttatggtgcaacatgcatctattgacactttctactttaaacatattaaaaatatttgatgtattgtttcgtgctatagtttttttcctgttgcaacgcacgggcacctaactagtattttaataaatccctacttattataaaaattgaagatatttttgtcggtattttggtacatcaactgtgtttgagtcgtttttaagtccgtccgtttttgggaagacatatctgtgtttgagttgcattttagtcttgtttgcttttgaaaatacaaaaggagttgtataagaaatcttaataaaaaaactcacattacttgagatgaaatacaaactcataattgcagcccacgattttctttaaaaaaaatattcatacgaattcccaaaatgaattttaccctaactaaaccgtataagaatgataaaattaaaatagtatttacccgttacaacgcactggtattttttctagtctctactattataaaaattaacaatgtttttgccggtattctggtacgtcatccgtgtttgagtcggtttttaagtttgttcgcttttggaaatactgatccgtgtttgagatggattttaagttcgttcgcttttgaaaatacagatctatgcttaagttggattttaagttcgtttgcttttggaaataaaaaggggtcgtataagaatctttttaaaaaacacgcatgctaacttgagatgagtgtcgaactcttaattgcagctcatgattttctaaaaaaaatatccaaacgaattctcacagtaaatttcaccttagctaaaccgtataacaataataagatttaaatagcattcacccgttgcaacgcacggacatcttttctagtctctactgttataaaaattgaaaatgtttttgccggtggcttggtaagtcatcgtgttcgaatcggcctcgcatataatcactgccaatttaactattttatgtgtccaacatgtacgagctttaaacattagattttccataagaaaatttgcatgttcggatcgtgcctttggccgattgcgttttgtcctgtgcattgtcacaaaccaaccgcctccgcgaggttgtcatcttgccgatacggtctgttgggcaacacggtttgggacctgctgttgcgcacctatatcaacaccaaccagcagcagtcaggtgtgttgccgtgcgccgaggcaagcagcacgacgtaccattgttgattattctctacacgcacacactgtatcgagaagaattcctaccgtgttcatcagaaactcaattcaatacggtctgctgtgtatacgtgttccaaaaaaattaaaaaaaaagttcaggagcgatatcaaagccgagatctattactacccacatattgaatatccacgcgtgcagcaagacgatcagcaacaacagccgat

SEQ ID NO: 53181 - DNA, 3578 bp, Oryza sativa
  unsure (1)..(3578): unsure at all n locations
annnnnnnnnnnnnnnnnnnnnnnnnnnnnnnnnnnnnnnnnnnnnnnnnnnnnnnnnaagtcatcgtgttcgaatcggcctcgcatataatcactgccaatttaactattttatgtgtccaacatgtacgagctttaaacattagattttccataagaaaatttgcatgttcggatcgtgcctttggccgattgcgttttgtcctgtgcattgtcacaaaccaaccgcctccgcgaggttgtcatcttgccgatacggtctgttgggcaacacggtttgggacctgctgttgcgcacctatatcaacaccaaccagcagcagtcaggtgtgttgccgtgcgccgaggcaagcagcacgacgtaccattgttgattattctctacacgcacacactgtatcgagaagaattcctaccgtgttcatcagaaactcaattcaatacggtctgctgtgtatacgtgttccaaaaaaattaaaaaaaaagttcaggagcgatatcaaagccgagatctattactacccacatattgaatatccacgcgtgcagcaagacgatcagcaacaacagccgatcgatgacggttgccaagagaaatacaaaaacctaatcagagaaatattcaatcaagctactgcgcacatatatctttatctttactattatatctctatctctactattataaaaattaaaaatgtttttgtcagtacgtcatccgcgtatgagtcggttcttaaatccgtttgattttagaaatacaaatccgtatttgagtcagtttttaaattcgttcgcttttaaaaatacagaagaaatcgtacaagaaatctctttaaaaactcacatactactaacttgagacgttcggacacctaattgcagctcatgattttctaacaaaatatatatccaagcgaatttaacacagtgaatttcatcttaactcgatataataataagattaaaataatcttcacccattgcaacacacgtgtattttttctagtaaaattaaaaattttaaaaattctcatctggagcgttgctgggctcgcgcggcccacatacggcgcagatcgatcggggctgtggggcctgcgcgggagagagcgcatctagcgcgcgaggctataaaacacgccggattctgatctcaccgcccggcaagcacgaacacgatgacatcggatcgggtcggtttctctcttgctgtcttctcgatcgatcgatggctcccacggcggcggcggggctggcagcgcgcgacgcgtccggccacctctccccgctcaccatctcccgcaggtgaaacttcaattatactcctatatatatctagatagggttctctagatagtagtgtaatgttgcgaggggctagctagcgctgttccgttcgtacacgtgatgccgttcgtgagcggcgccggcgccggaccgagtagggaataccgttcgtgagcacggcagcggcggcggcgttggcgtgcgtggagatggatgattctgttgaaacctctattcccatcgatattcatgatagttcatgattctgttcaggcttgtttcgttcgattttgccgacatgtcgtagtacatggtactacctccatctagatttgggcacatagaattaaatggtggaaggttattattgattaagaagtgcaggtacatggggaaattaaatggtgaagggttataattggttgataaaggattgttggtggagaaattgtattttgggataaattttaaaggctatgttatattttgcgacggaaacaaaaatatccaatccaggttctgaccttgggattaatttcttggcatcacacaaattaatttataggaaataaacttatttcagcaacaacttaattatattttagtactgtttgtcctagaaaataatcagaataatatatgatatagatagatagatactagtagataggtaggtaggtagtcgtactgctgtttagggtgcatgcatagtaggatgatactatcacgtacgtcccttcatgcgacggtttaatttgtcgatctagtggcagtccaacctattacacaccaaaatcgatcaacatgtggttttgcactgttcttttgtgaggtacatgcaccgggaggcttatgttgacacataatccaaaccgcattgtttgtgattacgtgatcagatcgatcacctcgtagtcttggtctcttggatctgtcattttctgtagtacgtactgtttggacttttagaggtacgatgtgttgagtacaactgtatatgcacagtaattggccattgtctctctgttcatatctagtgcactggtagcgttgcacctaggactttaccgtgtgatgggttgtatttcttcgactattgtcacaatctgtataattcctagccatatacgatttgccttttatgccagagtttagattgagtacgtttttaggcctcgttttaaagatgataataatttgagagcataaataataatattgatattgaaaagctgaaaaatgatttaagaacatacaaagaaaataatgatgaacaaagttttacaaaagacgcgccgtctagtagttggtgcctgtgcgtagagtttttctttaatcaacaatataaatagcgtttgtgctaattacttgaaaatctgtaggagcactggagatgatgatgtggtgataaagattctttactgtgggatctgccactccgacctgcacagcatcaagaacgagtggaagaacgccacctacccacttgttcctgggtaattattaattaagcaagctagctttacaaacaggttttgtacgttgttacatactccctctattccaaattgatctacatattttataggtacacaaaaaccaagaaaaattaataactctctcatactatatttactctaacaacaaactcgatgcatgtaccatcaccactattttctaactaatagcaaattaagatattgcatgtgtgttataaatacttgtgtgcatccatgtgcatggatgcacgcatcaatgcccatttactccaatgcataaataacgaatagacttaatgaataaatacaaatatgcagataatttaggaataaccttaaaaaaaaactatatgtagatcaatttggaatggagggagtacgatgcattattctgaattaattctgatcaaacaaacatgcactcgatggcgcaggcacgagatcgccggcgtggtgacggaggccggcaagaacgtgaccaagttcaagggcggcgacaaggtgggcgtcgggtgcatggtgaactcgtgccactcctgcgacagctgcaaccaggggttggagaaccactgcccaggcgtgatcttcacctacaactccgtcgacaaggacggcaccgtcacctacggcggctactcgagcatggtggtggtgcacgagcgcttcgtggtcaggttcccggaggccatgccgctggacaagggcgcgccgctgctctgcgccggcatcaccgtgtacagccccatgaagtaccacggcctgaacgtccccagcaagcacgtcggcgtg

SEQ ID NO: 53182 - DNA, 3455 bp, Oryza sativa
  unsure (1)..(3455): unsure at all n locations
annnnnnnnnnnnnnnnnnnnnnnnnnnnnnnnnnnnnnnnnnnnnnnnnnnnnnnnntccctcccttcgctctggttgcttgtaagtgcttaatttgatccggatccattacagctagctactagctagctagctgctctgtgttgtgatccattacattctgtctgtggcatgcatgttgcagcgaacaagacgctggccgggagctgcatcggcggcatggcggacacgtaggagatgatcgacctggcagcgaagcacggcgtgacggcggagatcgaggtgatcggcgccgactacgtgaacacggccatggagcgcctcgccaaggccgacgtcaggtaccgcttcgtcatcgacatcggcaacaccctcaaggacgccatcgagtgatgcgtccggtccggtcactgcttaatttatctctctgtccattctggaaccggccagactgtctaatcgaacgtttgattagaaaatgaacatttaaaataactttcgacagaaaacggaacagaaatctgtcggatttttttccaccacaggatacgtacccaaagaaaagattaggcctcaaaggattttgtttgcacactacgacatggttaatcgatgaaactaattcagactttatttcccgtaattttgcaaacaaacagtatggttaaacactaaattagcatcaatcaagcatttctttacctattacatgaagcacggtacaaagtttagacattgcataattaaactataactacactataatttcctctctctttttttaaagaaatacggcaggggaggcccccactgttaataaattttattaataaaaagagaggtataaaaatattacaacatagcaatccaattgatagctgcatctttgtctctctcaataagacgaaacagcagaaggaggagatcacccttaaatagctgcctccaaagaggagattttttagtaaaaaatggaaccattcctttgcttccagatgtttcaagccccatatagaaacttctccatgaaacacttgccttggtaactattctttgtatgcagggtagtgtcccgagagatacccagcatagcctagtagaattgagcaaaaggccattggaagaacaaatgcaacagatcttccagaatatgagcagaacaaagaacacaattaagatcgcaattgggtggcgcacaatgtttgtgatctaggtattcagtctattcatcagcagcaaccaaccaaagactttaactttagaagtagttttgcacttccataaccaaaggaaatgagagggtggttgtaaagctctgaagttaagggcataaaatttctgagaagaatatttcagattacccaaaatgtaaacccaaacatcattatcctgagaaagattgacactctccaaaagagttaacaagggttgcaactcctgaaaagcttgcgcaaaaagaggcagatgaaaattttcctccaaatcaaaaatttctgactgatatctttgcattagcaacataagagaataatctttacatatggaaagacaaaggaggtttatcactcaaacatcttcccaaaaatagcaagcgacaccatcacccaccatacatctagcaatgcccatggaaagatccatcagtttgcaaacatctttccaccaaaagtaacctttgagattgctcactccattcccataataagggttccaaattaaattaacccaaggtagatttttttctattatagaacttgtccaggtatttcaagagaagtgcctgattctgtatagaaaggtttataacccccaagccacccttattttttggtatcaaaccttgcccgatacagccaaagattttcggttacagttcacatcagaacccctctatatgtaataccttcttgccctatcaatactagtaatatgcatgtgctaaacgctacagtgcaattatattcatctttaataaaaccttagaatggattcggatgtcacgaatagaaaaatatatagagtataagaaaatatattttccgcatgtcacaaattctaatgttctcttaggtcaattccattcattttttctttttgtgttatgtacttaaaaaaatattgattttttctatttgtcacacaaggcacacgcctgttgcagcccattgatgataacatgagggtgtgaatataaacccaaataacagtttgaataatttcacaatgtacaacaatataacaattgttggtcatctcattaacgtcttctttcaagatctatatggaatgactactaaaattaatcgatggcaaaagtgcatatttagagagacacaagtgttaacatattatcagcatggtgcaaactgactcatgtagaacacgatggtgtgaagaagataatcatgcaatattccacctgaggtgatggcgtgctgtacaaaacaagaggatgtcgatgagtaacatttcgatcagcaatttactatcttctagaatatgtttttgaattaattttgatcatgcgagcctacctttgctcaccagttaagaacgtttttatacacgatattcctagtgctcttccctgtggggtcgacttctttttttgactttgccaaaattcttgttgtttgccttgacacacctcctgacagtacgcatttatccttgttgtttgcgcatttatccttgttgtttgccttgcccttgacacacctcttgacaatgcacatttatccttgttgtttgccttgacacgggggttcctaaggggggcacttgcgccggctgcttaactcgtgcagccgtgcgccctcccccacgcccgcgcgtgattagcgcatcccgctaattaccatcattaacattaattaccctaattagtattattattttagtacgcgaaaaattgggataattacggagagttcaacgtaggtttgaaaacctttaagtaaagatttgaaacattcaaatcaagattttttgaaatttttaagtcggatttgaaaaatttcaagtcaagatttaaaaactttcaactcggatttaaaaacattcaactcggatttgaaaactttcaactcggatttgaaaactttcagttcagacttgaaaactttcaacttggattcgaaaactttcatatcaaaattaaaaaaattcaagtcaagatttgaaaagttaactcatgtttgaaaacttttaactcaaatttaaaaactctcacctcgaaattcaaaatatttgatttaaatttaaaaactttcatttcaaaattcaaaacattcaactttaatttaagaaactttcaaatcaaattcaaaactctcaaactgatattgaaggtgaaagattcagtttataaaagtcgcaacaaaaatcacgcgcgcgtgtagagaaaaaaaggatagattccccaaaaaaaaacaaaaactagcgcctattttcc

SEQ ID NO: 53183 - DNA, 886 bp, Oryza sativa
  unsure (1)..(886): unsure at all n locations
gcgcacttgtgccgcccttactcgccgccgtccgccgcgcgcccccacgcgccgccatcgtccgcggctccgcgccgctgtgcgcacttgcgccacccccactcgccgctgtcgtcccctccgcacttgcgcggttgttgcgcccgcgtgcaccagtgagagagaacggagagagaaattaggaagaggtgaagtggaggcatgacaggtggacccaccaatttttttaaaaaaaatggtgactggactgccacgtgtatgccacggggtcaaggggggtaattcttctggtattgaaagttcgaggtgaagaatgtccggttttgtggttcagggggtaattcggacgaccacgatagttcgggggggtaattcgtactttttcctatttagaaacaaatctattttggttttctcaacattggtgaccagtctacaccaatccatgagttgtaactgtatgaacaatgacatgaactatctaataccatctaaataatcccaacggtcgattttgaaggtcggtttcataggccataattatgcttgcaagtgcgatataattcagttgtttgtatggcttgccacatcctcgtggatctatttttagagagttcatgggtaactaagatggtcacagttcctgatttgttgtatattggcccccgatgttcatgtatctgaataaactagtttctattaatctacaacatgcacttctattatcgagatatgatcaaactgttaaaaaactaagaaaacactttgaaattgcagcaaccatctattgttgaagaaacatgcaatgtttgtggatgatattttgcattattaaccnnnnnnnnnnnnnnnnnnnnnnnnnnnnnnnnnnnnnnnnnnnnnnnnn

SEQ ID NO: 53184 - DNA, 749 bp, Oryza sativa
gtaccctgtggtggaaaaaaatccgacagatttctgttccgttttctgtcgaaagttattttaaatgttcattttctaatcaaacgttcgattagacagtctggccggttccagaatggacagagagataaattaagcagtgaccggaccggacgcatcactcgatggcgtccttgagggtgttgccgatgtcgatgacgaagcggtacctgacgtcggccttggcgaggcgctccatggccgtgttcacgtagtcggcgccgatcacctcgatctccgccgtcacgccgtgcttcgctgccaggtcgatcatctcctacgtgtccgccatgccgccgatgcagctcccggccagcgtcttgttcgctgcaacatgcatgccacagacagaatgtaatggatcacaacacagagcagctagctagctagtagctagctgtaatggatccggatcaaattaagcacttacaagcaaccagagcgaagggagggatctccatgggcttctccggcaggccgacgaggatcatcttcccgttgggcttcagcagacccagcagcggcgcgatcggaatgttggcagacaccgtgttgatgatgccgtccatggtgcccgtcgcggcattcatctcgtcggcattcttggagacgacgaacgcgtcggcgccgagccgctccagcgcctcctgcctcttccccggcgacgagctgatcaccgtcaccgtcatcccgaacgccttggcgaactt

SEQ ID NO: 53185 - DNA, 1477 bp, Oryza sativa
  unsure (1)..(1477): unsure at all n locations
ttggtggcgacaccttctgctactgccatggctcccgcctcaaggttcccgccaactttgccagcagcggccatggggtggaggcggcagcttcggcacccttcgccttcgccgtcgccgcggccatggacttgtgcttcctcccggcgaggtgcgaccgcatgacagtcaccgacggcgccttcacgttgcagacatcgcagataatgaagacctcgtccagcctccgcatggcgtgtggctcgccgtcgacctccaccaccaccgttccatgctcgccgtcggcggcagcagctgttgttggcggcgcccccgctgctttcacgccattcataggagaggcagtcgccgtcgctggcgccggcggcttcccggcttgctgctgcttcagcttcgtggccttggagacgtgcttgccgccgtcgaggtggcacatcatggtgacgcggtcggccgtcctgacattgcagccctcgcagaggaggtagccgtccatctgcatcacctcgtacacgactccggcgctcgtcagcatgctcagcttcgtcggactgaagccgccgccaccgccgccgccgccgtccgaagccggcgggatcatcgacgccgcatcctcctcgtcctgctcgggctcgggctcgggttccgccggcgcggcggcggcggtgcagacagcgcgagcgcggccgccttcttcttgtggctcttcccgttgagatggtcctgcatagccttctcgccggtcgacgtgatgccgcagacggcgcaggtcaggtcggcggccttgggcttcttgctactcgtcgcggcggagacggcggacgctgctgcggcggggttcttcttcctcttggccggcaaggcggccgccgatgatgatgcgtttgcattcgtgacggcgccctgcgtgaaatgaacacgctcgtcaacttttagaacacgtatataagaacaacacggaaggaagtattccctccgtcctatacggcgtcctaattaagtttttgattaataattatactaaccatatatatacatattatattactagatttatattttaaatatttttatattaagctaatttcatattcgtcggaaacataacacgtaataaattaatggttaaagtatattattaaagatcgtgtagaaaaaaatataaacctcatcatttaggacagagggaatagtgaatattgacaacatcgatatagtaagacataaaaaattttaaatccaaaatcaagtatacaaaataaaagaaattctagtgcacagtaccaccttttcaacttaactaaccttcgtacttaatacttatattttaatacttatattttgaaacaaagatggagatagaaattaaggtacaacaacacatacataaattaatattagagccatccttaaaaacagnnnnnnnnnnnnnnnnnnnnnnnnnnnnnnnnnnnnnnnnnnnnnnnnnnnnnnnnnn

SEQ ID NO: 53186 - DNA, 884 bp, Oryza sativa
ctcaagtatagtacaacacacttgtagttttatttttagtatgttggcttagtagaaagtgagggaaagctccagaaggagtgctccaaaatatcagagttcctccaagaatttgatggagtgccggagtgttggcattcttctaacggagttctagagaaagccgggattgtttgccttcttctctcgcttgtacctcgatggatgcttcctttattaaagtaagtgtttgagtttctttatgttctttaactagtgttggtatttcttatgttcacggataaatccacaagagcacggaacactgttgtaacacttccccttagtgtattcgaagggtatcgaacacaaggaacatgtgtgtattatctatgatcaagattctatccaatgacaacaacctaagataaagtggctagagaggattcatatgtcttttaattagttaattaagataaaggtaagaatctatcaaatgcttcaggcaccggtcctcccatggtctgctaggacaagtccaccgttaagctctatgatgtacccgaacatggagagatacgaaggatggacagggctgtcaccacctaacgcctatctcacttttcgtggagcacacaacaaatgaaggtaatttctaacctatacacctcgccattactactctagccttgcacaaaaacttcctcctctatccaaagacctagtactagagcactcagttgcacactaagcgacgaacccacaccgatgagaatatactccctctgggttgataatacttgtcattttggacaaggacacggtctccaaaaaacaactttgaccattattttccattataatacgtataaaagtgttaacaaatatatgattggtaaaatttg

SEQ ID NO: 53187 - DNA, 4547 bp, Oryza sativa
  unsure (1)..(4547): unsure at all n locations
ccaatgggcttgtaactttgtttgggaccctggcccatgtggggcccatgtggggtgcgccccaatctggtggagcatgacccttggaccctcttggtcatcctcccacctctataaatagttaggtaccccttcagggtttcttgggtttttgatagattaaagtttagccattgctacttgcttgcagcgcgcgtgtcggctagaccgtccgtctgcttgttctttggaaccccaacttatcatttgtattaaattcctatttgcaatatcagattgcttttatcttgttcttgcttgtttcttcgatttgcttgcaggaatagggtttatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaatagccttgagtgttgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtctcgagttctggtcacgttttgtaccacagtcgtcgctgccaccgtgtctctgttgttgtcgggacctacgaaaacggaatcggctcgctgccacggttctatttttgtagttttcagaagtttctatcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccaccttctggccgaatcccacttccccctttggcccaattcgaattccttcctttttttcaacggttccaagtgggttaaacaccttggcaatttttgtttggtgtcggttttgagatctgtttggaaaaacggaaccggcataaattcagcattccattttttgtataattttaattttgggtttagacttttacatttgagtccctataaattttatatttatgtttgagtccctgtaatcttacattaaggtccttgagtcagtttttgttaaaaaaaataagaaaaaaagtgagaaaaaaaaggcagaaaggtgaaaaaaaaaagaaaaaaaaagccgcaccacaaaaaatcagaaaagaaaaggaagaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaactttgcgttctctgatttgagcatttgctattcctttgctacatatttaagcctacccagagctccacagatttgattgcaaccgtacggcaagtgtttgccgaggcatcgatatatccaacctctattggggtgcttggttgagtcggtgtacatcaccattccacttgcattggtaagatcttgtaagagcttggttaaaagcttgagtgtgtgtgtgagatttgagctgccagtacctagtagttgataggagcgtgtatattcttgtgtatgtttcttgtttgctgctaaccatggcaggattgcgcaaggggaaacaagatggtcatgctcaacgtcaacatctacaccttcgacgagatatgacgacttcttcacgtgatgcatatgaggtacatgactataattttgcacaagttgcatgtaagttaccagtctatgatggaaagtatgattccgctgcatacattaattgggagctagcagtagaaaaacaatttgatgagtatgatttttctaatgctcaaatgattaaggctgctagtaataagtgtaccggttctgcatctttttggtggcatactgtggggaataagcttgaaacttgggatgaatgcaaaatactgatgagaaaaagatttgtgttttcatactatagacgtgctctccttgagaaatgggaacatctaaaacaaggtgacaaaactgttagggagtactttcatgattttaaaatttgtatcacttatagtggtttacaagaatctaatgagaacacaatgactagatttttcagagggcttaatttcaatattcaggctgggcttgttaatgtgacatataatcatataggccaattgttcatgcttgcttgtattgttgagcgcaaaattttggagaatccaatggagcaacaagatatgcttgtgcctcctatcactgatgttttgcaggaagttcagaaaagtctccaaaatgagaagaacgatatgtttgagatgtcatttccatcactcgcgaatgaggagaaggctgatgcagctacattatctgaagaaagttcgcaaggtaaattaaatggtgctgagagaaatgaaggtgagtattctcaaggtgagctacacttgtccacttttcatgctatagtagagcaaccattagtggaatcaattactgagttgcctttgtcacaagttgatttacttgctgttccttgtgataaagaagagttgtgtgataatgtttcacttatatccatgccacaactagtgaatgaacatgttagttctactatttctttgtgtgctgattctaagcatgttgttcacattgctaatgaagtagaggaacgcgaattgctatcttctttaaatactttgggctatgttcagtttgatgatttttgtgagctcgataatttgaaggagaaattatttgctaaatctgatttgccatgtccaactaatgctatttttcatatctttggcgaatataatgatagaggaatatttttggtgtatagagtttacatttgttcagatttagaacatcttgtagttccggataaaatatgcaagctagagagacatgttactgctaatcatattgtctcgagtttgtcttgttttgattgcaagaaacaggttgttttcagtggactgcgcgaagagcaccatatggaaaaaccgaggacggttttctgtgaagaaggggaggatgatgtgaccatggctactatggatacgaccattgctcacatcatgaatcaacaagaagatatcaagatcaagtcctccaagtgctggaatccgattcggccacctattacactgctgacttcaaacggctgccgaatctgcatacgacctccgttttcggcccgtgagtacttgatggaaagctcttggagtcctctttccaatggatccagcctcattgcaaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcatgacccttggaccctcttggtcatcctcccacctctataaatagttaggtaccccttcagggtttcttgggtttttgatagattaaagtttagccattgctacttgcttgcagcgcgcgtgtcggatagaccatccgtatgcttgttctttggaaccgcaacttatcatgctgtattaaattcctatttgcaatatcagaatgcatttatggtgttcttgatggtttcctgtattgcttgcagtaatagggtttatatgcaccggcaagatcatcaacccacggaaaggtgtatcgatcgctaaggcgcatctctacgtcttgtacggttgtagtcggatcgtcaacgtttctcccaaatcgtagttatcacactctcatgaaagatcgggcccacaacagccttgatgtgttgagaggaactcagggttcattaatctctctcggtttcggtacgcgggtttttcaaaccggttaacggtgtgttttttaaaaaagtttctatnnnnnnnnnnnnnnnnnnnnnnnnnnnnnnnnnnnnnnnnnnnnnnnnnnnnnnnnn

SEQ ID NO: 53188 - DNA, 9685 bp, Oryza sativa
  unsure (1)..(9685): unsure at all n locations
nnnnnnnnnnnnnnnnnnnnnnnnnnnnnnnnnnnnnnnnnnnnnnnnnnnnnnnnnnnncaaagcaatttacataaaaatgtactatattatactccctcaatctacttttgatagacatatttccaaatctgaaaaatttagttttgatagacatatttcaatccaaccacctatcctcttattgactttctcggatttaatgcgtgactctctattcttctacacatgattgtctattcttctacacatgattggctacatgggcattgagaaacgtaaatattaatgaatcgcgtgtttacaaggaataactagtagaatatttaaatggataataaatagaattacttattcttaggtcattgtgaagatgaaatatgactatagtaatgaatccatatatggattatcaatcctattagtatattattcataaaaaagttatattgtcatcaaataagacatgtaatggaaaaacatgaacgatcgagatacacgttactccctccattccaaattgatctacatataggtttttttaaggttattcctaaatgatctatatatatttatgtttattcattaagtctattcgttatttgtgcattggagtaaatggacattgatgcatgcatccatgcacataagggggtgtttgggagagaggggccaccccctaagtatatataacccacatgcaatatcttgatttgttattgactaggaaatagtggggatggtgcatacattgagtttgttgctcgagtaaatatagtatgagagagttattatttttttttgttttggtgcacctataaaataatcaatttggaatggagggagtatacaatattattatttgatctctatagcttttgtaaaatgtctaagggtatggtcttcattacacggtctatattaatttaacggaacatttagtggtacgctattagtccaagcggctagtcggagcagtaggagaaggtaagctagaatctagaaacaaatattcaatatcgatcaaaattaaaacaacccaaaatcgaggtagacgaaaaaagacatgatgatcgaacctgcaggagcgccgccgccgccgccggcgtcggcggccgtgcattcccagatctcctcagcaacgggaagatgtgctccatgatctcccggcggacctccgactcgagctcccattcctccgcctcctcccgcaggatccgctccattatcttctgcttcttcgcctgccgcagctcgtcgcgaccagccgccgacggtgaagacgactgccccagcgacacggccgaatcacccccgttgtagtctcccgtgcccccgccgtctgcgccacgatgcccatcgtctgatcaagaaaggaaacgataccaaaaaaaaagacgcagatagcgagatcgatcgatcgatcgagaataattaattaagtaaccttcgttggccgggagcacacgggcggatccagagctcgccgtgggcggcggcggcgggggaggggaggaccggctgcggtcgtcgccgtcgcggtaccggaactccatggcggtgcgggtgcgggtgcgggtgcgggttctaccggggttttgcgggatgcgaagcgcgtgagcgctcggggtgcgtacttatcgtacgaggaggagtagggggatcgaaacggctcgcacgcggacgatctgatcccgttcaattccatcttactttttgggccttccctaatttcttttggaaaaaaaagtacaccgaagtttcccaactcatgtctgatgtgaccatagctactatggatacgaccattgctcacatcatgaatcaacaagaagatatcaagatcaagtcctccaagtgctggaatccgattcggccacctactacactgctgacttcaaacggctgccgaatctgcatacgacctccgttttcggcccgtgagtacttgatggaaagctcttggagtcctctttccaatggatccagcctcattgcaaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcatgacccttggaccctcttggtcatcctcccacctctataaatagttaggtaccccttcagggtttcttgggtttttgatagattaaagtttagccattgctacttgcttgcagcgcgcgtgtcggctagaccgtccgtctgcttgttctttggaaccccaacttatcatttgtattaaattcctatttgcaatatcagattgcttttatcttgttcttgcttgtttcttcgatttgcttgcaggaatagggtttatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgttgagaggaactcagggttcattaatctctctcgttttcggtatgcaggtttttcaaaccgctaaacggtgtgttttttaaaaaagtttctatacgaaagttgcttaaaaaaatcatattgttccattttttttttaaaaaaattagctaatagtacttaattaatcatgtgctaatggaatgctccgttttccatgcatagaagttgggttctcaaccaaggcttccgaacacagcttccaaactagaggatgttggtgcttaaatatttgttgagcacgttctgaagcagaggatgtactggaggaggagcaagtgtgatgcaagagtggacagctcaagagtagacagctctttaggcctctcacagtgcggtgagctggaccgggacctcgtcgcgccagctcggattcaggtcgacgtggcgacggggcccgtcccttagctaggtttctcgtcccctacctgagctatgcgaaactttgttgcggcgagggcgcgagcggacagggaaaagcgaggcacgcgcgctgtgggcagcgtttcttcactgccttatgccctcgcgccgaatccacctacagaaaaccccaaatcaccctccaacggaatcatcgacgaactgaaatccccccaaacgcacaacaaattccctcccaaaccaccacaggtgcggaccaaaccaacaaaatttctcgagtaatttggtagagaaaaggaaggaaaccaccacagatgcggaccaaaccaacaatatttcttgagtaatttggtagagaaaaggaagggggaaatcggcgaggtggagaagccgtccgctcctgctgccagccgcccgtcggcgttgagccgtccactcttgccgaccccggccagatcgaacgctgaaccgctggatccggttgtggcggcgccggaactgcagccccacgctccggctgctcgccgccacaccgcgccagccgccgccaccggggacgcctcccgccgccgcgccagtgcgccagtcgtctgttgatgtgaaaaacacacactggcctggaagatctgcttaactcctttgcaggtccaaaatctcgcctttaggttcatgagcgtgccagttgatttgatcatgcaatcaacaagaataagaaaaaccgtggttaaatccataaatgatagccgatcggctagttgccaatgacatatcatttatcttcgagccgatgtcatgtttgactcgatcggcaataatgaataaaaatgataaaactaaatctactcaatcggctgtagatattaacaacatataatctttacttcggtatatacttgaactaagtgattgggatagatcggtcatcatgccaagacagtataaattacttaagtcgaaatatatattaaagcaaagattatatagaagtttatagcatagccgatcagatagatctaccatgtatcggctaatactccgataccactctatatcaagatttgagacaagcaagatatattaaataataaacctaatataacttcaatgcaacaagatcttaatataaagggcagatttagcataacaaacaagcatatgagataagaataactaaatcaggtaagatcggctgaaactctgatactatctctattgatgatcataaaacaggctagatatcacaattatagataaacttaatagatcaaactcaaccgatgcagcattaagcataaagataactgtaagatctaaacaagatgatgaaaacctataagagatggtagatatacggtataatctagattaataatgagatctaactctatcggctactctctaacagtaaaaactagccgatgacaagttatatagcgaaactaatagagattataaagtatatatgataactcaaaaaattacataaacaagattagagtgttataaagatggaagcactaatcctgagaacgcaaaccgtcatgacaagtttacctctagttgaagattgaatcgatgcagctcaacccgaaagcaagaactcgtcaaaatagaacgaaagtaaaagggtggcgatgcgccgaaagtgttattgaacatgtgttgtttgattacatgggttcgggtcatatttatacccgagatacaaaatatgtcattgccggacacgactactatctctaacaaactctaagacactataagtctttgcggcagacttttgcccaaacatatctctaaagaaattacataagatatcctaattaatagatacaattgcctatctgagagctttatctccattgtggcaatccttgttaagcacatcgattgattccagaaacagcctcgaagctatctccatcgaaatcagctatatcagctctattggttgcatcagccatcctctaaccgatccatctcagccgatgcataccccaaccgatgtcttcacaaccgatgcacactctgttcttcgaatccatctctttgccgaatctgcttcgattccaatgtcgaacctggttcatatcttatcaaatttggtcgttaacaccaccgccggcgaagtccgccctactccggaccgccgtcaccggggacgccgcctgcttccgcccttctcccgtgcccgcttcctcctcggcgcgtgtgagggaggagaagcagagcgtgggacagagagggaggggaaagactcgccggtgcgcgcgtggtttcttgcgacgaggcggcgccgtggaccgcgccgtggcgtgggaggcgaggaggcacggtggcgtggcaggagaggaggaggcgcggcgatgcgggagagaggaggaggcggtcgcgccgaggagaggagaagaatactcgcgtgagtagcaggcgagggtaattgagagaaataaatgtgtggtaacacgtctagggtcacacccactgtgggcttggtacctttactagtgccttcatccaattaaaccatacatatatgggtgcttgcactatgaggtgggtgtttttggaccaaccttttgggctaggggtacgggcgacatagcttgcactgtgagaggccctactagtagcttgcttgtttgatgaatggatacatcatcaggcacttacacatgcattggtttttccgggttcccaacccctccttctcgtttttcgcacgcacgtttttcaaactgctaaacggtgcttttttaaaaatatttctatataaaagttgtttaaaaatcatattgttccttttttaataaaatagctaatacttaattaatcccgtgctaataaactaatccgttttccgtggtagagagtaccgttcccaaacgtgagtatcgaagacactctattggagtgttcggatgccccttttcctaacctctctctcgtttttcgcgtgcatactttttaaactgctaaacggcgtgttttttttcaaaaagtttcgatacaaaagttgcttaaaaaatcaaattaatctatttttaaaaaaagctaatacaaaattaatcacgcgctaatgaactactccgttttccgtgtggaaggatccgattgggatccatgaatagcgaacacaccctatggtagaagccgaagaaatctacccatcctagctagtactctcctagtactactacactgcatacatgtagggagagtctacactttctctagatttttacagataatggttgtactgcacattgacttttggtactagtatcaagtatggtagggagagttagggcctgtttagttccctggtaaatttttttatcctaccacatcaaacgtttgaatatatgcatagagtattaaatatagataaacaaataattaattacacagtttgcgtataaattgcgagacgaattttttaaacctaattagtccataatttgacaatgttgtgctacaataaacacataaacacagggccatgcagaagggcgtgcgacctgtgtgaccgtacagggtctccaaatttccagggcctcaaaaaatcagcccaaccagagaaggcccatgtattcgtgtgaggccagagcgccagaaccccgttcgagtacgcgcatatctccgcgtggcgacttcacatgcgtggcgcttcgtattctcgactccgagccccgaggcctcacggctttttgtattgtatttctttttcgtatctgtgacttattcagttcgtctcgagtctcgacgtctcgtctcttctgagcgccaggccgctagccggctcatctaatttcatattttcattcatctagcatatagcaacttagcaagcaaccaacaagcaaggcactaggcagcaagctagcaacagcaacgaacattctccattttcagtttgacagtttctgattataaaacaagagttcaaaaatgtactgttgttgatatatcgcatttgctctgcagtatatacattattttagctatatttggtacttgatttaggcctcacttagagccttgtacagggcctacaaatttgatggcacggccctgagtaaacatttgctaataatggattaatgatgcttaataaattcgtgtcgcagtttataggtggaatctataatttgtgttgttattagtctacatttaatacttcaaattagtgtccgtatatccgatgtgacacgctaaaacttttcactcctggatctaaacacagtcttagagagacatctacaaacctaccctataattcaccaactacactcctactagtaatatgcccgtgctacgctacgatgacataatattttagttaataaatcattaaatttgatgacagtaaaattgattttcttagaatcgatccaattaagcgatcatataaaaaaatatatttaagacaaaatgcaaaaatattatattgtctagaaaaaataattaagaacattcaccattatatatagtcactttaatacatattttaagacaacatatgtccacataaatagattgatgaagagctattccattaacatgtgggcataaacaagttggaaacatatcctatccacacaagttctcacttgtatacaccgtacataccaactaataaatatcaccaaaaaatctagaaaaaataatgcatgtactttcaatagtattatacttacgtgtaaaatcttaacctcaaattcattatattttatccgtcgaaaaaaatctaacagttttaacgttataattctatcaaaattttatcttttttttttgctctctatgtttttttgttcttcatcagtgtataaagaacatctgagggcagcaaggctgcgcagcaacattttctccttccaggaggtatggcctgaatgtttcagcaaggtctgcaaatacactgatgaagggcctaaatacttcctgagaaaaagtagttaactaggctattgttctaatttctctgccactaaattaattcaatcactaaaagtcaaacatgatttcttcaaattggaactaatttcaacaaaccggaaaagacagcatttctgaatctaacacctaacagtagagtattttctgaagatcagttcaggagcaatcaaatagttagtcccaaatcttgcatggattaggatcacatagatgatccatatagaaaattgacgatgggaaaactgggacggtcgttatagtaggtccgttatccgcaaatcgttagagacaatttaatttaaatgcaataaataaataaaaatcagaaattgcgagtccattacttccagaattcatacatttagatagaaattctgttaattacatctccgtagagaaaacccctgattaggaattccaacatgaaagaaaataaaattacatgagcgctaaaaggataaaaaggaaaatctatcctaaagctccagatgtcgcagctgtagaatcttctgtagatttccatttatatgtttatttcattttgggcgtccaagtattttagatgcccactaatttgttggtttttaatatcactgcgtgtatggtagcaaatttatacatagcttccttttttggcattgtgactttattttttcctatatgtagcacgcatatataaattgatgaattttcctgagcactcgcggggcgtaaccaaacgagtatttattttagcgccattattatcaacatgccacgggattttggtgcggcacacctgtattactactagcatggccttataccatcaagcgtaaccgaagtgggtatttgtttgatttatggtcgactatcacgatgtcgccacttgtcgtgcgtacatggttaatttgcaattggaaggaaaatgcacggccagagtatatggatgcatgcatgtgcgtatatcagattattttttatactgcactttatatatggtgcaacaagtatatatacactattttaagcaaatatatgtatgcagatgattttgagattataattttcactccacttgtattactactagcatggctcgaagccgtgaagcgtaaccgaagcgagtgttggttaattttatggccggccgtcatgactcggcgtagttcgtgatttatccaacattttgtagataaacagatggaatgagaaaatatatgcatgcgtacatctatttcctatctctaaccatggaaagaaaataaacaccattttattttaattcttgttagagaaatatggctgaacatatgtcaaaactagcatatgtgcatgctaattagtatgctcaattaattttgtttatcactatgcctgtatcactactagcacggctcgaagccatgaagcatgaccgaagcaannnnnnnnnnnnnnnnnnnnnnnnnnnnnnnnnnnnnnnnnnnnnnnnnnnnnnnnnt

SEQ ID NO: 53189 - DNA, 2019 bp, Oryza sativa
ctaacgggaccaaatcagagggtatggtatgatgacatgaaaagagtatgcatggaagtcactgctaggccgtactcatctggccagaccataggaaaaagtgtgaaatcatgttaaaagccatcaaatgaagcgaactttcttgtctcatatgtcccaatttaattcaactaaaatctcaagagcccacaaataatgttagagagaataatactgccttgaaaatttaggtggaagaacctcaacttaaatagggtgatattagagattccatgttgaccggttgaggtgatggttggactgccacacgcatgcgcgcatgccgagtcggcctcggccgtgggcgtagcgaggcgaggcggccgaccgagccgagcctgcctgctgctcttccgttttataacatctgttttataacagatgagaataaagtcaccattaacaaatgaaattcattgtgttgtaacctccacaacaaatgagagattcattgtgttgtaacatccacaataaatgagagattcattgtattgtaacctctacaacaaatgagagattttatattgtggacatttatttttggtcgccattttactctatttattcatttgactgttttgactgtttatttccacttttatttctttattttttattatatttttacattatatttgagattatacattaatttatatcgaatataccttgtttaagacacgagccgaaattggtgtcaacagatcctccctcgagctgcgggtgtcaaaattttgtttttgcatccggagctcgacatataatttcggattcgtagggacttgttgcacgtgaggtttatagtcacaactattcctgtgcccgttgtaagaaacgttgttgagaaaattaaggagcacatttgcttgactctgaaggtcaatactctgtgctgcaatttgttttggtcagcacttgcggactttggggaattttattaattttgtcagtatttgcacatgtacgccacactccgaatacctgaggctttggagtgtttaattgttttaactttattaactatcatcatttactagtctttaagcccacatatacatgtataaacatatcacccagaggttgagctcatggagccgtgggcttttttttttgtcgcctacagtttacgctcgtgcagtgcagcggtggagcatgcatgatttttttttatatcgcgtacagtttaagctcgtgtagcgatggagcatttgttttattattattattattttttacttgtagtgatggagtgtttgtgatttgtttgttttttttacgcttatagtgtaggcctgtaaagctaaagagcgtgtgtgattattttttatttgttgcctacagtttaaactcgagctgcgatggagcgcgagtgattttttttcgtcgcctacagtttaagctcgtgcggcgatggagcgtttgttttattattattattattattattattattttagtgatggagtgtgtatgattcatttttagcttatatacacacacacccctatttcttatatattgcacagtttaggcacttgagatcttggtgcagtattttcattattatttgttattatttttattttatcctttttatgcataatagcgtttcaagaattttccatttataggtgccggataatattcaccgtccggcgagatgatcctgtacgcgctacttcctcatgacatagggaccctcccattttggctcaaattttccctacattcgatgtgtaatattcatagggcggataagagcaagcactaagtctccttgtttgaatgaccttcttttgagccgtttatcgaaggctcgcgatgctctagcctgataggcttccaaattttgtaacgcctgcagccttttaccttccaatttctctaattcatctaagcgttgttttgggcacgcctaatgggcgggtgatcgctccagcgatcacccttccgtccccctactccccctctctctcccct

SEQ ID NO: 53190 - DNA, 6009 bp, Oryza sativa
  unsure (1)..(6009): unsure at all n locations
annnnnnnnnnnnnnnnnnnnnnnnnnnnnnnnnnnnnnnnnnnnnnnnnnnnnnnnnaaacttttgacttataaactttgtatctataaactttaggtgtataaactttagatgtatagaaatactatatatagaaaatatttgaattcaaattcaaatttgaatcggatataattcaaattcaaatttgaaacttttgacttgtaaactttaggtctataaactttagatgtataaaaatactataaaaatatttgaattcaaatttaaatttgaatcggatatataaacttttgatttataaactttgggtctataaactttaggtgtataaactttaggtacataaatttactaaaataggaaagtaatgcggtgccaaaaaatgaaacatggagggagggaggggggagaggtggtgatcgctacccgatcgcggtagcgatcgatcgcgcattagagtttccgcgttgttttgccgcttcgacttctgctatattttcatgaatagcaaccctcagtgacgggatttgaacttctataggtaagatcgcttcccctccaaacactaaagagtaaggagtcattccggtcggcgtgcgtgttgttgttctatatgcccacagggcctcgagcagcttatcatgccagtctcgcttattctttgtaaccactttcttcaaaagtttacagagagttttattgaacgcctccgcttgtccattggccgcagtgttatatgctgtggagaaattatgcttaattttaaacttcgcgcacaacttttcgatcagtgcatttttgaatggagaaccattatcggacataatccgagaagggatgccaaaacggtatatgagatgtgtcctaataaaattttcaacattttcagctttaacctctttcaatggcacgacttccgcccatttggagaaatagtcggtagcggcgaggatgaatttatgtcctttagatgatggcggttgaatttgtccgactacatccattcccccacatttcgaatggccatgccatgttagtaggatgcagcagctcatgtggttgatggataaagtcagcgtgtatttgatactcatgacatttcttcgagaatttcatagaatcctcaaacatagtcggccaataataacctaagtgttttaattgatagtacaatttagatccagactgatgtgcaccgcaaactccagcatgcactttatttaaagcgtctacgacctcatcacccgcgatgcaacgcagtagcattccgtcgtatgcacgtcagtacaacgtgtcattaatgcacgtataacgagtcaccctttttctaattctagatctttcggatgcttctaaaggtaaatatccgtgcaataaatattccaggaggggagttctccaatctcctgcctctatttcgtgaacatcggttatcatagctgccgatggaatttcttcctccttttcaatgagtaccggtaatactctacgctgctcaacttgaatgtccattatttaataagaattgactgacatgctagcagccaagctggttagagcgtcaactctctcattttgacttctaacaacatgttcgatatttagatttgcgaacatggccatgagttgttttgctctcgtgaaatactccctcctttcctaaatcgacgctgttgatttttttaaacatgtttgaccgttcgtcttattcaaaaacttttgtaaaataagtaaaactatatgtatacataaaaggatatttaacaataaatcaaatgatagaaaaagaattaataattacttaaattttttgaataagacgaacagtcaaacatatttaaaaaagtcaacggtgtcaaacatttttggatggagggagtaagccattaaaccttccttttttactgcgtattttccagcaagctggttgattatcagttgtgaatcatcatatatagagtgtgtctagccgcatattcaaggctatctcaaggccgattatcagtgtaacaccccagaaaaccacataagtctagatgccactaaacaaccacacataagtgccaaaacaagcaaatttcggtaacaactaccttagaaaaaaaaacatcgcagaagcatcaacatatagattaagtttatgatacaacaattgactgacatgtagggataggcttgaaaaaagtagttaaccaatggtcaacaactctagtaattaattagcccattatttctaaacacaagtaatcttatcagcatattacaatactcatgactaagtgagatcatgttgtgcgactgtgtagctaatcccatcctttcatgcaaacatgtcacagcaaatacatgaaaagactcgaacaataaagagacgataccaagcatgatccggagcaccacaacctagggttttatggagaacaagaataaagatgacgggaacgccaattcaccactcctcttgttcctctcctccttctcattccgtttttgcaactagtttcttgattcatcatacgacacaacagatctatgaaagtggaaatgtcgtggagaggagagaacacccaagaccgtacaaaggagggagggggcggcagtgttggcgtcgtttggggggaaagaagggggaatccggcccctcctcctctagggtattagagaagaaacaatgggctgggtttatgggccttcccaggttggcccacttctataggtatttttttctaccattaatttctatcgaacttatttacttctgtaaagcaactcaaaaccaacaaccaaaccttttttttgggtgttacattcgtaaatcttcccgagagtagaattaccaatccgaatcatagcaacaaaacctccttatctaaaccctaattacccacgaattgcaactctaaaaacacccaaaaacaacattaaaacagtggggaagtctcacctaaggttttatggagaacaagaataaagatgacgggaaacaccaattcaccactcctcttgttcctctcctccttctcattccgtttttacaactagtttcttgattcatcatacgacgcaacagatctatgaaagtggaaatgtcgtggagaggagagaacacccaagaccgtacaaaggagggagggggcagcagtgttggcgtcgtttggggggaaagaagggggaatccggcccctcctcctctagggtattagagaagaaacaatgggctgggtttatgggccttcccaggttggtccacttctataggtatttttttttctaccattaatttctatcgaacttatttacttctgtaaagcaactcaaaaccaacaaccaaacctttttttttgggtgttacaatcagtgcctcatattcagcagcattattagacactgccgtcgttaaagtgaacgaatatggaattatgctttcgttgggtgtgacaaaaaccacacccgcgcctgcccccgaccggcgacgcgcgccgtcaaaatacattttccatgatgggttaaaaattgaggtcgcaaatacttcctcgtcaggtaagtcgtcatcaatgggaaactcatccggaattggatgtgcagcgaggaagtttgctaaggcttgtccttttattgatttttgtgggacaaatataatgtcaaactgcgacaaaaacatcgcccatatagctaatcttcctgagaggaccattttactcaatatatatcagaatgggtccgcccccgacacgaggtgtatggtgtgttctagcatatagtgccgaagtttttgtgctgcgaagacaagcgctagatatattttttccacgtctaaataattgcattctgcccccactaatgtgcggctgagataatataatgctgtcttttttccatcatcattattttgtgccaacagtgcacctagggaggtaggcatcgcagccgtgtatagtatgagaggccgccctttaactggagcacttaaaactggaggattaattaagtatcttttaatatcttggaatgcattttgacacgcttgatcccactgaaatggaactccttttttcatcaggcgggaaaaaggtttgcatctccctgataaatttgagataaaacgcctaatatatgctaagtgaccctgaagacttttcagcttatgtaggttcacgggtggtggcattttcactattgcttgtatttttgtcgggttgatccgaattccttgtttcatgactataaatccgagaaattttccggacaatacaccaaatgcacatttcatagggttccttttgggttcgtgctttctgagggtctcgaacactatggctaaatgttgcagatgatcttcttcgcgttttgatttcatgacgatgtcatctatatagcattcgacaatttcatataataacccgtccaagacgactgtcatggcgcgctggtaagtagtgccggtgttttttaatccgaagggcatgacttcataacaatatatgcccttaggcgttcggaacgcggttaactcctcgtcctccggtgctaattttatttggttgtatcctgaaaaaccatccataaaggagaatatttcatatcccatagtggcatcattcagaatttcggaaatgggaatggggaagtcgtcctttggacatgctttatttaaatctataaaatcaacacatacgcggatctggttatttttcttccttacaggtacaatatttgagacccatgtagggtatttgacttctctaataaacccgacagctatgagcttgtcaacctcggcctcaatttttgggaggagctctggtcggaaccttctctgcggctgcttgaccggggggatatcctcctgcacagctagctggtggacagcaaccgtagggcttaaaccaggcatttcttcataagaccaagcaaacacgtccttgttagctgaaagaaagttatggtatttttttcttattttcttcggataggtgcttgctaataaaaattgggcgatgatatcaggtgtcccaatatctatttcttccaattcatcgatggtgggttgattcccatcctccatttgtggagatgccatcgttgcgtccacgagcttggctgaggtcctgcaaacctgataaccaagtccatatttcttctcttttaatttcttatcttgctgcaacgcttcgagctgtgcttgagacaatattttctcgaacggcgcgagctgccctcggccatcacatagagatggtccggtaagggtgtcatatcccatttgctttgctagcggatggcctattcattatacgaaatattggctcaccctcctttctccggttgcttggtatatattggtatattttccggtttgaagacgattcaccataacttccacttgtgacgaaatgttctgttagcgactttgcttttggtttctgtatcttttcgatgggctcaatgtagaatttagcatccgtgtaaaaggattcagccaccgtgaatggcctttcatcggcgaaaattctcacagtttctcctgatttatccttatatttgatgcacttatgtagagtagatggcactacttggttctcgtgcagccatgggcgcccaagtaacgcgttatatgaagtagtggcatcaattatacggaaggtcacataggtggacaatggttccagttttaggaccaacgatatagtgctcaaggcttcttggcctgcttggttgaagccgtgaatgactacatttgaccggtttaggtccctctccttgagtaaccgatctggttctgtaaaaccatagcatgcatataataatttcataaagcgctttggatgaagcacatgagtacgtgaatttttctactaaggatatgtgcatttatctccttttttttttgcatatttgcggtctacatgttggaactcagagatgaggggagaagtatgtcccaccgggcgtgccagaatctgacgacgggaaaaccgggacagtcgtaatagtaggtctgctat

SEQ ID NO: 53191 - DNA, 7292 bp, Oryza sativa
  unsure (1)..(7292): unsure at all n locations
annnnnnnnnnnnnnnnnnnnnnnnnnnnnnnnnnnnnnnnnnnnnnnnnnnnnnnnncttggcctgcttggttgaagcggtgaatgactacatttgaccggtttaggtccctctccttgagtaaccgatctggttctgtaaaaccatagcatgcatataataatttcataaagcgctttggatgaagcacatgagtacgtgaatttttctactaaggatatgtgcatttatctccttttttttttgcatatttgcggtctacatgttggaactcagagatgaggggagaagtatgtcccaccgggcgtgccagaatctgacgacgggaaaaccgggacagtcgtaatagtaggtctgctatctacaaatcattacagacaatttgatttaaatgcaataaataaataaaaatcagaaattgcgagtccattacttccagaattcatacatttacatagaaattctgttaattacatctccgtagagaaaacccctgattaggaattccaacatgaaagaaaataaaattacatgaccgctaaaaggctaaaaaggaaaatctatcctaaagctccagatgtcgcagccgtagaatcttctgtagatttccatttatatgtttattttattttgggcgtccaagtattttagatgcccactaatttgttggtttttaatatcactgcgtgtatggtagcaaatttatacatagcttccttgtttggcattgtgactttattttttcctatatgtagcacgcatatataaatttttcctgagcactcgcggggcgtagccaaacgagtatttattttagcgccattattatcaacatgtcactggattttggtgcggcacattgcattgcctattttgattttcaccacacctgtattactactagcatggccctgtaccatgaagcgtaaccgaagtgggtatttgtttgatttatggtcgactatcacgatgtcgccacttgttgtgcgtacatggttaatttgcaattggaaggaaaatgcacggccagagtatatggatgcatgcatgtgcgtatatcagattattttttatactacactttatatatggtgcagtgagtatatatacactgttttaagcaaatatatgtatgcagatgattttgagattataattttcactccacttgtattactactagcatggctcgaagccgtgaagtgtaaccgaagcgagtgttggttaattttatggccggccgtcatgactcggcgtagttcgtgatttatccaacattttgtagatgaatagatggaaggagaaaatatatgcatgcgcacatctatttcctatctctgaccacggaaagaaaataaacgccattttattttaattcttgttagagaaatatggctgaacatatgtcaaaactagcaaatgtgcgtgctaattaattagtatgctcaattaattttgtttatcactatgcctgtatcactactagcatggctcgaagccatgaagcatgaccgaagcaagtgcttgtttaatttatggtgaattatgcaaaatttatgtttgtatccgtgatttgtatccgctcgtagaggaccgaacctgagagcgagaatctcgcctaggcttgtatccactaacgggaccaaatcagagggtatggtaggatgacatgaaaagagtatgcatggaagtcactgctaggcctgtactcatctggacgaaccataggaaaaagtgtgaaatcatgttaaaagccatcaaatgaagcgaactttcttgtctcatatgtcccaatttaattcaactaaaatctcaagagcccacaagtaatgttagagagaataatactgccttgaaaatttaggtggaagaacctcaacttaaatagggtgatattagagattccctgttgaccggttgaggtgatggttggactgccacacgcatgcgcgcatgccgagtcggcctcggccgtgggcgtagcgaggcgaggcggccgaccgagccgagcctgcctgctgctctttcgttttgtaacagatgagaataaagtcaccattaacaaatgaaattcattgtgttgtaacctccacaacaaatgagagattcattgtgttgtaacctccacaacaaatgagagattcattgtgttgtaacatccacaacaaatgagagatttatttgttgtaaccttcataacaaatggaagattcattatgtggtaaccttcacaacaaatgagattaattttgtggtaaccttcacaacaaatgagatttatttgtgtggtaatggagatctctctctctacatataacgcaaggcaaaggctgtcaaagtgtgtgtcttcctcctactattgttccttggcgatactctccttctgttcctgcgctgtctctttgtttccccggttctgttcatcccgcgtgcacgggtgatcggaacgagcaggtacctccgaaactccgtccgcttgagaacctgcacgggtaggcgggtgatcaagtttttaggtagcgcttcaagcgcgactgctctacatcatcttcaccaacatgtcgacaaccggtgacaacaacaacactggagacaaggagaaggagcctctcgtcaacaccaacggaggcaatactgcctcaaactccaacggagggccattctcggggtacaacgtttcactattacacatctagcactgtcgctagatctactcaaatttcaaatgtcatgtttattgtcttaatattttggattaaaatatgccgaattatgaccaaatttccaacaatccaaaaacttgataggtctttttcggtagttgactttgttgcatcactaaaaccatatgctttcgatggttcaaattataaaagatggaaagcacgtgcacttttgtggttgacggcgatgcattgtttgtttgtctcacggggcaaaccgagtgaaccgcctctctcacctgaggaggaggctaagttcaaggctgcggattgcttgttctgtggagcattgatcagtgtgctcgccgacaatattgtggacgtgtatatgcacatgccttcagggaaggacatgtgggatgctcttgaggccaagttcggggtttccgatgccggcagcgagctgtatgtcatggagcagttctatgactacaagatggtcgatgatcgttctgtagtggaacatgctcatgagattcagatgttggcaaaggaacttgagaacaacaactgtgagttgccggacaagtttgtgacaggtggcattattgtcaaattgccaccttcttggacggactttgctacttctctaaaacacaagatgcaagagttcagtgttactgatcttattggctctttgggtgttgaggagaatgcgagggtaaaggacaaccggggcaaaaagatcgagagaggttctagcgccaatttggtgtagaagaagaccctcacgcatcccacaacaacaacaaaaaagtcaaacctgacgtcaaacccaaggctacaaccaattttaagaagaaaggcaagagaaaggcaaaaggaggttgctttgtgtgtggcaagtctgggcattgggctaaggattgtcctgagcgcaaggacaagaagtctgcaaacatggttattagtgagggcggaggaacatcgaggtatggtaaatttttacctacagttctctctgtctgtcactcacctgattggtgggttgatactggtgctaatattcatgtgtgtgccgacatttccatgttttcttcttatcaggtcgggagaggtttctccttgttgatgggaaacggatcgcttgcggctattcatggtgttggtacggtcgatctagagtttacttcgggaaagatcgtgcagctgaagaacatgcagcatgtcccttcaataaagaagaatctagttagcggctctctattgtgtagagatggttttagacttgtgtttgaatccaataaatgtgtcatatctaaatatggaacgtttattggaaaaggttatgacagcggaggcttgttccgcttttccttggatgatatgtgtaataaagttgtgaaccatgtaagcaatgatgatgatgagtctaatgtgtggcattcacgactctgtcatgtgaattttggttgtatgacacgcttagccaacatgagtttaattccaaaattcactttagtcaaaggctctaagtgccatacttgtgttcaatcgaaacaacctcgcaagcctcacaaggcatctgaggcgaggaatttggcaccactagaacttgttcattccgatctgtacgaaatgaacgacgtgttgactaaagggggaaagaaatatttcatgacactgatagatgattgcactagattctgctatgtgtacctattgaaatcaaaggatgaagcattacattacttcaagatctataaggctgaggtagaaaaccaactggaaaggaaaatcaaacggttgaggtctgataggggtggagagtatttttccaatgaatttatttctttctgcgaagagtatggaattattcatgataagacgcctccctattcaccccagtcaaacggggtagccgaaagaaagaaccgcactctaactgagatggtgaatgccatgttagacactacaggactttccaaggaatggtggggtgaggcaatattgactgcgtgtcatgtcctaaatagaattccttctaagcataaggaagtaacaccattcgaggaatgggaaaggaagaaattaaatctctctcaccagcgcacatggggctgtttggccaagctaaatgtacctatagccaaaaagcgtaaacttggaccaaagaccgtagattgtgtgttccttggttatgctatccacagtgtgggatataggttcttaatagtaaattctggattacccgacatgcgtgttggtacaattactgagtccagagatgccacatttttttagaatgaatttcctatgaaaaatgcacctagcacttctagtcaagaacctattttatcccctgagcactttgtgccgaagaacatattgatcaaacgcttgaggaaaatcctgaggaggataacattgtagcaactcgaaagagtaagagacaaaggactgcaaagtcttttggagatgactacattgtatatcttgtggatgatactgcaagaaccattgaagaggcatattcatctcctgacgctgactattggaaggaagcggtaagcaatgagatggactcaattatgtctaatggtacttggaaagttgtcgagcgtccatatgggtgcaagcctgtagaatgcgaatggtttttcaagaaaaagcttaggcctgatgatacaattgaaaagtacaaggcaaggcttgtggccaagggttgtacccaaaaagaaggcgaggactttttcgacacttattcaccggttgctcgcttgaccatgattcgagtactactcgctctggcagcctctcatggtctactcggccatcagatggatgttaagacagctttcctcaatggagagttggaggaggagatctatatggatcaaccagatgggtatgtactagaaggtcagaagggaatggtgtgtaagctgttgaagtccttgtatggtctcaaacaagcgcctaagcaatggcatgagagtttgacaatacacttacatctgctggctttgttgtgaacgaagctgacaaattgtgtactatcgctatggtggggtagagggagtgatcttgtgtttatatgtcgatgacatattgatctttgggaccagcctcaatgtgattgaggaggtcaaggactttctgtccaaaagctttgaaatgaaggatttgggagtggcacatgttattcttaacattaaactactgagaggagatgagggtgggattacacttgtgcaatctcactatgtggacaaggtcttgagtcgctttggttatagtgactgcaaggcagctcctactccttatgatcccagtgtgctattaaggaaaaaccgaagaatagcaagggatcaattgagatactctcagatcattggttcattgatgtacttagctagtgcaacgaggtctgacatctcatttgctgtgagcaagttgagccggtttgttttaaatccgggagatgatcattggcatgctcttgaaagagtaatgcgctatctaaaagggacaatgagctatgaaattcactacgccgggtacccaaaagtgctggagggctatagtgattcaaactggatatctgatgctgatgagataaaggccacaagtgggtatgtgttcacacttgtagggggcgctgtttcctggaagtcttgcaagcagacaatcttaacgaggtcaacaatggaagcagaactcacagctttagatactgccacagttgaggccgaatggcttcgtgagctcctgatggacttgccagtggttgaaaaaccagtaccagcaatcctgatgaactgtgataatcaaacagtgattattaaagtgaacagttcgaaggacaacatgaagtcatccaggcatgttaaaagaagactgaagtctgtcagaaagcagaaaaactccggagtgatagcattcgactatgtctagacggcaaaaaatctggcagatcagtttaccaaggggctaccacgtaatgtgatagactgtgcatcgagggagatgggcttgagacccacttagagttggacaatagtggaaacctgtccattgtgatcggagatcccgtgaatttggatggcaaaacaaactatagtgtagctgagagaagagaccctaaaatgagcctatcttcatgatgcacttctcttctaatctgtatggtaggatggtatacactttaatgtgatccgagtggcttttcataaagcagagatgttggcctacagaacatcttagaaggaacatacctatatgagtccgactgctagtcacagtctatgagatcttggtgatctctagatactcatgaaaaggccaggagtatgacttatatgctccaaacagaggggatgcaaacgatagtccagtaccatttaagggtttgagtgaaacctgaatcgcacaagactgataattcaaggcatagtccactgttcagttgtgatctggtgtagctcttttcctaggtggatgtccaacttaaaagtctccaccgaaacactggtataacaaacaggatcagaatcgagagcatttcttgtgagccatgaaatttggtggggattgttagattaatgggttaggcccaattaaatcct

SEQ ID NO: 53192 - DNA, 1306 bp, Oryza sativa
cagacataataaagacataagtgcgatttataaataacaatcgctaaaaatgagttataatctattatggctctttcttttaacctatcatggaggacatactacgtcatacgctcctaccacgtgttgacgtcatcgtctcctctttatttctcgcttgctatcccctctctttaatttatctctttctaacatatatactctaactcccaaggactcgagccagttgttgcctccttgatccgtcctcgaactccagccatcatcgcctctggccccgaaaacgagccgccaccaccatcttcaccccctaaccccaagcaccggccaccaccttagagatgccagatccaacctccctgatatcggagacactgaatatgctctccttaacatcatataggtggctagatccaatgcaagccaccatcccctaagccccgagtgctagtgagcctctggacatggtagtgagatgtgcccgcttgtatctcggtggcctagtagtatgacgggcacaaagatgggcttcggaggtgtgtagctatatgggcatggcatccggatctggccacccccatcttggtgaccttggtggcgcagtaccgctggggtctggcaaagatgacaaggaccatgatgacgagcacaacaacaacaatgggcttcggagggggcatgcgatatatagtggcacctttgaatgggcatagggcataaatgaccaacatgtataggcatcgactggcttgtcgagatcgtcaaaaagtacaagatcatctccagaacgctcagcctggcctcaaccaccaattcctatatcccttccttctcctgaaccgttgggccagagccaaacaaaaccccttccccctccccttcctcctcctcctcccactctcacgccccttcctcacctcgcctgagctgacaaacaatagtagcagcttccctacaaacaaagatggggtatatacgcacacgccaagtactactcaggcctatagaacaatatcacgcccttttgcaagtctattttgctcatcataggcttcagggtcagccgctgtatcacccccaactatagatggtcatgtgggccacccggcacggcacggcccaagcccggccgtgctgggccgaggcttgtcgggccggcacggcccgaccgatgcaccaggctgtactgtgccagctcacgggcggcatacacggcccaggcacggcccaatactactcgagccgtgccaggccggcccgaaggcacgatgggctatcgtgcttcctcacagaaaatgtctaattt

SEQ ID NO: 53193 - DNA, 1760 bp, Oryza sativa
tgggtgttcgatgataagccgtcgccgttgccggaggagatcactgtccctcgtcatcgtcgccgccgtcggaggtggagagcgatgccaagggacgccggccatggccttgcggcgcggggacatggcggcgacaagaagccgcggcatggcgccggcgcggttcactcgccgtcttcccggttccgatggaagcaccggtgatcgccggcgatcgacgtgctttggtttcgctgttgcagagcctttttggcttagttgtttatggatttcttttcgtttgctttgtaaatgtgctgagaatgagatcatcgtctgaaactgaaaatggttaagcctaatcacaaatgtgaatgccttgttgctactttggatctttgatccactggtgttagaacttagaactctcctgaccaagtattaagtatgaggttagtaattaaattagagaccttatccttatttccttagtaatctttttcaatagtgggtatctggtctttgcttcaattgaaactacacgcataataatttacagcttataaaactgctaatatgaaaaagcaaagaaccacacacactccacccaccgtgtacaatgacttctagattcatgtagctagtgatttctttgtagcagtaaactatgctaagtggaatccaattaagatttttcttctgttacaaatgctgacacttacgaatgctcatttaacacacagtcaaaaggaaaaattcagcaacaaatctctagactcattaaaaaatccccagaaagcttacccagtactatgtatttatgggcacaatcatttaaagtctatgagtgacattatatactcacgactctttattttaaaccaagcacccacgacgtactccataatcacactagctaactatacattttcaattttatattttcaccatatcgaaacaaaagtataaactcaattaatggtaaaactagcttctttcgatgttagcatagatttacagtttctggatcaaacaaaaccaatggctctaactaaaaaggtatattcaccacaaaagttgcttaatatatgttcttgacaaaatgaatgttagattactgtttcttcttcctagctaaccggtggtgttccttgtcatgctgactatggctgagaacattggccatatatcatatcaaaggcataaaacagtcagatatgtccaaccatgcatggaaaggcttatatcggcaaacgatatgattatgctgcaaggcgcaatatggttcctttttaaaaagaacaatctggttttgttgttaatttctctacttttgttttgtttatggaaatttctctacgtttttttttacgaaatatttactccagctggagaaacaattttagaggatataactacaccctagaaaatgtccaatagaattatttacctcatattttggagcgaatcagggcatgtacaacatatgaacatgcccacaaattaaacctcagatatgaggtaataaataattctactggaaccatattattatgaggtaaataattctactggaacatattcttctccacagagtaaaatctattggaaccatattctactccacggagtaaatgttccaggtatgaggtaaataattatactgtaacgattgaacatgcaactaattcgtggagaaatgtcaccaactaataaatcaaaccccaggttttttttatgcaacatcacattcttacacttttttgttattaaaacaaact

SEQ ID NO: 53194 - DNA, 1784 bp, Oryza sativa
cgtgttccggcggcgcatgacgtgttcatgggagaaatactactgccggtgatgacagagtggatgagagttccatggatacgtaggtatccatttgtgccgcctccgccgccggagtcgccggaggaggaggagacggtcgtacctcgtcggaggaggaggcggagagcaatgccaagggacgccggccatggccgtgcggcgccgggacatggcggcgacaagaagcagtggcgtggcgccggcgcggttcattcgccgtcttccgggttccgatggaaacaccggtgaccgcccgccggcgatgaactttgcttaatttcgccgttacagattttacttagtttatttattttctgtggatgtttttctttgtttgctatggacattttctgagtgtttttgagattatcatctgaaactaaaaatggttagtactaaccacaaatatgtacgaacaatcgagaagtagatatgaggttaaatacttaataattaattagaaatttaatcgtgaaaaattagagatctaataaactgaacatgtctttaaccaaccagaaggcccgtgaaagaacataggagtattgtttaagctagtgccgataagacttctctaatttatcaaatttgtagaaagacatcgcaacattctaaagcatactatcaaaaatatattcaatatattcaatgtttatatttaatgaaactaatttaatttaatgttatacgagttactatatttctccataaacttgcttatataagtttatcttagaaaaaatcaaaacgatttatgaagtatgtattataagtagattaaaaatcaatgtttaaaataatagactatgataaaacggttttaaaattaatattttggctatggccgataaggcagtgagctgtgagcagatgatcatgttggtctttttcttctctttttcgatgacttcaaccagatgtgtctaaccatgcatcgaaaagcttacgacgataaattcaagatgatgcagctcgcaatctgattcgatccattactatttttttcaaaaaaaatatttgacgaaacaacctaagcaatttgttcttacatggcattctccagattgctttgacattatggctgtcatattaaatctccataccggtcgaaacttagtggtcacacgtcaatcgactatatcttcctctgtctagttcgtgatgcctatctaatactacctatgttttttaatacttcaccgtcccaaaatataaatatttttaaccctgacacggtcatcgagatgctattttgaccaacaatatttataaaagtaagatgttttaaataaaaagagttgcatacatgatagtttgtttaataataaatctagtaaacttcaattttacatgattgattttttttattttttctgctattaatggtcaacgtaaacaatgtttgacttgtcattatgctaaaaatgcttatatttaagacggagggagtatatgatggcattgattttttaacaaacatttatcactcgtcttattcaaaatttttatgtaaatataaaaatatttaagtcatatttaaagaacatttgatgataaatcaagtcatgataaaataaataataattaaatatttttttaataaaataaatggttaaacgtatttttaaaaattaacgatgtcatatattaaaaagctgagggaataccttttttgggaaatcgatcgatggcgtgttgttctagagtgccgaggttttttagttattattgttgttggaggt

SEQ ID NO: 53195 - DNA, 895 bp, Oryza sativa
tttagtagtttgaaaagcgtgcgcacgaaaaaagagagggaagtgttgagaacttgatcttgcagacacacccgttggcaaccacaacagattagctacaggtgaaatcgatggaggaggccaatgacagctggctgtagctagctcatgcacgagcaatccccatcaagagagggatccgcaaaataacaatgaatcacaggggcttagaatgctcacaacaatgaaaccatgatcacagaaactaaattcaaacatgatcgatagaaatggtgaagtagtgagactttgatcttatcgacaagaacaatggttcgatccagtagataatgttaggattttagaaagaagaaaaaatgggatttttttaccatgctattcttctactgcaagtcatccgttatcctccttcagctgtgcaaccaagtttgtactcctagcctgcaatcaatgacattgtgcaataattgtatatagaatctcctcttgttccagttccaaattcctcaacactgcacagaccaattgacaactaaaaaaataaaatttaaacaggaaaagtaaggaggtgttgaatgcatcctgcaggaatttcattgtggtcaggcttgttgttagactgctggtaggaagtcagagagtcagatacaaaactgtagtgcataaaatataatctaaatgacccagtgcataccttgaaactgaatttgttatccagacaagcatggaagtcagattccttttccttcaaacgaacatgatcatgaggcctgaattcactatggttcttggtttggcatatattatgaagtgcaactagttggtgctgaaacaaatagtgtgcactacacatctaaccaaaaagaactttaatagtgacaggttaccaatctca

SEQ ID NO: 53196 - DNA, 720 bp, Oryza sativa
acgatgactccctcgccacggttactagcttcgagctcttctacgacgacggcgtgggctccggcctccgcccgctcccggagaccatgtcggacttcctcatgggctccgccttcgagcgtctcctcgaccagctcacccagatcgaagccggcggcctctcccgcgcaagggagaacccgccggcctccaaggcctccatctccatgccgcggggccgcccactcgcccagttcaatcgccggagaggagacagaaaaagtgacgggagtggcatggttttaattttagaaatttcgagtgacatgtagctgatatgatgaatattagtgataattttttaatttggcaaagttgcagtggcatggatcgaattaaccctttaaacaacatcaaatcaaatctaaaattaagtttgaaaatttaaaatgtagcttataagcatacaaacataagtgaaacaaatagggttatatatatgtctccctttaccacctactcctacaacagtggtacgacagcttcacccaaaatctgataagccgatgccactgcatcgaattcttcaggtgcaactgcaccgccattacacgagtctctgaatcgacgatgttggtgccccatgtttgtgaaattttcgatcaaagaatacaatgtgtgacacagattccataaccatgtgtgtgacagtggtgtttcataacaaatatatagttgtat

SEQ ID NO: 53197 - DNA, 764 bp, Oryza sativa
atcatttacatgtgagcaccttacgcgtgttgaagtcgtatgctcggaggatgatcccctggtcgaagacgtggtgaacttctttgtaaatagtggactgacctctgctcaggttcatatcatacgccgggtgtagatcaagtacatgtgagcaccttacgtgtgttgaagtcttatgctcggaggatgatcccctggtcaaagacgtggtgaacttctttgtaaatagtggactgacctctgctcaggttcatatcatacgccgggtgtagatcaagtacatgtgagcaccttacgtgtgttgaagtcttatgctcggaggatgatcccctggtcaaagacgtggtgaacttctttgttaatagtggactgacctctgctcaggttcatatcataacatttgttgctccagttgagtccgaaagcacatataaacatgtatactgctcttgtttggtgctatgatatgagtagaaacaatcatgtcttagtagtactatgtaagtgaaaggtctgtcaccttgttctgttgatgttctattgtcctataaccaagacgtactgcaagttgatgcttgagtactctattattttgcctttatattttcccgacgtgatgttatacaccatgactggaattgagatcacctttgcttgtatgactgtaactttagcagtcatataaccatctttggatcaaataacaaggactcagatcgcaccaatgctgacaaacagtattgctcctaaatccaggccgttga

SEQ ID NO: 53198 - DNA, 761 bp, Oryza sativa
agtccgcgtacatccattgccgatccatctacatgaaatgcaaaaaaaccgtaaaaatattcaacgaaagtgaaacccactaaacagtcatacaataatgacatatcattatacatacaataattataaaataatcccacaaattattctttttgtaattatttttgaagtttttaaactaatatttaatgtgttgtacttcttttaattttcaatttagtttgttttctattattttagattaattttcaatatattttcattctcaactattttataaaaactttttataaattgtaaataaacaaaatttctatacattcttcttccctacacaaattttctctctcatcaacttccaacaaagttttagagacaataatgtgtaccaaacatagcttcaaatgtaatatgacaacaaaaaaaatattggaggatgaagttgctaaccttttagacacctccaatttgtatatgatcaccaaaataaattcacaataaaatttggcaagacctcccctctgaagaattttgaagcttggctcggactggaggaagaagaagacatatataaagatcactactggccctcaccgtcgccgtcgtcgaaggtggagaacaatgccaagggacgccggccatggctatgcggctgtgggacatggcggcgacaagaagccacggaatggcgccagcgcggttcactcgttgtcttcccggttccgatggaagcaccggtgaccgccaacaacgtacttttg

SEQ ID NO: 53199 - DNA, 714 bp, Oryza sativa
cagtagtccatcaatgaactatctaagttggctattcaatttcacaatgaaactggagcatttcccatttggtaagtcgacatgttcttgttcgctgtaatattgggttgtcaactgaagattcatattcatattttgagaaatctgagtgtttgtctaatttcagttgtcattactgcacataaatttgaaaatcaagacaacctcaaagtcaacatacaaatggaaatgtctccgcaattgttgaaagtcttgcaatagttttttgtgttgtgtttagactggcgtagctacttaaattgcatcaaaagcatcctgacaattaaatcgatgtgctattatggtcttttatcgcataatgttagtgcgctggattgtgttttcatgttttgttggaaattttgtctataacatggcaagggttttctgttgcaacataatcatttcagtatcgtgcagctgacaatggaaaacaatttgcaattgtacccaaaattcaacaatcttgtcagcctgactcttggtcaatggtgtttggatgcgaacttctatggattggttgtcttccttcagaacgcaccaaaactggagaagctaactctggaacttgaaaaggtaaatcgtttcatccatatgtatactgacccttctcgagagatctttcacaaacacacatgtcaatcagggatgtagcttatttgttttctttctata

SEQ ID NO: 53200 - DNA, 730 bp, Oryza sativa
cacataatagcacattttaattcttgcacatgatagcaattttaagtctagtaagttctctgcctcaaacatatgggcagtctaaagtcttacatataataggtaaataagccaaccaacaacacataacaccaaaagaactatccaactcatccaagaagcctatgttgatccagggaacttttcactaatgaacatagcaaaccaatgcatcttgttttcaaatggaagtccatcgaatgctctagcaatatgagggttggcaaccaaatgagcatagtaaaatgatctatggacctcctcaaaaccaggaagggttttcaatgtgtcaaataaaccttctggaagcttattgtccggctcggcgacctttagtatagcagaggcaagcttgtcaccaacactagtgaatgcaccaatcagcccgtcatcttcattctcttgtgtttttgctttctttggcttacttgcagatgatgcctccgcacgatcatcagtagtggcaggaccatcattttcttcatcattgtcatcttggacatcctctgttcctaggactgaacttgagtcctttgcatactttcctgtagccatggtgctaccaaatattgtaagcatctcaccatagtgtgcaagaggtttgttaaaataattcgcatcagccttgtgatccttcatgaaacaaaagttaatgtataagcaaatgcaataaaaagttataaaaataaag

SEQ ID NO: 53201 - DNA, 764 bp, Oryza sativa
cattgtcgtcggccggtgacgcgctgaggacatcgatccaaccatggttgtcggagtcccagtccggcaccgacgacggcgagcacgccattgctctcaccctcttggccggagactctgaagcttcgtaatcttctgctgctgctgtttttttttttgctatgttaatggagacggtgccgagtacttcgatccagccatggtcgtcggagtcccagtccggcaatgtctggccgccggaggatgccattgctatgatccggccggtggggctgttcgacatgtcgtcagcttcctcatcgtctgtcgatgacgacgtctcggactcccacaacgccgccgctgcgtcgagcgcgctcgtcggagacacccatgtcgccttcacgacttctttcttgagaccgcatgactttgagacgaacgggtgctgtagcagctgcgccgccgtgggccggtcgccggcgcgccgttgcatgcaccggcgcaagaagtccttcgcctccggtgacagccatggcggcaggtccggcacggcgtccgtgtacccgatcatccggagagcggcgagcacgtcgtccatgtcgctccacggggcgcggccggtggccatctcgatgacggtgcagcccagcgcccacacgtcggcagccgggccttgctcctcgccgcgcgccacctcgggcgccatgaacgccggcgtgccgccgagcaccggctgcttcgaaccaccgggcatcaccaccctcgcgcacccgaagtcggcg

SEQ ID NO: 53202 - DNA, 872 bp, Oryza sativa
gaccccgacgccatcgccgagctcccgccgttgcgccgcgcgcgcgcgtttctcgccatggcgaaggccgccgcctccctcttcgcaggcaggcagctctcgcggtgacccccttcccgttatgactgcgtgacccgcatcgcttctgaccaattgtttttattactattattattattgttgcagtgcggcttaggtgttcgggagttgatccggatgaacaccctatcaagaaggagtttgtaagctctctctctctatatatatatatatacacctgcctagaatcctatctacttctacattgttctcacattctatagtagtagaaattcggtttcagatttgccaataagaacaaaagtttgggtgtatccttatataggtttctaatttatgttaacaatttctaattgggaatctttgtaccatgccatactattgtaaagaggagtcatggacttattttataccctgtttttagacaaaggcaaaccaccctgctttcatcccaagcaaataacgaggttcggcacagtagcatcagagaaaaggaaaaggaaatagctggttttaccagtgccctataaatcatagtaataactagtaagttcaatcttacaactaccattatcaaagcatatcacacagttaagtcacccctacagctgtctttaaagtggtggactgaaagctcatttagccagctcgtttgctcggctcacagcagccctgattatactcgtttatattccacaataaatcagtcgatgttaatttttgaaagtagactctcaaggagggattgattggactaggatggcgcaatctttattctttaaaggtgatatctcctgattatgctctggagg

SEQ ID NO: 53203 - DNA, 2889 bp, Oryza sativa
  unsure (1)..(2889): unsure at all n locations
accttccatgcatgaattacatcatccactattcagatacttgaagaaatacagatacttgaagaaatagggttatttgaaaagacagtgaacaatagaatcagttggaatccatctccccgtctagattgaagtagtaaatatagatatccagggatcatacctgagtggggcagcctaaccgtagaagactgtgtcgatgcagattgagcactggagcaccgtcgccgacgtggaagagataggagcgcggcataggggaggggacctaccgtcgaccggttgtgggctctgaggaagaggggcgtcgagaccttccccagctttcggctgtgggcggtggttccccggcgatagggcaacgcggttgaggaaaatgcgttgaactatgggcggtggcagaacagcttgaggggagcgacgggagaaatttgggcctgtttggttgctaccaagaatatgcttggtctgagactagtctgactcattttattccttgtttggttgccaccctgagagccattctccctagcctggcctgaaggaaccggacaagtgattagcctgagttaggtgaccaaaatcggtcacctgagctccaggtgcacgcgtgcaacagaaatcaaggataacctatcgtagagatgtcccctgtgcgcacgaggcccacacccccacacctcacagtctgcaattctgcatgcagttggagattaatttgatgcatgcttggatttggaggtctcttttctcgcgttctcctaattgtttcccctcaacaggtgtgatgagggtgttaggccccgatcttccgataggtattgataaacagtcgatttggacggagtcgcgacacaactcgatccggcttctgaacgaacacgctactgagccccgcaatcgcagcaccacgtctcctctggttatcaaccgtgccgaaacccggttgacctcgccgagaaggctaatctctgcatgcgaatcgaagaacacaagcaagaacaagatagatttcaaccaatttgcatatgaatgattaagtacacgaatttggggttccacaaaccgatctagcagcgaaactgttcttgacagaataatctgaataaactgttttcgatcagcggctaggtccatttgaagttgatgctgtcaggaggcccgaatctgaatccaaaacgtgtacaacttgttctcttgtcttctatgggccaaaagtgacgtggtgagatgaaagaagacttggagaaggtcttggtttggtccccaatcaacttattcaatcatccatgcattccttacactcgatctcttttctttagcaacgtttgttcaaatatataacaagtaaatctaatatagaacatatgcacctttggttgattaatacataaagtagccatggttatatccgagctagttgtgttctcatcatcctccccttcttgattggaaatcgtcctcgatttcaccttgtcatggagcgtattaaacttatctttatctatcacatccggtgaggaacatttcttgatggtcatatgattggatcctaaaatctttgtagtcgaaaaaccactacactccccttcttgcaaaccaacctgtaacttatttaaacaactagaggaactagatagataattacatgtgcgcatgcggtcctctagacaatacatttcatcatgaaaaggaggtatagtcaaattcgaacaaatatatactcgatgcacattatattctcctttactatcataattgccaatgacatgaaaaatcacatcagaagtacatggcaattcaaatctagcaaataatttcttctctaaatagttgagtggacaaaaatcatcaaaatgaatatatccccaagtatttaaagaacatagcaatttaagctcttcattctcccaagcaatgtgaataacatgtttaaactcaacactaggtggctctactatagaactaacatgttcattcactagttgtggcatggatataagtgaagcatcgcacaactcttctttatcacaagagacatcaagcaatttgttttgtgacaaaggtatttcaacaattgtttccactatgagttgctctaacttagcagaagtagtggacatagttggcacatcataactatgcataccttgagcagttgtagcaccattactttttttctcatcttcagaaattgtaggcacttggtcaattaaacattcctcaagcatgcgtggagctatgtataggtttttttccctcttcgtctttcttctcttcctcattaccttcgttgttcttagatcctgcaaaatattagtatccaaagcaataggcacaacattacgttcgttttgtaataactcagacttagttgaaggcatcacaatagtatctttcctggtatctctgaaaatctcattgattctatttttcttcctttcaatactatctttgaaaatttcctcgattccaatcttcattctttcaagattatcttcgaaaatttcagtaaaactcatgggtaccaatttcattttccgaccattatgtctaaatgtgtatgtattagcaacaaaattatgcgatccattattagcgtatacccatggttgaccaaacaacaaagaacatgcttgcatagggacaagatcaaaattggcagtatcatggtaatttccaatcgaaaagtttattctcacaattctatttaccttgaacttaccacaagagttgaaccatttgatgtaatatggatgaggatgcggttgtgtaggcaactcaagtttctcaaccaaatctgaactcatcaagttattgcaactctcactatcgattatagtgcgacatnnnnnnnnnnnnnnnnnnnnnnnnnnnnnnnnnnnnnta

SEQ ID NO: 53204 - DNA, 5262 bp, Oryza sativa
  unsure (1)..(5262): unsure at all n locations
annnnnnnnnnnnnnnnnnnnnnnnnnnnnnnnnnnnnnnnnnnnnnnnnnnnnnnnnagttgaaccatttgatgtaatatggatgaggatgcggttgtgtaggcaactcaagtttctcaaccaaatctgaactcatcaagttattgcaactctcactatcgattatagtgcgacatgctctatccttaaccacaaactttgtttcaaataattcgtggtactgccattgctctgctttctccatttgagaacttagcacttgttgcaccaaagtactgtcatcacgtgcatctgtggaaggtgatgtagcagctacggtttgtctcccatccaactttatctcatgtccataagagatgtaacctaccattgttagtagaaaagagagaacaacataacaatattgttcctattaactatagaacatggattgtagtggagactagcaaatggaagcgtcttaccaagctcttacaagtgccttaccagcaatgctaaggacggtacaaccggtggctggttcgtgacaccttgaaggacatgatgtggcgattgcaaggatcaaagcagtgctgactagaagaatatatgtggagcttgggaggcacaatatatagtagaaaaggaacgcaattatgctaataagaaaatgcaaagttgaataatagttcaaagtactagtcaatgtgctggcctagtctagactcaactctagctcaagcaagcacccgaccacactaaggactagaagcagctcaaaccacaactctgcactctagatacagctcaaaagaatcactaaattttctcttctttttttttgctgcagctttttttaagcacctttctgccttttttttcttttttttaggtgcggcgttttctttcttttttttctttgcacctttctgccttttctttctttctttagtttttcttactatattttttttaacaagaactgaccactgacctcgaacagggactcaaatgtaaatatgaatattacatggactcaaacacaaagtgcaaaattaaaattagatcaccccaaaaatggaatgctcacatcacgtaggttccgtttttataaaaatatctcaaatctacaaccaccaaaatacctaacaatctgataatcgaggaagcggcatggaagaaacttgccgtgaggtggaggtggttgtcaaccgtgagggggaggtggaagttgcggatgtggggtggggggttcagcctcagcctccacaggataagagtggccccactatttctttttatctctaacagaactaacccacagcaaccaatctcgtgctttttttttatttctttctcacggcacacataagctcgggaacacacgacaagaaccctagcaagaaagtaactctctaaccgctcgataaaaatttctccacatcataaaaacggaaaccagatgatgattagattcgatttttcgaggtcccagcaacaaccgacgagatgaaaaactggaaccaaaactgacgtacaactcacaccgacttgagtgatgaaccctagacctaagtgatgaacagatgcaatactcaaaactaaaaattaaatctaaaaactaaaccagcactcgacacgacgatgcaatctagaattcaacaaagcaaaatctaatagaacaatgcaacggctcaaatttgtctaggtaaagaataaatatttttgtgtggcaattttctagttatgggaagataaattacctaatggcaaccgtgctttgataccaactgatgagggatgttaggtcccgatcttccgataggtattgacaaacaatcgatttgcgtggagtcgcgacacaactcgatccggcttctgaacgaacacgctaccgagccccgcaatcgcagcaccacatctcctctggttatcaaccgtgccgaaacccagttgacctcgccgagaaggctaatacctgcatgcgaatcgaagaacacaagcaagaacaagatagattgcaactaatttgcatatgtatgattaagcacacaaatttggggttccacaaaccgatctatcggcgaaactgttcttgacaaaataatctaagcaaaacccaaatctaaacgatgatggctactgaattaatatgattagggacgtcctagggttgccctagggcacacaccccgttgggctaagcccacgacacaattacaaggcccaaaacccgagtcagattcggactggatgagatacgtggcttgttttgcagattcctggcagctcggtaggaattttgatgtgggaccaaaaccatctgaaagtagactccataagctttccaacaagtactcatgggtcccaaaattccttctagatcagcggctagtccgttgaaagttgatgctatcaggaggcccgaatctaaatccaaaacgtgtacaacttgatctcttgtcttctatgggccaaaagtgacgtggtgagatgaaagaagacttggagaaggtcttggtttggtctccaatcaacttcttcaatcatccatgcattccttacgctcgatctcttttctttcgcccaagcaagtacctctgcaaacgaaaacacacaaaactcattgtgtagcaacgtttgttcaaatatataacaagtaaatctaatatagaacatatgcacctttggttgattaatacataaagtagccatggttatatccgagctagttgtgttctcatcaaggtgtgtgatagatttgtcatttgtaatagaaagctagatagctagcagatagatttttggtgggcgatgcagtcttgccaatattttgtatcttattccgattatcacttaacttagcaataatcatgtacagcctaatcatatttttacttctcaggcagcagttgcaaaccaaacaagcgaagcatccagctgcctgactaggcaaaaatctgaactcatcggatgcctttcaggcatgaaaaaaatcttaggcatgaaaaaatctcaggcatggtgctcaggacaccaaccaaacagacccaaagtcacggaggaggagatcgtgcaaggggatggagaagagatcccatcgtgatccatgattgggtggggcttgcgctacgggggagagagacagagagagagagagagagaggggggagggggagcgacatgaggcgttggatcttagggagaagatcctgaccaatgaggaatgagtaatgaagtctgtaacactgtgttggtgaactatagggtaaattatctattactatcttgggcagctgcaaagtgcacatgtagtactccctccgtttcacaatgtaagccattatagcatttcccacattaatattgatgttcataaattgagacaaattcatgaacatcaatatgaatgtgggaaatgctagaatgacttacattgtgaaacggaggaagtaggtaggcagtgaagaaaatactgaattcagcaaggtaagcctatctccataagataaaaaggttgaattagcagatagttttctatcaattctaacagaggcaaaccaagatatgtgaaaggaagtgagccaacttgacaacaaaaactcctgccaatatttgtgctttttcctcatctatattaattggtatgaggcatgatttatgataattcactttgagaactgtcctctgtgcaaaaaattacagtaaagctttcaaagtgaataattcctttccactggctttgacatacaaaagatttcaaagtgaataattcctttccactggctttgacatacaaaagagtattatcagcatattgcacaattggaaaatctagatcattctcattagggataggttttgacaacaagccaagagtataggccttgttaataataacctgaagcaattctgcaccaagcacaaaaagcaaaggagatagtggatcaccttgcctgacggttgttaacgattagtttcgcccgtcaatattactaaaataaaggaaaactagttatgcttgcaatgcatattatgttagaatgagaaatattccactagtactaggattctaatggagaagaaccgacagcaaaatagacgattggttaatcagacgctgtcgagaagtagacttatggatggatgggccaagaacactaaattgacacgaccaaaacagccccaaaatttacaagtctacagaaaggagcaagcgaggaggccacctgctgaaaatgggctaggaaggcccagcccatggttcggccgaaccatgggttgggccgaaccctcccgggcgccattggatgcgaggtttcttctggatggcttggatcactccccaatgatggttggagggcatttccgaccattccaaccaccacaaccgtcattgggaggctatgtaaagccctctcatcctccactccatcacacactcaagcaagaagttctcatactctctcaagtttagtttagtgtcacaagttcaatttagaatagaatcttcatagaatcttcagttctcgacactcgtgcgggcttggaaccaactggggatgcacccggatggacccaagccccacgccacagcatcggaggttcaacctcgcagagtgccagtgagaaccggtgacaggtgcctcatcacgtacatacaatgggggaatatgaacgcccgttcctccagctcaagtggtatgcctccattctccaactagtggcgctcaatttcctctcgggacctgggtgaaatcacgaggaggttggatacccttgacatacggacgagagagatccatcacaacctcgaggaacacatagcccagatgcaagaatggcagcaaaatgctgatgctcagttcaccaacatcaacaatctgatgcagcaacaacacgctgttctccaagcgtacttctgcttccaggggttcaatccttaccaaggaccctgagcgaaaggcaagcttgggggagacgtctttccctccattgaagtaatttgtatcacattgcatatttccctttacaattgcatgtttgaatttccgcattgcatcttatagattgaaaacaacataaaaatttgcaaaatagaaaataccaaaaatataggatatattttattatgctaggtaagacaacttagttctcttgttgaaatgatgaatagttgttttgttttatatctctcatatatgggttcatggttaagtactctctcaaaaattgaataagagtatccaacaattattcgggaacctgatggaagtaagctg

SEQ ID NO: 53205 - DNA, 6036 bp, Oryza sativa
  unsure (1)..(6036): unsure at all n locations
tccctttacaattgcatgtttgaatttccgcattgcatcttatagattgaaaacaacataaaaatttgcaaaatagaaaataccaaaaatataggatatattttattatgctaggtaagacaacttagttctcttgttgaaatgatgaatagttgttttgttttatatctctcatatatgggttcatggttaagtactctctcaaaaattgaataagagtatccaacaattattcgggaacctgatggaagtaagctgcactttgctaatccgagtttaggttgttacgagatatgagatagtgataagagttgctatgatcctgttctaagtttgacttgaattccagatattttattttccaaaatgataaatttgaaagttcctcatttgatataaattcctaccagaggcaaaaatactcatattgattaagtcatatacattgttggttacttgtaattccattgaactttatcaaatccatgtgacttgtctagatacttttcatgctctatgatcaagatcatacacccacatatatgcacatgctatacttctacactggaagctagcatccactcactccacttatatccacccgaggatcatcaaaataaattctccatgcttatatgtgctttcttctcctagaaaagaaaatattttttgaaaaaaaataaaaaagggagggaaaggcatggttatgaaaatgataaacatatgctctctcaaaaatattgagcatgagatgaaaaaaaaatgtagccatgccctctcatgtttattaaaggaggattttggataagaaagtaagcccccttcgtaagggttaggcaaggtaggagccggtccacgaagtggactacccaagccttgatcactagggtagttcttccttcactccgaaggtgatgaactccaaaccactcacaaaccggcaccgggatttctccacaatctccttggagagatcaccgggcaacatatccacaagccgtctagggggcgactacctccaagagtaacaagtaacatcccggctcggagatgatccggtgtcacattaactctacaatgaagtaatgaacttgtcttacctcaatcaactctcaaacacaccaaatggataaacacaagctcaagatagtgtgagagtagatgcaagggatgtatgtaaataaagcaagtgccaaaagaatccccttgctgctgatgggggagtatttatacccccatctacaaaaactagccattggggtcgaaatccccaacctctgttgcctgctggtcaaaccgcccatcagtgtaatagctagaaagttagccactactgtgcatttaatgcgcaggcacaactagcacggtctgactgccataggtcggcctgttagaccgcctgaggcttggttagacctccaggggctcaatcagaccggcctcgactctggcggctctggatcgttaagccaagggcatccaactggctcagagggggcccggtcataccagccaacacatgccgatcagaccggcttgggtctagcggtcagacaatgcaaatgatctaatatggcattttaataaactctttgtttaggtcataacccctcttgatagtatgtcaaaactataaataagtctagacaaaatttgatcgtccaacacctcgatcaaataaaataaaaccattagatttaccatcttcgtcgctctgcgtcatcaattttaatcatcggtgatcatcttgttaacggtgaaatttgataagccccgaagtcatcatcggcttagagtcagtatcgtttttagagtcctagaatcggccgatgggaattatcaagtcgccaatagtcggattgttgctatatttggttagggaaattaattcattaaaggaagcttattcagaagtgaccgagttcaaggaggatgcggcatgacagtttatctattaattaggaagagtatgttagtttccttttatgtttaggaaagtgtgtttaatgttcgataaggactttatattttccttttatctttagaaaatttctttcttgtccaagaagtactcgtatctatccatgggtataaatatgtacacacggggttattgtaaactatctcaacgatcaatacaactactctcagcacatcgccacccgaggttttttatttatcatccgatcgaacatggcacctaacgtggggctgcatcggctttcaatctctggcgaagtggttgttggcaactttttaatctgacaatcaagccgttgactgattttcagagtggtggatatcttagctaatctaatctggtaaagcgatttagccaatactggcataaaccctaaaacgaatattagccgatacaagtaaactgagataccaaactagattaactaagatatatgtgtcgacgtttgatgtcgcgattccagtatttgcatagtatggggattgttggtactaggatatatgcgagattgaggtaaaagagatggaggcgaggatttttatgcaaggttcgggcccctgaattgtcagataataaccctacatcctgttggccgaagccggtgttgctctttattcatctggatcacacaagtacaatatttgggatagcctatctaactattgtcgacttggcggtctgaagttctgactcgtagtcgacaacagggtagccttcctcctcgaatccgcatccggcgagatcagagacagcgctattgttgacggttgttatcgatcagtttcgaccatcaatattactaaaacaggagagaactagtgatgcttgcaatgcataaatatgttagaacaataatattccactagtattaggtctactaacctttttgcagagaatgacaataaagtgaaggagaatcgacatcaacaccaacaataaatcaatcggacaatgtcgaggaccagacttatgtatgaatgggccaagaactcagaatcgacatgatgaattgggcccaaaattcacaagtctgcggagtggagcaatagaggaggccaccagccaaaattgggctggattgggccagccccaggttcggccgaaccaatcctagcgccattggatccaggttttggcatggacgtccaggattgcatcccaataacggttggagggcacttcggacaattccccttccataaccgtcatacctaccttctatataaggagctcactctcttcacttcaacacacacctcaagcaagagctctctcattcctctcaagttttgtttagtagtatctagctggtggaatagaattagaataggaatcaggagtccggaagtcttcagaagagttcgggtatggctagtagctttcctttcctcttatgtaagctttgtacttttattagaatactcttttatatacatttatggtattgaaatactttccgagtatatgagtaccaactttacattatgttcttgttatactgaatatacggctagcttatctgggagatgctttggtgcgggtatagtgtttgcatatgcaattaatctatgtcatgacgatgatattagagtagtatctggtagtttaggcgtggtatctagattatgggatatcattatttggggttatatattgcggatgagaggtgggccgctgatggtgacagctcagtacgggtattcctccgcgcctatatataatcctaagttaatttcctggggagggtattcctccgtatttagccccggttggatggtcatgacgggctgtcgtaaggaactcggcagtcaggggtggcttctcgaagtaccaggagggcatcagatagagggtattagctagtatattagttaactagaatgtatgtatactatgtatattagaagtataggaatagattattctctttctcttttctttccacctagcttagattatttattatgaggatgagtagaaatgcttgtgtgtcactctacccttggattatcataacccctgcttagaatatgattatcacaagtaatatataaattattagttgagttttctctacatgatcttcccacgggataaaataaatacgatacccttggaatactctcgggtgaaatgctacaatggtatatccgtgtgcttgcggatgaactctgtaaccataatataccagaagtatttctgcgccattgctgggaattatatttctagtaatgtcgttaagaaataccaacagctatatctctcctaacggtatccataggcaccataggggactagccatgcctatctctgaagtcgatatccggcgtcttgtcttggcgtatgttggcttgtatgttgatcttgtgtcttgatctattgttccgtgtcctctctcctcccagagggccttgtatttatacctataggtgtccccttgtccaagtagaactagggaaaccaatatggatacaatccgagtggtccttatcatttccatgtagaactctggttgtctttccttatccggaactcctcctatatccgaaggttgtttccgtacaggacatgatatgtggtgaatcctgccgagatttagtcgactacttattaggtatgtgatatccataaccctgacaatatgatagatatgtaggaaaatttatcaaccaaaccagagcgatcgaagaggtcgaagcgatgcagttttcaacaacactaatgtagccgatacaattaccagggcccgcggaacgtaggacttaccccttcgctnnnnnnnnnnnnnnnnnnnnnnnnnnnnnnnnnnnngtcaagtgccaagttctgccaaatgataagtaaaaacttggcaaagagggtggcgatgcgccgagagtagttgtattgatcgttgagatagtttacaataaccccgtgtgtacatatttatacccatgggtagatacgagtacttcttggacaagaaagaaacttttctaaagataaaaggaaaatataaagtccttatcagacactaaacacacttttctaaagataaaaggaaactactaaatcatgcctaattaatagatagaattacgccgccatgtcgcatcctccttgaactcggtcacttttggataagcttcctttattcagataatttccttaatcaaatctagtaagaatccgactattggtgacttgacaattcccatcggccaattccaggactctgaagccgatcctgactctaggccgatgatgacttcgaggcttaccaaatttcaaatttcactgttaacaactatacaacctaaaatgattatcttcttgggagatgatcgtcttgggacagcgagagtaggattcaacaccaagtttctccttggttttccaactggtttttgagtaatgggggagtgaagcttcatagtaaacccatcatcctgtcgtgtgtagaagcccttttcaaggaggatctaaaaaccggattcttggtgtccaaacttaggctgagttcgttggttaagttttcaacacatatctcgtttttcgcgctcacgtttcccaaattactaaatggtgcgttttttataaattatatacaaaagttgttttaaaaaacatattaattcatttgcaaaaaactaatacttaaataatcatgcgcgcgctaatgagttgctttgttttgcgtgcttagaggattagttcccaacacacaatacccaacacagccttagagcctgtttaggggagcttctagcagaaacagcttctcacaaaatctccacctccccaaacagattgtcactctgattctaagcttctcacaaaatctccaccacccccaaacagtctagattgtcactctgattctgataaaatgtagttctagaaaataaactagaacccagaagctggaaaacccagctttcatattctaagaagctggctactaacgaacatattcttaaaatcttaagctccccaaacatggatttattggatccaggaaaataaaaaaaatcccacgctagccttacctagaaaagaatttttatttttta

SEQ ID NO: 53206 - DNA, 5279 bp, Oryza sativa
  unsure (1)..(5279): unsure at all n locations
atttattggatccaggaaaataaaaaaaatcccacgctagccttacctagaaaagattttttattttttaaccattttaattttttatttaaaaataaaccctttcaaaacttattttcaaaatctgagcctttacacaccatactacatcagcgagaatggtgtgccaaataacgttgtcacactagcgagatcaacatggccaagtaatgctgtcacatcaataagacctatatgacaatattgttttgctatgacagttcagctggcgtgaccaaaagatttagattttgaaaataagttttggaaatgtttatttttaaaatttaaaaggtttaaagaataaaaataattccctagaaaataggttaccgaagagaaaaaaaaaaacctgtaccaagggcggatgacgctgtcttctgatcatgacagtgctcaagccaaacacacaaaaaaaaaagttgtgacacgtaaaaggctgttcactaaagaaaaatataatacatcatacaagcactcacaggaactggacaagcagactactttggcaacattcacgctacggcgatgttaaacagtctcaaacaccactagatcaaatcttcagcaatggactcaactgccattcgagggtcagtgctttaactaaaaacagtcaaaatttccttctgaaaatgacattcagacaggactacaatattgctctcaaggcaaagataataactattacagtttacatctagcttgtctacttcattctgccttggtatgtacaccacagcacaactaagcaaaattttcttgattgcagagtaagttataccgcactttatccattctttgaagtaggcagctagtatttcatctgcatggaagtgaaacaaacaattgaggcatttaaaaggatagccacaatttatcggaagtgttaaaaaaaaaaactaatctcaagctagccttgacaatgacaagtctaaaatgtcaaataacaaaaatgtgagttgcttcaagttgcccttctctagcattatgcttaacagaaactttctacagtactagtatcttgagtggcatagttatagtatcatttttttcaccccagttacagccactgaaatgtatccgctcagtttagttagatcaatgatcctgtcataaaaggattattaccctagcacgttgagctgttgtctcaaacctctacctgcatcatgctgtcgtctttatcaagtagaagtgagggactgaaatcacacagtagagtggaatgtatagagaagtgtttgcattgagattgtgagaatagttgacgtgtatgtctggagtaattgcatggctagcagtgaatacagtttataaacttataggttctggcattttttgttgtgcccaatatttaatttgatgattgcatctaattccaatggctagcttgtgcaggtaaagatgtaagcacaagtaactaagatgaagggccaggaaaaatctaaataaaagaaggaaagaaatcttgaggaaggaatgaaggattccactcttggagcactgaagttgcaggagaggtttgaaagcaatacaatgtagacttgagacacaaaaggtgggttgtaggctcggaggaaatatgcactagatgagcagcaccaaacatgggaaaaagatcctctgtggagtttcaaggtagagttagaagcaaaaccaagaaatgtagcagaaataaatgcaagaaagtagcaggaaccaaggaaggatatggacttatttggttggggacctgtgaaatgtgcggaccctgattaaaagaagtctggaaatacagaagagtttgataatttctgccaaacaaaggggcaacattatgctactactgtatgtatgcccttggttagtaccatacacacagtgttccatgaatattaagtttagttatcatgtttggttatcataattatatttttaatgttttagctcagttcagctggaattcagttattggtagcatgtgggtactttgcggtttgtgcagaacatggttctattttctattattaccggcaccttattgttactgttatagtattgtaatgtgaccagctatggggttatcaagatttgctatcccattaattgctttatttcggggagatttctactcaaatttagtagcaacatttttaattttaggtgttgaggaatagtttaaggactcagctcaatgctaatctagggtgctatatgggtattcttgaggctaactagtttggtggtagctttgagcagttgtgcataagaaatcctgatcagttattaaagcaagaagataacattcggtttaaacatgcccttcaataacaaaatggattaagtcagaactgggcccattggttatacggggaaatatctggtgaaaaccatcaaataagtgaaaatacatgaaaacgggacctaaaagttctctaaattcatgaaaaatttactagagaggcatgaactacattaccaccaaatctcaagtccaaaatcaacttcatttggaggaaaaaaaattcaggcaaaagcacctaatcagcgataaagtggagctagtattacaaagtctaaaaatgcaccccaaattaaaaggctaaaaggactcacatctgccagtctgaccgcggcttgactgctggttttggctagttcaatggggttcagccaacaaacaatgggcatttaagtgttgcaagtatcgtgattacatcatattgtcactatggagcaatatgttatagacatgggccaggcccatgcagcaggttaggcataacagattaggaaaaacatcaattaaaggtaggcgattatctagttaggaaataaatgagctctgatagtaaattagagatagagattgggttggtttctacaattttagacattatttcctttggtgtggtagtatgtactctattattaatcaatcaatcaaatctctaaagttagccctaagcctcagagcttctcttagtggagaccctgctagagctactagagggctagtgccctatagggctctggacccttatccaagccagttcagaccttgattgcaatgatatagaaatcatgaatgcaaggaagcagcaaggaatacctctggataaaaccaacaatacacaatcttagtcctcatcttcatcagagaggagcctaatagggcccttcaccttgctatcattatgcccactaagctccagagctgcttttgcaaggaattcttccgtggcagcacgaacagacttcttatttggccgcggtggttgtggttttctcttgttcccagagtaactccctccttctcctctactgattgcctgcatgctcctcttctgatctgaaatagcaaatgaaacctcaacactacaccataaaaaaccaaaccgttcgtaaaacttttcaataaacaattatgtaccagttgtcaaatggggcaatgagtgaccaatgaaccttgctgctgcctgtgtattcactgtagtggttgggcgcaatggtgctgcaattcagaacacaagcagtaatttggtatacgtgtgcatagatatgatatttccaccaatagttaatgagttgtcaagtacccttgtcccagtcctcaaatcgatttaacttttcctcccacaagcttaacctctcctgaaataaatgaagcagaagtggaactaaacatctgacagtatcagcattggaattgaaaaaacatattgattggattttccattttagattgttccatgcaaaatttctaactaagaataaactcaaatcttccctatccaagacttcaatctttaactgcattactgccccaggaacaccaaagttataaaaccatattagaagttaggataaacgagtggaattacaaacctacaagctctagccaaaatcaggtgaaaaactggataacaattcgtgaaatgagcatagagcatggatgatttaatgttcaagctgccaaaggattgtagagtggtagtcttaaatatcaggatcatcaatttgtgcctactaagtatgaatatcaggatatgggattatagaaggtagctcagttaagttgcttcagatattagataggataaaaggaagtacacaataccagcaagggaaaaacttattcagcactgatcctatgggaggcacacaagtttgggaagaagtgcacaaagtgaaaatccagtatattatagtgttagcttttgcatcttgttatcccctgatcagcttgatcaggaacaggatgtggctcactacaccctggacagatcagtaaaattaattcctagatggctatactgaaaaaaaaattggtttggtgtgtgagaaacacaagaatgaagggatttgttaaagcaatatcccatggaagtaagtttgttccttttgtggccaggaaagtgcatgctgtattcaggtatggaggatggtattaatattttgtcatcctgtctcttagctacctttgtctggattactatagaggctctcgagtgggacaggatgtcaacttctatttgacatcttttgtataagtgaatgaagtgttcaaaacttggccctaggtgctaggcgccaggtagccaccccgattatgcattaaatggtgcattgggtggttaactgtacttgggggctcttgtgcctgctattttagtgttctattgtgtaagttttatgtaatatgctcactagttgcttgggattcacggccatgccaaacctctagcaccttatatatgtgaatgaaaaatgggggtgaatctgtttatcatcttacactattttcttttgcagctgtttcttttacaatctataaggcaagggatcatggaaattgaaagcagccttttcctcaggcaggaacttatcgtacacattctttctaaattccaatacgcaaaactggaggtaattgctacatcaagaaaggcaaaataatatggaagtaatcaaagggcaaagggcaataatggctacaagagttcaaagatcagggagtatattggatcaactttacttttcttagttttgcaccgtgttttacttattttgatttattatcattgtagcaaatttagaaatgagataacgatcagactgatacatcccaaattatcctactgattatttgagtatttctttcaattcttgtgcacatgccacaggagggtatccaccgtcacgacatctttccactgagnnnnnnnnnnnnnnnnnnnnnnnnnnnnnnnnnnnnn

SEQ ID NO: 53207 - DNA, 3514 bp, Oryza sativa
  unsure (1)..(3514): unsure at all n locations
annnnnnnnnnnnnnnnnnnnnnnnnnnnnnnnnnnnnnnnnnnnnnnnnnnnnnnnntactttaataaaggaagcatccatcgaggtacaagcgagagaagaaggcaaacaatcccggctttctctagaactccgttagaagaatgccaacactccggcactccatcaaattcttggaggaactctgatattttggagcactccttctggagctttccctcactttctactaagccaacatactaaaaataaaactacaagtgtgttgtactatacttgagctgaaagttgtgtttgttgaagtatgtgaggtctcctcattttatagcttccaatgatggttagaatagcggttaacccctcacaactgtcattgggacttcatcagggctatccacgtgtaaggtggagatgaggtgggacaggatgggttcggccgacccctgggccccacatctctccaccaactttctccaatagcttacaggtgggcccctatggtggttaaggacggttggtcccacttttggtttcgactgacttttgggccctctgttgacggtcattatcgatcagtttcgactgtcaatattaccaaaatagagaactagtgatgcttgcaatgcataaatatgttagaataataatattccactagtattaggtctactaaccttttgcagagaataacaataaagtggaggagaatcgacatcaactcaaacgataaatcaattggacgatgtcgagaatcagacttatgcatgaatgggccaagaactcagaattgacacgatgaattgggcaaaaattcacaagtctacaaagtgaagcaaaagaggaggtcgtcagccgaagatgggctggtttgggccagcccatggttcggccaaaccagggggttcggccgaacccccatctccaccgtgatgccaaggttcggcatggacgtccaagattgcaccccaatgacggttggagggtacttcggacaatcccccttctacaaccgtcataaccacctctatataaaggcttcactctcttcacttcaacacacacctcaagcaagagctctctcatttctctcaagtttagtttagtagtatctagctggtggaataggaatagagtagaaatcaggagtccggaagtcttcggaagagttcgggtatggctctagtagctttcctttcctcttttgtaagctttgtacttttattagaatactcttctatatacatttatggtattgaaatactttccgagtatatgagtacctactttacattatgttcatattatactgaatatacggctagtttatctgggagatgatttggtgcgggtataatgtttgcttatgcaattaatctttgtcatgaagatgatattatagtagtatctggtagtttaggcgtggtgtctagatcacgggatatcattatttggggttatatgctgtggatgagaggtgggccgctgatggtgacagctcagtacgggtattcctccgcacatgtatatactaagttaattccctggggagggtattcctccgtatttagccccggttgtatggtcatgacgggctgtcgtaagaaactcggcagtcaggggtggtttctcgaagtaccaggagggcatcgaatagagggtattagctagtatatcggttaactagaatgtatgtatactatgtatattagaagtataggaatagattttctttctcttttcttcccacttagcttagataatatattatgacaatgagtagctaatgcttgtgtgtcactctacccttggattattttaacccctgcttagaatatgattatcacaagtaatatataaactattagtcaagttctctctacatgatcttcccacggaataaaataaatacgacacccttggaatactctcgggtgaaatgctacaatggtatatccgtgcgcttgtggatgaactctgtaaccataatatatcagaagtatttctgcgccattactgggaattatatttctagtcatgacgttaagaaataccgacaccctccaatccttgtactagcgtatgattggttaggggttcattttcatcgcatggcgggtgtattttctccttaaatgacctgcatacatatatttgtcaaaactagtagaagtggttagtagtaaattcgtaccactaagttttgataatatgtttgaaatcttttacccaggagttgatggttaaagtttgcacttaacaaccgtcaacataccctaataatcttattgtactactagcttcgactttaaatttttagagctacacatacctagctctaaaatttataggaggtcgaaatctgccaaaattaaacctaaattaaggaaaatttggatactaaatgattgcattttagataccccacttttgatgcaaaattttgtcgtgacacacgaatgcctaggagattggcttagctccagtggaggtgctaaatcttgatgaggttcgggcgtgccagttaatttgatcctgcaactaactggatggaaatatatcaatgatcaaggagctgatcatcaacttaggggctgaacatcaacttagggagacgatcaacttatgaagctgattttgataaggttttgatgaattgactataggttccatttatgtaaattaaagtgtatatcggttaactaatcgatacatctgatagctgaagtccacaataatgataactcatcggccagaactcctatgaacaccgcataaaaaatatcggcttactagaattaaacttattagcaacaatgtaataaatcggacctaaccaagaaagtataagatcaaagataataaggacaacctatttggctaatagatctacacaaacatgatggacatatcgatcaatctaaagctacaatatgattacagaaatagaaacttaggcagaatatcggacctaaccgagaaagtcctaactaagctgatatgattctaaacaacgatgcagttaaagatagaatcaatatatctgagaggcctcacttacttcaactggaatagaatattagacctaactaagaaattcaagtcgggcccttaattaacttgtatagatggaatcaactagatcccgggtagttacaggcttacagaagatcaaatccattctgaaaagattagaggaatgttattcttaaagatattttttattgaaaatgttggaggactacatttcatttcattaaggagaaagaaagaaagaaagttgatttctatatatatatataaaatagtcccccgcaaaaaaaaagatttataagatcacttaggggtttttaccctccatttcttattcctattaggaataactcactacaacaaagctaacaactcttaaagaaccagatttgtacatatactattttaccccttgttgaatggatgatactccatattagaaagacattgtgtaaagtagagtttgtttgctaataaagcgaa

SEQ ID NO: 53208 - DNA, 718 bp, Oryza sativa
aaaaaatatttttaatttaaataaatgctgaaatgatatttgtattatcaaattagccatttaagctatgtaaattccaagaaaatttccaatcaaataaatagttcaaatcaaaaaatatttcaattcatttttttcatataaatagttcaaatcaaagtccccatatcattatccggtgcaacgcattgacattttgctagtaattaaaaaataggtaaagcttccggttattttttcgtccgtcattaaagcatgggcccacacgatatttcgccactaatctgtgaatccggatgcgtgatggtgattttgatgctccacaaataaaagagaaacgaaaaaaaaggagaaagctagcaagcagcctagccaaacagcagcaggccggcccaacaaaaaaacaaacgcagcccatcagccagcccacaaagcaaagcagcagcccagcacagtactgcacgatactgtagtagtcaggaataagtttaccttagttccctgaatttgttgctgaatctgaaagggaaaagtataccggaggtccctgaacttgtcaccgagataaaaaacgtccttgaaccgcaataccagacacccggggtcccccaactatacaaaaccgaaaaccggtaacccaacgtccctcgggggttttgaccccagttttgatctacgtgccaactgagtcagcgtggggcccacgtggccccacatg

SEQ ID NO: 53209 - DNA, 758 bp, Oryza sativa
acgtgtacacctggcatgtggggcccacgtgggtcccatgctgattcagctgccacgtgactaaaaccggggtcaaaaccaccaagggaccttgggtgaccggttttgtatagttggaggaccccgagtgtctggtattgcggttcaaggacgttttttaatctcggtgacaagttcagggacctccggtatacttttcccaatctgaaatccatccctaatcgcaatgccgggtatacctcatcctccaactcacagtaccatgtcaacgtggattatcatggccagttttaactgacgtggcaagtgagccccacacgggtcccacgtgtcgggcccaactcttctctcttccttctctatcggcaatggccgcccggcggagaggggctgttgccaacctccttccccttctcctctctccctagatgcaatcggcggctggcagaagaggaacaagacgacgccgaccttccctcctccttcctcgagcttctcgccgacgcccatggccacccacctttctttttcttcacggcacagcttgccgaagctcaccacaacaactccatatctaggactggacttgctgacggcgttcgtaagctcacgcctaatggctcgagctcctcgcccccgtcgacgtcatgcgcgagcgtgctcagtacctctgctccctcgtcatctccaacaaagtcgagaacacctcgccgtgcggtgtgtcgacaagcatcgcatcgcatcgcatcgcatgtcca

SEQ ID NO: 53210 - DNA, 1278 bp, Oryza sativa
cttgatgatccggcgtggcgcgcgtatcgttttataactcacgcggggattcttcccgcgcaattttaaaaaggattagcacaaagatccgcaaggcaatattcattctactctccaccattcaatcttgggctctcgctttgcaaagaaaatacagtaataagaaatgcagcttgtctttacatgcgtgtatctgtgtgtgtgttccagaaattaatcaggcagtatgaaaatcgaagaacatgatcaataagttatcagaaggtgccatgagagcacttctatagtatcaatttaacagtaaattgtacatgcctgaagatcatattgagttcccaaaagaagcaaaaatgcccaacaaattcagccttgttttctcattagcaaatagcaatgtaacaagtcacatacactgccgtctgcaagacagtattgtttctaacaatagacgcagagatcacatactcatctgttattcatctagtcatacagtattccttcttcctctatgcatgttgtatccttcctgtagtaatcctaatgctatattgaaaacaaaaatgtttctcgataaatcttctattagtcttacaaggcaaaaggagtatcaacgccactggcaacctgacttgtcgttgtgccatatttctttctgcactctggttacttacagtatgcatttctgtgggtacgtgcagcagttccccgtatcaagcatttgtgttaagaacactacaagtgaattaagtaagctacaatcaccttactataggtaaccaagtacctatctaggaatcgaagatgcaaaagaagcaacctgaaccttgacaaggtttgtctggagccggcccaagtgaaatgccgttagaagccacacgaagcagagctgttatcagaagggagaaaattagttcttcagtgatatatgcaatcctatgtggtgatggggtacaaatacaatgactgaaaccatgacacataccggcaacgcgtagagggtgaccatggatgccttcttctcaaggctgctgaacaacaaactgtatattccggcagctgttgcatcaccaagcctttgaacaacaacatttatcaaacctattaaaattcattttcattagttaaatagtcaaaactgaaatgggtcatacatttgtgaacacgtatttaagatgattttaaatataagactaagaaggcaactgaaaaactgactatttttctacaatagcctacttaatctggaaattcaacttcaaatttcgctgctaatcaccc

SEQ ID NO: 53211 - DNA, 1311 bp, Oryza sativa
gggaggacggccaccactgacgccaccgccgcatcccggaggcggtgccgagtcgtcgtcgtcgtcgtcattccaaatttcaatccaaactccgtcgttactctgcttgtcctcccgtcccggcaaatctaatcaaacaagtcactcacaaacacaatcccccgattccgaggtttgacgtcttataaatatgtttttttctttctttcttttcattttgacgagagaggagctgttcgttcgtattgtcaaatcaaaaaaaaaaaaaaagcattctggtatcagtatcagtagagtgtaattgactaaactggcaacaacaaaacaacgacaatgacgatgattttgaacagtgtaaatgtataaataaatgagagaatctacttatataccattgactttagtctagttcaataatctgccactgacttagtttaattttataatataccagcgtcttttgtttaacttatataatttaccatcgccgtcagttaagtctccgttagcacggtacaatttcgtactaatgaccaaaatacctctagaataaaaaaattaacccaatatattttcatgtccgcctctgttacggccacaagtacacgtgcaatattgcaggctgtgtccgtggtccacaagcccgtggcggccgcatacatacgtatgtattgctagaattctactccctccgtttcaaatgtaagtcattctagcatttctcatatttatatagttgttaattaacaactatataaatataggaaatgctagaatgacttacattgtgaaacggaggaagtaatatattagtcaatacataatataaaataagcgtgtgattagatttatttttgtaagtgcaacatgccgtcaaacaagttgctaaaacaatcatatgtatgcttagataatcatgtattatcatagaagaatatgagccgggcaacctctgtgacatgttacagtatggtatttgtgaattttcggccaaattctgaaagttttcatcttaggggtattttcgtcattagaacacaattgtatggtactaacggagactaactagacggcgatggtaaattgtagaagttaaacaaaaggcgatggcgtactatagaactgaacaaagtcagtggcagattgtggatctagagcaagtcagtggtacacgatagattttctcgtaaagagagatcaatagtctgttatgttcgtggccggatccaagctttgcacagtttagttaatttgctcctagccagtgcagatcaacatctctgggtatgtgctatgtaaatttagtttctt

SEQ ID NO: 53212 - DNA, 1446 bp, Oryza sativa
tggcccactcttccttcgtgaaacaaacaagttaggcccaatctcttatgtttggagcggaccttcggtctttagataaatagaggaataagtttacttgatgttcctgaactttacattgagtttgtttgagatccccagtccgcaataccaaaaatctctacccctcaactatcacaaaccatgcaaaaaagatcctaaagcagtattgacccaatttttctccgctttcgccgatgtggcatatggtgggccccacatgtcagcgtcctctgggtcagctactgcggcggtgggcgtcgcaacgtcgcggaggaggtggcgaacgcctccacaggtccccgtggcggaggcagcagcgaatgcccctacgagcccccacggcggacgagatccccaccacaatggactgcctctgccctccagcgtgatgacactctctctcgtggcccgatcttctggtgagggggataactctcgctttgatcgagtgcgacgtttgcgacgtggctaccaaccagaacaagtccaagacgccgtgcaatcgctacaccacaaacgatgtcgtaccaaccgtgacgcgcggttgatgatccctgcaatgcaaacgagagaacactgcaagaacaagataagatgcaatctaaatactgcgaatagggaattaagcacaaaggaatagttacgattgaagtggtagatctaatcgacccggcaaatcaacacaccaactattgggggctctgaatctatagtcgccgactaatcgagcgaggactagagacaaggtgaatggcacttggtaaaattcaactaaacaaaactcaaatgtttttgaggatgaacaaagctatttatagaggaaaataaagctagggttcagtgctaattcgtggaggtggagggtgacactttcgagatgagcctagtctattacaaggcccaaggcctaagttcggtttcagcaacagcactgtcttgttttggcgattcccgttgactcgagatgaatttggacatgagaccagatgcgtttgaaaggtagcgatataagctttccacgaagtccaagatcactcaaatcggagttggcatgaaggcgctaggtccgtttgaagtcagtgctgtctccggaggccgaactggacttggacttggaattatcattggagcgtgtgaagttatgagcgtatccgacgaagtgatgtcctcatcacagcggcagcctcggaatcggtgctgatggcggctaccgtagcgacatggggtgggtgaagcactatgcaagctagagttggctaccgtcgctatgcccgccgccactccgctcagcaccctctaccatcggtggccttccaggcttgctgaagaagagaagagaagagaagagaagaagaaaagaacaaaggaagaaatgcggactccacattttttttctttccactt

SEQ ID NO: 53213 - DNA, 1036 bp, Oryza sativa
ggtagtagttacttgtgaagattacatgtcatgccaaattgcttagcaacaggttttattccacgtggtggttatctgaatttatagatcaaattgtgggatatccgatgcattgtttattgtcctcaaagatcatatattgctaaataggaaataaggtaagaactaaaattccttaggagtttgaaccagaaagcttctaaaattcctcagggtctagtcagtggaccactggacccctattaggccatttttaaactcaattcccatccaggcagtgtagcaattctctgttattcttgtttaacgtgtctttctgctttagcttgttttgtctgtcataatcaataccagttgttcttctcaccagggactcagacttacactatttttagtttctacccaatatgaccttaagaacatatgtgctgggtctgtggttttcttcaaaatttatatatgttccatatttgtttatgctgtaggttttcttaacaaaacattacaggaataggcggtgtaacgacccagattttttccttgattttgaagagatatatgttattgactcaaaagcaaggtcaatcacgagagcaaaagttgtggtaagacgtttgaaatttaaattcttgaagcattcagaacagaaccattatatatttaggttgcaggagctctttcatcactaattttagtagaaaaaagtatattagtatctgcatgatgatttgaaggaactagtttaatggtttccatcctttgaaatattgcatgcaaccatttggatgactggtaaactgggtctgtgatgtcattggtttcacagttagtcctatgccttttcatctagacatttgtgacaagcatttatcttcacttttttttttgcatagtttaattaatttttgttttgttgagattattgatatcgagctgcctattacaggttagtgtccctgaaggaaagaagagggacaggagaaatgacttgctactcatacgagatggaggggaatcattcagaataatcgacaag

SEQ ID NO: 53214 - DNA, 735 bp, Oryza sativa
cacatgtaatgcaatataaactcttggtgcattggttacatcattcagtttcattgacgcatgcgtcaggtttgctgtcaacgttgtgttggttaatggtgaggagcaagtctcaatcgagagttgcatgagaatgataggtttggtggaaatctcattgtcaaaaggttcatgattgatcgatgcttaaagaccgttttcagaagctgtattttatatactagtgtgcttcaacagctgatgttatctttttattaaaaaaccaaaccggcatgacatacacaagattctccttgattgcaatagctggaatgaggaaataaaggtgcatgccttggacaagttgttatgctaatcttcagaaagaattaattctgaacagtcacagattaatgctaattggtgggggtgcatgggacatacatactacacttatcagcatcatagtgctaactgctaacatttgtgcgtgttactcaatgtagggattgagagatgcgtgggaggaggtgaagcagatgcgatgcagagaggaggagaccaagcagagggcatcgtttctccagcaaggcttcgcggcggcgtggaaagacggcatccacaccgacatcgccgtcaggcctggaactgggcccccaatccaagcccataaggccatccttgtcagtctctctctctttcagtttcagcccaataggccggcctttcttttatttgattgggcccaatgaaact

SEQ ID NO: 53215 - DNA, 717 bp, Oryza sativa
atctctccatcattgtgtataatatcaatacacatacacaattcattttcacttagttaatgctatttctctcttctctcattaagccatatctcctcaattgtttctagccctcaaatgattaatctatggttggaattacctccctcattttctcctctcataaagccacatcaaattacttttaaatttggaccatcattctatatactatttaaattatgataaaccacaataacttatgcaagtttctatcgtctaactatcttacatattatttttatttcttataaatataccaaactcccgcagcaacgcgtggggtttcatctagtttaaaatagatgtattagcacacattgtacttgtttacccatatacactttgtatcattgtatgcatgcgttgtcctagcttagaaaataaacagagagatggacaagtaagtaacaatgcgatgcacatactcttggcattggcatggaactgctagtgctgcccagctgttcaggctcctgagataccttgtccttgagctctttgatgtacttggacgcatctacgaggattgatgtctcgtttgcctgcatataatcatacattcatgcatgctatgtttagattaatataattaaactctcactgctgcagaaaattctattactatcgattcataactggaagcgcacaagtttttgaaccaatagtgtgtttggc

SEQ ID NO: 53216 - DNA, 1687 bp, Oryza sativa
aataaagaaagagagcgaggaaacaaccaacggttacggacataatagcgcggaatccaaaatttaacatgggttggcccacattgactcccaggccatctgctcacacgccacacggtctcatccacacagggaaatgcacgaatcatggcgcaaatcctacggatagaaaaacgacaaatattgggggtgaaaatctgttgacaaagatctagcaaaatcgttcccaaatatgcagagtaagcctttcaccaaaaacttccccactggatggtaaatttacaattttgcagaggttgatcctcggtgacaattatgtgcaattagcttgattcacgtcgaatttgcaggttgtttaattttctggatcaatggtccagtttgttgggctgtttactagtactactgaattatgcagagaatgtggccccgccccgaattcagtaaaccttccaccttaactgccatgttcgtgctaagcctgcaattttgcaggcagatgatcctcctcttccctcgccgaaatcagcatggtacccaattgtgcgaaatttgcttgattcaggtggaatttcctttcctatatgggtaaggacttgagacccgtgtttagtcttttagtttatttagtgcgtttcacgttttgtttgtcagagctgcagtctgcatggtaagaatccgcaattgatgcatcgttacctactagtaactgccaaattctaatcgagttaccactagaagaaaccatgtaaaatctgcaaatccatttgatgcaaatcatgcttctatcaggaaaacaaatcactgcaaacacatgatgaacggcatgcagcattgatgcaatccatcagatcacacacattcacaattcagacttggaaacattttgtggtagaaaagggagaaattaatactactatccagcatttgtagcaactgtaccaatccacgattatgacatcaaattttgactgaaactgtaactgcattatccttggcagcaagaggactgaaactgaaactgcaattgcaatcttgaagcaaatcttgaacaaattgacagcaagaatacctgtaccaggacgggacgatcgatcaaactaacataacggggtagaagccacgccggcggtgagtagttcgacgggacttgctccggcaaagaacttggccgctggcaaccacgttgaagtcggcggccggatagtcgtccgcattgtacgatctgcactgcagcgacgaacaggaacagcatccgcccacccagcgattccaagcaccctgaacgcgcgcggacgtcttcggcggataggggaggacatgggtgcagagtggttgatggcggcgaaggttgtggagactgaggagcgcgtcgtgtggcccaaggagatgaagacccagccaccgtcgtagtagcccaagtaacgcgtggcgcgtgcgtcgtcctggagcgcgtgggtggcgcacccggcgagggtgcggcgcgccggacgaggatcgacggggatggctgggcgcgcgccaattgtggcagacttggtccgccggtggaggagccaaatgtgggcgatcctgagcagcatggcgtagccctcgccaacgacgtcgacgtggtccttccacgccctttcgcctcgccccgccccgcccgccgtgtcgaggtggagcagagcaggttgcggttccg

SEQ ID NO: 53217 - DNA, 2552 bp, Oryza sativa
tttttaactgtaaagttttccattaattaaccctgatccaaaaaaaaggaggatcacctaacaaaatgcaaaagaataacaaagccccaataatatacatatgacaaattgagcacgtgcacagaattctgcctataaatattcgtgtacatttgactggcaaccagcaacagcactcaagcctccaaaccaaatggcttcccctaaaccctttgcttgcagtgccattgccttgttatttgctgcaaacttggtgtcagctcagcttagcgcaaatttctatgacaaatcatgccctaatgcactgcccaccatccgaatagccgtgagatctgccatcgcaagggagaaccgcatgggtgcatcattgctccgcctccacttccacgactgctttgtcaatgaaagtgtcctgaacctgcagagatattcaaaattttctcacttctaagtattacgtaataaccttcagtattctgacaatgcagggttgtgatggctcggtgctgctagatgacactccaacattcactggagagaagaccgctgctccaaacaacaactctctgcgtggatttgatgttatacacaacatcaaggcacatattgaggggatctgtccgcaggtgggctcatgtgctgacatccttgctgtgggggcacgcgaatctgttgttgcggtaaggggagaaaatacaaaggatatcaaactaaaagttagttatttgtctgtcttaaaaagttaacaggaactcctgacgtcagaagatgagcaactgaaatgaacaaaacataactctttatgtatagctatgaaattctataccaaaccaagccttacaaagtattaaaagtcaagttgccaaagatagtaaaataaattaattgatatttataaaatacaatcagtagtgacatatgaaaaccgacaatttatttttcagctaggaggtcctacttgggttgtccagctgggacggcgcgactcaacaacagcaagcctggatactgcaaacaatgacattccagctccaacctttgaccttggtgatctcacgaagtctttttcaaacaaaggactaagcgcaactgacatgattgcactctcaggtactgtgtatgtaaatggaactttttggtatataataccatctataataaaaccataaaataaaacagctatccttgctgaagcttgattgtcaaaacaaactgtacaagtggtgttacatttatgtaggagtatcaatatatcatggtgcaaccccaacaggttgtttagtatcaagatgctactgatcaattgatcactaacatcaaataaaaatatatgccaggggctcacaccataggccaggcaaggtgcgtcaattttcgcaaccgcatctacagtgagaccaacatcgacacttccctggcaacatctctgaaatcaaattgtccaaacacgactggcgacaacaacatatccccccttgatgcatcgacgccctacgcctttgacaatttttactacaagaacctgctgaacaagaagggtgtcctgcattctgaccagcaactattcaatggtggttcagcagattcccagacgaccacctactcatcaaacatggcaacattcttcactgatttcagcgcagcaatggtgaagatgggcaacatcaaccccattactggatctagtggacagatcaggaagaactgcaggaaggtaaactaggtcataaatttttacagtctaagcctgtgtgtgcctgtgcggaagagtgtaatgttcagagaagggagaagtgtccctttcctgatgctgtagtcgttttgaaaggtgtctgtattgctattaaagaacacatatgtgaaagaataaaatggcataaaaaggcaactggtgtaacagttgatatggcctttcatcttttcatccacaattcttgcacttgaaagatcattgataacaaaactcggctccaagcctcttactatggttgatgaatttcatgactaaaacaaacttgtaataataatggttaagaacaactgttcagaatgacttgtcatgctggcagtgatcattacttggcttaattccaatattcagttcattgactatagtttcttaactagtacaactcataaccgtagtatatcaaagttgacaaattacatatcaattgtgtagggttcaggtatatgatcacaggatgattaaaatcaccattaagaaatgtggcaatcatgcttatttgaaaaggaaaatttgaacattagatattttcctaccgtctgcacttgatatgcagatatgcaagtgcctatatcagcaacaaggaaaagctaataatatatcatatcatgattttgttttagataatatcatatagtcatattcaataacaaagtgaaaacattgacaatttgtcatatagtagatggagatttctccttagaaccaatatttattttctgaggtagacaaatatttgcaacaaaatatattgtttcccacggaaggtttcccagtaaaatgattgggaaggttttgtttttca

SEQ ID NO: 53218 - DNA, 721 bp, Oryza sativa
tccctcccatttatgatctacaacttggtgtgtttagttgatgcacttggtaactgcatgggtgcgcatgcactccttcccccccgtggggtttcctccaacaccggaaaagatccctcaccaccgtaccacaccacactagtacagtatatattatggagtttatcccaaattaaggggggactcgtccaatttcaaaaacaagggggaaacccccaattcaatcaatccggcggggggcttaattaattttgtcgccgggcggccttttcatttccaatccaatccaatccgctccggctaaaccttcaccttaatcccttggatccttgggaacttgccttccgcaactggcgcgcttgccaccgggcgggttccaacttccgctcccgaacccgctgctctctagagcacgacaagacaatccggtcgatcgagtgtcgagtcgaccacagcggcccgctccgtcgtcgctcgcctgtgttgctaggacctccttcccgtgccgcctccccacctttttcccatctccttcaagtcaggaacggcgctcttcagggcgacgcacagcgggctgaaggcgtggctggttgcgtggagaggggcgggggacaacaagaagaggggcagcggtcgccgacgggaggctgcgtcgtagggtggcagtcggaccggagtcgcgcgactgtctcgcggccggccggggaggagtcagcggcga

SEQ ID NO: 53219 - DNA, 1215 bp, Oryza sativa
tcctccccctttctctacccaacttcttagtgaaaaaaacagacatgatttttgtgattcgttagggtagagatcaatgagaggccggtgaagaaggctatgctcgatttctccagcctttcagtctccgatccatcctctgctcctaataaaggtatctacttctacttgtcacacgcttttttccctttcataaacatatgagaccgaagcaacatttttttttctttcaaaagaacatataagtgagatactgacgagaattttttttcctttcatatgaactgaggagaaaattagtactatcaaatattaggacagaagcaacattttttttcctttcaaaagaacatataagtgagatactaactagaaatttagtactatcaaattaagaaagaagcaaatacatttccgcattaattataaggtgaaacggtgagcaccagtgtcgtttcaagcatggctcgaacacaggcctcacactgagctacacccaggttctcacttgtgacaaacttaatcagtaatcacaccagcagttgcttgtctctgaaattgatgctggaagacactcgtcctgataccacaatagtaggattctacttaccagttaattagcctccttgacaccatgataccgctaacacaagttgcatatacttgtactttgacaccgcacgtaaacatgatattcacagtttccgtgcttacagcttcagaggaaccacgggttaagaaacttttggtacagcacattgagacagtacaccttctgaggcagttcagaatgttttgcactctcttctggtaataatcgttttcttttcattacttttaaatttgtctagtcttccacaatttggtttcctcgcatggcataatcagttcagttaatgtgtcattactcatcggcatctgagtatatctcttgttattttttacttttcatggagttatatagacaatagagcaacacaattcttttattgacttatggataccaacattatgcaactaaattgtcttttaaaaaaatattgccagttgtactttaccttatgaccataagggttggacagtggatcacaattacaccattttactttgtagcattctgacttggatgcccaagagataaagagccagacaaaggaatggaacaacagactaagcaagataaagtagtgaactttttcctagtatttacttaat

SEQ ID NO: 53220 - DNA, 1791 bp, Oryza sativa
atgagcattgtctcatacggttcattggaaaaacgtttaatcttaaccatccatttattttaccttattttaatcttaacaccttcatatccgttttcattgtcaaggaccattaaatgtggaaagaaggtaaagaatggagttgccgtctaaaatgctctatcccatgctttgcaagaagagaagacaaaaaattgaaaggccaattagaccagaaaaaccaaaagagggggcaaggcaacccgaaagctaagctagggtttttgccatggctacatccgactcctgagctcccccttctccattcccgatctttactaatcctgcctgaaggataatatctctgatacgcaccaaaaagttgtctttaaatagggtccctctcataactagtttaaggttgattatatcgctagtgcatactatgtgtatctaagtaatcaaaagagtataatcttcttatgtatacctttataatcgaatatatcggtgatatatggttttagtgtgcagcacacgatttcacaacatcactacctaaaatttattttattttgggttggttttgcttattggtaggggttaatggaaaccttaacctttttttttgaaaaccccttcccccattaaaaaagagacactttcctggacctgggaaaaccttctgtgtgaaaaaacttttagtgggggaataggcaagggggcaattttaaataacaaaaggggtccttttaaaaccctaggaaaattactgggacattaaacctaatactatactctttttttttgaaacaaccccatagtatttgacaaacactttgatttaacaatggaaagtgaacattttgtgtacacttttagaaagcatgtgcttaattactcaataggtgttataatacattaatactatggatgttaatataattaaaataatatttaggaccatggtagtatgatacacttaaaaatatgatgatatccaaatattgcatttataaacaagatcttaactggcagccttatttctttcttggggtaggagatgaatcctatttttatatattcttttcaccgacttgtaatacactactatgtaaatactatactcttaaattaagagaagaaccaacatgtactcacttttagttatacacatagggagaactacaatacttcaccattcttttcttgatctcttaaaaaaggaagctctataaagaaagtaaagctaaggataagggtaaaaagaaagtactatgatgaatagcttggaataacctagtatatgctaatattagttgaattgaaaacaactactaaaacaagaataaaatgttgcattaatagtcaaagggtgagacaaagcacataagcatactctagaatatacaaaacttttaggaaatctgaaaaattttcaatacaatttctatgttaaaaaaattatatattgtgttttctttaattgtgtagtactagtagtcggagtaaggagaagcaaaacatgaggagggagcgacacaaaatttactagaggaaagaaagccaaaatggcaaagaaggaagaaaaaagaaaagggaggaagaagaagagacgctggcaacagctgcgtcgaaacgctttatcccttgcctcgcgagaacagaaaaaagaaaaaaaaagaagagaagaggggaaggccatccgaaaggaaattaggctagggttttcgccatggctaccacccaccacctcgagctccccctctccattcccaatctctccgactcctcctaattaatcccgtattc

SEQ ID NO: 53221 - DNA, 1637 bp, Oryza sativa
cagaggctgaagagagatccaaaggcgccacacctgttggggagaaggatcctcggaaggaagtggaacgtagacggcaggagaggaggaggaaggacgagaaggataagggatcaagcaagagcaattcagattgcgaggatatcgagagaagagtaaccagggaaggggagagaaagcgggattctgatagaagaaatgagccagagaagcgggatgcaacaagagttggcgctgagggtcataagccctataattttgatgctaacaaccagggtagtaagacagtacagagcaaggcaaagtactttggccgtatgacaggcggtctgttatcttcttcaagaggttttggtggcggttccttttttggtagaagtgctcagacctctgctcctcaagttaacaaggtgactaaaccgcttgttactgtaactgaccagagtaacgtagtcaaaagagatgcccaacctcctgcaacagccaaatctgctactgctggaggaacgacaaattcatggactaatgttcatcgatctgtgagtaacaaaggcattattaattgctgcagcagtctatctgttacgattacgacatgtgccattaattgttttcaccctgactatcgtcttacaaataccgtttgcatttttgttatgcttttatgcaggttagtccaaatgtgcagtcacagcctactggacttaaaaagtcatggcaccagctgtttagtcgctcagcatctgtgtcaccttgtcctgatgttcctgctacagcccgtgaaatgaacgggcaaccagaaccatatggagcacaaattagcaatgctcaaatcttcctatcgcagtatccccctctggacagtaaccctagttcaagccgctgtatgcaatttccaggtttcccaccagtgaatggagcacctgccaacatgtcactctctcattttccagctggacatatgccctactattgtgagccagaaccaacagtgtttgaagaaccagaacaatttgaggacccatgctatgatcctgatgcaattgcgttgcttgggccagtttcagagtccctagataactttcctctcgacttggatagcgggttcatctctagtgacatcaccaaggaaacacatgcgaagccttcaccaatcgaatctcctctttcaagatcacgtacattcgaggataatcctattaggcactcaactggaaaagggcctaatggttctattttgcttgaagctagcaatgaacatgggggcacatggcaaatgtggggcacgccattagttcaagaaagtttaggtctacgaggtcctcagactgagtggctcctaccaaacacaaatcaatttaaccatggtccagtcatttgaatggtggaacaagaagctcagtgggttctggtttggatgacaatgatttatggctgcagaaagcgcctttccagcaaatgcctcttgatacaaggagtctgttcctttcacatgatgtctcagagaatgctatacacaacgatttggattttggatcaccaaacaaatcagcccgtttgcaccccattgggccacctggtcattcttggtccaagtaagtatgttgtgacattcttgtaccgctttcagtattttt

SEQ ID NO: 53222 - DNA, 1032 bp, Oryza sativa
tctgcatatattcaggttatatatttttttctgcatatattgaggtttaattccttgacaacatttttgttgggatctcgttctgattgaaaagcaaggtatcggaccagaagcaggcctcacggttacctagatatgggccatgcgtctgtctgtctcatgggccttacccatggcctaaagacgcctaccaataatcgctaactaaaacaattttatttattattattaaataaatcatgtgttaaacaaacttgtgacagaccttggtagtccttgcggagtaatagtgctgacttgttgatcctaacaacatggcttgactccaggccggattatcattgataacaaaacaaaacggaagattagtaggagtaataatacaatgtcacgattactgaatgacgccctaacagaacgttggcggttcggcatatactcatttttagtgcacatttttagagatcaattcatatggaggaacaaataagcataccactgcactgacatcaattgtaatcaaggcatcggaacagcagggtccggatggaatggataattacatgcatagtacagagcagaggatgggatggagtggataagaccatcctagctggatagattaggaggacatactctattattaagataaagataaaattaactaatggagccgattagattattactaattgatcatcgtgatcgtcatcatcttcatttgtctgcatcttgcagcaggaaggaagggtagcactaccagctccacctctcgttctcctgcccgtcgtcggtggtggccggcggcagctgcgagtagaagtcgtagtccaagctgctgctgttgttggtcttggataatgggttgtagtagtggtgcgcgagggcggcgccgccgaggacggcgagggtgagggcctgcgcgtgaagcctggcgtggatcagccgcatctgcggcgtcttcctccgcccgtacgccaccgatgcgcccaccgccgtcgcccacagccctcctgttcgtcacagatcgat

SEQ ID NO: 53223 - DNA, 795 bp, Oryza sativa
gcaacggaaaccacaccacaccccgatacgactaggatttcctctctgcttcttcgatccccttgtattacaatcgatcctgcaagagaagcactctataattgcagcggcaagatcgattttttacaaaccaacaaagcagaaaggattcacgcgccgccgcttgcgatttgtgagttgtctttcccctttcgattccccctcctctcttccttcccctatcgtcaactagctcgagttgcttgcttgttccctctgctgcttcctctcttgtgtggattggattcccggcctggccctttctttttcctcttctctcctagattagaatcgtcgcgatttgattcctcaatctctcgatttggccgccctatctgttattaatccccaattgttcttcacacacatactcaattgcaggtcaattgcagccagaaagaggcgatggatttcaaagtcgcttcctttctcctactcctgttaatcgtcacctgcggagctgctcaaggtcaaggcaatgattttggtacgccctaatccaacaccttcccttcctcccttacctatgctcctcctggctcctgcatgcagtttggaaccaacatgtcaaacattctcaagggaaaattggacaagttttttattgtgcgtagtaaagtatcattctaaaatttatatatatgggcagctgctgtgggtattttatttggttgaaattcaacttgaggataacctgctactgatcctcttagcttggttattcattgcctgcaaaatgcatccattatttttgtt

SEQ ID NO: 53224 - DNA, 1146 bp, Oryza sativa
tcacatatctaaataataattccggtgtcctcaagatcactacagaggaattatgtgggactattgtcaaattgtcactgcccccatgctattatggcactattaaaataaaccgtagaaaattacatgttaacctctctagaagcaaaaataactctaaagacgtgaggaaaacggtatgggtaggagggttattaattgatgatgtggtttggttaaaatattattctgtacttggatttatcaagatgccattctcgattaggggagtttcttaacaacaaaatacgagacttttgcatgattttaaatcttacattaacttttgcatatattcatttcgatgaagaatgggtatgatcctataaaattcctgtgaaatgcctcattcaataaaaaataaagacctgaaattttatttgtggtatctatctatcatccccttctcaaattttagtgttttattagtagctatccaaacggctattcctacgttaattttcatgttttgtaatgatctgttttgccattgaagtcttatgaatttttctttttttaaaaaaaaatcatcatgttcctgcgtgaaataaacaagccttagcaaatgtaaaatacaatggctattgattaggccttttattttacttgttactagtaagaaaaaacacaacacttgtgaaacatgcgaggcaaacatgaacgaggcagatgccatggcaacagaagaaaagagaagaaaccatgtgagtagccaacagacaaggaagaccaaagagtccaaaaccgatagagccaactgttgggaggaagcaaaaccaacaaccttggggagccttgtagcaaagaaacggcggcccacaagaagaaaccaaagcagcaggtggagtgaaacagacggcccgcccactggtttctcagtagccacagttttgctgacgttctcttttatctgtttgcttcctataaattctacgcgatagcttcccatttctcatcactgtctctcactctcactcccaaatcacatcctcaaattcagattcagagtcgtcgaaatcagtagtattcatcaggaatggagcggctgagctcatcggtgcagtcgtgggtggagggaacacaagcttcgccagcatcggtaagcaa

SEQ ID NO: 53225 - DNA, 959 bp, Oryza sativa
aaaatttaatatctacattctatgaacagactgtttttggtaaacggtagttggccttgggctaaatagacaattgtacgttgcgttccattaaaaggaaatcccatgctttctctaacttaattgacaaggcattctcttagtcccgtaggattaggactcaacttgaatgttctgaatgaccgactgttcactgtacattaatatgcacttcattttgtaacaaggacgtaaggccattttagtcaatgtactgaaacaaaaaagtgctaaatgcacctactacattcatgagttgcatattttgcattatcttttttttttctctctgtggagaacaaacgtgtactgaagaaagagagagagcaggagaattttaattcccctggctgtcttagttagcaaccaccactcattacaatacattagtccctgaaaacgaaatagccaacacaccatcctcctctctatccccctgtcgtcccaagcattcgtttttatagcctcaccacagctcaaaaacacaatgctagcgttgctgttcacgtcgttgccaagccacaaggagaaggaagaaggaagagaaggcagaaggaagcagcaggagaaggagaaggccagaagaaacaatggattgctgcgtgtgcagtcccatggcgtccatgtacaggcttccaaggaacgccatctgcgctgcgtgctatgaaggtgccaaggccatcatcgccttcttcaacgacgacgacgacgagcacgccgatgctgatcaaggctcggtgaagcccagcagattgacaaagctcaatagcacaaccaaggtaagaccttcccatatctcattttgctcctttattaattagtcctttaggattggtatgactatgttcggtttacaaccatctcgattgtgccgtgtgctctacttccatgaaaaatctagccttgcgtgtttctagatt

SEQ ID NO: 53226 - DNA, 2072 bp, Oryza sativa
gggcccaatgaaactacttaggcccagctatatacaggcgaccaggtcggaggtgttccgccacatcctcgccggcgacgacgattgcaaggcccccgccggggactttctgtcgctacgggagctgacccacgaggaggtctcccacctcctcgccttcctatacacgggctccctggcgacgtgcacggaggagcggcacctgcacgcgttgctggtcgccggcgacaagtacgacgtgccgttcttccggcgagcgtgcgaggcgcggctggcggcgggggtggaggcgggcaacgtgctgcggacgctggaggtggcggagctgagctcgagcgcggcgctcaaggagcgcgccatgggggcggtggtggagcacgcggaggaggtggtgttctcgccggagtacgaggagttcgccgtcaggaacgccgccctttgcgtccagatcaccgcgctctgcttgccaataaagcatttcccgccaagacgccttaatatcccttttatttttcttcgtttagaatttagttagacgacgtacgatgtataagtgtaattaaatgatagtacatgcatatctctggaattaatgtgatcaatatatacaatttagattctttgcacgaatatttaaacgacaaaacgccggtcttgttcattcagcacccaaaagatgagcaaaattttacaacataattaactgaaaatatagatagtatactatgtatattcctcacaataagcttgcgctgcggcagatgagtattaagtcgaaacataaagtactttttttagaactaaacatagagtagttcattgtggatcaaattgatgatccgtccatgcatttcttgatggcttgcagcactgcatgccgaaccatttgttcatccacgcttctctctgcagcttcactctgcaaatacaacaactaagtactaataaataattcactaaagagttagggaaatgctacaagacgatatcctatttggacgggataatatctcaggtggtgtccccccgttcgaacgggataccgtcctgtagtattcatcaagatttattatgtaagtactccctacattccatattataagttgtttgatttttaaagtcaaaaacttttaagtttggtaaagtttatagcaaaatataataatatttttaatgcaaagcggtgtagcaaacattggatcgaaataaatataatgctaaatttaatgaaactaatttgaaaatattgctaatcttttctataaatttggttaaatcaaaagaactttgactaaaaaaaagtcaaaagtattatcaacgagtactattcttccgttgtcacaagaaaggggccgggttaattagccaaattaatcaacgaaattacttaatctatcgatagataattagtgtggtacgtactttggctggatccaaacgcttcaaaacgaaatgcggtgtcatctgcgcacgacacgtcagcatcaaggacgtcgaggccaagctcctcgaatgcttctagcaccgacgtcagcaactcaggctgactcttctccatcgacacattgattcgaaaacctctcttcttctctagctctaccgatgaaacactcacctgcatgcatccatacgtcttcaatgctgcattaagttctttttttttcccaacttgaaggaagagtcacattttatgctatgatgagctataaacttaaagtatcatgaggagcagttgtggagctatcaccaccgtcgaacccagacaactaatagtgtttttcagtgatcgactgatttttataggtattagcggctatctacagtggagacggtagcaacgtagcccaagcgtggacaccgtacaagacttgcccgcgagctatctccgttgctgaagaggagtgatccaaagctatattcttcataacttagttcgctccatcggtgaaggcttgtgttaattagactatataaatttatcttttttaaggaaaactaaatagatttgcattattgttgtactcagtccaatcttaaatatttcacgtttaaaatataatttggataaatca

SEQ ID NO: 53227 - DNA, 867 bp, Oryza sativa
tcactttagcgcctagactggagttctagctcgtctgcatcttcatcgaaggactgcattctcctggcggagctgtgaggcacatcaaactctcccacagagcgcagaatttcctgctgatgtgttcacagcttgcctcaccacacccatcaaaatggcactgcactggttcgtccccttctcatgtttgattgttgtagacagaatttctcatgctgtatctgcatcaataatggttaatattcatgtatataaactattaaaatttaaaaaaaaaactattcaggttttgtaaccgatcgttactccgtgattccatggaacacaatcttatcgaccaaattcctggaaggcaaatgaccgcaaaactcttctaggggagttgaactgaattttcactgctatcacagacactattgcatggaatgttcttcctcatggtactgatagtcgttttagttacaattaatgccagtgatcaattgctttctcattcattttcttttaatctgttatgattcaactttcactgcgcagatctattccaaagacttttcaggcaggatcttttggttgctagtctctttcgcaacttcttacttgctgagagaatcatgcggtccgcaaattgttccccaatttcataccttttgttgccaccaactcatcagcaccatatgtggtaattgatggcactagccattctttttatagtttagctacctcttctgcattttctttaatttcctaaattttaattttagggatgcatgggacatggctgcagagatctgcctttctaagcttcctcaattaattgctgatcctaatgcagagtttcaggtgctattaaccgtctttgctttt

SEQ ID NO: 53228 - DNA, 1501 bp, Oryza sativa
  unsure (1)..(1501): unsure at all n locations
gcagaaataattacagttcaatgcatagatgagtactttgcattccttcaagtggacaacatttgcagagtaaaatagcaaggtctacaaattcaatattacccgtggacatgtcaaaggttgatcagatgaggaggaattgctcaactggtagtaatcagttaggacgatgaagcataacctaatcatagtgcacactgaagctctaaacaccataacaaacagaaaataatgcgctttcacaagttaggctaattgttgtgaaaaatctgcaacagactaggatataaagagttctatacattgcgatctcaagctgttgcatacccatgactcatggaatcatgcctaaatacacttacaaccataatcaaattcagacctagtagacgaatcacctgattgggaaggggaataccatgagacatgagaaacgaccaaatcatacaatttccttatggaaattaaaaaaaaaaaaaaaacgcttccattgtgccccttttcacctttcacatacagttgatatatgaagcttctgtaaaccccaccncnnnnanaaanaaaaaaaaagggggggttggcccagaaacacgttcagcatatagttggacagtacattcaacaacacaagtctaccgattacaaatatctgtcagagcccactaacatttttattcatctttcatanccagaagatggcgtncgtttctgcgcaccctcaacaagcagatatancnnggcttcacatacctgcgatgtgtctgcctgatccctaggttcctcattgagtgaggaataaaccatccatgcatggtccaacttccgctctggccggaccactactgatccaggaacttcagcatccttccttgtcacaagaccatcactcttctcaccataccttgccaccagaagttgtgagcatgctgccattgcagctgaaagtggcattacaactgggatcctagtaggattcccatcagctgcagctgggagctccaagtgtgcaacatgagagagggctgtaagcacactgggagtgatgctagcctctgtgtggaacgagacaatgggaacctcaggaggcaatgggttctgccgcaggaattctttcctcctctcatatgtcaggtcttccagagcctgaagatcaccctgaaggaaaaaaagaaaacaataaacatcagtgtcgtccattgtgcaggccgacaaggtaacgatcaagctcatcaagacaaataccttaaggacttttgataccaaaatctccatgagtttacgtaacctgacatagtcaccaagctggccttctcgcaagatatctgaagcaaccgggcttcctccatatgggctttgagctaaagccaaacctgcgaccttgtctttcagttgtggccagtaaagggagagggctgctgctgcatctacaccacccttgctatggccgagaagtagcacccgcttcttcgatccccagtatatttcttctatatattccttt

SEQ ID NO: 53229 - DNA, 1231 bp, Oryza sativa
cacgaaagctaaattttatattgcaatttattcttaatggacatcaaaatgacacgtgttttcatgcccaagttcttttagatgcacacctattgaattgattatttggcacagtgcataaaatagaaatggtggcactaaaaaaagagccagtcaatgatggaattgctacaagggcccttaacactttataaaggtcaagcctgccttggttattcatgaatagtgaagaaatggtatttggcgcttgtgtcacactatcacctatttgtttgattagaattcataggagacgaaaagacaaatgcaaaagcagtctgtacccttgaaacagtgaagccccattctggaagacgcgcaaaggtgccatctgttctgtgatttcttgagatgagcttccagtattatcaatttcaccaggagatgagtctgctgactgttcggaagaagcctgaaaagaggatccaccaacagttgacgcaggtggcagagttgctagttcttgcccttcctcagaaatagctgtgcaattaatcaaggagatgcagcagaattaccacattgggtgactattttctaatgaaattggcacaagagaagagagtcattcgtcgaagttatggagaggccaacctgtgtaaccagatacagggaggcactgggtaagatatgaggccgtctgggccagataagacgcagcttggtttaaagctgggacggagaggaagagctgtgaatcttcagtcctgtcggctgaatatctagcatcaacctagatttatcaataaacattaacaaaattggaagtagaaggcaagtaattgtgtggtgtggcaaacttttggcaattaaatgcatacatggtacaaccggagaacgcacataccgatgatgcagaagtagaaggctgccccagcgttgaaggcaaatcctccatggttggctctttatccatgagcggttgtactacatgtgaagcaacgagaatagaaaatgcaataagtagcgaagaggaagactatggaatggaatgcagcacaagttgatgagatggattggtagcgagcgtgtgaggaagtcaggattgagggtatctcaattactggtgggcaagcctaaagtaataaaggaagggaaggtatcccatccatcccccatctgatctcttgagaaacacgctcatatcgtttacccaaccaagttaacgagtactcacaaattattgattcat

SEQ ID NO: 53230 - DNA, 799 bp, Oryza sativa
aaatatgcatatttatttggatgtgacttttggaaagtatcatttaatggtaaaaaacggttattacaccaaaagttcaatcatagctccctgttctatatgtacctttcgaattgtttcagtgacagcaacagcaacccaagttggccataagcagggcaaccatattcaatgtggcaatgaatggggatgcacagatagcaactgttacaccagctatggtaaggatacgaccctgaaatagttgtttaattcataacaggaatcagtaacgaaatttcgagattttttttttcgaaatgaaagaagaaacaaaattagcaaaacttcctcagtcattgcagttttctaacaacttgttggttaggacatttttaaattatatggtttttgccaatgctaataagttgctcagtacttggaatgtagtgatgtagaacatgcaatacatcattttgactacatcgtaatgaactcttcccttcttttgacgatatgagatgcgaattatctcttaattggcaaactgaggaacatatgcgtgtatcagaattacatcagaattcagaaggaaaatctattgaaattttgacacattcttgtcttcaaaagaacaaagagattcctaataataggtcctgggggataaaaaaataaccctttggggtacccatgcctaacaatagatgtttaaatgaactgagcttctattgagccttccccaccaaaacaaaaaggagggagagcctaatgagtcaaaatgttcagtttgcaacatataaagctacttcaccatgac

SEQ ID NO: 53231 - DNA, 1537 bp, Oryza sativa
tttgcagcatgatcaatatacatgacatgaaaaaaaattaaaatccatacatccgtgcatatggtgtgtttagttgtaattggtctgatcagcttttttggtctcgtgagctctgactgtgctccctccaaatactcttaccttctctcatcacgggttctcatcaaccaatcatcccttccaatatcgatctcctgcagtcttcaatttaattctctctccccacagctagctagcgacatgtttctaacttctgtatatcgacatgcatacatattgcagattgttttttttaaaaatatactagcaaaaatatttgtgcgcagttgaaaacaattttcacgattgataaaaactttatcaatttaaatgacaaaccgaaacaaaacaaacaaaacaatgacaaaacaaagtcagaaatcttttatagcattgagtaagctcgcttcatacatcatcatatgaagaatccttcatgtatactgttctatagccttacatatcgattgggtggctattccataagttgacgcatgcgtattttgctataccttattgaccaaagattaaaattttaattattcaatttacgaaaaaatattgttggtggaaagcattcgcaaagtaacaaatttgcagcatacacatcttaaacaattataattttaaaagaaaaatatttatgaggagagaagtttggaagagaaaagaaaaagaggaaaatagagaaaatataagagattggaagaggatcagggaaaaagaaaaggagaaaaagaaaaaaaaatagttattctagactcacatcgaattagatgaggacgacctataactaacttaaaaactaaatgaaatacggatgacgtaccaaaattttgatataaataatcttcagtttttataatagcatagatatatctagcacatacttcagattcactcataaattaatacaacacaactagtattgagaacctcggcctcttaattttaagtttctggtgtctgtgctatgaaccactctcaattttatttttcgttatatatccgacatggcatatgttcatcatatcggacgcttgaaagtcgaaatcgacatgtgtgaatctaatagtaagcacaaataatcacatgtacatgttgaaactgtgtaaagcagccacatgatattcacattttgaattatggtagaataatagactgaaaatgtaaaatacaattaaaatttacataccatagtcttcagaaagggtgtttggtgtagtggtatgattctcgcttcgggtgcgagaggtcgcgagttcgattctcgcaacaccccttaatcgttttttttttctttgaagccctttttttttcctctctggaactgctctgaattcatcctgtgtgtcgactgctgttttatttaacgctaagtttggtgtacatcttgggcttgagacgacagaatataacattttgtcatcatcgatccatggcgctcgtgcatatagtgcagtgcgacagtaaacaaattaacaagagccgtagcaag

SEQ ID NO: 53232 - DNA, 721 bp, Oryza sativa
catcataagcaacagaacaccaaatctagacttgacctacctcccacaatcttctttttctttttctttttctaatagaaatagaaaacctcccacagtgttctcactgatttgacatttccccaggcctgactcaggaaagaacccaaatctcctcggacaaggttgaatctttaccaaaatgttgattgagtccagtgtagggctcaacatccacacaagaaaaccttcatgagtcatgacacagatacgcattgatccagcagttatagtatctcaggctcatggatgggacaatcgaacatcaactgatataaacgcactaatgtagtaatgctataacaagacaacgcgtgcacggaccaaatcaatcatttcggcgggacgaaattaacaatccccatcccaaaaatagaatcattatctaggtaggatcaaaagcgcgtagacgaggaaaaaaatgattggtacggacctaaatcatggtggtattcgtagggattgcgcatcattctcttcatggcggtgttgtagtcctccatcctagtgctccccgtcgtggaggagcggcacaggaaaaccccagaggaactccgccgccgttggctcctgcttcctccggcggccatcctgctcctagcagcgacggcgccgcgcgctgggagtcccggggtggccggaaaacacggggcggtggccatggcggccatgtttgcaggat

SEQ ID NO: 53233 - DNA, 881 bp, Oryza sativa
gtgctgtctttggaggttatcaggtgttaggagcaagttgctcttgccagcccgccaccatggattcctcgtgaggtccaacggcaaggaagcaaggagagcatatgattttagaagcaaatgttctttgttttttgcggggacggggatggtaaaagttgtgtccccgttgtgattgacggggaccgtgacggtgaaatttgaaccccacgggggccgggacgcgagggcaatcaccgacggggaattctccgttgccatctctaggcgctaggggcgattgatcgccccttagtaatctcgtgtattaagaccactcaattatgagtacattaaaaactatgtgtcagggttacggataaggaataccctctacccttggatatacgacgagtacggatatggtatacccgtacatatacggatagctccggtatacgttaaggaaatccatcacgtaagaaaaacagagtcagaagtcctactcggataggattgggtctttaccatatcgtgaggggtccgatatctccgagttctacttggagatcacctgatccgcgatataaaagggaccccctgggcagaacctaaggcatcgaatctgaccgccaacatatccaccacagcctacgaagtcgaagcctacaggagcaagacgccgggtgatctagtcgaatcaactcgactacggtctcgtcggtatcatcgagttctgttatttcctttgtaatctgtgatttccatcatataatcccataccaactggagtagggctattaccttccaaggggcctgaactagtataatccttgtcttttgtctgctgatgtcgtactacgtagatcctcatatcaacggaccccaataccctctatatc

SEQ ID NO: 53234 - DNA, 1166 bp, Oryza sativa
  unsure (1)..(1166): unsure at all n locations
aaagcaactgtacaaacgcattaggagtacaaagatgaatcaccatgtttattttagataagctttctcactctagaacaatcaacaaataataaattttattgatcaagtccctctcctccacaacttacaggtccagcatcttataacgcagacccggaaatttaatcctctacaaccaatcctcaagttttcacaaatcaaacgttttaaatgcataaaatcaaactaacccagaaaaaaattaaaaatntaaaacccctttcccccattgggtataatcaaacgaaaatttacggggattttacagactatcatgtgttaaaacccactttgcttgtataacctctgttacaaaataatcacccttttttggcnnnntnaagcagaagctannagatntntncttaatganttcttnctaacatttgcacgtggggagaaaaaatacaacaatactgggagtgcatcccataaacatgaaaaaaaactgccagctgcaggcagatgtaaattttccccctcactaaaaatcaaccctactacatttgaccaaatggttacctatccancactccttttttgcacaaggggagatttttatcacatcccgcggatcaacactaatggttaaacacaacacaagtgccacacagccagttttcatctgcactaccaaaccaatattagtaaatagcataaaagcaataacatccaccagtacccccgaaaaaaaaaaggaccagaaatacaaatagaagtatatagaatatccaaaagaagcatccagaagaaaacaaaaggtattgggacagatttctgaccaacgtagacagtcatttgaaaagcaaagctatttgttgatcagctacttntagataaaantgnccacaaccatgctcccattaattggtacatgggctctccatcatgtcaagtaatttagaatattctcttttttttttatgaatcacatgccacaaactgggttattaaagttcaacacaatggtcccccccccgcccttttttaaaagggaattaaaataaaaataagatgcaaatcccactagggacatcagtcatctgaagaggaaagaaatagtttaatcaacatgagtgttcttatgttggaaccaagcatttccacgatgtccaaaaggatat

SEQ ID NO: 53235 - DNA, 736 bp, Oryza sativa
tcctgtagaatctccagtgctttgtcactgtggcgatcttttcctcagctatcctcttgtactgccatgcttccatcctctgctcctccttctccttctgaagctttcgaatcattgacaaggctgcacttgcagaagttgctgaagcttctctctcctcttccaactccatgaataacttcttcatcataatgtactgtgcgaatattgctttttgtaactgagtatcttcagtttctgccatctttctcaaaggctctgattagtatatggtttactatttgccttagaatctattaaattcatctattgaacctgcaatatttaaaaaaacttcactttattctctgaagacatgcgaggattggatgaagctgaaaaaggaaaaaaaattggagttgattttgaagtgtaaaatcaactcagcctagaataatactgtcacaattcttccgcaccataaaaataatattaccgtacatatgattcctttctagtagtttggtgattatgtaattgtatatgtgatatcataaataacacaaatgagtttcagtttttgcacctactaaaacttaatccaggatgtgttaatatttctatcatagggtaaaacttccatccacattgtacgcactacggaagtcatatcatgtatcctataatgcttaaatttatgcccctagcctaaaatgtgtgatcctgccatgaagaataagagaaagagatgatatta

SEQ ID NO: 53236 - DNA, 1087 bp, Oryza sativa
  unsure (1)..(1087): unsure at all n locations
cttattctattccagccgccactagctatagctcggttacaacttataaaatactatagaaatatcccttggatgttttcgaatctgatgccgtgtttttttttcctttttcaatcatgttatgcgtgcacgcatgcagcgtcgtgggcaatccaatgatatgcgggagcatcagcggcagccatgcggggaacgcgaacgcagcggagtgcgccaccgtggtcgccccggtcaccgtgccattcccgctggactccactccgagcagcagcagcagtgagtccaacctcctctcgtcttgtctttgcattcttgggatcgatcggtttgggggatcggagggagtttaatcgtgttcgtttgggcgtatgtgcatgcatgcgcggtgtacgtgtgcactgcaggggcggcagcggcagcggtggggaggtcaaagggtggaggaggcgccgcgcggttgccgatcggagtagggacaagccttggcgcctccgcgcttgtgctcctcgccgtctcctgctttctctggaggcgcaggcgccggcaccgctgcctcctctcgggcccctcctccgtcctcggcatcctcggtacgccacgtccccatcaacaccagtactaaaatgcacgatcgatcagttagttaatatgtgagtgtaattggtgatttcagagaaggggagagacgtggaggatgggggaggaggggaggtgatggcgaggctggggaacgtgaggcagttcgggctgagggagctgcacgcggcgacggacgggttcagcgcgaggaacatactggggaaaggagggttcggggacgtgtaccgggggaggctctccgacggcacggtcgtggcggtgaagcggctcaaggacccgaccgcgtccggggaggcgcagttccggacggaggtggagatgatcagcctcgccgtgcaccgncaccttctccgcctcgttggcttctgcgccgcgggcttccgcgagcgcctcctntctacccctacatgcccaacggcagcgtagccttccgccttcgaggtacgttacgtacgcttaacgtgacacacacaacacagtggtagtg

SEQ ID NO: 53237 - DNA, 1164 bp, Oryza sativa
agttaattggatccatgccactgcaaatataacattagatccatgccactgccatccagttttctgtcaatctccgtcagctctctccctcttcctctccttgcttctcctccaccttggcgaccggcacgacgcacacgatggcgcgcgaggtgcgacatccaggggcggacgccgaggcggagctcaccgtcgaggaagcggcggcccatgcctactccaagagcccacggcgagcctcccacctacctccccaccacgtggcctacctacctccccacctcgtacgttggtgatggcaaccggcctcgcggctcacttccagtccgtccccattggcgatgccggcgccgacgcccacgctactgctggcgcacttcaccctcccaccgctcgccggcgaggacctcacctcctcttcgtaaccgccctccatggccacctctccaccatgctgtcgcccgcctcccgcctccctctcccgcttcctcccccagctcaccccactccgcctctcccgcctcatcctccacctcacgccctcgccccgccacgacgatggccacctccttgactccctcctgcaccacgccttccagacctcctccagcacgtcctcctcaccgcccgccttgccgttgttcgctccaatggcgccagtggtggcgtgcagcagcggtagaagttcttcgtctggtgcaggggaagaagctctccttggccatgctcgccttctgcgtcatgcacacccacggcctgctcccttgcgtcgagtcctgcaacgtcttcatcttcaccgcgctcggcctcaggctccccaagatcgccgagcctcgcaccaacgcacagcacccatccaaccatcgcctcccaggcagacaccccaccgtagcttcatcgccactgctgccaacgcccatctcgtctccccgccgagagagagaggaagagagatggaaggagaaggggggcaaagtgacatttcacaggtgagattagacagagattgacaaaaaaaaaactagacgggagtggcatggttccaatttccccaaatttcagtggcacgtagccgatatagcaaatagtagtgatatttttctaatatgccatatttgcagcggcaaggagcttatgcaaacatatgaatgatcgctccagaaa

SEQ ID NO: 53238 - DNA, 964 bp, Oryza sativa
tttttaaccgactagctatttgcccatgttgcttaggtaaaaattaacttggacaaccaaaaccactaaaagtttgaggacagaagatagaagttgaaatgtacagattatctcatttaagatgtcagcgctttttaacagactagctatttgcccatgtgttgcaacggatggaaaataaatatagtataagatctaagttaaaacacaaaaataatctaaaaaatgtatattatcatcgcataaattttttttagcactacattcgtacatgcatagatcctacacacaaatccaaggagacccatgtctatcgctggtccttgcgcagttgcgccagaaaaccattgattcagtttgacatgtggcaacacggttcagtgattataccaactttggttgtctacctgtatgattgtctctgcaagtggaatagttgaactcaagtgtaatgatgctatattttgatgagctaccacagaccagatgcaatacatgtccaagaaaacgattttctttcatttttttcctattttaggagcagttctacatcaatattaataaaccagataagtccaacataattttcaactaccgtacagaagacatgttataataagcttttaacatacctgcataaaattgtaacgctctcttccaattgattcattctcagcaatggaaaaatatgccagcattggatagtgcccaatataggatgcatagctatccctttggatgtttactgcccattcactgcaataaaagaaatcctcaatactaagttactacattcccaacaacacatttttgtttattttggaaaaagatatacttacaatcgattcaagtcagcatgccctgtgcccacatatttcgcttgaagatgctcaagttgagaatttatgttgaacctgtcgctagcctttaaagaagatgatttatcatatcaacatcatggtca

SEQ ID NO: 53239 - DNA, 797 bp, Oryza sativa
acatcatattccaaacagatctgcatcagttgggcagcacaaaaaagaaaagaaaaccacagtagtgagtagcatggtgatatgggtcagagacaactaacctgcatgatggctgacgggtttggtcttgatcctggacaggatagttgagatccctggagtcagaaccaagctaaaattaagagaacacaagcatgaattagggcatattccacagtaaacctcagtcacaaaacaattggtatggggcacaatccatatgaaaaacaaataccaaaagcacacaattgatacagatatgcaaataagaaaataaaaagttaagaggcagaaagtgcaaaactgaactatggcaaacagtatgccagcaattttacacttgccgatggaactggcacatgtgggatccatgattgccattcactcactcactcacaccaagcttgactcaataagaaattcgatgtgatcatcatgcagtgctcatcaaacttcttacaactatgtacagtattatcttttaaaataagtagtgtgcaccataaaacactattactaactaggtcgtccttctcacaacaactaatcactgaggatatttcttcatcagacagcaacgaaatatagaagtgtactgaaaggaaaaaggttttttttatataggcatagacattctagttgtttcattatgcttaggaggacactaataaagcagaactttccatctctcatatccaacacatcatttgtttgccgtacatacaaaacagggaaaggatcagtgcaagcttgagtat

SEQ ID NO: 53240 - DNA, 1449 bp, Oryza sativa
agcatatgcgacccgttgaagaaatactcgtcagttccccgttcgatgttctgtgtgatggtgatggtgttggggcgaggcggtcctcttgtgttcaactctgtctttacattctacttcctctatctcacattatatcacattataagatctatttttttacatggttttcaacgatataatttgattattaattatttaatattatgttatcaataactataaaattagtataatataaaatattttgaaatatatagtatgcataatacttagtataaatattgctagtgtaattgttagtcaaaatttaacgagtttgattttcatagaaacaggagtgctctataatttgagacagagaaaagtatttgctaacggtgacatactagtgttggcatctcgaacccaatatggcagagatagaagagaatgcagagagagggagatattgcggcgaaaaacttgcattacactctatgtattggaaaataggcaaagagttggaggcgaggaggtgtggcgtggcaatagaggagtcgggtgattcgaattttgagaagcccagtcgtgatcactgatggaagtgtaggtagtggaagtagtggcatgaggaaaataaaaaggtgtaagtcatggacggacaattaggagcattgtctaaagatacacagatacacatttgtctaggcgggcctctttatgaccatcttatgtgtaattttcacgtgcattaccttaagtggcacacctatgctattagacattaatgtgagttgttgcctaagacattttgcctgtggcacacctatgctattagacattaatgtgagttgttgcctaagacattttgcctgtgtaaatcattgtaggcgaaattaatgtacgttgttttcttttagcatcatattagtagtccaagcctccaaggtagggcctatgaaaattcttctttttttaagtagcgatcgtccaagatatggcaacttaaagcaggttcttttctcttaaaaataaagatgaaaattaagtttttttacgcaaaacgaggtggtattaacgtatgattggttgagttttaattattacaaacttgaaaaataaattaatatgacattttagagcaactttcatatagaaagttttcaccaaaacgcaccgtttagcagtttgaaaaacgtgccacgaaaattttaatcttcatccaactcttgttagaaaaaagaacatggcttactctggtaggactaccaggtgaaaaccttatcttggtcctccttgagacctcaatagacggcgacggtggtgctcatcatcgttcatctcgctggagacatcatctaggtcccttgccaaaacttccctctggcagctgatgcaagctctttctagttgttttatcctcttgcaactgtgtcctagcttatgcaagttggccacgttgacggg

SEQ ID NO: 53241 - DNA, 752 bp, Oryza sativa
agggtggtattaactatcaaatgtcaattataagaagtacaaaatcatggtccattgaaattaggaataacaaggactaccactagtaatagagaccagaaggcaaattgcttcccagtacagatgattcacatgagacacttttttagtgaaagatgcacaaaacatatcaaatggcctgcttagtggctagtcatatttttgcactacaagctaaatcaaacatagttaagcatgcatggtcaactggattagaaaacaaaagaaattgagtaagaaacaactcaacgctaagacaagtgggtggctccgagaatacaactaatatttgggaggacacaaaccaagttttcagtttatgtgattcagtgatcactgaggaacaacatagactattataactagaacactacagtttataaagtggatgggggaacaatcttgaacatggaacattatctattcgtaacatatggataatcgattaaaagttttggaaaggggacaaaaagcaaaaaaaaaaacaagataatcacagacacatggctcaccgaattaaaagatgcattctcttcatctgctgtcctatcccatggaggtcgataccattcctcgatccgatctttcacaggcactctaaacatggatgctcctgcaggcattgccatcggtcctcctaccaaagctcaccatgaggcgaagggaatgtgtcaccgcggaccggctggaagctgacggacaatcgcgagggc

SEQ ID NO: 53242 - DNA, 1093 bp, Oryza sativa
atgggcttataaaaaccaatgctggaaaataaataatagtcttaaaaattgaaatcaactttagagaaggacccttcttgttctccaacaaaagttggattaaactttggatactcgtgacacacgtttttcaaattgctaaacggtgcgtttcgtgcaaaaactttctatatgaaagttgttctaaaatatcatattaatctattttttaagtttgaaataattaaaattcaattaatcatatgttattacaacctcgttttacgtgaaacacttaatcttcatctttatctttatcttcagaacatttaaacaccataaattttacgatcaaattttgactatggagggtaccatgggagaggaaacatacggatcccacaattcgtacagtattgacttctcaagtcatctgcttctacagttccttgtaccaccaccttgttgttgtgtcctcggccgatcgagaccctcgagaattcgtttcagctctgatttcgcggcgtcatcgatgctgcattgctgcgtgctacagccacgcccttgcacatgccgccctggtcccgtcgtgtcccgtggactgtagcgacgacgtcccactcgatcgggcaaccgccacgaaagcccaccaacgctttggacggaggcgcatttacgtgccgcgtgagcgggcccgtcgtcctcccgtgcacatggcacgtgggccccgcgcgggtcgctcgctactacgcctacgtgaagttgctggtcgccgcagcgctggcttttggtgttggtggtctctggctgcaatgcgtacggtacatgggagggaggttgagctgcaatgcaaaggcacgtatggttgttttaggccatttctaatccaagacactagacatagtttaaataaacttcacattattaagaaactagtactagacaatatttttctaatgcaaacaccactattccacacttaaatttaatgctacttatcccacatgatgccttggatgttgtatagaaacagtgtctcatgcaagacatggtttccttctctttcctcatttattcacttgccacatcattttttatcttatgtgacagctta

SEQ ID NO: 53243 - DNA, 792 bp, Oryza sativa
acatcgctcatccaaacatgcccttagtttgtaagggggtgtttagatctaggggtgtaaagttttgacgtgtcacatcgggtattatatagggtgttgcattgggtgttcaggcactaataaaaaaaactaattacagaatccgtcagtaaaccacgagacgaatttattaagcctgataaatccatcattagcaaatgtttactatagcaccatattgtcaaatcatggaacaattaggcttaaaagattcgtctcgcaaattagtctcaatatgtgtaattagttattttttagcttatatttaatacttcatgtaggtgttcaaatgttcgatgtgatatggtaaaaaaaatttagagtgggatctaaacagggcttaagtaccttgatgtagatgtggaaaaaagctcgaagctcgtggtttggattggctcatggtgagctactgagctcgactctgattgactcaaacccatggtcttaatgagttgagccaagctagaaatttaactcttgagcttaatgaactagcttgtgagttgctcattactacaaaagatcaccacatcttcatatatacttagtgtttcttaactagcgagtagtgactagtccattagttacatcaaaactatttgtattttgtgaattcttcactagtgtttattattaagtttatatgttgtaaacaaataaattactaattataaaggtgatataaatacgttaacaagcttgacaagagccagctcatgattttttgctcactttttctctcacttctgtatt

SEQ ID NO: 53244 - DNA, 997 bp, Oryza sativa
gggcatggtccccaaacatcagaatgtattaatatgaaaggctcacagttacgaagaccaatcccaacatatgtagaccgagtatgttttccaagctcacaagcatcacacaccaatctatgcttatccactttactaaagagatctagatacaacttactcaaaatctcaaaagatggatgtcctaactgacaatgaagcaaactgatctccttctcaacatttccaaccaccgcagctagccccagttcctcatgattgatgtaccacaacccatcacacctgactctagtcccaatcctcctcccagtccccttctcctggaacagatgagagttctcatcaaatacaacaatgcacttgagttggtcaatagctgagctaactgagagaaggtttactggaaaggaaggaacatgcaagtcagaggataagtttattgatgatgtgcactctactgaccctataccatgaataggtttggatgtaccatcagcgatttggatagtttcaaagtggacataaggggtgtatgatgtgaaggtattatgcaatcctgtgaaatgctttgatgctcctgagtctatgatccaatctataggatgtctgtatgtaaatgcaagtgcctgtgcctgaataccttcgcccacttgagcgtagttggcgaagtaccaaaagtgagtggtggtgttggagctctcattgatcttgttcttctgccattcctcccactgtgtcacctgttcacctgttaaggtaatagctttaccctcctctatggctacatggcatgaggagcacttcgcccctaccacgaccttcaccaccacgatctccacaacgacctcttctaccactgtggttccccccaaagtaaccagggtctcatccaaatccaccacgggttccaccaaatccaccataccttcctcgaatcaaccccctaccgccaatgttccgagaagtgggacaattgagctcacatgacccacttgtc

SEQ ID NO: 53245 - DNA, 2216 bp, Oryza sativa
ggtgtcacctatctaacaacgacacccaatggctacctttttgataacgcaagctgactcagataagaagaatctattccattgtaaaatttatactatttcaaagctttttacccgcaagatagatgactgattaccagtttaagaacattttaatgcatacatatataacaaagtcacaaactacttaccataagtacctaggtagaggtatttgttgccgaacacacgcccaatccgagcctcccatttgccgttgtgatgatgcctgaataaaacagctgttaattaactgattctactagcaatgttcagtagaaaactggaaccttcagtgtagattagtactgattaactaccttgcaactcctctgtacttggacacccctcttgagaagccactgctcttcctgcagggtgaaaaaggtttatgatcttaatcaagaagaactacttcaaaacacagcttctcagacatgaatattcactatgtctgatcagagaagcatatttcaatgggttttgatttggatttttctgaaagtttgtaatgatctgaattaacttctctttgttgaaagtcagtggtaacatggggttaactgaatatttacctcggagcgatccgatgtactcttccctggactgcccctccatttccttcaattcctcgtcatatgttgacagctgcagagagttccaacatgagaaaaacagcaacaatcttcctcagaaaaccaaacagaatcaaacaagctgcactgtgcgtgcatttcttgaagggttccgaagaacgcttgtgcagaggattcagttcagagaaagatgccatggatttttggagaggcgtatgccacgtacagggaagttgaggacggtgtcgtggccccagtacttcaatgcggcgaggtcgtaggcgcgcgccgccgcttcctcgccgtcgtaagcccctgcaacgccggcgcacagacagtgaggtggtcagcaaacaatccttctgcgtggccatggattttggtttcagaatgttcagattgggagctcaccgaggtaaactgttcgtccggccacgccaatccgatcgcaaaatcagagcaacaagagagaacgcagcgaaatcagaatgagcaaattgtctgacgagcagctcgagggatgcaactataaggtggattaatggagtgattggtgatgataccttgtctgcccttcttgctctgcgactcgttccaggtgttcttgtcccagagatgcgcctcgaaccgcccgtccaccggtgcctgcgcgccaaaaaaaaaaaaatccaaaccacaaacgctgtcagcccagtgcggcgaacgtacgccggtgagaaaatccggccagccaacgcacgcaccgtgtgacgccgcggaacgcggagctgcgctgggaggggcaatcccgcggggcgctcctccgcggccgcttctgccgccgcctcggctcaacctcaccgccgccgccgccgccgcagacgccggcgctacagtcgtcgctgctcgcggcggcggtctcgccgttgctgcgtcgcttggccattggcgaagagcgagcgcgggaggaggagggagatggtatatatggaatggtggtgccaaccagaagaagatggcagcaggagaagagagcttttaaaagagccggagctaaataaatggcggcaaagttgcagccgccggcacagctttaatatgctcgctcgcgtcgccaaaatggaggagacgaggcgagctgagctgaccggcgggaggaagaagaagaagaggaaacagagagagggagtgaggcggctagccttgggttgcagtggtttctctctcctcagctgtgtcctgtctctctctctctctggatttaccggtggcagtgttgcggtgaattattgacttctttgtcccaactccccccaatgttgctgaaaaaccagccacaaactatccgtcctataaaaaaccaacttactaaatgtgacacatcataatattatgaatctgaacatatctctatttaaatttattgtactacagtatgtcacattcagtactagatttattttttttagacgaagggagtagttgctaaactctctgaacagttaaacctgattaagttacagattttattttgatttttattaatgtattttttaaaactgtaaaatggtgtattttataaatatctcataaatcgatttt

SEQ ID NO: 53246 - DNA, 1265 bp, Oryza sativa
tcaagtaggaaaatttcctataggatttgaatcctataaatttctagataaaccctttgattcaaaggggcccaacatgccgtagcactttggtcgctttcgtagtgcagctgtgagcctgtgaaccaacacgtgtgcaaaatgaaatgtacagctgactgccgacacggaacacctgtccgaatgactgttttatatttttccgactgaccacgtacacttttcacatagattattttgttaataaaaatgttttacatcaccggtctttgttatacggcacacaaacagtggtatttttactgaataaaaattatgttgtgtgatgggaaaaattctgaaagagagagagagagagagaaaaaaaaggccagctaaaaaggctacgaagaccagttcaattatatcgagtaagggcccattctaaacagagtttgaaactttgaaatgagtttataagccatacgcaaaataagaaaaaatattactccattagataattaattaaatatatttactgttataaaatttaaaggttaatatttttttaaagaaaaatctttccaaagaaatctttatagaaagttttctttttgagaaaatatagtgtttaattatttgggaagcgtgtggtcgtagttgcgagtaaatagctcccccgtaagctcaaacatactccctccgtcccatcccagaatataacaacctagtaccggaatggacttatcctagtactactagtctatatagagggtatgtgtgctgtgtgcctaagcctacaaaaaattttacgtttataggacaacgtataaatataatcacacatgagtgctaactttaattattcaataatcaagttctacaagtatatgcatgagtatacccaagaaacaagggttttgattattaattcctccccgccatccccttctcatataaattaagatgatgttgtttataataatttaaattatatatggattggttgttcaaaagccgtggtttatgagaaaaggaaaaaaaaaggtaatatagttaatcatctagaggtaaaactaagaaactaaggtgacatgactttataagacaagaaaagaagaaggaagataattaaggcgacatgactttataaaagaagaaaatgaggaagataattagaccataaataattaagatgatatagctcaacgagagaagagagaaatggcattaactatatttagtgtgataaggtaaaaaaaattgtctctgagaaccgtaaaact

SEQ ID NO: 53247 - DNA, 763 bp, Oryza sativa
actgtgatgcttcattgtgacaataaatcagccatcaacattggaaacaaccttgttcaacatgatcgcactaagcatgtggagattgataggttctttattaaggagaagattgatagtggggtacttatgctagagtatatcaagtcatgtgaacaactagctgattgtctaactaaggggttaggtcctagtgaaattcaatcaatatgtaacaagatgggtatgattgatatcttttacccatcttgagggggagtgttggtgtaaataagtgatgttcctaggacccatttgtaaatgttaagagaatataaaggaggagacgtgggaacaggggagtaaccctgaaaaaccccccaaaattagacaatatcccctctgccaactatatcttcaggtctgcaaccgcatctcagttgtatgcagtaatgcttatgcacggagcattaccacgtttgaactccttcctacgttctgttggtgccttctaccccggaagtgattctccaagtcagatgcagatgtgcaattagccttgcaagtgctgcaactccatcttggcacaaacttttggttcttttcaacaaactgcgccacttcctttgcatacacctttgcttccatttccttgtcttctctcttcagggcttctaagttttcttggtgcctcctacctcttaggtgagtttttaagtccagttcacttgaacaattggctttgcaaataccataattccatgttggtggataatgccgtgtg

SEQ ID NO: 53248 - DNA, 2379 bp, Oryza sativa
ttttcaaaaacaaagaactcgcaatgccacacttgctgacgaagatcatgatgaatcaacaaatggataggatgcggggcaaaagatttagcgagattagtgctgtagccttcccgtgatccttgtagctctgctttcctctctgctccctcttgtctatgcgtctcctctgttttttcttttggtcctttgtttctcaccgttatcggtagtgttgctgtacagtttcctccccttttaatataaaaccagcaaagctggctcaggtttcataaaaagaattaccatgttcatatttatattcggttcattcaatttaatctaaagcctacaaagcaaaaaaaaaccggtttccgatgttggactggactgtcagtgactatgctggtctggcgaatgtggccggggcacagagccacagattgtggtaaactacggcctgttgaattaagcccatatcgaactgggcctggatgtcacggccggcccacttttttccagtccgaatctctgtcgcggagtcatcacttctgtggtaacactggtactccgaggagaggatatcgcggcgcctcggcggtgcgaactccgaatcagaacgggagtcgaattgattcgtgaggatataaggcgcgctcggggacgtagcagccaatcaattcgacgtgtgattccactccacagcgcgctctctcgtctccggttcgcttcgccgcacgtacaactgtctctctcctttgtgacatctcgccaagctagctagctagccatggcggcagcggttctcccttcgctgctcccgacgccgcccgcgagcaagttgccggcgctgctcccgaccccgctgaggagccagatgctgccgctgctcccgacgccgtgcctcatcatcctcccgcctccttccgcgcgccgccggtctccgatcccaagcccggccgcgccgacgccgtcgagaggtgggacgcacgcaagaaagccggcggttcggcagcgtcgtcgtcgtcgtctagctccagcagcgggatcccctgccgcgccgacgcttgcgaacgctgggacgcgaacaagaacaagaaagccggcggctcggcagcctcgtcgtcgacgtcgaaggccagcggcgggatcagcccggccgcgccgactcctgcgaacgctgggacgcgcacaagacaccgggcagccctgcgtcgtcgaccggcagcagcgggagcccctgccgcgcggactccgtcgagcgatgggacagcaacaagcggccgctgagccgcgcgtcgtcggccgagcgctgggacatcaacaagaagcctcgcccaagaaagacgctgtcggcagcggcaagaacaactccacaagccagacgacgacgatggtgaagcctccgcagccgttctctcaattttctggtccggccttcttcgcttcgccggatccgggcatgcttcccattccaccttcttgttggctcactagtcactagtgtggttcctgtcgctgagaatgcttgcttctagttcaacatgggtgtcgtgtgtaagtgtgttcaggttgtagagattggaatggtcgtcgttgcatgcatggtgccccggccgcatgctttgtgctcaatcagcactggaaatttcacacggttgtgttagcctaattgcagttgtaatgttagctagataaatcgaattaatggttttgaggatgaggctgtccttgtatgatttgttatattttctgttggaattaatagatgggctaaggcccatttgaagattaattctttagaaaatcacaaaagcccacctcataagatggcatgcatgtggagtttagtaccaccttgcttattctaggagagggggacctcctaaaaagggaggatgccctcctagctacttgaagcatgtgtggtggagagaagaggggaaacatgcgcttgctcgccatgtctggtaggcggaaaattggttcctcacccttgcgcagatgcagcctccttttgcagttttgttttgctgcgggaaattcggatttgttttgttttgccttttgcagttttgttttgctacgggaaattcggatttgttttattttggaaacattccgaaaaatccggtgcgtgaaaacgtccttttgcagttttgttttgctgcgggaaattcggatttgttttgttttgccttttgcagttttgttttgctacgggaaattcggatttgttttattttggaaacattccgaaaaatccggtgcgtgaaaacggcatggagtccggataggttacgcgcgacttatccggttcggtttacgcgggcgccctgatcaggcgatctatctctatataaaccgagccgccgccttcacgcaacacacgcgaaatca

SEQ ID NO: 53249 - DNA, 783 bp, Oryza sativa
  unsure (1)..(783): unsure at all n locations
catgttcctttatattgacttcatctaccaagaatctgaatgtcccccattgtctttgggattagggccttagttttccccatcagcggaattgagagtttgaggcccatctaggcgaggtgttattgggccatgccgcctctttctccgccatccagcccagagcccaatattgatcgttgccagtgcctgggccgcctatcggcaattggcccatcagaagcctgcggcccggagcccgcacgagcacacgcagccgcatccggcccagcaaaaacactactctcgtaatattgtgggccgtggctcccaggtcgggaggtgagtgggccgtcgcgcgtgattctccgtcacggcccaatactgggccgaattcacaccattgttcggcccggcctgctcgtatggagagtttttttttataggtgaagtatttgagattgtgattagactctctccgtccttaaaaaaaattacctaaaaggaaatatgatccattcgagtgtaacaaatctgaatagcaaattatctagattcattatattagaatgtattatattcttatttagaaatatgatccattcgagtgtaacaaatctgaatagcaaattatcttgattcgttctattagaatgtattatattcttatttaggttgagttttttttaacagatggatacccttctggacccaactcaggctatggatctctaaggatggtggtggttgcacctcgccannnnnnnnnnnnnnnnnnnnnnnnnnnnnnnnnnnnnnnnnnnn

SEQ ID NO: 53250 - DNA, 2148 bp, Oryza sativa
  unsure (1)..(2148): unsure at all n locations
tttcaaaagtttgagtacgagcagtaacataactacttgttaattaggaatagtaatatagtagtagtattagtttctgatgcttctgctgacgctatatatgttcgtactagtcttctgacaccgtgtttagctcaggatggcgtgttactagagttgctggtattagtgttttatctatccaacactgtagtttgtacatgggatgagcatattatgagttaacgatcacatgatattagtatatttattgtctatctttatgaccagagttaggctatactatcatcgaagtcacttccttatgagaaaatccattatattgctctgagtttgttataggtatatgatttgccactgattttctcatgttctacaatatgatatcgacttttacgtaacttctacaatttactatcgccttccggttagccttcattagtaatgtacatttttgtccaaacgacaaaaatctccttgggacaagaacttccaaaatttgaaaaataattcagaaatattatattataaacataagattgtaaacatcaaattttttttgccaaaatttggttaaaaatttcaaaatatcaaattttaagttttttgccaaaatttatatgtttacaatcttatgtttataatatgatatttcaggatttttgtccaaattttgaagttcttgttctagggatattttgatcatttagataaaaatgtacagtactagcgaaggttaaccggatgacgatggtaaatcgtagaaattaagtaaaagtcaatgacatattgtagaacatgacaaaatcagtgggaaatcataaacttgttgtaaactcagtggcatataatggattctctctatctttaaagaaagaaatgtgtctgtatactactccttgcctccttggtatacgtgttttaatacagtgctctaatgggtgtgtttggttccntgcatcgcacctggctcgcatccacgggtgcaggcctgtggtgtttggttgcctgcacggccactctagcctggctccacgcgtgcaaatcgggcttccgagccaggcccgagagaaacggtcgatctgagattcgctcctcatccgggctgagcacgtgcaggcgggggacgcgtgggtgcaagctcggggacgcgcaggtgcaggaggcgagaggggttccagcttctgctcaccttcccatctcatttgtcgctcggtgcctcccgtctccatcgccgcaccgtcgtcgtcatctccatcatcgtgccatattcgacaaagccatcgaagcttcctcaaccagaaccgctagagctcctcccctcaaagccgccgccgccgccaaatccagctccgcttgaagccatcgaagtcgaatccggctcctaccaaagctaccacttgctctccttcatccgaatccagatgtgacgacgagagagggttgtcactgctgacgcccggatcttcctcctagtcgccgctgtcaccgccaccatcgccactgccttcgtctacagctgctgcatcgggccctcttcctctccttctttcgtcagatccagagcccaggagctcgatctagtggcctcaggcttctggttgccggatccggacgcttcctctcccttcttccatcagatccagagcccaggagctcgatctggtggcctaggcttccggatccgaatgcttcctctcccttcttccgtcagatccagagcccaggagctcgatctggtggcctcaggcttctgattgccggatccggacgcactgatggcggcgaatcgtcaggatcccgctactgccggatctacgccctgccaccgcggcgtagttggctgtctcggcgacgaggccacagtcacctgccctctttttccttttatttatttgctgttttttctcaccgcttggatgaattaattgaacataacaaagttgatgcaatactgtagcacccgatatggttcatatactattttattcgtcagtgcaagaaatccaatgacttgattttatatacagggatacactgactaatacaatcctatgcatatttcgcatatgttaaaaatcgatatcatatactgtaaaaagatcagcgttgagatgatagaaaatttcatccattagttatagatgg

SEQ ID NO: 53251 - DNA, 1082 bp, Oryza sativa
atgttgattactaataaataacctctcaccacatgaaggtggcgtcgggcatgaccatcccaacggacccttcaggtacttaccactgcaggccgattccagcaggatactccaaggtcgaagttgagttggtcgaaggcgcgtacgaggacctcgaactggattaccctggaggagacggtgagacgcatctacgagacacaagccatgcaattattctatggcgcaggctgtacatcatcctccctgggcgacaagcggcgtctcgtgcaccatcttctctggctccgccatctcctccggctccgccatctcctcctcaggatcctgcaccgtctcctcctcaggatcctgcaccgtctcctcctcatgctccagcaccgtctccacctcaggctcctgcaccgactcctcttcaggctcctgcaccgactcctcctcggtctcctacaccgactcctccgcaagctcctcttccggcaccttcaaagtcaagggccccccaggctccaccgcctgcccacagaagggcaacgaagaaggcaaaaattgacgccgccaagaacaaggacccggggtacgattgcacacaagaggagcttgacgcttacatggcatcagaagtcaagagacaattcaagcctcaaagtccagaaaagaagattcctatagacccgagtgtcatgaacttcttcaggggtatgtctgcacctgccaaggaggccattaagctatcggactatgagcgaacgctgaagaaagcatcttctggaaagtccaaactagtccctcagcttggagagcaaccaaaccaggagatcgagccgttggtgaccggtaaagaaatgacgatagaagaatttattactgacaccggtctaactacggatcaattgctaggagtcacaccaatcgaaaaggcggaagtgaaatacatgtacgaactcggtaaaccgcttgtcaagcctgagctgctgcagtccctacccacacaaatgtacaagttccatccgctgtacatggagatgagcgccaccggtagagagatgatcggagcgaggatcagggacacggacttcttg

SEQ ID NO: 53252 - DNA, 4884 bp, Oryza sativa
aggtccttgtatataagtagactatagaaaataatatactgccttttatcgttgtagaatggagattcaaagggcccgacggcggggggttttcgatactggattcatcgaccctcggaaagtaaacgtcgcaatgctcgaccaatatccacaagccacagaggacaatctcgtccatctcctgaaggcgcagcattacaagacgttcatactgttgccgtacaacatagagttagtttaatttacctgttttcctataccaaatttcattccggtacgaacttgttaagtgtttcatatgtaatgcatcccacgtacattgcagattccactgggtgcttttactcttcgacctgtcggcctgcaccgtcaacgtatatgactcaatggataaaaaagagtctacgtttgacaaggttttcgaacttatagacaggtaccgtcataagttcctctgttaattaagaaaatcttgttatgttaattgctactatgaatcatagctttaaactccatgtagggcttggtatcggttccgtcatttggtccgggtaaatggagagaaagacttaggcggaagttcaaatttcctgtgagtacacatgctctacatttatatttctccgattcaaatacatacaagtgtatattaattagatctctcattgtttgtcatttattgtagtgcgcaaagcaaaagaagggaactaacttgtgcggctattacgtgtgcgagtattgccactgccttgcagaccaaatcatcaccataagaaagctcaatgtacgtacaaataaattcaaaatttcattacgtatcgatttcttgtttaattactaatcaatttcatacattcatatagtttattcgcatgagggataacctgaccacgcacaaggaatttatcgcggcggttcaagaacaactcatgggattcatcaacgaacaaatccttgatcccaagggtgaattctactacgacggaaacacaattcataggtccttagcttctgagctagcgactactactacgtcgaaatcgtagctagctagaacatataatggattgtaattaatacatgactacatatgtttctatatgcatgtgtacacattttctataatgtaaatatattttggtcatatatatatacatatgcatttgcataacatatatatgtatatatacatatatattatgcacatgtacatatgtattatatatatatatatatatatatatatatatatatatatatatatatatatatatatatatatatatatgtatgtactgaaacatggtttatatatatatatatatatatatatataaaccatgcagcaacagggccatgcaaaaaaaaaggtcagctcgatctttagtcccggttggtaacaccaaccgagacggatgagccatctttagtctcggttggtaacccaaaccaggactaaagatcgatctttactcctggttaggtagatgcccggtttgggttaccaaccgggactaaaaatcgatctttagtcccgattatttcacccgggactaaagatagcgatctttagtcccggattggtaatcccggtttggaaaccgggattaaaaggggttataaaccaggactataaagggtttctccaccagtgtatcgcccagtcctaagctaagtacgtctccgttttatctgccgtgcgtagtgtatttttttcttttagcgtcggtgttccaccgtgttagcttgaagccacgcgaggcgtgagtgacacgagacccagagcagctgaccggctgcctcgtctaccacattaatctggacaactggattataagtaagatattgagtcgatactgaattactggtggtcaactgtttaattgcacacatacatgatcaattgaatataactatcatctatctattatattattaaaagaataaaaaaatgagcctccacgttcgctctcatggcctagaaattctcacgttaatcggagaaaaagaaaaagcagagtctatatagaaatacaatttagaaatagctgaaattcggaattaaaaaataaggaatattagaagaggagactagagtccatatagaaatacaatttagaaatagtttaaattcggaattaaaaaataaggaatattagaagaggagactagagtccatatagaaatacaattaggaaataactgaaattcagaattaaaaataaggaatattagaagtagagtatagagtccatgcagaaatacaattaggaaataactgaaattcggaattaaaaataaggaatattagaagtagagtatagagtccatatagaaatacaattaggaaataactgaaattcggaattaaaaataaggaatagaagtagagtatagagtccatatagaaatacaattaagaaaaaaaatagatattcggaattaaaaaataaggaatattagaggttgagtatatagtctatataggaatttaaaactaactaaaatttggaatgaatataataaaattaaaagtagagtttagagtccttataaaaatacaatttacaaataactaaaattcgaaattaagaaaaacatgggaagaagagtttaaagtcaatataggaatacaatttagaagtaactggaattcgaaattaaaaattaaagaatattgaaagatgagtttagagtccacatagaaataaaattagaaataataaaaattcagaaataaaaataaataatattagaagaagagcatagagtctatatagaaatacaatttacagaaaattcggaattaaaaaaaagaaatacgagtctagagtacatataagaatatatataatttacaaataactaaaatttgatattaaaaataattaataattaacacgtatataaaatataatatgaatattacacattagtagttttgtaaagttattgcaaaatttaaaattatgttgtcattttaatatatttgaataatataatgataaaacatatatgctattatatgagagaaaatataatgatgctagccgcgcaatctacgtagctcacgatgctagttaatataatctactaattaaaatagtcgattgaataaaaataaatttaaagccctaatttacgtttcgttctggggcccactgatctcacctcggtggaatcgggctcggcggcgagagcgaactcggtcggcgccccctcccattccacctgcgcacggcccaagcgcggggcgtggccggcgagctcccgtccattccctcgtctctctggataggggatctggaaaatttgctgctctcttgatcgaacggtgaaactttctcaccattcatccatccggcgaaacttccactgatgaatcggacttcccaaacctttccacgctctcgctccaaatgaccaaaagccagaggaggagggtttcgcagcaacaacgtgggcgcccacggcccgcgcccggtcagcgaggaaacagatcgaaaaaaaacaaaagccgctgacgtcacgatctcgaggctcgcgattcccaacaatctctttaaaaagcttcctctcgccgaatccccctccacctccaccacccgccgccgccgccgccgccgccgccatggcctccgacctgcgcccgccggagcaccaggtggcggggcaccgcgcgtccgccgacaagctgggcccgctcgtcgacggcgaggggctcttctacaagcccctccaggccggggagcgcggggagcacgaggccgccttttacgccgcgttcaccgcgcacccggccgtcccgccccgggtccggggcgccttcttcccgcgcttccacggcacccgcttcctcccggccccagccagccccggcggcgcgccctacccgcacatcgtcctcgacgacctcctcgcgggcctcccgtccccctgcgtcgccgacgtcaagatcggcgcctgcacgtggccgccgcgatcccggacccctacgtcgccaagtgcctcgccaaggaccgcgagaccaccagcgcgctcctcggcttccgcgtctccggcgtccgggtggtcgatgcccggggcggcgccgtgtggcgcccggaccggtcggagctgaaggggatcgacgccgccggggtccgccgcgtgctccgccgctacgtgtccacgggcggcggcgacggcctggactgcgcgctcgccgccgcggtgtacggaggggagggcggcgtcctggctcagctgcgggagctcaaggcgtggttcgaggagcaaaccctgtaccacttctactcggcgtcgattctgttcggctacgacgccaatgcggcggcggcggctgctcccggaggtggaagcggcggtgtaagggtgaagctggtggacttcgcgcatgtcgacgatggggacggggtgattgaccacaacttcttgggcgggctctgctcgctcatcaagttcatcggcgacattgtcgccgaggttaccgagaaggcgtcttcagatcattcttgaaaattttgtcagcttggagatcagatgattaaacggtaaagcaatgcccctctatgttttgttctttttgttttgttagatttggatgacaatgttagacattgagtcagtaaacaaaaggaggatgtaaagcaaaacggcaaatctcttgtgtcttggattatgttctatactgatggaagaagattaaagtataaccagaaaaagtgtcactgtggtctgggggatgcatgaacttgaaaaggagtagaattaaatatttatttaatttattgcaagaaagagtagtagtagaatattgccactttaatgaaagttatgatgctacgaaacaaagaattggttgctatgcatctagagaacctg

SEQ ID NO: 53253 - DNA, 1929 bp, Oryza sativa
cgatggcgacaaagcaaggtggcctcgagacaactcgagatcgatcagcgtgtgctgactactggcctgatcatatcgttctcaggccgatcgaacaccctgccgtcacgacaccggcacctgcagccaggtacccacttaataaaaaattattatataatcacattaacatccactctgatcgatccataagtgtttggtcgtcattgatcgttggtcaggacgaactactatataccagctacttgcacttgattttcctggcccaaggtgtctctgggtatataaatatatgtagtagttgcatagaacaaatctgaaatcagaagcccgcatatcttttttttttttgtgaaggtgttagtactcacatgttcagacatatctgcaggatgctctctttgacttggtttgtatttttgttcagtactccaattcaaagaaccttatggagtaggagtagtaatagtagtagtacggattgaatcgtatcatacaaaatatatgatcatgagggtgacctataatgtagaacggacgataataaaggtgttcccataattgatagattatggataacacaaaattactgatatggatacattataaagctacagtaatagatagcttagagaaagctatctaataagctatactgatgcagtacaagtttatgagaaaattgtgtttttaaaagcatatagcaaggataatccacaactccagctgttaatttagatttgtgggcgaaatctgcaagtggaaatcaggacaacgttacatgccataaacttccatatgttgctgcgtaaacaacgcctgatcgagtagttgcaactgcattaacagtaaagcagcatgcatgcacttcgatcgaaccatgacatgtactgctgatcaagcaggagactgacgctgacgctgatcacactgacagtctgacactgatacacattattgtttcagtttagctggagtatagtaggagtatggtccatcaggcacacatgttctctccctgacatgaatgtacggagtaggattagcaactcgcgagcgaccaaaacagtctggccagctaccaccatcgctctttgcacggctgccacagacgacgagctggtatcgacgacacagcaaaaacatcacacccatccctaagttagatactccttcatgctatagaaaatcaatctagtaccgatgtaatatatcctaatactactaatactaagaatctgaacatatctctgtatagcctatactactagctagctgtatacttcttatttcgttttctaatagtgacactttcaactttgcagtacacgctttactatctatattatttaaaaattatgtacaaaaatacatactccctctatttcaaaatataagcattttagctatgaatctggataattggttggctagattcatagctaaaaatgtttatattttgggacggatgtagtaagatataattaaatcatgattaaacattattttaaaaaactcatagcaaaatagatgataattctataagttttataaataaaaggaatgatcaaatattggttaaaagttaacggcatcatctattaagaaaataatgttattattgattgtacagtatacaaatatgcatacaggaaacagcatgtacaagttcattagctaaagtttcacgtcattccctaactcagtctaaagtacaacacaatattaaatatatgtggtgatatagagctgctaggtagtatcatcattaatgtccaatcctgcctaaagtacagacaatggtattttcttttgttcatattttacataagaacacagtctctggaatgcatttttaattattttttaatataatatatataataaataaatacatttaatttttatcatagtactttgtaagacaaa

SEQ ID NO: 53254 - DNA, 2329 bp, Oryza sativa
agttcacgctaaaattaaaagtttgattgaaattggaatgatgtgaccgaaaaattggaagtctgtgtgtggaaaagtttgatgaaaaagttaaaaatttaaagaaaaagttgaaaactaaaccaggccgtagtactacatgtataattttaggacgggatggagtgctgcaagtctctctctagatctgaatctccgacaacggttagaagttgtgttcttctgtgaacatcacgtcacatgtactctccgtgacattgtttcaatcaagattagttcaagctagagttcaagtatagcatatccattatatattaatactgagatttactctgtactagtatatctaaacaatcaagattcaagagctagtactgtagtagtaggtgttgtttacggaagactggcattgcatgcggttgtacgtgatgcacagacatttaatgcgcccgatgcggttgtacgttttggagttcggtgtactgtttaagcggcggccgatgggcctgaactctatgtgggccaaacgtgaggcttggctgggttgtgtcaccgggccgagtatactaattgggccggcctaaatgcctaattatcaaaggaataagttcatccgaggtcccttaacttgtcaacgaatccgattttcgtccttgaaccccaaaaccagatacaacggatccctcaactatcaaaaccggtgcagataagttcctctggcggtttagagggcggttttggctggcgtggcgcttcatggcaattcgatccagaaaaataataaaattagtggggcctacatgtcagtttcacaaaaaaaaaaatggtgggacccacgtgggccccacgtgtcatcctcactgctccgttcttcggggaatcctctctctctctcttctttcctatgatgtggactagggcggcgggcgaagtggggcgacggtggccggagcgcgggcgcacgaagccagcgggacaaccgctcaccggtggccacttcgatgatctccagcccctgtacctgcttcggcggctgacctcgtcgagtgcttgccgggcctgggcgtcgccgatatccggtcggacgacaggcgcgtcacgaaccttcaatggtgtcgtgtgccgggctgcggctgcgactgcgtgggcctcgcccgcgactggagcaccagagccccatcagcatggaaaacgaggcgcgtggggtgacttcatcgactgcttcgggctgaggccacccagctggacctaccacaccgtcgagggaggctttcgacccactggctgggaatggacggccacctcatcaggtacggcgaggacggtagcagcctcgtcagggtgatgaatctgcactacgacgccgcagtagccgccgccgaaatccggtggttcgtaagtgtgtagatcgaacatttgtttgtcatgctgcaacagtgtgatgtgagtaaacattttggcactgaattttgttcaaatttcaacgggatttactgagggaaataatggattgtatcgtgagtagaattgtagaaatagaatcgaacagcaactgcagcaagcagtttccaatccctgtgaaatcgtggagaggggagaaggagaaaatggcgacgtgctcaccattcgcttccggaagctggtggccgaccagataaatggcgcccgacgccgatgatgccctcctccatggcgccgcttgcgtcccgacgccctgctcctgcgccactaccgccagtcactgtcactaccgcttgcgccctggccctccttgacgccgccgccgcttgcaccctgtggccccgcgcgccgccactgcactgctcccgcgccgccgacgcccaatcgccgcatcggtggcccggtgccctcctcaaacccgtcgccatcagtgtcgtcgtcttcgatagcggcggcggggaagtaggtggagagaagcgggagctcgcccgccaccgcccatagcgaggacgccgtcgaggtcggtgagcggcgcggaggacggtggaaacggtggcgggggccgcgatggtgaggtgtgcgtccttctcctagcggaggacgccgctcctttctcaccggtcgccggccgcctcctgcgcatgcgcgcgctcctttcctccctccggccggcgcccgtgcgccgcttcttatctgtgccagcgagaggagggaggagaggggagagagatgaagacgacgagagatggggagagatcaggagaaagaagatgaggggtgagaatgactcgtggggcccacgtgggtcccaccatttttattaatttgtatatgaaactgatatgtgggtctcaagggtttttttttt

SEQ ID NO: 53255 - DNA, 1936 bp, Oryza sativa
tataattttgcgatcaaaaagccgctcaacaagctgctgaaagtcatgaaacttttaaagacatcagatttatgcttaaggagatatatccaagaaaacttgctatagctatcaatgaagctaaaataaaatttttttcctcgaaaagaggtggaggcggtcccccatacatctgaataaataagttctagggttttattggacacactcaaagaatgggaatacggtaattgattgctcttggccttttgacaagcatcacacactgactctttattagattctctaagacacggtaacttatttgaactaatgaccttcataacaatgggatatggaaggatgcccgaaccgactgtgccaccgctcaagcgatggagcaactgcaaaggcctgcttggtggatgatgtggacggaagcggatagagaccatggcggcgtggccccttaagaccgcgctccttgtggttcgatccttaataaaaaatacttagactgaatctccacaaaaacagagttatcagaggcaagtttagttgctgatataagatttttagcggcctgtggcacatgaagaacataattaagatgtaaaggacaagttggggtatgaactatagcatgaccaatgtgcttgattttcatacctgcaccgctagcggtgtgaatctgatcatgtcccttgtacacctcccgtatgttgagtttctccagttgactagtgatgtgatcggtagcacccgtatcaacataccagttcgagttagcgccatggctgtatgtagctgcggcgacgagtttgtcatctgggacgtagtcttcgtcaaagcgatgccagcaatctgcagcaacgtggccacgtttgtagcacacctggcataaggggcggccgtcgttgccgcgctgttgacttgagccacgcccacggccggagccgcggccgcggttgctgttggcgttccggcctcttcctgcgccaccacgtgaggagaagcccccacggtttctgctggctgcattcgcggagccttgcgtgacgaagcgccaatctgctctcgaagctcaggagctgcgagacagcctctgctactgtgaccgattcagttttggccaccagcgcagagacgactggatcaaagtcttcatccagtccattcaggatatatgcgatcagttcatcgctatccatggacttgcctgctgttgctatctcatctgcaaacgatttcattttaccaacataatcagaaactgaaagattacccttcttcatggtgatgagggccagccgcacgttcatggtttgagcatgcgtttttgctgtgaacatttgctggatcctctttccaggcttcgcccgtcgttgcggcagtaccaacttgccccagcgtttccttcgtcatggaggaaaacaggaacccgaggatctgctgatccgctgcaatccattcgtcatgccctggattggaaaattgaacctcttttctttccaccgtttggttgattgtgccggattgtcctgccgttcccccgtgatgggaccctccaagcctgcgccacgaatcactatgagaacctgtgctctccagagcgcatgattctgcttgctcaatttctcggagacttgaaccccgaacagcggattggaaactgcggtagaggaagagctggccatctagattgaattggttttctctcgctctgataccatgtaaaacagcgaaagtgagatgggttgaacgtcgccctttgtttcggtgcgacggctgcgtgttatattggcgcaccaatcggcgctgagattataggattatatagcctctaatctagccgagatttgatctaaaggatatacatcttatctaaactaacaatctaaatctcagctagatcagttaggcaagatatacattaatacatgcatgttgtttaaca

SEQ ID NO: 53256 - DNA, 6038 bp, Oryza sativa
tcaggttctcggacaggcggttggtgcagaaggacttcggcgcggcacgaccggtggaggggctcttccgatactgccaccgccactcggtctcggcggccggcggcgagaggcgggcgttccggctggtgcggttcgccggcgcggcgtcggaggagattcgccggggcgacgccacgttccagcagctgggcctccactgctggaccctgcacctcctcttcgggttcggcccacgggcccatggtgtcggacactgactgagcaactcccgagtccgaccgagacgacgatttcaccctattgtggattatcaagtagttgttaggagtagtattattattgtctttcgtccacggcgtttctgctgtattcgccaattctttggacatggttagatcgtgcgcgctagcggcatatcgctaaccaacgacgtccttctcttccaaaaaaacagttactagtacactcaacagtacacgcctttttttttcttcctagagagttttctcctaaattacttatccaatctataatccgattacaccattatgatcgttgcaattaaatctttacaacaagatcttatacgattatattctgataaaaaatatctatgttgtaaatacttttattatatatgtaagttacttttgttctatacataaattacttttagatttaagctttttaataacttatatcttttaaatcacgtattattttcatgatctatttacatcattgtactctacataaaatatgagacaaaacaagatccatgttaaatatattcaaatatttcattaatttaaaagtaatttatttaaattgtagtagtaacttagctatgcaatagatgtaacttagctatgcaatagaagtaagttagcacaaaataaaagtaagttgttacaacattagaagtaaattcgagagaaaaatattttgtatctaaaaattaaatttaaagtccataaattatacaattgactaaaaactataataaacataattgacttaaagcattatgaatatataaaaagtaatttagtcaaatctaaaagtaatttatatatatgataaaagtaacttaagtatataataaaagtaatttacaagtataaatattttttatcgtagtataatcatgtaagatctagttttgaagatttaattgtaacgaacacaatagtgtaatcggattatagatcggataagtaatttgagagaaaactttgtaagaaggggaaaaatacatgcatgtgtaatagaaaaaaaggcatgcatgtgcgctggcttctccacggcttttatggttggcgtcgcgcgataagacaatatcgagaggcctcgccgattagtttttgcgcaattcttttgtttctctctcgttgtgagagcaaatttcgaattcaatttgtgtcagattcttacttcgatttgaatttgtgttaaccgcttagaaggttcttaagagaacaaggcatcaagggaagccttgatgaacatgcaccaagtggacttgacaccatgtgccaaattgataggactaggggttatttatttggttgccacactttaccacaccacactttagtcatgccatagttttttaggcatctgtttggttcgctgtcgcaattgtgttatgccacactttcttaactttgggacccacatgtcatgctctcaaatttagagttaagcatgtcacacttgtggcaaactatttataagccacacttatgccaccatatcacaactaacctaaacttagttatggtaaggttaggcatcaatcaaacatcccctaatatttataattatttagcatatactttataagttcaattttgtttgaatctgttacatgttgcaatgcagccattggcctatatttgcataacatcaaatgcttagattcagatgtaatactaccaaacgaggacagcaattaatccaacaaaagttggattaaattttggatactcgtggcatgctttttaaactgctcaacggtgcgtttcgtgcgaaaactttctatataaaagttgttctaaaatatcatattaatatatttttcaagtttgtaataattaaaactcaattaatcacacgttattacaaccttattttacgtgaaacacttaatttttatcttcatctcatattcaggacattcaaacaccaccttagtttggtgcgagggggcaatgggcatggtctatgaggacaggcatcaatactatatactcctttcataaaaaaaactaaattctaaagatgaatctaaacacatatgtgtctaaatttattcttataataaatctttttaggacagagggaatagagatgtagattttcatatgcaggaggaggacggggcgggcattccggttggtgcagttcaccgccgcggcatcggaggagatttgccgaggggacgcgatgttcgaggagctggaccttgcatctcctctttgaactcggcccacgggccaacaatgttggacagtgaaatcatattttcttaaaataagttcatatgaggtccctgttcaacaaaaagtgattttcatcctacaaccgaaaaaccagatacaacggattccttaactgtcaaaactagtgcaaaataagaccaaaggcggtttggacggcggtttcagctaacgtgatgcctgcgtggctaatttggcttggtcttcatctgacgtgacattgacgtggcgcttacgtcgttgtttgatttgggaaataagaaaaaccgtagatctatgtgtcagttacgaaaaaataattaagaaatgatgggcatacgtggcccccaaatgtcattctcatcccatcctttcttcctcctctctccccatctcccttctcttcatctctcccctctctcttctcctttctccaggcgagccccgccggcggcaacgacccaacggtggcccaggacgtggtcaccctgcacgcactcgacaaacagttctacaagaacgtgctccacgccgagtgctgttcacgtcggacgccgcgctactgtcgttcttggcgacggcgaggctggtgcacgccaacgtgcggcacccggtgtcgtgggcaaagaagttcgcaaggacgatggtgaagaatggcgaggattgggctcatggccgcatatatcacaatgttactactccctccgtttcaggttataatacgttttgactttggttaaagttaaactactctaaatttgactaactttatagaaaacaatagtaatatttacaacaccggcatagtttcattaaatctataattgaataatttttcataatatattaatcttgggttaaaaatatttctaactttttctacaaaattagtcaaacttagagtagtttgactttaactaaagttaaaacgtcttataacctgaaacgaaggagtatatgtcaaactcttgtaacatttttgcgagtgaacaacaaatgaatagcaatacaaatctgatataaatcaattcatgcgctgatgtataaattcagttcataatcagttcatttttgcgtgcaccgccaccttcgtctccagcttagccacgtgggcagcgtgtctgctgaaaccgccgtctaaactgttttcagacttattttgtaccgattttaacagttgagggacccattattactggtttttgggttgaagaatgaaaatcggattcactaaccgttaagggacctcagatgaacttattcctattttcttcgataacatgatagacacataaatagccactgcacatgtaacaccaccctcgcatctatacggtgaagttagttaagctgtttgtatattcgatttctttcgtctgcaatttgcaacggctttgccatgtgcgttatggtcacgagatcgacgttgtccacttgtggaggcaatcaggcaaaggtagcttaagcttggtgggttaactgtgaaatggaagagtactatagctagtactagcaataatgtttagatgatttttcttttttgctgattagaatttggtactgtttttgtctacgcaatttagggttgatctccacaaattttcgctccgatctcgtgcgccgcgtgcatcacattattctcccgtgtatacattttatatacctttatgaccaagtaaccataccctatatctttatggacgaaatagcattccaaaatgcagaaatttcagtgatcaattcaatacttttacaaactacgaaggctatgtttggatccaaagtttagatctaaacttcagtatttttccatcatatcaacttatcatacacacgtaacttttcagtcacatcatctctaattttaaccaaaatctaaactttggatccaactaaacacagccaaatttgttttctgcgttccaaataggtaaaatgaaggcaagcaaatgcaagcgtccacatgtcttcaagcccaattaatgccacttccgcatagtaaaaaggtctgcccaaacgaccaacgcctcctagctttctttcctcctcaatcctggtttccttgctcagagctttaggcctggtttagttcccaatattttcttcaaacttttaactttttcatcacatcaaaatttttctacacacataaacttccaacttttccatcgcatcgttctaatttcaaccaaacttttaattttgacgtgaactaaacacaccctcagtaatgttcagacttaaaagagacaaaatgcttatgtcggtttggacttcggagacattttaattggagaatgaaccacttgttgactttaaaagtgaaaaaaaatatttagagaataaacaaaacacaatacactcatggatgattggatgcttaacatgtagtgttaataagaaattaatctaccacttgcggatctacgtacaacgtcgttgcctggaggaacgaagagcggctgcaatttaccgtgctgacagcactgtcaaacaaaacgaaattacgctacccaagtcatgtgaatgtgttctagcttgcgtgttaatttaaacgggtataattaaaaagcagcgcactgatacatacatgttgcccatacacaagcagatcagtcgagtgtgcaggaaattcccagtaaatttccatagcacttattttaataatatatagtcaaccaatcaatgaacactgtgaatgcactgcagttattgtgtgctactacaaaaactgttgccgacattgttcagcttgatggtgacgttccttttttttattttgtttgaaggtgaaaaggatctgtatacgtggtggtagagacatttactgataggaaaatgcatatattagcagtttagcgctaagtcctcttaattaatttgtgttacacatcactgacttgatgaagtgtgtgtgtctggctggaggtctcccgtacttcactaggagttcaaacagtgcagaaaattaaagagataataaaacaagaattctttgcagttgaattcacttgagacgtatatgtatcattcttttccaagggaaaggcgctgattattgaatatcgatgacagtttaagcaaacagttatcccaaacagaaaagttacagatatctgaacaaaagaaaaattggttgctgctaaacattcgtaaattcacctggattttctggactgtacgtgtgccggccagataatgtgaaacaggatcaaacagcttgaatttttcactcacaaatagaatatttagacgaaattcaatgaagacgtacgtcagtacattaggcttctctccaagtagtttcccccctccttcccgggaaataataaccagtccaattacacttattcaataacagtacgaagtcaaggccaaggttctgaacaattccaagagacattttgtccttccattttaagctttggtccttctccaaaaccctacaaataccaccagatcgagctgccatgccaggcatctccacaggttcattcattcatccgccacattaatttctatcgtcacttcttgttttgagttatttctttcttc

SEQ ID NO: 53257 - DNA, 1076 bp, Oryza sativa
tatatgttcgttttatatcaaaaatatttgactaggaaaaagagtcgaaacgacttagagtatgagtatttttcttaatcctcctgcacaaatctaaaataatacatggttcatattttgaaaaagaataaaaaaaacagagagacagtagtccgtccatgaagcgacgagatcaggagcaagcgatcgcgaagctgacgagcatcggcggtggcggggcggcggcgggagagacgacctcctgatcatcttcatgtggaccaagaaggccatgctcgccgccgtcgtggtggtcgtggccaagtgcagggagctctgggaaggggtgctcacggcgggctccggctgcggctgcgtgtcgcgttccgccgccgccgccgacgacgacgacggctactacttcggccggagctacgagttctcgtgctccgccaccccggtcgccttcgctccggcgaaagggcggcggcgccggcggcgctgcctgctgctgccaccctgcgtgggagccaagcaggcgagggagatgctgcgggaggcggcgatgatgtccccggcgccgcctgtcggtgccggcggcggtcgacgctcgccgccggagcggtcgccgcagtggtggagggagcaggagatcgacggcctcgcggaggagttcatcagccggttctacgagcagctgaggtcgcaggtggcggatgaggagcggcggcgggcgccggagtgcaagagcagggcgtcgtcgtcgccgccgtccccgtctccgccataggcgatggcttaattacgtgcgtgcaggttgtgtgcattaaatacgtacgctggtgtttgcgattaatgtcatgtggatgtgtgtgtgttttcgatgatgagagggagttcgttcgttagtgcagttttgaactttttgatatctttccttacggctttcacgcggtttggaattgcttgtctaattatctttgtcccgtgcagttttgcgcgaagctaaataatttacgtaaagttagattaaatatgtaataactctgaaattttaatttttttatgaactattatatggctcttaccttttatat

SEQ ID NO: 53258 - DNA, 1060 bp, Oryza sativa
tcctgtgaagggggaaatagttcttgctcagtttagtgctgacaactcctggaatagagcaatggtacgtttcacttctatcctgatcttgaaagttgcctgtatgtctcacttctatgttgcaagtcaaaactaattatgtgttggggtcatggtttaggtttatgctaacctaagcagcttactagaacttcacaaaatttcttttggtatttacatttttccttgcaaagggggtttaatggcattaattgtgttgtgactttagaatgataatatgctatctttgcaaatcaattgttcccttggttagctgttctgtatagtcaagtaaaaatttctacaagtggtgggtcataccaattgagtaattgcttattttcataaatgtttgggccacttgagttaatttggacccaggaaatgggtgatattgttagaatccattgtaattcatttgacttgctcaaacttgtgttcctgctaaaatgaaggattggataaaagggacttagatgatatattctttagttgaatatttaagggacttggggcattagtgttttatgccaatgttgtttttacctcatagcttcgctaatgttctgctgttgattgcctaaacagctagtgatttcatcctgttgttttaattacatgatccatcatccatgggatcatctctaggaaattgcacaaactcatgttttattcttatgaaccattttagtcctggacttgttaagttgaacattcccgttttagtttctggttttcaaaaataattaggaagtatatccattttaactgatctgcagattgtgaatggacctcgaggagctgtatcatctcaagacgacaagtttgaagtattctacattgactatggcaaccaagaagtcgttccttacagtcgcatacggcctgctgacccatcaatttcctcttcgcctgctcttgctcagttgtgcagccttgccttcataaaagtgcccaacctagaagatgattttggccatgaagcagcagtctatctgaatgattgcttgctcaacagcca

SEQ ID NO: 53259 - DNA, 1937 bp, Oryza sativa
ataaaactatagatttaactcggtgtatcataaaactatacatttaacataaaatttatcacaaaactacacatttaagatgtagtgacacaaaattacatgtttagtaactaaattatcacgaaaatgcatgtttagaaccaatttaatcacaaagtaataatgtttataactcatcataacaatggtgctagggatttaaactccaaaagttgtagttttgtgataagttcaatattaaatatgcatttttgtgatacttaacctaaaatctgcagttttgtgataaatttagtgctaaatatgtagttttgtgatacaacttcttaaatctgtagttttgtgataatttggtcaaaatacctgtagttttgtaaaatttactctaaataaaactatatacattgctaagactgaaattaaagtgctatgcaatgtgtaattttaattcattttagctgcaatattgtacataattttaaaaattttatgacttataagtttatttcatgtaattttttttagaattacacagtacaacacagacactcaaaacgcacgcacactcttgtatgtcggaatattttggtagtaagcaatagcaaagtgaatgagtgatatgaccattggattaatatattatcatccaatgtatgggaaatttaaatatactgcattatatttaaatgcaatatatgtaattaatttgtttggaagaaaacaatactggttgaacagatatgaacagttaatagaataatcgaccgattgtctcatagaaaaatgaatggtacatgagttaaaccaaagaattcaggcctacaatgaataaattcgtctaaggaaccctacgctacattagatgaattcatctcaacaaacagctatggttgtctacgttagagcaagggcagggtcctcttcttccactggaagagtgtattcatccctcgagaaaatacccttgtttcttttatgccatctaaatagttattaaaaattaaaaattaacaagatagattaatataaaatatatcaatccacagacatgcagatttaaattcaacttctacaagttataagaaataattatgaaattttaatttgttttttataacttgtagaggttaaatttgatcttacatatttgtagcatgatatatcccatactccctccgtttcaagttttaagactttgactaaaccgtttcaagtttcactaaatctatagacaaatatagttatagctataatactaaattagtttcatcaaatcaataattgaatatattttcataaaaaatttgtcttgggttaaaaattttactactttttttctacaaacttgatcaaacataaagcagcttgattttgaccaaagtcaaaacatcctataacctgaaacggaaggagtattaatctatctcatcaatttttaattttttattactattcatatgacatgtaagaaacgaaggatgtcacctagacgaagaaaatccatctctgcttccactgccgcccatcaacatctgtgtggcgagccgacaccgccatgtcgccatgatcctctgtggcgagccgcgcgcatcgacgagcgaggctatggcgagaagaccacgtatacgatgcagcggtcgagccgcaggtcctgcagcgacgcgtctccgcgcggcgggatctcctccgacgcgccgccggcgagccgcaccagccggaacggccgccccgccatgccgcacgcggcgaccgccgcgccgcagtagcggaacagcgccgccacgggccgcgccgcgtcgaacaccctgtcgaacacgcgcccgtccgggaggcggacccgcacggcgcacgccgcctcgccccgcgccgccggcccgtcgtcgcacacggtgacgtcgacgagccgggcgacgagctcctccatatcgtcatcggcg

SEQ ID NO: 53260 - DNA, 1399 bp, Oryza sativa
ttagaattctaatatttaaacaataatatctttcacatcgcatattattttttagaaccgttttattgtctcgttgtaacgtcgttttacagcgttgtgagaacggttctaaaagttactacacgatgatcgacacaaaaatgcttttataacgttgttactgcggaaattagtggtgttactgcacattgatcgtcgcgttactacgccgttccagcgacacgagaacttaaaaaaagtaaatcccaatctttagagagcaatatcgcccatgagagaggggggtgtagaatagttattctaggaagtaggggaggggtatatatatatatatatatatatatatatagtaaatttgtttggtgctccatggtgcccgggcaccattgttgaaattgagtatatacccaattcaaatgagtatgaaactttttcaattacttaggtattaacattaactactttactaactagttcaaagcaagtttgaactgaatttgaacttgtttttgttagattttgattataggtatatagcatccatatatataattagttagatatgtaatcatggattgtgaaataaagttaaatttgagttgttttgttgataagtataggtatgaatcgaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatatatatatataacacacaccgtaacttttaacacttaagctataattatttttttagtacacagtatacaagagaattaagataaataaaaaataattgattggctatttaggaaaagagaaagaagagatataaacatataagagagataaaaacacatagggaatcaagtaaaaatatggtatatttttagcaaaactgatttttctttttttttctttttcctttcggagaaagagaggcacactctgccacttccatcaatagaaatggaagtttaacagacataaaacgttttccaaaatatcggaatatttttaagcttttaggttaaactggttagtgcatgcagataaattattatttttacatataaccctctaagcttttatagttttattgggagtggttggaagagctagctggtgcagtacaatctatagccgcagccaataaaagcatgtaagccttatatgtaagtccataattatttattgaaattattttatttaaatatgaaaaaatgttaattaatttcccatggtaaaaggttaatcggtttgggggtttggaggaatttcaatttgtacaaataggaaa

SEQ ID NO: 53261 - DNA, 2090 bp, Oryza sativa
taatttatgagtaaaatttcatacttatgtccgtagcgatccaaaagtaaatgctataacataaactacgatgataaaccgcaaaactgcctcgaaaatcaagttttaaagtttaaaaattataaattttggcttatacttttcccccatcccctttggtgcggaagcccgtgatgccccgtgacgtggtggtcgccgatatgtggggtccacatgtcagggactaggcccccctcaatcccccctctcgtcggcgtgatgacggcgtcggctcctcgcgagttctttctcccgccctccgccgcccgctgcccgcgcgggtcgccgatctccatatcgcgagcaaagcaaagcaggaaatgagatatactagtaaaaggtgaagtactcgagtatcttccccttccttctccttggcgtaagagagagagagatctcccgtctcgtcgtctcctccgcttccctcgcgccgagacgagtcgtccatctggcgagcagagcaagggagggggagggggaggggatcctggtgagcatccacatcctctttctggttcatctctcagctcccacccggaggagtacttttggtctggaatttgcttgggctcgttaaccctaagccttctcttctagttctagatctggaagaagcgagccttaaccttaatacaagtagtaacagtttgtttgttcccgcaaaagtttgggggttcaactgaacccccatgtcccaaggtgaatcgacatggagatttgtatattggtggccatttaggaaaatgggtgcaattttcccaccctggacaattagcttttttttctaaatgaacctcaaaagtatgcaaattaatggtgtcgattgaaatgaaggctaatccgagatcaatgtaaataagctatagtaaaataattgctcaaagcgcgatgaatccttttcattcatgcgaaattcagaggggacccacccatagtttttccccagtaaaagcagaattaatgaagccgaaggttctggaggtttatacgcaagatgaagttaagggttttatggcttctcaataggcgcctgttccagaactgagtacacaagagcatgaatgggtgggtaattcattctgactgcttcacttctgttccttccattattagtgggaattgctgctatgcttcttttatgtgtatgatcgtgtagatatgcactatattggtgttgcacatgttacaggttaaaagtgtcttcgaagtgctccaaggctttgacaccgtcttgctctactgggaccaagactgcgcccgggatactgggagaaagcacggatctatgtttcgcaccttgtcacagacgagcctcagagctgtgctcaagccttttctgtttgctgcaacatgcttgaagcaggtggagctctttgttgggagggtaagatcgtgcggtcatggaactccgacgctgagtgcatttgctagttcggtcgattcttggctaatggtgaggttgcaattcagactgcatagatttttcggggatgatgtttgttttgtccgaaattacattgttgttatgttaatatcagaggctccgcaaagcagctctgaaggaggaagagcagttgtttctttcagttgaaaggactataactctgctgggattgactgattctatgcaaggtcatggtctattctactataacattacttttcttcatcagagtgaccattactttagtcaaggacctcttactgttgtacgaaatggataactaggttagcttttagtagtgatgttgtatgttactataggtgattctagagatatcagcaactctatgtaatgtgtgatggcaaaaaaagttgcatagagatatgagattatagagacatgatagtatagtctttttttttcctttttaccattttaggtagttttctaaaagccggagaggactgtacaactgacaacctgtgttttcagtttcatgcttctttatcacttgacagactgtggttttcactcaccccataatataaaatcttatgcagtttatgttctggagcagaacatttgtatcaagttgtgcaaggagctg

SEQ ID NO: 53262 - DNA, 1582 bp, Oryza sativa
tctgaacctgcgggaagggtgaatgtctcgagcattggggcccacagcatctctttctccgaatctgggacaaagctctcatgatctccgcgtgcccttgttctgcgccagtacaccgtactgacaggcacgttatcccgcacaacccaaccgctatgacgtacatagttcttggcggcttctgccggggcactaggtcggccatcttcgtccacttccgttatgatgtgccgaccctcaagcttcttcgtggcacctcgttgcccgcgtgccctcttctgtccagcggagggttaacttgcactatcctcctccttctggttcccctccacatccctttcaacgtgcccctcctggttcccctccgcatccctctacatgttcccttccttgttcaaatactggtttggatcctctttcccatctttttcattccagtactggctgcttccctccgcgattgtatcgtacaatatctgttcctcatcgcgatcagccatctgttcatacatgaaacagctgctaagtcatgagacatttatgttttaacaatcttatatgctaacaatcatgtgctaagtctaggtgacgtatattacaggaccctagctagtcaataaattatatagtaagtctaattacaaatctaataatcttatattaaaacttaaataatcttatactaaaactcaaatagtgataaatgctaagtttaggtattgtatataccagacccctagctatcaataaattatatagtaagtctaattacaaatctaataatcttatattaaaacttaaataatcttatactaaaactcaaatagtgatatatgctaagtctaggtgacgtatattataggaccctagctagtcaataaattatatactaaagtctaattacaaactataataatcttatattaaaactaagtctaagtgtcgtatattaaatctaatagtcttaattgcattacaaatataacaatcatatatatataattacgtcacttgcctgcgcgaattccttcgagggatagctaccactccggcttgagggacgactccgacaacgtcttttctgcaagatacaaaaagatgtattaggataaacgcgaagtaacatatattgcatttgatgttcacgtttcgttcacgatcgttcacgttcgcgttcttgttaaggtcacgtttcattcacgtacgttcgttcgttcacattcattcacctgcctatattgcatttcacgttcacgttcacattcgttaacgttcgttcacgttcgttgacgttcgttcacgctcgttcgttcacgttcgttcgctcattcacgttctcgttcacgttcgttcgctcgttctcgttcacgttcgttcgctcgttcacgttagttcacgttaattcgttcgatgtcgtggcggcagcggagcggcggtgtggcggcagctggacggcggtgtggcggcagcggacggcgccgggacggcccggtgcccgcgtggcggcgtggcgcgtggcccggtggcgacgttgcgcggcggcggcgaagcgcgcggcacggcgccggcgttgcgcaacggc

SEQ ID NO: 53263 - DNA, 6975 bp, Oryza sativa
gtttggggataaattgggggctaaatgtgtagttttatgatacaactccttaaatctgtagttttgtgataatttcgtcaaaatacctgtagttttgtgaaatttactcataatttaataatataattaatgctaaaattagatggatcaaaatagaaatttctattacaggtgtacaaacagagtcacaaaatatgctaattttcgcatttgcatgtgcgccggccaacgatgcgggattcgactgagacgtgccgatcgatgcatgcatgatcgccactactccacgttgaaactaaacccaagtcaaagtaaacacgtatatttgaagtgcacatagtttcattattagaaaccctcgatttagtcgaattagcgcttagattgaaatgaaaattacgacatacacccattattttggactctttaaatcatccattttggcatgggtgcagtgagcactaattaccgtgcacgcacgggatctaaaaacagtgcgcaggccgtccccgtcacgtctcactgctacatcctggtctatggctgatggccaattcaaccacatgagcgtactttcccggtctcataaaaaataaacatagtcccgttctaactttataaaggcacatatttttcttttttttcgttagcacgtttttcaaactattttataaaaaagatttctatatagaagttgttttaaaatatcagataaatttattttttaagtttgtaataattaaaacttaattaatcatgcgttaatagctttctcgttttaatcttaaaagacgcgaatattagggaatgtcataatatcaaataattagaaggggtgaggtttcgaacccaggtcgtctagtctaccaccttgtgtagctagtcggaagacccttggacatttctccacgcttttaatcttcatccttaaaagattcaagcgggcgcctgatacaaaatacgacaaatcctaagatatattacatcctatactaggtcttctctttatatgatagagcgagtaggcctgtatataagtgtgatcacgcccactcactgacagactcatagacaagaattccactacaacactctaccgatagtaaaaaaaataatctaaatcatcgtttttatttgatcgaatggttcagatctatttatactatcaccctaattagtgataatagaaacgtgaaaaggtattattgtaaaaaaggtgcgaagggacataattgtcatttagcatttagcagtgattaaatatttttttctcctttttttagctttttgataaaatatgagcgatgcgagcgcaatgaatgagcatggatcgatgtagccataaaaaaccctaatcactgcattagtaaattaatatataatttgcccttaataatgaattatttaaattatttttactggtaatataatactatctatcagtagatagcactagctagcgcattactccacacacaatcatctcaggcccagccaggcaaggcagcagcggccatgcatgatccatcgatcgggttcgcaagctatagcaagcagcagctttcatttcctttcctttccccttttccttatcacgcctttctcgctctttggcttttgagaagggagggagtcccggtagacggtagacgcaggcagctcgataatcgacaacaagccagcagcaatagcagtgtgcagtattactcccttcgtcccaaaataattgtaattttatactattcacatttaacgtttgactgttcatcttatttaaaaaaaatttacgattagtatttttattgctattagatgataaaacatggatagtactttatgtttgactaaatatttttaatatttttattttttttaaataagacggacggtcaaacgttgagcacgaataacaactatatttattttaggacggatgtagtacgtacgaggactcatttattaccgtgttttactgatggatgggataacagtactgatggatgggataacagtgacaccccccccccccccccctctctggtgccagctacctgggcagctgcccggtccatggctatggctcacgcctggactgctctgtattccgatgctgcagtgcacaactgcacatcatcgatcggaataagaggtactcctcctcttactgccactctgccagcttgctgtgcaaagcgaaagcgaaaagaaaagatgttctactagtactgcatcgatctgcagtgcgtattcgtttctccgataagagttgatgaaatctcacgtactcgtggcacgcttttcaaactgttaaatggtacgtttcatgtaaaaataaaagttactctaaaatatcatattaatccattttttaagttcataataattaaaactcaattaatcacatgttattactacattattttacatgaaacacttaacctgtatcttaatcttcatcttcacgagattcaaacaccaccccgtacatcggtacatcagtagtactcctacatggaatcattcctaaacgcgctcgctgtagccctagagatagagagaagagagagagagtactcctactttactgtcgtacttatgtgatacagtagccgttaattgaggtgatagttaggctatggcgagcgctccatgctagagcgtggtctcacccctcccgagcgaatattcgcgccacgcgggtatttgtcataacgacggctctaacaggcaaggaagcgtgttggggagaggcctctccctgtgccgtcaccccgcaccattgaaatcaactcactcccgcgcattgctgccatgaacgaggtcgagaagggcctacccggcggtgcatcggaggattacggcaaggtgctccgccgcgaccgttgttggctatttcgccgccccaaccaccgtttcgggcacctccttcgccgaagtcaccgcacaatcgctcgtatcctcaccgcgccacctcgatctctgcctggatccccaccgttgtccccaccactcagatccttactgcgtcggctctatctctgcctccactgctcgcccccccctcccccgctacggcgatcgagtcaggcaacactgaggggagaggcggcgccacagagggagagaggggagaggcggagaggggtgtggcttttggtggcgaggcgtgcgggcacgtggaggaagaagagcgacctgtgtggcactgtgcgtgaggtaaggaagggattggatgggctgggagagtatgacagtgggccatggactaatacgtaattttttctctacccaaaggactaacatagaaaaatgtttatgggacccacttcaagaatgattgctcaagtcgggtcttagactgcttttgctcacgtgaatggtgggggtggtgcctgcgttgaaattggccttatagggcaggagcaatgcaaagcttcgattccaaaaaaaaaagtgtatatcacatatgatgaaccaatagaaggatactattatcgtaatgcaggcaaccttcaagttgggaatgcaattgcccaacgcaagtgcgtgccgtgcctctgtgccttttgtcctcgctcacaggctaggaacccgtgtacttagcaccgagcggccttgcaggcgatgacagagaaccacgtggatgaaatctttgacgtggcatatgcatctcgaatcgacgagggcatactacaatcatctcttggcgaaaacgtacaagaaaaacgaagcagatcagcgcccagaagagactcccaaaaacgaaagtgacgtgtgctagctactgatggacatgatgatcaaacgagtgagaccgatgccgataataatcttgcggacaaaattttgacccacgccgcgcgcaccggccgccgtcacatacccgtgctatctacaggaccgatgtgctaatcctatctatcatagtgttctagctagttctaccgtctctgccccaccaagaaaatgtatgagtggcgcaggtaggggggtgccaaagtgccaacacccctgtccaaacactaccaccactacacccccatacttttactctatattaagttagctaagatagttatttatctagtttattttgggtagcttgaaagtattatcagtttagttagttagcaagtctaaaaatattagcaagaaacatgattaaaaaattagtttgtgatttctcatctttttcaatgtaaaatagatgatacttatttatgagattatttaatactccctccgttttcaaaatgtttgacactgttgactttttagtatgtgtttgaccattcgtattattcaaaaaattaaagtaattatttattcttttcatatcatttaatttattgttaaatatactttcatatacatatatagttttacatacttcacaaattttttaaataagacgaatggtcaaacatttgctaaaaagtcaacggtgtcaaacattttaaaacggatggagtagtttacattaaaagaacttagcaataaatattagttttaaacttccaatgatattattaaagagctaaaattcaagtttttcttaaaggactagtttacgcattgcttgttattagcggtgactatttgacctactttactattaatattagttattcagtcttatgatttatcttcacccctacatcccgtaatctcaaatcctggattcacccctgctgatgtttgcttgctcagctgcacgcctgcaccacaggacaaaggctgatccatgttgtcctttgacataaatatgcttgcatgcgtacgattcacttcgatcaccattcgtgcctgcaaatctgccatggcaaacagaactaaaaagaaagaaaacgtactccctccgtcctaaaatatactccctccgtctcataatataaggaattttgagtttttcttataacgtttgaccactcgaattattcaaaaatttttgaaattattatttattttatttgtgacttactttattgtctacagtactttaagcacaacttttcgttttttatatttgcaaaaaaaataaataagacgagtggtcaaacgttacaatcaaaaactcaaaatcccttatattgtgggacggagggagtaagtatttttggacttcgatacggtcttcgagatgctactttgatcaacgatatctatataaaaataagatgttttaaataaaaaaaagttgcatattgtgatagtttgtttaatgataaatctagtaacatcaattttacataattgatctttttatatttttgctattaatagccaaagttataaatatttgacttggcactagggttgtcaaaaaagctcgaggctcacgagctacttgagctcgactcgtcctaggcttaattcgagctcggctcgagctccaaacgagccgagcccgagcctgtcccaaagctcgtgagctttgtcgagccgagctcgagcttctaacgagcctagtaatatatgattttttattgctatttaataaattggtagatcaaatatgttatttatatgccttgtattggcataatatatttgttttattttttttcctcttctactaatatgataaaccataaattaattatttttaaaaatttatcatttgaaatatacattgttctaattaaaaatcgagcacggtagtcgagctcgagcttgatcgagctcgaaccgagcctgtatgaaagcttaaatattttataagctcggctcgagcttatatcgagctcgagcctaggcaggtgagctcgctcgagctcggcttgttgacaaccctacttggcactatgctaaaaatgcttatgttttgggacagaggaagtagctagtagatcgatgccgccgttgctcatctgggaatgctacttcctccattctaaaaaaactcatctttatagtgacctagcactacaaatctagacatatctatgtccagatttatactactagattatgtcctagcactataaatctaaacaaatctctgtccagatttatagtactactagaatatgtcaacatctagtaatatattaagtttttgggacaaagggaataatagcttgcggtggccaccaaatcaagatccccacggccatgcacaatactctcttcatctcaaaataaatttatgttcaattaattattagtatatcatgatttataaaaatagaagacaaaatgtatttaacgcagataaagagataaataacgtatattatgattagataagctgaggtattataatctctttgattttatattgctatgtgtgggatatatgaaaatatcatagtactccctccgtattttaatgtatgacgccattaattttttaacaaacgtttgacctttcgtcttattaaaaaattatgtaattataatttattttattgtgaccttgatttatcatcaaatgttctttaagcatgacataagtatttttatatttgcataaaaaatttaaataagacgagtgatcaaacgttggttaaaaaatcaacggcgtcatacattaaaagcgtcatatattaaaataaaatccggaggaagtattataaaattagagggagtatataacaccagatgcgtacattaattcacatctggactacgcagtggccagtggcgagtggcgacgtcgtttgccccggccggctcggggccctagccaagaaaatcaacgcgagacggccgtggcccgtgggagtcgtgatttgatcgacgcgtttatcacaagccttttatcgctttgcgcacccacaggagcagcacacaactgtagaaaatatattgtgcaccggccgtttaatttctttctgcgaagtaatccgaagaaagtggaccagtcaccggacgcgtacatagatgaactagtgcaaaactatatgttatggaaaacggctgtaccgaccgactaatcgccgtatatacgatcacggtagtaaaaccgttccg

SEQ ID NO: 53264 - DNA, 2656 bp, Oryza sativa
tgtttagtagggttctagtgatacgtgacagattaaaatgttatctactattcgatcacagaaccgagaattgataagtctgggatgagatctgtgaaattgatattggcaggttggttgaagatggggattaatctgcaaccatttgtgcacaaactcatttggaatgtcttagttttttggtgtgtttttgcttcaaaaataggattatgttgatgctggcttgatcaaattgaactgggttggttgcagggttggggttaatatgcaaccacttgtgcctgtactgatttggaatatcttatatttgttctatttttgcttcaataatagtttcaataaccagattattcttgctgtgtatttcgccatttgtgactccattctgactcattaccatgaacttgcatggttggtgcgatctagtacaagaacttgtaaagcacttgtttcttgtagaaatgtttttgtacaagtgaatttaggccataagggcacaccatagatatgtttattgaattgacgctgattttgaaaccacgtagtcatgcacatctgagttgaataatgatttacatttacctatgaaaaaatataagtgtacaagttggcacttagacctttgatgtatcatgatatcgggagtatgatttctgtgaaaaatttgaaggctatgtagatgtgccacacgttttcaagtcacaaaattagaaatcattaatattcattgtgtctgggtctattagaaagtccgaagcttcatttgcctgtttatttttggtatgttaaaatatgtgttgcctagtgtcccaatcgtctaatcaacatccaacatagcaatgttatatatttggtgtcattttagcatcagttaacatgcgctacacagtttgcaagtgtattgcacctgcttcacaattatgagttattgtagtaccagcataatttgttctcactataagcgtatttgttctggcaaggtgccaattgtacaatgaataccacttgcataaattgaattgttctcaatgttgtacaacgaatgaattctatactaattgtattgattaattgagttttcattagaccctcgtgatgaatatcaatgatttctatacactggtattgacttgtagtatacaatgattgaatcgttctcaacattgtacaatttttttaaaacaaatgcattgtacaattaattctatactgaaatgacagtgtcgacctgcattattttgactagttttaatcgatgttcttgttattcctttagctctgtctaacggtcaaaatgttcatttttcagctcttcttgtatgggagctttttgactggagatgagaccgttgatcttaagaatggcctcacatgttgcatctacaatgtgatttcaatgctcaccatggagatggccagagtctcggccgtgaacacaaagacaacaagatatttgttggtatttcttatgatcacagataaatctgcaagcgtacagaatataccgatgtagcatttcacccgggagtattctcaggtatcgattttcacagggaatgtgtgtgctaactccggtttaggttcatccaagggcacgaagctatggataaggaaaggatagagaggtttcaccgataagaaatagtgtctatagaaatctcaactttaatcctaatgcggtacttcgagcactggccagctcgctgctcccagatatcattttaccacgcacccggacagggaggatttcactcatattgagggctgtcacccaccttctacacttcaccttcacaccttaccgttgggattgcggagccaaccacccgaaaaatccaactaccctagacccccgcgtcttaagcaatttaatagctacttctagtgttttgtactccacttaaagcaatcactatattataatggactatagtgaacgatgatcccacacgctaattaggaactaaccaagagataattctcaccaagcaaaactaaattacttaaaagatatttctattataatcagagtaattaacaaagcacaaagaaataggaaggggattaccgacaactccagaactcctccgacttcttctcctctactctctccctaatctagtatataataaagtacaatagagcatcttataattcagctcatgcttcaagtgtctgtgaatgagggtgaggagaggggtatttatagtgtggaggtgacttgagagagtggagatgctaaggaatattctccatagaatccaaatagcatcttccttctccctttgccatgtgtcttcctgatgacggtttccactggtattaacgctcataaccgtcataagatgaggagtacaaccatcatgccgaagctggattggattgggccagttgctcgaaccctggctagcccatccagctagccctttctctggtgttctgacatgtgggtcccactatatgttccaatgaaaattggccaagataaatgggctcaacactccataggcttggctatggaagttatattctcatccttcatgtatatttcatctcaactttggtgggttgcattctgcatacaaatatacatcagcactcgtagaaatggttagaaataaatcctaccactatgttggatgttttacttttatgg

SEQ ID NO: 53265 - DNA, 1067 bp, Oryza sativa
ggtggaaggcacagatagtttcagcaatataattggctcagtgtattactctgatggggatacattgaaggatctggcccttgagcttgttgaaaatgtacgatcaattatttatccactacctttcatttgactcacatgattctttttaagatttattttaataatgagatctgcttgcattgaaattcttttgtatgattaattatgcagggtcttgccaagtatgttgagtggagtgccaacatgatggacgttgatgcaaaaataaagctgaagaatgctgagcttcaggctaagaaggaccagttgagaatttggacaggatttaagccaccagtgacaaactcgaagccaatccacgaccagaaattcactggaaaagtgggttccctgttctcacaagtagtgtattcaacatgatcatgcgattgaagctaatttgctttgtgttgatcctttcataggttgtagaggttgtgagtggggattgcatcattgttgctgatgacgcagctccttacggaagtccttctgcagaacgccgggttaatctttcaagcattagagctcctataatgggcaaccctcgtagagatgagaagcctgataattttgctcgtgaagccaagaattcttgcgcacaaggttgatggcaagcaagtatgtacataggttttgagatattccatcaagagttccataactagattgttacctctgttgaaaatgtactgattttttctccttccaattttcagcgatctgttcagatgttatactctagaaggatcagcactgtggatggacagcccacaacaaacacagctgaagacagggttttggattatgggtcggtttttcttggttcaccttcgcaggctgatggtgatgatgtttcttccattccaagctcaggcaaccaacctggtatcaatattgctgagactctgctctcaaggggctttgctagaacatctaaacatcgggactacgaagaaaggtcacactattttgacctgctgttggcggctgaatcacgagctgagaaagcaaagaaaggagtt

SEQ ID NO: 53266 - DNA, 733 bp, Oryza sativa
tccactcatggatagaaacaaaaaaaatacccaaaatactctttgatcactgattcaccgccatccaacacacgctagaaaactgaacaaggttaaacgcactctccactcagcaacatcttccgctgcctccaacccaacgcaaaatcaaatcaaatcaaaacttagtaaacccacagatcaattctactaacacactggcctgaatccgcccccaattcgccacacggagataactccaacctacactacgcacaaccaaacccagattctactcaaaccacaccacagtaacaaatcgatcaggcaagacaagaacatgtcctactcaaactattccagaccatcaaatgaacaatagaagcaagcgagacaagattttttctagatactgaaaagcatgcggaaaactggtcatacttaccatcgcactgttcttgcaagagaccttctagccaacgctgaagttcttgccaacaagatctacaaaagcactagaaaatagcagcagaaatcaacgagtcccttcccaaaatgataaaccttgagtttcactcgacactcaaggctgttgttggcctgatctttcgatgagaggataagtcgataggatggagtggcgttggcggtccgactacatctatcaagggatgttgcatcttagcaatcattacaccaaatctctatggaatgcacgatcagcccaaccacaagggtaattgttcctgcaagc

SEQ ID NO: 53267 - DNA, 1703 bp, Oryza sativa
ggaagttgggatgtgcgagcgattcttctctgcaggaggagataacgatttttttttggtgggacctgcttgaaaaaaaaattgatggtagacctcatctaaagctacgcgcgctgggagatggagcctcatttacttttttcctacatgatgcttgtgcttcttggtgagccgggacacatttgctattgcctgtagagtggtacgcctagtacgtacgaggcaggagacagattagcagctgcgtgctttcctctccatctgatggtgacggggatggccacgattaagttggaggaattaattcaatcgattggggtgaactgatcaagtgaaagcatgaacgagtcggtacgaattaatgagaggaggagatctgcgacgtgggtaaagattagaggagggacatgtgggcgtggggctcattgatggatgttcgcttcaaaatataataagctttgactatgaatttatttagatgtatgtattcagttttgtaactaaaatttattatattttgaaattagaaatcatggagatatagagttgtagttgtatttttctacggtactaccagtattggtaggggcgatgaatgtccgtgtcttaggcctcggctagcagaagtgaccaaatatagttcagagtttagatctccttcgaaatagataaatttactaggaattttataaaaattgaactaattaatatgatatttctgtgttccaacaaagacgtccacgacgtagcgtcaaaatcaatacttctaaagctggcattggaacttacaaatcgattggttcaaggaacttacaaatcgattggttcaagtgatagagctaaacttttgagataaatctagaaattatataagaggaaaaaatcaagaaaaagaaagcatcgtctcgatctagcacatgctagatgttttccaactaggtagaatagtatgtatctgataccttgaaattatagaaatttgtcctcattcaatcgatgataattggaatgattagggagaaaattagagattaaaaaatgatatttaaaattttaaaataaattagataatctctattaaagtcctctaaacttaatgtgttgtaaattaactctaaatatacatgggctatataatactcgtaccaacaaaaaaacataaaaaagggtgtgactatgatcacatactctttatttaattaattatgttcaaaatgataaaggatttattaaggataagtcttgcattttctccccctttgactcaaaaccggtcacgcattaggataataaatccatcgattatttagttggttatatagatggccaaaaggcccgaggcccgacggcccggccgatggcacggcgtttaggcccggcccaagcatggcacggcccgtcaagggtcgggcccgtgctggcccaacccggccaacgggccgtgcctgggcctcttcgccagcacgttgggccggcacggcacgatgggccgcatgccaggcccgacacataaacaatagggagtaaaaatagacatattatatgccacggtcgaaagaatagggatgcaaaatagacttattttacctatatatatgtcagcccaaagaggagggacggaaaatagacttatttttactatatatatatatatatatatatatatatatatatatatgtcacagcccaaagaggagggatgg

SEQ ID NO: 53268 - DNA, 747 bp, Oryza sativa
ttttagaataccatgtatccctattcaaccttgtttcctcgtctgaaatttttagcccttatattaattctctgcgttgccctcttgtaaatagcattcagacagagaaggagaacaaccgaactctcccagtcaaaattccagatctagcatgtcaaaatcttttcctcaggtgtttcacaaggtttgattctttttaacctagataatgttgaaaatggaagtgtatcaattatcaaatgtcaggatatgatagatcacatgaactgtgtatattcacaagttcatgaagaactagctgttcagcacaatatctttttcgtatgaatactaaatcataagttaaatctggattgaagtgttgttttgcaagcaattggaggagtggattgtgatgtcttttgaataggcctactattcttgctgaatttaggaaatattgtgcatctgttctgtcttttacgactgaagaacaaacaatcactaaaaataaaacgataattttaattatttgtttcaagcatttttcagagaatgtaaaaaccagaaaactggagcataaaacataactacattctagtttagttatgctgttttctggttcagatcattgatatttgaattcccttatgtgtaattgtgtggtgaggtgcagaaacttcctatgggagacgccgtgtattattatttcaaggacatctatgatgctcttcggatagcacaagttggtgtacgtttgatatttct

SEQ ID NO: 53269 - DNA, 2903 bp, Oryza sativa
caccagctctaagtcgcctttgctgcttgcgtggatcctgtcgtctctccgcctccctctcgcgtggatgcgtcgtcgatggcgatgggaggggaggatctggcgacctctcggcaatggcccaccggtagctacgatggccgagacgcgcgggcggtggatctggtgttagtggaggctcgagggcagtggcgaggctagcgggcgacggatccactggcaggggaggctcgaggacgcggaggcagttgagttctggtggcctcatcctgaagttactgcagccgcctgcttcctcgacatcgccacccatgggagtcgccgccgtagtgaatcgcctcccggtttcttcattgatgctccctcaatacctcaacacccaagaaccttgccgataagggccgccgccatgttagatccgtggaatcttgttgtaattatggggttgattccatcccttttgtgttgaacttgtatccctcttccctcgttttatttgattttgtttaagtggggaaggacgacgtacggactctcggacttacggccgaaaatacggaaaaaaagagaggtgatgatcagaaagttttgaattttttaaatagttaaggttaagatttttttttttgaaaaaccgacatctgttgtatatttataggtcccgtttttaatctatacaaatcttgtagcgtatgttccttaaaaaaaaaccgactcctattaaaaaaccggagccaaccttatccccacatgccatagctcacagacgccatccatccatccttatccacagaccacagccgccacactcccacccaccgtcagcgccaccgcacaccatctccttgccaccaccatccctacctctgtcgcatccacctactgccactggcccccgtcacgtggccacgcctcctcagcctcatcgccgccttcctcctccctctccctcttggtccagaggcagcagcggcgcaggggcgggttagcggctcccggcccagcggctgcattgcggctcctcgacgcagcggctgcccagcggcgcggcggctcaggacctccacgacggcgaggagcggcagcggcctccctctcacccctccctctccctcttggtccagaggcagcagtggcgcaggggctggtcagcgtctcccggcccaacggctgagctgcggcttctcgacgcaaaggcgccgcacggctcaggatctccatggcggcgacgagcggcggcggcctccctctcacccttctctctcctctcatatcctatgtgatgtgatttattttgtgatttccacctcttctctcatcttatgtgtgatctattttgtgatgtgattattggattgtctcctgtgcttgatttattttgggatgattttgtaatgattccgattggattgggatttagttcttgggttaaatttgtgatgatttgggattggttgtgggatgttcagagcggacgctcgttgacagatgaagcggaagaaggtgcttctgctttagtttttagggatttgggatttgtttgtgtatttctttgtagtgtcgatcttgtaacagcgaatgggaaactgattttctgggattatcggtcggttttgatgttgtgatttgtcctccaattataattttgtatcctctcagaattttttttctttggccgctgtacacgattgcgttcacacggagagagagggcaccgctcagtcagacatttacggatgaaaaatttgtgacgaaaggaaaaatactaatcttttagttagttaagatgtgacacatgctataggctatattcgttgaactaggatgtatcatatctcactaaaatctcttatatttagggacggagggagtataacttgatgaaggaattatcaacattattgctttgaaactgttgaatacaaaatgaaatcctagaatttgcgtatgtctgattagaaaatgtgacaatgccaatgtagcaggtaatttcttttagaaggtaatttcttttagagtaaatttcacaaaaccacatctctacccatactaatactacattcagtggttcaacaacagtggccgcattaaggtaacacaattggtgagattaaatttggcaattggttattactgtgattttgttgattgcgatgtcgtacctatgcatgctggctccttgctccttgctgttgggtagactttcacaatatgataaaaacacgttgcatcatggtagaacaaaatcaatactcctttgtgcataatagaaaaaaaattgtgttgcatcctatgactcttgaagctgtttttgagaatgatgttgctagagctaagaaagagaaaaatgttgagcatgctaaaagtgaaaatcagattgtagcaaaagaacttgtacaacataacaagaaagattctaaatctgaacatggtaaggacaatgtgattaaatcgaaaggtccttgtttgcttgccactaaatctgatattgtcaatttggatacgagtgacactatttgctatgctctcatttgtaaagaggccttgtttccttttgagaatatgcctatctcttttcttcttggggtcactaattttttgcagaagtattaggatgtgtttcccaaggacgtacccccagggctgccaccggtgcgtgaaattgagcatcagatcaacttgttggtaacaaagatagaaagggattgaattttgaacctggaaatttggtttggttgcgtttgcgaaaagaatggtttcctaatttgagaaaatctcaatggatgcctagagctgatggaccttttaaagtattagcaaagattaatgagaatgcatataagcttgatttgcctgtagattttggggttagtcccacatttcacattgcaaatttgaaaccg

SEQ ID NO: 53270 - DNA, 1207 bp, Oryza sativa
gtattatgcctcaaatttgatgataagccccaatgctaaaccggtagaaagcgcgcaaaacctcttgccaaattcaccttaacaaaattgtttctcaaaagcgctaaatcacggaaccaacatggcaacatgggtggttcactcttggaattcgcacgcagatgcacgcagctagtagtaggcgtgttgatccagcgactgaagcagcagcgcagcactcatgtgagacggtgagagtctggatgatgactggcgactttgttaggactcgggaccagatgagcatgagctgcctgcctccctcccacgacccacgcacatcgcgatcgaccttgctttggcacgtgatgatgttacactgttctctactttcttcgtttcataaaatacgaacctctagttctattactatcatttttgtatttcataaaacggagtaaatagacaatagtgtaccatcacataataatagtaatagtactagagtttttttttttcttttatgaaactactctacccgtcccataatataagatattttagagggatatgacatattctagtgctacgaactgggatagagatgtgtcacattctttcaaaattctataaagtctatcaccggtctctaacttgtaccgctgtgtcatcctggtccctaaactcgcaaatcgatcgtttaggtcctcaaacttgttcgactgtgttatcccggtccctaaacttacagaactctcgttcaggtcctccaacttgttcagttgtgtcaccccggtccctaaacaggacggtctaaaatctttatatcaaaaagtaattcataactttttcatgtgaactctaattaagacaaactttatatcaaaattgtagccctcgacgcgacctacaactttgtagttgaaaagtttttgaattaaaactgtttagggtcccaaaatattgttgcatgttatagattttgaaattttaattttaaaattacattttgggacaaaaaatgacttaaaataaaaaaattcaactacaaagttgtagatcgcatcgagggctaccagtttgatataaagtttgtcttcattagagttcacataaaaaagttatgaattatttttaaatataaagtctttagactgtctgtcctatttgacccagatgatattcaaatccaaatttagggaccggtgtgacacaactgaataagttg

SEQ ID NO: 53271 - DNA, 3202 bp, Oryza sativa
  unsure (1)..(3202): unsure at all n locations
acgtcctgttgaccctcttcagcgtgccatcgcatcatcctagcattccccttgttcctgaacaaacgccttatccggggtattataggaaaataccacatcaccttagcaggaattctcttctttgttagctgcccgtcaacttctcctggatcgtctcgtctaatcttgtatcgtagtgccttgcaaacagggcatgcttctaggttctcatactcctcaccgcgatataggatacaatcatttggacatgcgtgaatcttctgaacttccagtcctagcgggcagactatcttcttagcctcgtatgttgtctcgggcaatttatttccctccggaagaatgttcttgacgagtttcaataaatcgccaaatgccttgtcactaaccccattttttgccttccattgcaagaactccagagtggcatccaactttttgtgcccctgctcgcaacctgggtacaacgaagttctgtggtcctctaacatcttgtccaatttatgggctcccttttcactttcgcagtcctccttggtgtcctgcaacatctgaccaagatcatccgcaacgtcgttaccatcagcatccctttcctcctcgcccgtttgatttccttcaaatccaacgtactgagcaaagtccggaatattgtcgtttccacttcatcttcttccatttcaacaccttgctctccgtgggatgtccaaaaattatagcttggcatgaaccccgactcaaacaagtggaaatgaatagtccttgatgcagaatactccttctgattcttacacttattgcatggacaacaaataaaacccctttgcctgttagcttcggccactctcaaaaaatagtgcacgccgtcaataaactctttggaccaccggtcagcgtacatccattgccgatccatctacatgagtcgagaaaaaatcgtacaaaaataattattcttacaataatgacagtcatacaataattataagataattacaaactgtttcaacagtcatataataatgacatatctttattcatacaaaaatcataaaatattacaccaaataattcttatttactatttctaaagttttaaactaattttaatgtgttttacttcttttaattttcattttagtttgttttctagtattcaagattaactctcactatagttttccttctcaactattttataaaaccttctttagcaaatcaactaaatttctatatattctttcttccccacacaaattttctccctcatcaacttacaactaaattttggagacaaaaaagtatgccaaacatagctgcaaatgtaatatgacaaaaaaaaacattggaggatgaagatgcaaaccttttaggcacctccgatttgtatgtaatcaccaaaataaattcactagaaattttggcatgacctcccctcttttttgaagaaattttgaagcttgctcgggcagctggaggaggaagaagacatatatataggggtgggactttagtcccggttggtaagttacgatctttagtcccggttggtgggggtcctgacaggccctgtcagcatttgaaccgggactaaagatgaccttaccaaccgggactaaagatcaaatatgcccgttaccctttttaaccgggactaaagatcatctttagccccggtttttattgcatccgggactattgtggaattcggccgaccgacgaaagatggtttctccaccagtgataggccggagtacacgactcgctgcctctcattatatcgcatgcacatgaacacacacagaacgtcaatgctatagctacgactggctggttgtgctatggcctctctgatttggggggcctcaattttttttgtggggccctgtacgggcgctccgtttgcacgccctcatcgacgggcctaggtgagatgggagaaacttcgtcgccgatgcttccgaggagagggagcgactgccgctacagaggggattggaagtggtgagtatttggggccacggtagaggaggggtaaaggtgaaaaaagttaagggttaaggggcaccttntacaaagngtggnngngtacggtcgnnngtagattagaggtggtcagaattgtattagctagtatcctcaaagcaacctcatcctacatgacgtgttggaacccttacactgtttatggtcttacaatgtgcaggtttgtataatgcgaatggaattaaaatgttcaataatgcaacatgcaacataaattagcgcatgctgatcaatggaggacaaatatatgcaacaaatttagtgaatgttaataaacctgatcggtgtggcataattaaaatggtcacaaattgagcgtgaagatattatcctaccacccttgcagcataggcgtagggataagggactagtaagggtcatgagccatggctctctcatattttatatacctcactattttctctgacttagcttgcatcaaaattagttataaaaaaatttagcactgtaattagtcaaaatatatcgcctggcatataatttagtgctatgattcctagcacacatccactatctaggttcatattacaactggctacgtagtaacttgcagcatccatcaaggtgccctgaccaaatgagagagagagagagagagcgcaatcgctgttgtgtctaatatttttcaagtggtgcatgtgctttaaggactatttcaacattgtaaaaatacatggcttttccaataaatcaagggcggaatttttttttagctaaatactgagagaatcaacactcaccgataaaaaaaaactagttcaaataaatgaggctaactaaaattctatcattacattggtttgaatcatactagttatgcaatgtaaaaacacattattttgttgagaccaagttggtccaacgaagttttgttgttatagccttattttctgatctccttcctcgtagagcgttttgtagaaaggaattgaagcatagaatcaaagcaagaaaatgttgttaggcatgtgcgtgcacatgcatatggtagtaccaaaaataacttcctctaggatagaactgtgatggatcagatgaagataattattatggtgagtacgttggattgaccacttgagtctccgatactttgacttcttcaattttgtatgtagggccacataattttcctttt

SEQ ID NO: 53272 - DNA, 1127 bp, Oryza sativa
agtttccttttagagaaacatgctcgtttctagccataccagtgtaggataagagcgtgatacgtgctgaccacttacgttcctcctgaatgaatatctgattgatgatagttagctgcttcttgtttagggtggggggtatctatcgtaattcattttcagataggagaaaatttgtgggttggtacgataggttagcccaggcatactaaatttggctttggctaagctggttctatcctttcgtttgatcgcagggtgtagcttactatcatggcgtcagccactggagcgtctggatggctgaggggtaaggtgaagggtgtgacttctggggactgtcttctcatcatggggagcaccaaggcggatgtcccgccgcctgagaagtcgattactctgtcatacctcatggccccaaggctggtaagatttatatggacttgatgtagtcagacaatataacacattttctaggttcatttgtctcatgaatttgtggaagtgtttggtctgttccaaagtggacgacttttgtgtaacccctaaaactaatggaaatactccatccttccttttttatatgaccaatgtcaaacaaataaaaccagaggcagtataatagtgacaatcggactctttccaccaccgcatgcattaatattcctacgctatggttttatattttctcgtgtagttcaaaacttatgaatttattcttattctccagtctttccctccctttttgctttatgtattgaaactaaaactttgtgctgctcaaggctcgccgtggtggagtggatgaaccatttgcttgggaaagcagggagtttctaaggaaactctgcataggaaaggtactccatgtgaattttagatcttctttgaatttacttaaatgcatagatatcgattgtgtttgtagaaaacatgccagtttccctgttaccaatgaaaaattcaaacatggtacaggaggtcacattcagagtggactacacagctccaaatgttggacgagaatttggtactgtttacctcggtgacaagaatgttgcctactcgataattgctgcaccatgggcaagggtaaaggagcaagggcccaaaggcggcgaaccgag

SEQ ID NO: 53273 - DNA, 4745 bp, Oryza sativa
ctgacaagtgacaacaatataacaaagcaacataacgttctagatgctggaaatagtttgcacgaaaaaaaataatgtgtataaatcaggtgcatgtttatcttatctatcaagaggtaataagtcaggtgcttgattgtcattgtatccccatcccctcaggaaaaaagaatcaacaagaaaaactactttgaaaggcacacacatgcaacataccgcagtggcagacccagaggaaaaactaaaaagcaaaatcaaacccagtatcctctgccagtggtgtgtagcccgacatagatttgcccctgcctaccagagtcctatcatggttggcttccatggtagctgaaaccaccacagttggtgccactggcatactaccaccttcctagatgcacaaattacacatctactccctctgtcctagaaaaaaaacaattcctaactttaaatctgaacaattgtttatccaaatgcaaagctaggaattgtttttttctgggatagagggagtaaatgtgtaaattgcactaatcttgtttgctacctcaacagccacctcaaattgtccacactatggccacatgcatctagtttccattttccaaccatccatcacgaccagaatagcaaaaaaataaaatgtatcatcacataaactaaaatctccaaacgtatattgttctctcatttaactaaaatctccaaacgtatattgttctctcctctttattaaaaaagaaagagaatcccccagcttcaattcttattgaaacaaagtatcagtacactctagatcgtttaggcaatacaaacaaacgatgtcctgcaatcatcctcttctgtaatgttagcatgttagcatcacgaattctaaagcatatctccacagcaaaatcagccaatcttcattgtgctaacaccgcctgaccaaacaaactaaatcgtataaaccaatcaacataacacaaccagatagaccaaatgcttccatagatctaccaaaacctcctccgaacacgacgagtttccaaacatctaaaacccaacctcgctagcgtgcaaaaccttctacaaaatactaacaacacgcgccatacctacacaaatctaatcaatgcatgtatatcaaaactaaactaaacacacatactggcagaagaagcaacctctcgatacaaacgtgtctaaacctgacctatccatcgctcccccacgaagcgaacaaagcgaaagcagaggaagacgagagatcacctggagaccagcgcgggacgagcgggagacgggggccttcttccccttgtccttctccgccgacttggcggccgtcgtcttcgcggcgagcaagcccttacctccttttcccgccatcgctctctctccctctccctctccctctcctgtctcctccccttccgctccgctcgaacgcccgcgcgaccccggcggcggaaaccctgcaaaacgggggccgaatccggcgaggcgagcgccgggtcagagcagatcggggcgcgaatcgtgcggatctcgccgcccggcggcgaaatccgcgcgggaagcggaggaatttgggggcggattcgggattcggataaggcggaaacccttacctttcgcgagctcgcggagcctcggcttcctcctctcctaccccctgacgcgacgcggacgaaagcgagattttttttttcctcttctcttcctttctttactcccacgaaagggctagctagggatgatataggaaaaagtgcgcttttcacttaacccctcaaataataatgatattattattacatataatggggggcgttggggagagagagactctgtgtatagggagtctttgggggatttggggaatagggtagggtggtatgtgggaaactaccagccgtgcgccacttggcgaaatatttcgaaatggcgtgccggtttccatatatgccctcgacgctgcggataattacgcggatgggtgggagaaatcagcagctgagacgggagacggaggggcatctcggtgagggtatttttgggaaggtggagcggtggcgggatgccgggatgtcgtgcgttttggggtgcagttaccaaactgcccttgccagaggggtcgttgacctgtaacttgaaggactccagtcgagttgtgccggtgtgactggtgtggtggtgcaaatggccaaatgctttttggatggcacgccgccacgcttttcttttgtcttttatattttcaccttgtagtacaaattcgtacaaaattactctattcgtatgatcaaattgttatcttaggctgtgtttagattcatgggtgtaaagttttgacgtgtcacatcaaatatacggatacatattttaagtattaaacgtagactaataacaaaacaaattacataatatgtctgtaacaccgcatgtaacaaaaacaaattacataatccgcatgtaaactgcaagacaaatttataagcctaattaatccgtcattagcaaatgtttactgtagcaccacattgtcagatctggagcaattagacttaaaagattcgtctcgcaatttacacgcaatatgtcttattagttatttttttcgtttatatttaatactccatacatatgttcaaacattcgatgtgataggatgaaaaaatttgccagaaaatctaaacagggccttacacatgttcttttatgattaagatgtagatttgcctcagttttcgttagcttagttttcaaaatgctaaacgatatattttgtgcgaaaactttctgtataaaaattattttaaaatatcagataaaactatttttctcaagtttggaataactgaaacttaattaatcgtatctaactagtaatatgcccgtgctaaacgctacggtacaattctatttctctttaataacttttaaaatcttgatttttctattcgtcacataagacacacgccgaccgctaccctttgatcacatagcatgatggcgtgaatataaacccaaataacagtttaataagaagtagatataaaattaatagttttaccatgtataacaagataacaagtggttgtcatctcgctaacatcttctttcatgacccgaatactaaaaagatatctgtactgaaatttattgatggcaaaagtatatgttcagaaagacgtgttaacgtatagtcatgttatcagcctggtgtaaactgaagcatgtatcatggtatggtatggagaacataattacacgatattccaactgaatggtgatgtcgtgttgtacaaagtaagtggacattggtgagtaacattcggatcatcaatttactatcttctagattatgttttcgaattaattttaatcatgagaacctacctttgctcaccagtcgagaacgtctttatacacgatattttattgccaggtcccataaccaacactacaatctataagcaaaactaattccgacacactgcgggagagatgagaaattgaggaattttatggactgatgcatttgttgctattaattattatacttgcccatgattttttcattaaagtatgtgtctgtttttcattagtatcataaggtcattacatcacaacttttatattacgtgtcgactgtaccatgtaacgaatagtgttcccatagaccctttgtctaataagatgtacactcccctgaatatgttagctatagcatgtgacaatccaattattgtggactgtgtaagtttattttggtcatagattcagaaaataaaatgagtttgaatgaatattgtttacttaaattgctcctaagttggttcaactgtctccaaaaagatgtgaggcaatgactccagttagttagttctgtatacagagtgtatttgccaccctttgaggggcaatacttttatgaagcttaaaaaatgaatttcaatacatctgccctggcttgaaagtaaacatgattttattttcaagattgcattttagtttacagtagatgtacactgtagctaggtctgtcatttttatttgtaaaactcaataggtgtaaccgctggtccgctgctattttaatgcagatttcaaaaccatgtataccacaattggtactgttaagcagttctgcatcaacactggttattattatacaataccactatgttaattagtgtggaatcacttacccatgtcctcttaataatttatcctctgattgcactaataaaattagggtgctatatggcataagttatgcacgcaatacttcttatcaagatattctaaagtaaaacgtctcaaatacagctacaaacattgacaagcgggcatattacatccacacaacagtgtattgtttcaggtccctagaaatatacctaatgctatgagagctattcattcctaatttagatggtgaaactttcttgaaaacaagaattaatcattccatatgtgcttaccttttactttggagcaattaggcacaggcaaggtgattctttctgttccctcaaggcattctgtttataccccttggaattggttgggcttgaatccaaaaatccagagcataaaacaatatataaataaactcccaatgaaatgttgcaaaactcccgatcacaatagattcattggtctactttataatatcttcctccttgccctctaccacatgcaaatgtagtaggaccagcctagttgaaacaaaaatgaaattaggaactaca

SEQ ID NO: 53274 - DNA, 21451 bp, Oryza sativa
ttttcctgattcatgcaaaactgttaacgtcggatacaaggaagtggacataaactattttcataagataagacgcatagattattttcagtttattggcctgatctttgcagttaagtgccatatatattttagtatttgacatgtggaactatagccacgaatccgcttactgacagatcaaatcctcctagcataattgactataataaagaacacattggatttgaatccaaggaaacatatcacacatgcacgccatcaatcacgggtgcatgtactccaaatatacaagggtctaaatatacatttcactgatatagtacacaataaattttatttgtaaatatacatgtgtcaatcaattggacaatatcaaagacatttatttctttggagcatgtatattgtacctgattggagccggcctatgtaacctgacgaatgagtttgaaccggcaacggcgcttccaatggaaggggaggttggccacgatgaggctgcgtccctgactggacggcgatgaggctttgctcgataccgcgacaggaatcagggaatgcggcagcggctgagaggccggatgagagtgatggcacctatagaaccatcttctcaatagagtaacataacaatgtatagtagtcaataaaatcagtttaggcaatacatcagtgcttgcacataaccaatgcagcacattttacatattcaggtgtcattatttgaaaagcaatattatgacgtaactcattgaatccactgccacacggataatagacccaccctggatatttctttaaacaaatagacaaaagcattatggaattttcagaaagtacatagtttagctcatgtaaattttatgtggctggaattagctcaaggaaagaacgaatcccatcatcatgacatcataccatctcattgtcatgttacattttcaagggaaaaaattatcactgcacaaagcagaacttggatataacctaaaagtaccagaagccactctgaaagttggattaattccattgttgcagcagttgaacgatataatacttgaaggttgtatatgcacgctactaattaaagcgcttcatctgaattacagacataaacatcctgatcataagagaaattaaatcatttgcattatataaaaagttgcagatgctaatcaaattgtttaaaacatgacgtcatcattgataatttagtgggatatgtgcacacacatcagaaacatggcactgtcaatccgcaagtaaatgaattgccattgcttattaaattttggaccaatcgaggaaaaatcaagaagaggaaagagcaaatgaaataagagaaaaggatctccatgtaccaggcagagagggccgatgacactgatcaggtagaccgccggtgaatcgggtagatgatggacgcaacctagcggcagtgaatcagcgacggagctacggccgagtcggcgctttgtgtggcagcggcggcgacagtgtgagtcaatttggaggcaggaatcgaatgagaaacacatgcagataataactttttgtgtcataaacgcacataataatttaatttcaattatctcactgatgtattctatagtgggagggaggaaaattaaacagcaagtacatattcatttgtattcactattttatctctatttcagtaactttgaacagatgcataatagccattgataatttaatattaggatgattcatagtagaacggagccgctccctaatgatgaagctcgccacgttgatccaatgaaaaaaaataaaaaaaatagaactaaacaatcaggcctgaaatgttcagactgttcatgcttatgctctaccaactgctatacaattaaagaagaagatccaagaaaacatatgcgtaaaatttgagtttccacctcacagcaagtttcttctctgacaaataaaattatctaaactcatatcacagtaataaaaagaccacaaccaatatcaaatcttaaatactgaaggacctaaaactaacttatatctggattggatcgtaactgctgaaggcaatactattcaacacaacggtagaaaatgtacattatcgttaaaatgcctgctcatgatagtgtaacctataaagagatggggatttcagtgcattcgcgtttgggaggggaggaaccggaatatagatttggattttgctgtgaataaagatgtactaattatttgacgaggcattaccatcgatccatccaatctgcaaggtgctctctaccattgtgacgttctcgctcccgctgtcctgcacacacacgcaaataacaaagaaaaaaaatcagagaagggggattggagtcaaggaatggagataaaaaaaaaaagaaaggaccaggaagtctgggcttctccgttaaaattcaaagagttagggataggaatttaggagatcggggatggagaccttcaagtgtacgatgcaggcaaggaggcggtctacgtggtgggacgggcgtagaggagacggccgacagcgacggggatggcggatgtagggttggcgcgatggtgtcttggcggcacggacctcggtgactcatgtgcagggtatggcgacggggacggagatcccgaccagcgtaggagaacgtgcggagcggatgaggactgcggcgacggcggcgtcggcgtggatcgtgggtggctgggtgtggctgctgttgagggggagcggctgaggaagaggcgttggaccatcggcggtggcagaagggctgaggcgcgatgggagagaggggagcgatcctgcaaagagatgggagtgaggggaaatcgcgaaatcacggatgaggagatcacgcgaggggggaggtgggagcgacgggatggggaggagatcgcgattggcgtgaggcagcgtagtggttggcgtggcggcgtccggtttttgggggcagcggcatggtggcggcggcggcgtccgtgtgcgagagagaagtgagagggttgcgcgcaggttgggggcggcgaatcagagtggggcccacgcaatcacgcgattgatggaggtgggaggcgggggatcgatctagaccgttcgattttacacacagatgatctggaccgttccatgaggaatgaaagaacgagtgaatgagtgaaaccatttgttacaactataggatagataactttctcgttttacatgtctataattaatctttattttcatcaaattcaaatggggcgtatgtccaaaataatccatgtgtgaagcgctagaactactggtggaaacacaagatacatgagaaacttacggtgattagctgacgagaatctaatatattgacgtgcaatccttttgcgtgttcgcgaaaaaaaaatagccgacgagaatataggaaagatacattttctaacctttcactttcaatttattttctaaattctgtaacttgtataaaagtatagaatatttgaaaagttgcagtttcctgaaactcctcgagcaagggctatgtgtacatacactgagtggacccatcgtattcataccaagctcgtacaattatacgggtagcagttaatcgcagccccgtcctcatcaatataggtgaacagaacttctattgttttgcattggcatggcaatacttccaggggctcccggcgcacatgtttcaggctttcagcagtaaagcagtttctcctaaccttggaagttggcacctttgaagtactgtcaatttctagaactcttggttttgtccaatcagggccctgagagaatcctcctctacaaatataaagcaattatagcgtttgaaatttgtccagctacccctcgttcaatttcctcacctactccccatcccaaacaatcaggtgatggttgagggattcaaccggaggcatgaaaatatttttatcccaaccataatttatcttaaaactttcaggagtgcttgtatttgtcgaggatggagggagtggtatgcaaagaatgaaaattcagcaggacatccgttttttcaactgcacggatgcatttcccaagaggcgatgccagcatgatgatacctgcaacagacagaggaacatgttggaacataaatcagctaccccacccaagcaacagcatactgtgaagtaattccaccctcaaaatgcagcttacatgcactgttaataatctggcattgatgtttgtggtgcctactgtacatgtgtgagctcagcaaggctggggatgagtgtgcactagttgtcatggcacaagaatgtgcacagttggtgcagtggacctgtggttaaaaatggataatccgaaacaaggattgtgtgtaaatgcttgaatcggggaaaccattgactatggggtgcagccgtgcaggcactcctttcatatgccatatggtgaagcgtggtgaacgagaagggatggcatggctcaaggaggaaatgaggtaacaattaaatattgttattcataatattagcgaatggtgaaactatacttacagatggtgagagcagaaatgcatttaatatgctcaggtggtgatgaaaaataggggaaattggtgaccattgacaattctgcttaaatataataaaatagcagcaggaaaaaaaatcatctatgagagctggaataaatttgcttgtatggaattcttgttctgaaaaaaaaatactggaacaaataaacactacctgaaacctgatggacagttaccagcacattatccattgctgcactgggactagtaatcttgctgattgtagcttgataagaatgtggtattgttgccggccattgtcacccaatcacccccaatcttgtcaacgttcatgaaactgcacctgccaaaagatgcatttacacgttacataagttgcaaggtttgtttgtagtaaaaacatcattagtttattttactatgcaagaagagaaaattcctgaatcttctagttcggtatcttcaattttgcactgctgaggaagattcccacttaagacaaccccctcaggcatctacaagattttgtttccagttccgaaccttcgggcatttagaaaattccgtttgcagtttctcaaaataaggtttacgagtatactttctttgttgccgtacttgatcagcatctaacaaagatatggggcttcctatcgaatttattctgggccaattggctagctacagttcaaagagttaagagattttatcagagaaagcttggatatcatggctatacattatattcgtgttaaacattgtgtggaatttcttccatacttttacctttgtactttgcagtctcagtgtctggtagaatcataataacatttgaaatcaaaagactcaatgggattatgggattatctcatagatctggtagattttgatatcaagtttcttttgatcagtaaacacttaaatgctagtgcaaacattgcaggcttcactcaaataattagcgatgactcacttataaaaaaataataaccagcgataattgtagaagcaatctctagtgcatacagaatttatgactagaggtatagcttacatagaagtgcaggattttttttttactggagaagtgcaaaattgttcttaatgaatctagatcatgccctgaaatttgatcttttatgaataaaaatgtctgcttcaattcctgcatgctggaagaagagaaaaatcaatatgtattcagaatatgttgtgtgaataaagaattagaagaaatcaattaaagggagcgggtaagcccagatactgttttagcatcaaagttttcaccaataacttatagctagtggtttatgaataatactttattccccagattgaaaactgcattcttccaggttagaagaggatgagtaaatgacatgtgcaccagtaaatgtgtttattgggagaaagaagtgtgcaattgaaaattagtactgcctacacaattgaaacatactcctacctagcatatgaagcaacagaatcagctgccaaaagtactagcacctgctgattttctcactcctttcctttccatattctcccttacttcattgctgtagttccactgaccttcagcagcatacatgttggaaagcaaaacatatccaccctcctctgcgggttcaagacagaggagttcctttgaagcaatctctgctacttcagtattctgacaagctgaactcgcacttaaaatggaaccccatatagaccgacttggcttcattggcatcctcctggccaaatctactgcatcagacagcctacctgatcgtgcaaggagatcaaccatacagccaaagtgttctactcctggttcaatgttgaacctttgcttcaaggtatcaaaaatcttgcacccttcatcaaacaggccagcatgactacaagcactgagaacagcaaccaaagttaccccattaggttctgtaccctcagcttgcatcttccaaaaaagatccaatgctacatctccatggccatggaatgcaaggccagatatcatagctgtccataaggtaacatctttgtccacggccttctcaaatacggcatacgctagcttgatacttccacatttgcaatacatatcaacaagagcggatgctaagaaagaatcttgagtaccatgctccttaaccacccaaccatggacactccttgctgaatttaaagtccccttgccggcaaccgcagagatcaaagtaacagcagtcaccttatcaggtattacactactagcaagcatatcatgaaatagtatcattgttgcagagaattcttcatatcgagcatatccagccagaagcgcattccaggatattatatccctggcaggcgcctcaccgaaatatttgctagcaaggtccaacaagccagcattagcgaatccggcaaccatagtgttccacgaaatgccatccctctcaccagcttcatcaaagactctcatggccgtgttcatttccccgcatttggcatacatatccaagagagcattgctcaagatcaatcccctatccgcgacaccgatcctccgcacgacgacgccatggacggacctaccaagaactgccttcttcagccgcccgcagcaagcgaggagagcaacagccgtgtactgatcaacaccgatccccctcgacgccatgccgcggaaaaaccgcagcgccttcccgctgcatcctcccttgacgtacccggacagcatgatgttgcaggacaccgcgtccgccgtcggcgcacaccggaacatcgcctccgccgcctccacatcgccggcgtcgaggtacatcttgatcagcgagttccggaggtacacgcgcgaatgcaggccagtcaccaccacgtgcgcgtgcacctgcttcccgacggagcggcgctccgcatccaccgacttgagcagcgacaggaaggtttgctcatcggggtgaatggatgacgccagcatcgacatgtagagagcacccggccgacgactagccgaggaggaggccgccgccgccgccgccgcggccgaagagagcatgaggttgtagatgtagaggttggggcgaggggtgaagtgctcgaatagggtctcggcggcgcgcgcgtggtgcgggaaggagacggtggcgaagtggaggagcctgctcatggggaaggtctcgaaggcgaggcggaggcggagcatgtgggcgaggatggccttgaacggccgcgccccgccgccgcaccgctcgaggaggacgagcgccgggtggcccagccggagcgatacggtcgggtcccacggcggcctcccggcgccggcggtggaggccatcccgccgccggcgagacgggagcgcgcgtcgggtcgaaggcgcctgccgtctccccgggcggcggtaccaccgtcgctgtttgggagcggcggaggccgtccggagagggccgcctcgccgccggcgcccgcagcgcctccgagccggtgccttcgcggcggcggcggcggcggcgtacggcgaggcggcgccgcgtggcagaggcccaacagctaaagtaaacgttcgccaaattatgggccgcgaaattacttcatgggctgaatattatgcccaccctctaattgcgctacgctggaaggaagcccgagaaaaaaactcactgttgcaacttgcaacggccatactagtctgttaaaaaaacaaaaaaaagacaattctagttatgaacctgagcacatatatatttagattcgtagttaggattttcttttatggaggggtaaggcttatttggttcgaagaatttctaaatcataagaatatgaaaaatagaaaaattaagatgtcacatgtaatccaattcctaggattttttttctaaaatgtctatctcatactaagaatcatatacgataaggttataggactatgattcttaagaattttgaaacgaataatgtatatataaaaaaaatcctatggttttaattagtacaataatcttttagaaatcctttaaaccaaatgagtactaagctaaattgtgtaaactaaagtgtgtgcgcatgtacccatatagtgaaatccgtttatgctcaagcaagatcgaaatcagacgagaatcatacggtgctagctcagtttgttctagggataccatatttaccatggtcgattcacgtcacatgaaaaacaagggtctttctaatccatccaggaaagcttgtccagttctaatcactttcagtcagtgtcccctgataaaagtttagtataaaaaagagagcaagatataggcccctttgaattgcatgattaaaaaaaaagagaaatagggaaaacacttgattctgataatagtgcaagtgtaaaacagatgattgcaaaacacaggaataaccatttgattggacagtagaaaaaacgcaggaatcaaataagagagataaattcaaagaaaattttcaagagattagagacttagagtggatgttaaatttcatacatttttcaactagaatcgtagaaataagaaagttttctttcctatacgaattaaagacataaataattaaagacatgaatagtgtaggatttcaattcctcttttttttttgaacatttttcctccaattcaaaaggggccataaagttttgtaccttcacctgctcatcatatgtcgtcacctccatccccccatctcatcaaatcaaacaagacaatgaaaactgatcacattcccctggttaagtatgccattggcaaaccattatcgctcgatcacaaccaacatgatcttcagtttaccagatcaaaacccaattgctcccgaggaatattaccagcagtgtagtactagtagcagatacatgtcatctgcttttcgatatgagccgttcagtcccgtccatgtctgccatcaacttgcttcgtcagagttcatcagactaataccgaccaaccatcatgcatgtgcagagcgatcgatttctctctcgtctataccgaacactcgaatcgatcgatcgacaaaagcgtaatccggatcttcgatctgtcaggaaccttggcgacgaggagttaatcaacgggtgatgagatcgatcgatcgatcgatggatccctcctctcatgtcggttaggcgacaggaaagattgcgtaccagcgatccctgctcctcatcgacacaccagtctgtacattcctcgatcgatacggcgatatatatctcgatcgagcgaattcaaaagaaaaattgtctggtttatcaactctgcatgcagcgtttgatgtgattcgagtggcactttggtggtattttttttctcccgaaaatgaagatgaagttctttacgcaaaatgagacggtattaacatatgattgattgagttttaattattacgaacttgaaaaatagattaatatgatattttagcgcaactttcatatataaagttttcgcacgaaacgcaccgtttagcagtttgaaaagtgtgccacaaaaatctttatcttcgtccaactcttattggagaatgaatgggacctttgtgtgatatggatcctatctccagcctccagggaaccgaacaaaagaagagaacaagtaagagacgcttcgatcgtctgatcgacacaggatcagtggattgcatgtatgatcgatatacatccactggccacatggttccactgttatttctgcaccatgtttgattacgaacaagtagctaattagctatagctagtagcctagtactatgtactaatgcaaagtacgtacagggtacagcccaaattaattctatcttaagccaagtactaagtaccagttagttcggtacgcgtattagcagctgggaatagtcttaagacagcggtacaatagtccaagtaggcactaattctgggtcgcatatgcattgcagtgcagtgctctgatgggtgtgaagtctgaacagccggatataatcgagcaaagggaagagggagggggacaagtgaaactgctcatgtcgtccgagtgtctccggatgccacggttcgctccactgttgttcggttgagacccaacagggacacgcacggcacggccactgtttgtccgccacgcccacgcacacgcacgttgcaagagctattgctttccgtccaaaaaaaaaagatcaatcctatcaacgaacatagactgatccgtagttaggagttggtttattttgaaacgaatggtgcagatggttggattcggcttgggcccgggtgcggtggctggtggctagctaagcatcggtcgatcgatcggtgaacgaattctatgagtttgtcagtagccatcggtgtcatatgttattatcgtcgtcgctgggtcatatggttgtgacttgtgagttgtgagttgtgagagagagcgtccgtgcctaaataattagctgttgaatacccatgccgttcgtgcgtgcagtggggagggaccggtccgattgctgcgagatcgatggagggagcaggtcccgttcacggggccccggttaagttgtaactactgtactgtgtaagcagtagtaggatgcagctaccaaagaaaagcgagtggccatcactacaactactgcattaggatggatcagtaggaccagcgtcgtctcagcttgctggtatttggtccattgctgcgacgcgtacgtacggcgggaagcagcgtgggttccctccaccaccgcacaacggccgagtttagtttcaaactttttctttaaactttcaacttttccatcacattaaaaataattttttcacacacgtaaactttcaatttttctatcacatcgttctagtttcaaccaaactttcaattttaacgtgaactaaacacacatgggatgggagagccaaacgggccacggctctgcgcgcgtgtgtgcagtgtgatcgtctgatcgatcgatccatcggccgcgcgcgtacgggatcacgcgcgattcgcaatggattaatgggtgttggatcgcgtgtggtgtagctgcttttgtagctaggcgagacaagcgccggctggccggccgcccgtcgagatgaccgtcgtcgtcgggcacgtacgtcgatgtctacgtgcgtgcgttccggccggccggtgagagcagctacaataagtccacatcagtaggctatagtgtttcatatagtaaatttttatctagttggaagagagagagagagagagtgaaaggagagaggcgctggctacccatgctgcaggcctagcttttttccctgcatgtgtgtgactttgtacatcctttgtgagcagccaatcaaatggtactacttaagatttttttaaaaaataaaagttgtacatgagaaataggtagagataactatagagctcattactttatttattagcttttgaaactagctataacaggatgatgtgttatttttgtagccaatagcgagctctactattaaccttgctctgaggcggccccacacatcgagctctccgttaatttttttgtgcgcatacgtgtggttcaattcgaacggtcgggatggctagtttgttggttgcctaagcgtgtctacactgacatacatgagagtatagatagctaatagatttgttaaacggcatccaacagaaaatttaaagagatttcttcaccgctatatatctgcgctaagattcatgtatgagtcccatctcctccagctctcgtaagttcctcctcttcttcgacggcagcagcatcccaactctgacagatgagctacgaattactaggtttgggatcaaaatttgggcaaagagtaggggaatgaagtccacttgggcttagagggataatcgtgggcgtgcaaacacaagaagacattgtggtggtgccatcgctgctagaaccacgaggttggaggaaacggagtcagtggcgatatctttagctacaggccggatctactggagacagtgaagatgatgggggcgggggaccttgctgagtaggggaggcggcgacattgacatcgatctactcaatctggaggacgcggcgttggggagatggataaggtgaagttatcgtagcagcactaatctcaaaccggtatgggtagttcaaaagtgaataagatgaaatggatttcctcgcaaatgttacataagcagtccctcaatctagagggaagtggactttaaactcttgagagaacatcctattgttgtttgcatgtcattcaaatagtgttatgaaactttttaaagaaaatcaagaaaatggttaatatgctatatatgtatcaatccgcaaacatgcgggttaatattaaattttattagttgaataaacaaatcaaactatagttggtcgactattttttttcttttcagcttgtagaagttaaattaaccttatatgtttatggagtaatctatcttattaaatattttctaaaaaaaattataactatttcaataattaaaaaacaagaggatatccctctcaacagttcagaaccgtttcctaatctaaagatgtatggttgttgagtcgaagccaccaacaaacggataatttatgaatacacacccaaatgtgtctgaccgatatccacaccacggtccaaccaccatctacaggaggccataactagctgccagtggctgatcgacctgtcacggcaaaaatacccacgacgcgcgcggtgctcagtagctcgatcggcctctacgagagagatgagcagcttcctttcctgcagggccctggttacgactactatcacgttgatccacgagcatggcgctagctaccgtgtactgcgtacgcacgtgcggcacctcacgcaccgggacagcatgcagggaagcaggcgagcagcgggccggggttccactcccacatgagaatccatcctcgtacgtcgtccggtggcgaactgatggccggccaccatgcatgcgcctcggctcatccgtcgtcatcgacacactgtcacacgtgggcgggggcgcgctcccgctcgagctccatctatcccgtaattttgataaattgaccctttcaaaaaacttattttaaaaataaaccgtaccaaaaactaatttcaggaataggccgtggcctgtcattgacgctgagctaaagcgtatcagcgccactgcagttggtgctgagatttcatctgccgtggtacaaactcgtcttgtatggagagctcagcgccacactccacagcgctgacctctgtataccataaaatcgcataggtgcttcaaaagcaaggaagcgtagatagctcagtggtggtgttgcgtagtagcaatccaaggcacgggagtttgattcctgtcctcttcattttaattattgtttttctcaacttgctctttttatgtgttcttttgaatgttcacgtgccttttacaacttcattttatttttagacttagagggaacgaatataagaaccaaaattatacgattcaagtttaaaattttatatttataattctttggaaaagaaattaataggacaataattcgtggaggataagtaaaagaaaaactgaaaagaaatactacactaacgaggtttgaacccgtgaccttcaagttcaaacttgtcgatactaccaccaggctagcttcacttgtttatctaatgtgagctaaaacgtcccagcgccaccggcgttggcgctgagatttttgtccaccatgacacgagcttagcgccaaatgggttggcgctgatatcagtgttaaaaccgtgggctggcgctgaggccacggtctattcctgaaattagtttttggcacggtttatttttaaaataagttttttggaagggtcaatttgtcaaaattatggccatctatcgatccccttcggcaaggcacaccgcacgcatgcgcgcgcccaaccggccacacatgtggggcgtatgagcagctgcgcggtatcacggacgcgcgcgacggatgcatggatgaatggatggatggatgtacgttgccgtgttggatcctgtgtggtgtggtgtagcgacttgtttttgctcaacacgccaaagttaggtccaacatgatgggatggcgtcaatgatgtcggcgacgttcttctagctcccgatggaagctaagtcactaatgtgaagggaaacggcgttaacattattggcgccaagtacctatttaatttgtatttctttaaaatataggatctatttataataataatatatttacaaataggtcattggcactagtgttttattacaaataggtccttttctgctacaaatatgtcatttttattttttttacaaaaaggtccttggcgccaacgagatattagtgacttagttttcacctggggatgagggggacggcgccaacgttattgacgtcaataacgttggcgccgcgaaaagggttcattcctagaataagttttttttagggatctatttgtagaataagttttttaaaaggtgaaaatccagccaatgcgacaatgtgatgtgcattcctatttctcgatcgaaatatttcagatgggtttatagatcgatctaccgaaagcaagttttattagattgagatctaggaagggagatttggcctagctaatgaagggtttggtggtgtctttccgtgcagctgagctaacgagttccattctgatcatgaagatatcaagtgggacacacttggatatattcgttgatagtttttattttactatttctatgaatccgtctcgacaatggattcatccattcgctggtgattgtgaatagaggaagcttagcactttgtctttggtggctacacatcgcagattgtgctcatttaatctagatggtggcacggagtaatggagatgactccagggtgaaaaatctaatctctagtttacctggattcagtaatatcgacgtttatttgtatttccttcgcatgtgtcttctcgggcttcagataaaaatctcatgtttctgatggcaatgatagataaatgttgcgttttttcttgaaggagttgttttggagtagatgttagggactttatattcttgtctcgattgtttttgagtaaattgctataagataatatgatatgttcatatttagcttaggttttcattttctctaaaaacatatatatggccatctaagcgtgtgagaggtgtgtgtcggcaacaacttagtttaattacctcctaactcatgtagcaacttaacctttccggtgctgttccatcatcaggaacatgataaatccaggttgatggcactagctatctgtcggctacaagattcgccctaaaatggcgttaaaatataccactcgtaagcaaatctccaaaagacatataaacaagacacaagcacaagtgaatagtattacacacaatatatcgtccatctcgtccattcatgcgagtaaagaggatgtttcactctcttcactttattttagtgatggtacatgtatttcctctcctcttaatatatattgaccaccacaacttactgcagtgtaacagtacgcatacatcaacatattccgtgatggatctaaaaaacaatatatggaacttatctccttcttcctcgtccagtcccccttctcatcttacgtactctcccttatttaccccccccctctctctctctttctatcgatggtgatctagtgaagtcgtagggggacccgagttttccatcacccacgctagattcacccctaaacatgctactccctccgtttcagattgtaagactttccagcattgctcatatttatttagaagttaatgaatatatatatatatatgtgtgtgtgcctagattcattagcatctatataaatgtggacaatgttagaaagtcttacattgtaaaatagagaaagtagctggcaaccataatcgcgccgccgcgcgcggtggagagaaggcaaagcgcgacgtacgtacagacgacggaaaatcacatcgcgatggaattgaagcagcgcgagcgtgggcgccgacggcgacagcacgggcgtggaaattgagttgaggcggccggccggctgcacggcattgctcccctacagccatatcgcgcgtgcgtgcgccccatgcgttcgttcgttcgttcgccgccgtatcgtccccacacacgtgtatatatcgtgtacgtttataattcgttttgttagctagcgctcgtcgactcgtcgcgtgatcgtgtcatctctatcgctctatcagatatagattatctcgacatatatcgatcgatcgatcgaaggctaggaataatgctgcgagtgtgactgtgtgtgtgtgcaagtgcggccctgtatgtgcatggcatgggcgccaggccacgccagtgcgtgcgcgtcgtctgccgggcatttgggggtgtagtattggcaggcaggcaggtcggccatgctagcttgcttcctccactccgctagccttttttttaggtaatgaaatatatttcagtctttgcttcgaagaaactacaaccactcgttacaaatatccgttcaataataaaaaaaagcacaaaatattacttacaaagagcaaaaaaaaagaaggaagtgaaacatagactaatgtcaaccaccaacactcaacgaagaatcaacattgttgacaaaaatctatatatccgttgtctctctagcttaaggcatgcagtacgcatgagtttgttgttctcgtcatgtatttgtaattgtgctcagaaaccgaagcctttacgttgccataaaaagtacctatacataagatttagatggggatttatcaaagaccatatcatttctactaatttagaaaaacccaacatatagcagatgtttctacaaggattagtttcattgtttttatatcaatacccacaagtcaattctcaaatatatatgatatactactaggaggatatagaccaaaagagaactgtaccgatttttagaaaaaattagcaaagtggcaattaaaaaataaataatgtatcgtcttacttttcatgcaaaaaaaagaatctcaaactcatgcccttctaatttcttctagccaaattatccttagttatagtactaccttttaaaataaataccacataaaaatcttaatcttaaacaacatttccacgtaactttactctcctcaatatgaccattattcctcttcactccgcttgctagctaccttcacacttttgctctacttaattttctggtgctagccaagctaccagtgcagaagcctgaagctgaattttgccgtcacggcctggaccgtctcaatctgatgcgtacgctgcgtcgtcattcgtcaaggcgtacgctgagtgtgtttagctcacgttaaaattagaagtttggttgaaattggaacgatgtgatagaaaagttagaaatttatgtgtgtaggaaagtttcgatgtgatggaaaaattgaaattttgaagaaaaagtttggatctaaacaaggggcttattttcaccatccctacattaatctgatatgaacattctgacatctatatacgcacatcaatataaaatgaagccatgtcgcgtgcatagatctcaaaagtcacatctcagctggttattagctctactgctaacaaaatctgcattgtttccaccgtaccgtaccaccacacctcagtatccaaaaggtcaatccgtaaaaaaaaatacaataaattggagtgcatatgcatgcactgaatggggaaaaaaaatccaacacagtagtactgtacgtatagtacgatcctgtgcgtactcgggaggggcatgggctcgtttccatgcctccctgctgcctcccgtagacgacgacattgcgacgtgcatctgacgtcgctgcaccgtgctactcggacaccacatctgcagtgcgtgcgtgcatgcatgcatccatccgtcgtcagagagcagtgtaaaacctcactgggaaaccaagcttatatgacggcggcgtcagctagcggcagctgcagagaaatgcagcaattttcagctgatccaaaggcacagctccccagcagctagctggtcagggtctgtgtactgtacatagtagtatacagtactaatattatggttgtgtttagttccacgctaaaattagaagtttgaagaaattaaaacgatgtgacggaaaaattgaaagtttgtgtatagtaaagttcgatgtgacggaaaagttagaatctaaacaaggccttagtttccttcaaacttccaacttttccgtcacattaaatatttgaacacatgcatggagcattaaatgtgaatgaaaaaaaagcaattgcacagttagcatgtaaattgcgagacgaatcttttgagcctaattacgccatgatttgacaatgtggtgctacagtaaatatatgctaataacggattaattagacttaatagattcgtctcgcaatttcaggcggaatctgtaatttgttttgttattagtctacgtttaatacttcaaatgtgtgtctgtatatgtcaaattttttttaccaaaacaactaaacacggcaatagctattaatttatatcacagtagtttgttttaaagttaggtttttttttcatttatctcctactctcagccaataataatcattcatctttaactgttttctcttttcaaccaatcatatattttctccaatattcctatatgcctttttaatactcttaccaacctaaaaatacttatattttacttccttcatcccaaaaaaaacttaatctaatactggatgttaaggtctgtctaaatttataatactagaatatgtcaatattcagtattaggttggtttctgtgggacagaggaagtaaaggggagtacttttattgagttggcatttgccagtgtgcaaacttgttggctggggctgggctagttgcaggtagttttcgatctcattctgaatgcatgcatgcatgcctctacattgccgtttcttggatcgtgcaatgtatgctacggccagtgagactgatcgatcgatcggtgtgtgtgtaggccgggggaggaatcgggcacatgcaacaggaacgtgtttctagacaggttaatacaataattaggggggttagcttaattgggagtcatgctacttctatggattatctgtgggtgtgagccatgctacggagcattattgtatatatattcatgaatcatgaggtgtgtgcatgtatgtattctgctctttctccattccctatcacttccacatcatgtatatatcgcattgcttgtgatgaaaaggatgacaatcatgttgatcagttcataattaatgcttgatcataactgccactccgttcgtttcacaatataaatatttttaagactttcgacacagtattcgaaccaacaatatctataaaaataaaatattttaaataaaaagttttgcatattatgatagtttgtttaatgataaatctagtgatattaattttacatgattgatctttttttatttttatttttattattaacagttaaagttataaagatttaacttgtcactattttaaaaattatttatattttgagatggcgggaatagtcttgctatagattctctaaattcatccctgatttttttaaaaaaaacatttctgctaaagaacacgttattactagcacgaattacttactgggatcctatcatcggtcagcgtcgatcaccggcaaaaagctggcatcgtgtgtcgagatcagaggttctcttcttcagagccacttgatgcgccactggaacttccaatcttctgattgtcctcgatgtaacagtcggtgttcctgtgctaaactttttcatgttaatccccaggtcttgacgatgaacgaagccctaattaattaactaactactccctccattctaccaattttttaatgatgttctataatataaggcacaaccacttttagatattctataatataagtgcagtcccaatcttccacctaggatggtgtctatggcattaactacattgtcatgtaggacttttaacttatatggcactatattaattaagagagagagtgaagagaggaagaaactgggtctcatgcaagacacagcttcaacacaagaacctatgcactagacactatcaagttttgcattgggagataatagtgtcttcataatatatgaagaataaatatgattggtagagaagagagatgatgtatttattaatggcccactttaagaaaccatggtttgtggagtgtagtttctatcatgatgtcttattgacatggcaccatagacactatttatggacactatgagttgggactgccctaaagcatgtatgcatgtaggtaattaactatgatctcttctccattaaattattacttttttaaatcatccactttcatgttctctaattttattggatgcatacattgtatttattagaatgatccaaactacaatatgataataattattttctcggtctttgggttaggggtggttatgccttatattttggaatggagggagtaattaataactattccctaaaataaaaggagtatgtatgtgtgatgattattaatcacgatggtgagataagattaggatccctaacagtaacaggcagagagaaaagtaatgctttggataggggcttagctagggccttaaattagacccaggctagctagctagctagtagatgcagaacagagaaacaacacggtgctagctactctctaaagtagaaagtaaagaataattgtattgttagtagataaggtggaaaatagattgtattgtatcttgataaaataaaggataatctagtgttttatcggtatgtatgagatgagtgaaaagtccatttatttt

SEQ ID NO: 53275 - DNA, 813 bp, Oryza sativa
acattctgaagctgaacagaattggtttgagctgaagatgctctgaatttcagattaacattggggaaatcaagaagaggcaaattgaagccaatgaaatgggacaatgcgatggtaaacgaaaatctgagcttaaagaaggccaaattagcagtctacattaggcatttctcgatggaatctaggtgaaagatgaaatggagcttgaaatgaagtgagcggcgaagtgaagtagagtactaagtgagagtgataagcttaggctgtgagcagaggaggccgacgaaccttggagcgagaggagaccatggcgtagaggtcggcgtagctctggctgagcttctcgcggcgctggcgctcgcgcatcatgtggcggaaaccgcggctgctctccacgtcggcgccctgcccgcgccgccgccgctgcggcacctcctcctcctcctccatctcctcaccctcccccttctcccccccgccgccgccgccgcccatcctgcccagcacgtccatcaccctccggtggatgttcgtcccaccggtggtgacagcccccgccgccgccggcgctccggcgtgcaccgcgccgccgtactcctggaacgcgctctgcctcgcctccgccgccgcctgctccggctccggctccggctccggcgacgcaatgaggccgaacggcagctccggcgacgccggcacgtggtgggggaagaagaacgcggcctcgtcggcgtggaacgcgccgtagtaccactccatttgcatctcttcctcttgctggtcttgcttcttcttcttcttcttcttgttctc

SEQ ID NO: 53276 - DNA, 4622 bp, Oryza sativa
tatggtttttagagtaccacacattttctctatgctaattctgaaacttaattttaaacttgattttaagatatttttaacatagtttctttttcattgccttttaagtcgctaagtacatatgtattagagatttaaaaaatatttttttaatcgctaataagttcataataagctcttgggcaatcaatgaggcctctgctttgcaaccacacgaataccgtggatgacagctaaaattatggtagcaaaatgccatgcatttaaatgtataaatacagtaaattgacaaaccattatctttttcttaagaaaaaaaagaaaatttggcaggctagtgctctaatcctggttttgcaatgaaataggataacaaagtacttttttctcggaaaaaaaatcaaaaagtaaacagaaggaagaaattgtttttttttcttttgcggggacataaggaaaaataattgttggtatatactttcaacagaaggaagaaagttaaggtataccaccaaacttttagctaagcaaacacttattgagatctaattgaaccttattgttgattttatacattttcaaatttactttaaagttcaagggacttgttcggcactgtacttcaagtttagagggattcctgcaattttcctcaacaacaattaacaattctctgatgaaagggatcccaaattttcaaggcatcattgcaactaatcaacatgattatcttattagcatgttggcgtatttttctcccttcaatacacttaaaatagtatttctccgactgtcgaacaaaagggggaaaaattcaagcaacgagtagattgaacaggagacgctcacacaaatgtgaacttgaatcagcatcccaactattaatcaacacgtcaaatgattttaccacacgctgtcgctagtgcgatgtttgaagagctaatgacgagtaaagacttctcctggaccagctgaatcttctccttccggcacaccattttttttggcggcacagaaacctatggaaacttctaaattgttcatagagtggttactgtgctgttttttttttgggggttctattggaagtggttagtttactgttgacaaggtgtacctttcaatttactaattaattaggacctttataaaataccttgaggatgtttttagcatgtgcatggatgcatgcatggaggagttatggactgatactctgataatgctgtttatataaatcaaggcttaattaaatggtcaaggcaaagtcatgagtgatgagtgattccaattattcagttattacaatgtgttccccgtgatagcctcctcgtgtgttaacttgtcgtagtctctcagttgtttatcatgtgctcaaaaaaattgtataacaatttcctccttctgtgctgtaatttctatcgcaatttgtctatcaggcaaatgaaattcctctatactaccggaccggagactaaaaaactcacaggcacatgtttaataatgatatagaaaattagagattgaaaacagcatatagtaaagccacgtgaattgagaatcgtcataagaagaggttatgaacttaaaataacacgacaacttggcaaaccccccaaagaagtcgtaagacacaaacaggataaattatgagatcgtatatatttccaatggaattaatataattgttgaaaatgactttatatatagaagattttcatgtagcattcaaattttcaaaactcctttcaactacgaatttcccggtttatttctaaaaagactatattccaaaaaaaagggagagaagaattccaagccccttttgaacttagcaatttcccgatttattactagaaattaatttattccccctccccacaccccaccaaaaaaaaatcgtacagaatacttttctgttccaaacagggctaataaaaagctatccactatccctctgttgatcaaatgagtaaacgacggttgagccagtaagcagcttcgctagagaaaccggtgctcacctgcaactaataccagccgcatgataaaaaagcagagaaggtgctcttgcaaattccaggggacagagcaaacgtgccaacaatgcagcgtcgaccggtggtcgcggggaggaaaaatagcttctgctatttcatgtagtagcttctacaagaccacatgtgccaagacgacgacccaagaccagcaggcgacgcgattaattaaggattaatcaattaacccgtgcgaaagctactatatgcgcgtgcatacgtgttggtgttgctagctatagtgagctcatcaagcagtcgtacatgtaggttagtcgacacgagcggtacacaggcgtacagtactagaatggagtgcagtacgtagccaggtacgaacgactggtcgcggtcagagctagcggagtgtgccgtccaagcgactcggtcgttcgatggttgggtggaggagaggtgagctgaaaagctaagcgtcgccgcgcggtacgccgaggaagctaggtaggccgcggccctccttccttctcgtgcaaaaaacgaaaggatatgatgggtttttcacgtacgcgatccgcgctgcgtttcaccgtgacgcgcgtgtgccgaccggggggatacccacccggcaaacggccaccgcgcggccggagctacgcggtcacgaggcctgcgacccctgcaaggcggggatccggccgtcttgtgcgcggtgcatgctgcgccgcctcagctggtgagagatctaaggttcatgtcagctgaatttttctttaaggtcttcaccgtgtttagatccaaagtttttctttaaacttccaacttttccatcacattaaacttttctacacacataaacttcaaactttttcgtcacatcgttccaatttcaaccaaactttcaatttcggtgtgaactaaacacagcccttgtttagttgtgaaaattttttgggtttggttgtcacatcagatatacagagacatatttaaagtattaaacgcagtctaataacaaaacaaattacagattccaccaagaaactacgagacgaatttattaagcctaatcaatccatcattagcaaatgtttactatagcaccacattgttaaatcatggcgcaattaggcttaaaagattcgtctcgcaatttacacgcaatctgtgtaattgctttttttcctacatttaatactccatgcatgtgtccaaacattcgatgtgatagcatgaaaatttttgttttgggaactaatcagtgcctaacttttggtccttttaaaaatcttattctataaatagatcttaaaaaaattattctagaaaccaataccttgccggcaaattttgctacaggacactacttatgtgtggttttagccctaggacattgcccaaactcacttttgggggaaaacactccataaacgtggtaatttggcaattggccccggccccaattaaaataaacctttccggttgaagaggagagagaattggcgtgaaatgtcaaaaatgcctataggcccacatgtcagctctatctcctatctctcttctcatctctctctatattctctctcactctcataggcgcacgggggcggcgtcagtgccggcgaggctggtggtgcttgagcagatggagccgtgggtggagcagcatgtgctgttgctgctcaagccggcgaaggaggcatggcagccggaggacatggtgcccgacgcggcggcgctcggcgcggacgggttccacgcggcgtgccttgagctccgggagtgcgctgcgcggcgtgccttgagctccgggagtgcgctgcgcggcgtgcccgacgcgcacctagtgtgcctggtagggaacatggtgacggaggaggcgctgcccacgtaccaaagcatggtgaaccggttcgagtcggcgcgcgacgtcaccggcgccgacgggacggcatgggcgcgatggatctgcaggtggtccgccgaggagaaccaccacgacgacgtgctcaaccggtacatgtacctctccggccgccttgacatgcgccaggtggagcgcacggtgcaccggctgatcagctccggcatggccatgcacgcgctggtgagccccgaccacggcttcagctatgtcgccttccaggagcgcgccaccgcggcaacacggcacgcaacgtccgcgcccatggcgacgacgcgctcgcccgcatctgcggcgccatcgccgccgacaagagcgccacgaggccgcctacacccgcgtcgtcgagatgctcctcgccgctgtcctcgccatctccgccacgaccgatgccgcctcgtcctcctccgctggcttgagcaatggcagcaagtgctgctccacccatggctccatctgctcaagcacctccagcctcgccggcgccgatgccgccccgtgcgcctctggtagtgagagagaatagagagagagagagatgagaagagagataggagatagagctgacatgtgtgcccaagggtatttttgacatttcacgcgatttctctctcctcttcaaccagaaagtattattttaatcagcgcggtgtccactgtcaaattaccatgtttatggagtg

SEQ ID NO: 53277 - DNA, 2298 bp, Oryza sativa
acgaacattcctttttctttgtttgttttttttccaagcatgaaaaggacgtgcaaaaggtgtgacttgtttcaagagaaaaaaaggctgagattttttttttgttcatggaaaacaaaaggtggatgaagaacagtagctctggtgcaagctgaagaactgcgaatttgcgatatttttaagattaaactgcggttgaaagaatggttttcgtgacatcaaaaatcgtatcggcagcaacttatgtacaattttatcaacacgttctcatccaaggcctgcaccgctgcatgaacagtaaggatggctccatcgcatgatcaggcagaaaacgagtaagagcagagtaacacaccagaaatcataatcttctatacattttcgactcccaacttttagctgaagttaagtacaaaaaaaggagccaaactagtggactaatctggttgatgatgcttcttttctaacccagaaaaggcacatgattttgagctcattgtgcaatgcaaaacacatgcttgcattgacttcaaatagtccccgagcaaaaggaggagaagtgcaggggcaaaaaatcatggtatgggagcaaagcacatgctgccttgtgcatagattcttcattaacatattaaactataggagtacagccaccatcagtattatcaccatcctcagccaaaaacacgtgaagaacattgaagacaagcttggcaattataggactcaaggtttagctccacatgcacttaaatgttcacaaggtacatgattgacacacttgacgaaatgaaaattagttgcatgacagatgcatcacatggattaagtgttaaggatatcacatggattaagtgttaaggatattaagaactcccatgtaggtcctgttgatatccttaacattaagaattcgcatgtaggtcttgttatactgtcatattcagtctagcagttaggttgcttgttcagctattttctagtcctcttgcgacccctcccccctctggaggtggctgcagttttctcaggagagctatgaagatcgccgccaccagtctcagagggttcatcattaacgcttgcatctttgtcacttgcttcctcaaaaagctctgtcttatcagtggagttctcatcctcctcctttggagccttgtcagcagattcaaattctgtgagtttgtccttgagttgtctgagcttggctttcttcgaatttaagacagccacaaactagagacatgacacaacagtgagtagagaactactatggtaagctcaatatacagttttcttgagttccagtcaactaataactgaatgagaaaatcactaaatgccaaagtcaaaatatgaccacgagagggaacaaaatatcaaagctaactaattggggagaatgtgaaatcatcatatagtgttcaccgtgagaatagtttgtgatgatgcaaacaagcaaggctaaaggatgaaattttttgaactgcaagaaatgttcgtctttcacaaacaccagggaatgtacctttgaaaatgtggattgttcgaactcagctttctcaatgttaaatctttcactttgttgcaagcacttctcagattcttgtttcaacttgtcaaaggattgtgttttcctaacaacctcttcctgaaaaatgaagggaaggcaacagtttagtcattcaggtcaagtaaatcatatatgaagatgacttggtggtaggttgcagtgaggtcgaatcaagttcatcggaatcttgacaacaattcactacttccatagaaaatattatagcattatatccatggaatggaaaaggaaagtgacatacgctcaagcgtatatttgcatccataagaaaatccaagatctcagctatagtctgctgagtgttaggtgcaggctgcagtttccatcgccattctaacttggtgccttgtttctcaaatgtccatgacagctacatggaaaaataaataatcaataactcgggaaacaaaaggagaaaaacgtgtttggtacaaaacaagcaaggacatgaaatggtctcctcataaaccaagacatgcctgtaaagcagtactacttgtgtttaacataatttcatcaccatttgaaaatcatgtatcatatcgtcaatggtgctcatatttaggatattatgacatcaagggaatccatgttgtccctaacagatagtgactttaagtaatcagggtctagtaaatcgtcgacgcgcaagggctaaccctcaaacaagtaagaggtcttaaaaacattatgtattaatataa

SEQ ID NO: 53278 - DNA, 2374 bp, Oryza sativa
gatgagtgaaggtgaactacaatcgggagctaaatgcagtctccagctacaaaattaccagcaaactgcgtcgtttcgcccctaaacaaacattgctggaccttgcagtatacacatgtaagcgagagagaaatgtgacactgtgagcatcaaataacaatcctaccatacagttacaaagatgatatcgattgctctacttccaacttgccctaaaagcagtagcattcttccatatatagataaaaaaagaaagggataagaaagaacgaacccttcgattgccgttggcggcgtcgtggaaggagtaggtggaggagggctgctggaaggcgaggtagcgctcggcgagggcgaggtagtcggcgacgggctggtcccactgctcggcgcggaggcgcacctcggcgtcggaggcctgggcgacccacgcggcgccgccgtcggtgacggcgagggagaagcgcgtggggtgccacgtggccttcacgaagacggctccgccgccgcccgccttggggtcctccaccgccaccgagagcttcgcgcagctgtgcctgggcgccgccgtcgaggtcgccatggatcggcggcggcggcggcggcggtggctgttcgggagaacacgcgggctttgaattcgtatgggccgtccgattgctactgttggttcaaatcaagggcccaggtgcgagccctcacaaaattcatcgaaaagtcaaaaaaatacgtgcctgccatactgccaatagtaatagtagtaaccttattttcattttcttttgggcctgtgtaagttggcgaaaagaaaatttttgggtgtcacatccgatgtttgaccggatgtcggaaggggttttcggagacgaatgaaaaaactaacttcataattcgactgaaaatcacgagacgaatcttttaagcctaattataatccatcattagtacatgtgagctactgtaatacttatggctaatcatggactaattaggctcaaaagattcgtctcgcgatttcccccctaactgtgcaattagtttttttaatctatatttaatgctccatacatgtgtccaaagtttcgatgtgatgttttttggaaaaaaatttgggaactaaaccaggccaaccaggcctttgttacccaataccaactgtttaattcattccgttagtttatttttagagtaaatttcgtgaaacctcacctattatgatctgagttgtataaaaccataggtattttggcaagtgggacataatctcagatattatggtactaacttttcacaaagccttgctattgatcattttgtctttgatctaccataattttaagttctataatcgcatctcaaatttatgaaaactttatccatcatatatcctgtaaatattatattcttttttatttgatagataggtatatcaaaatgattaacggtgttgttttgtggaactttaagatcataatactcggggttatgtgtcatgtgccaaaatccttatggtttcgtgtaacctagatcataataggaattttatgaaatttactcttatttttatattaaagaaaatccttcggtgggattacttttgagttttgactcgtaatgatgggagaaaactcatttactccctccatttttaataagtgacgatttgtattttcttatttaaactttgactattaattgtgcttgaattacaagatcaaagttttatgtttatgtcttagagtatacccacgttaataacatagaacatctctagtgcttataaatattgataaaacaagtggtcaaagttaaaaggtaaatagtgccccgtatcagttattatgaaatggagtgggtagtacttaagggaatgtccccctcataacccaaaataatgcttaatataaaagatcataaaaaaaactcaggcatttatgaaaaaaaaaatcaatgtttcgaccttagatataaaacacccccacaaaatttcaaatataaactcgaccaacatatctaagcgaggatataaagctagattatgatcagtacgtcgattctctgccatattatatcagtcttgtttctttccaccgccatgtagattgatctttattgtcaaatagacatcatggcactatattgtcaaagatctttctacagttctttacaaatatgtgcattaatctaaaaaccaaaagcatggtctaagttgacagtttgacacactattttttaaaaaaaaactgtagttgacactctcagctcatcaagacctcaagcaacaagaatcctataattccataatagtgccctttctttcacaagtagctaaaaagctctctctctctctctctctctctctctctctctctct

SEQ ID NO: 53279 - DNA, 12524 bp, Oryza sativa
  unsure (1)..(12524): unsure at all n locations
ccatttttcatcgattttcattagcacgtttttcaaatgctaaactgtgtattttgtgtgaaaactttctacataaaagttgttataaaaaatcaaataaatctatttttcaagttttagtaattaaaattcaattaatcaatatggtaatgacttgtgtcgtttgcgtgcgcatttaatccttatcttgtttgagaatcgaaggaccacaccacgcatcgatcgatcgaacgtactccctccgtcccataaaaaaccaacctaggactagatgtgacacatcctattacaacgaatctggacatagaatatgtcatatctagtcctagatttattttttaggggacggagggagtaagtcgtgtcgtggccgcctctttagcctgtagcttcaaccctaagcttggaatcgaaaccatttccatgatcatttcatcatcatcaattcacaagtggagtcacaaagttgccacgctttgcaggagaatcacttcgcatttcaacgtcatggacctgattactaacagacaggctatggttctctctccctctgttgctttaattttgttgttgtcgctgccacgaggaatatatataaaacagccatcatgattcatcgactgatcttccactgcttttttttttcacggtcaccggcgaagaaggctggatcgccaatctcaaaagaaagtgacgcgaatagcatctgatcgggcgctgctgctgctgatgctgcttttgtttgttttttgtgctcaactaaaaagattttgtgtcgcgttcagttctccacataatatcgcatctgatctttttgttctgctggtgctaagcatataatactcgccttaggcgagtgagtcccctcttctggcatgctatggcaaacgaaacatacagaaagacagaaagagatgatcaatttgtcagggatatgattttttttttggatcttctgaagttctgagatgatgatccatggctgttgagaggaatgacgtccggtctgaagatcgccgtccccaggcggtggcttcggaccaggcttcattccccatgactcatggaacccacacgtgtgtactgatcctgtgagcttcagcttcgtatgaattatgatcagcaaccaaccaagattgcagggaaggcaggtaggcaggtaggcagatgtccattcaattctgttgagatttctgaaggttttcatgtttgggattttgcagaatcgcagtgccactaggcactggctgcttgttttggatgaactttgctagcttggattggatgcacaggttggtactacctacctacttgctgttgctggcatggcatgctgatgctggcatgctgcacctacttgcttttcgtgcttcgctcgaacataaggcaacaaaagattaggtgcagatttcaggacaggatcaacaagaatgaaaagttcatatagcaaataggatttccagtttgaatgaaatgcgaaactgaatagtgacattacaaggacaaaacaccggaaaaaatattctggtcttctaagtactgatgaattattctggtcttctgaatactgatgaatcgtatgtagtagtagcctatagcgtcaaccctagacaagcaagtaatgcattcagtccaaactgtcaacgtcagactaactagaatgaaaagccgctcaaaccagcttgttgcgatcaagtaccagcctcgcaccttccttattacaatctccggttttttagcatacggtaccatctaattttaaaaattgtttattttattgtgacttattttagaactacaatctaaacctaaacttttacatatttatactaaattttaaataaaacgaatgatcaaatgttttaatggcgttatggccggggttgatgtcaatttcgaaattatagatttaagctacattcagtatcaggtgaagaaacaaatgtgttaacatgaatacaggacatgacatttcctacaaaaattcgtcgtacaatttccagaaggctgttcttacagaggttctggtgactgtatttacatctaatcaagctgtttggtccaatcaaagggttcccagtccttcatgaaattagcaacagcttgtttctgattatccatcgattcatgccttcggcgcctgtgcatgtcctcttcccgcaactggagcatccctctgatgacattcaacccaaaacctgcactgaatttgctctcatcgtctatgacatgggcaaatccacggtcgagcccgaactctacatgaaagtaggcaaagttctctgggatgacttggtgcaggtttccctttgttggaataagtttcttcatgtcatgctgggtccattcttcttccgcttcatcaattgcctgaagtaaataggttggattttgttagaacctgaagcacataagaaataaattgttctcaatcatggacaaagcaacagacaaccgaccttcttgaagtacatgggagcattgtttgaaacttcggaggggatagggatgcattcaatcatgcagtgcctgcgttgtttggccaagcttataacagtctccatgaaaacaatatccttgtcctgctgcgcgaacattttcaggaggcacttcttaaagttgcggatctcctcccagacacttctatcaactgttcttgttgcagactcatgctgcaaccataaaaaagaacatatcataaggtagatgatgaatagtgcataagagttgtaatgaaggtcgggtttacatatgactattcaaaattacaagaagctgaagttagcttgttgttatgaaagcacatcataaaatgattttctcacctgcaatggcagaataatgcagtgcccagggacaacaggctcaagctgtggcagcatcaagtaagtgaagtttcctatagcaacaaccagatgctttggccgtgatgggttctcgaagcaatacatacagcgctctttctgagttgtgagccaatgagtgcttctcctctcctcatgtgcatctttgttcctccttttgcctttcttactgggggcatcaccaaaatcatattcatcctctatacttttagacatgttgtactgtttattgtgcataattttatttgcaagatgccggtcagcatcctcttctcttttcctgcgatcagctgcactaggctttattgtgttcctacagattagaaaaacaatagtttgttcagcaagcagataaacaatacgagtatatatatgctgatacaacattgaaatagaaaggtcatttctgtaatgcttatgtttgtaataaattggatgtctacattaaaatatttgaatatccctatgcaaaacaggtgcaccctgtgttttgcacttttttttttgtcatagtatgccaaaatggcatacatatggccaccaaaatatttcagaggagcagatcaagtgcatgctgtatccattccccttcttatctatacaactatgcctcatacgcacatgctctagaaactagacattaagaatatgaaactgagagtatttcaatatgagagaacgattactgttagaacatttcagcatagctttacagttgcagacatatttcttttcaagtcctcagatattgtgggagaataacaaggtaccaatactaaggcgtttacaagtttttagccttacaaagtgacatcatacgacagtgtgtgaaagcaggcatctgtaatgtgctaactcagaataacaacgtcatggactaacctggttgaactcctcacttcatgcctaggttcttcaacagcagtatcctcattctccagcaccgcctccatttctcgctgagcaagaatagttagcagttacaaagtcttgtcacctctaattcaagtatattcaagcatatggaaattcaatttcttaatcatgccctatttcagatataaaagaaattgtgcttcggcatcctaaattgtatattgatcataaagcgataaacatagtgcaaattcttgagcatggattgatgcggatccgaccatggttacatgctactataagagtatgttaaattaggggtcaaagccattattcaatagcaatatgttagctcaggggtctaagccattactgaaaagcaatgaacagcatgtattttctgttacttcaaatgaataaatgaaaccatgtgcaaaactgcactttcattactatattgtaataagtatagttattttccaaacaaattatatacactaataatgaatcaagaaggtaagcctgttaatgttatcacaataacaataatgcaatacttaccgaaagttgttcagcttcttcatgcttgcctttcattcggagctgcagaatctttgctgctaactggttcgcatttagcttttgagtgctaactgaaggtgctttctttgagctacccttatcagacttgagctcatcaacctctgcagtcaaaacatttacagtcttgctttcaagattattaatcttttccaaaaagcttccatcattagagaacttattgattcctgctatcgctgaagagataagtgcctgatcctcagaagaaatattctgcctattccttttccatggtacagaatcaggtttaggttttctcattgcatgatgccgagaggaaacatcttttaagtattcacgtctaccactgtctccaccttgctgaccctcctttggattttctttggaatgttcttctgagctgcctgcttgcccagcttttctgcctctaatggcatgtaaatgagcatgcgaaggggcagctctagatgctgacactgatgcagctaagtggcctaacgagccccatctctcaccaacaacctatattgaatagtaatagaagttaggggaataaactacctaatgtcagtcacttccaataataatatgtggcgacggacatacctcctcaagttgttttccttcacgagctgcttgctcttttgcacgcttcaaagctttgagcctccagctagcacctccatcaccaaccacagaggaagcaagcaactggttgcctgcatttgaagggctagattcatcagggtacccactgccattatccctcaggtatggattcaattcctttggattggctttcttcacctgtcagtacccaagaagttgatgtaagcaaagcaggagagatatcccagtttagagtttagaatcactaaacaaaacatttattccatacatcttatacagatccgtagatataaatatagggtgtgttcgctacagccggctcccaacgtgcacagtacgcacggaaaacggagcagcccattagaacgtgattaattaagtatttgctaaatttttttcaaaaatggatcaatatgattttttaagcaacttttgtatataaacttttttgcaaaaaaagcaccgtttagcagtttgaaaagcgtgcgagcggaaaacgaaggaggggtttggaaaagggggtgccgaacacacccataggccgtgtttagattccaacttttttcttcaaacttctaacttttccgtcaaatcaaatgtttggacacatacatggagcatcaaatgtggacaaaaaaaaaaccaattgcacagtccgactataaattgcgagacgaatcttttgagcctaattacgccatgatttgataatgtggtactacagtaaacatttgctaataacggattaattaggcttaatagattcgtctcgtagtttacatgcggaatctgtaatttgttttgttattagtctatgtttaatacttcaaatgtgtgtccgtatacttcaaaaaaaattttggcgcaccaactaaacacagccatagtattcctgcactgaacaactgaatgttccaggggtttattaaaatatgagttaacgtacaggacaaaacatactcatccatcgtcatgaagaaaattatacagcagttacttgactaaatgtcattgctaacgaaagaaaccaaatctaaatctaagtatgaacatcataactaaatagcaacggtcactcactgaattgatcacaacaagcttagcattgaaccaactttcagctactatagcttagcataaaaccataagcagaatagcattctaccatgggaatattgttcataatttgagtagataggatgcaagtgcctaataccatctgaagactactgttcagctaccaacaattaaaacatggcatcttcactgcaagtggtgaatcatatacaatattaatgcagtacctagcttatggaaatattaccatcacaaacatggcctcagctccacaaagaactacaataagctaccctgaattgcaattatatggcaaaaggtagctactaggacacaagcattgaaccataagcatatctcacatgagatgtggtaatcattacctcctcgggtgcaacctcctcctcatctttgtcagccccgccagcttggctgctctccgcccgaccactgcttgccgacttgagcatccattcgaggcccatctccttcctgacaatatcactagctctcaactcctcacctccaattccctcatcctcctcctcctcatcatcatcatcacctgcggcacctccaagcttgctcttgcgactgcctgtaacaagaggtcagcaataccaggtgatcagaaacacaactcacaaaaatcctaccaaaaagcaccatcctaacctaacctaaacaagtttagggctacttgcctcttctcttatcagattcaccactggactcctcgtcatcatcatcgtcgtcatcggagaactcatggcgccgcctctgatgcttcctccggtgcttgctccggctcaaccctttctcctcctcctcttcgatcgagtctccgctatcggacccctcctcggagtccgagccgtacttgctccgcctccgccggcgcctccggtcccgcctctcctccttgtccctccccttcctgccccgcttcttccgccgccgcctatcctcggagctgtcggaccccgccgagccggcgccgcctagggcatcctcgccgatctgctcccgggggataaacttgacgccggagagcatcgccggtgggcggcgaggcgaacgcgctagggcttcgttggttgggggagagaagcggcgaacgcgagggcttcaacggcggcggaggtggcgcgccggcgacgagccgacgagagagaggaagaggtagcgagaccgcaagggggatccagccatcagggagagagagagcctttccgtgatgtgtaggctggatgggccgggccttaacaagtgacgggtaccgatacaatcggcccatcggcccgtgttgattcaattggcccaatactcaacggttttcagcccaattacaaagcaacaccagtagcctttactacttcctccgtctcataataaattctatttttttagtaatcattatttcattggagtctgtaaaagtagaaaataattatattagaagtacataaagtaagaaataattgtattagggtttgataaaataagtgtattatagtcttttgggttgtttttttatgtgtgtgggatgggagagaaataaacttattttggatggaggaagtaaatataaatcctcgccaaatattgaaggtatgaatttgtttatctctgttccaagacttgtttgttcctcggatagttgggaagaggattagaaagataatgatctcacgatgctgacaatagggtgtgtaaatatcactttgaggtcaaaaccaaatttatgtataattctgatatattatgtacgagtattctatttgatagtttgacacccgtatcccaacttttcctgtaccgaagaaaatctgcttggactcctgtttttcattttccctcctttcctgtttcctagcaaaacaattgatacggaattcaaattacatatacccatttgttctcgctgaatgcgtacatatccaaaacggtctgtgagataaatatccttttccctcttgcactagtcagaaatcatccgaacagcggatgaacaaagcgaacaatgtcttaacttccatgaagtgtcccctgcaacacgcaagcaaaatgctactacagcctcagtggtgtaccacgaagaaagatgatcgaatgtgcacaatgaagaaagatgatcaagcatggccgtacagttcgtgagtaagtaccattttactaccaacaaaaccttcctgctccatccctgagaagggatgtacaagccgtgctccgaggtctgaacactcaacttggggagacgaattcgacaggaatcggtttagctcaaacccagaaattcagttcgcttgtttcgcaccgtgaaacttgcgtgcgaatgttgcagccacaattaatgggaaagcgatcgtagcgtcacaatgcacctgcatttcaaaaggttgaggacttgaggtatcaagattataggtttatagtgcgacaaacatccatggtgtatgagttaacgatgctccaactatctcttggtatcataatttctcgttcagatcttctatatcaggcaaagcagaatcatgtcaaccatcatcgcataaatcattgaacaaagtaaaattgatgcatgcttcaaagctaaaatgcatcaaaagatataggtgcaatacagagcaaaactgtgaaatgaatataagatggattagaattaggatctagtccaagatcattgatgcaatctctttggcataccttgttcaagcgaagctgacaaaaatgttcatatatgcagcatatgatgtttaacaaaaggcacttttagctagctaggcgcacatcaaatattaaaaataatcatgtgaaaattgctcaaggtacagaaatataccttgacgggtttggctgaacctttaatctttccccatgaaactgcttcatcaggttgtgctccagaatcactgccatcaaactcttgggctgtgttgatatagactgcataatctgcaccattgcgaaacatattggcgttgcatatatgatgcttgggtagacctccaccaagaactatgatccctgtcttccttggggttgcatgaatggcttccccattcatcaatcttatatctgccacattttcgagcataatatgagaaaaaaaattgaatgcaaaagcaagaaaaccaagcacacaaacttgccttgtacaatgtcaataattaggccaggattgcggactgcatgacagaatagcatgtctccaagcgatccatcagtcaatgctgggcagtatacaggaatattgttctgatcaagttttggaaagtcagtactatctcgtttcagtcttttgattaacagatcataacattgcacttgggcataagaacttaaaacccacacaagaatatcgaatatcgatgctggtttacgtgtcgtattctccacagatgcttaaagtatatggtctattgcaacatcatgagagagaaaaaaaacaagtgtcttgaccaaatccactcaactataagtctataactcattctaaaaagtcaaataaaggttaaaatttggatatcatgtacattatatcaacatcaataagccaacatccaggatataggaaggcggtgccctagttccaggaggaaaatatggtcccatgccattattgtgaagagtttacagctacnccacattagatacagacaaaaaataactcaaatattttttcaaggaacaaagaaaaattttgaatcagactacctagtatctcattgtgtactaaggatagagatgcatggactttataaacagaattgatggtgtggtccccctcttgtgctattattttgcactttgtaaggatattcaggtgtagttaataaacatgtgttaccttatacgcccaataaaggtaggaactttcatcatttatttctttgccaagacaagctatgaccttcgatggtgtccaaacattctgcaggtaagtaaaattgatcgtacttcatgaacaggagagagagcacaaaagtagttggaagagttgcttctgagagaaaagatgtatctgataattgatagttggaaaacaagggcacagcagtaaagctacagaaattcatagttggtgtcctcatatgtcagttttatttggatttgtgcgtgtatcattactaggttaataaaacacggaccaatttgaaagggagctaatgaaggctggttcaaataatgtgcatagatcctttttattcctgtagcattgaaattcaacatattttaatttattatttgggagtacttgtggggcagattatagctgctttccatttaagttttttctctcatgtttcttatttttgaacattctgtaccataatactagtggagttctaagcactctaagctaggtcattttatattactgcccaatacatgattcctcctctatacagctaatgaatcataagcacatgtgcattatatagtgttgaacacattgctgcaagttatctgcgcttcagccagaagaaaaatgtaacagtacctcagtggattgctcttgtagcatctgatcaaaaagtggcatgatccagttctcaaacttgcaatagttatcattgggaaccaaaagatttccaatccgattcaatccctttgaccgcaacagtgttccaggtaaagaaaattctcctctataagtgggagcaagacatttgatgagatcctcctctataccaccagcagttgtaacaataacatccacctaaataacacatttttcaagggggattagctacatcatagggataagatatcaatgcttttgataatgctagtatgttaccaaaagcatgtaaaaccatctctaccaaaccaggtcataaaaggaaattacagcaacgcgattctcaccatgtgatgctgaactagaaaacggactacatctcgaatgccagaagagacaaggtttgaagtgaatcccaggaatattttgcactttacagattctctatatgtaggatcaagctcagcttcatcacagtcctcacgtggcttctcgtgagacagcctccaatctaacttcagtgcattcaagaacagaatagaaagggttagggagtatcagaacatcttaaaggtgttaaaaaatatcatggaaatgttaaagtggaaaatcgtggaacacacatgtaagatggtaacagagagttttttttcataatttttcatctggattacctccagatcacttacgaggaagttcaagtgtacatttggagttgtccaataaattcacaatgtaaataagtaaatttggtagcattttttatacacctacaccatttcaaatttgctaactgtttcatctgacaggaattatcgagataatcatcagtagagtgtcaaccctagcatgaataataagctgcaagtttccgattttatagcaaccacatctatcgcatcattcagcacatgacttcacctcttcagctccaattacaccaacacagctacagcaatgggcctcgtctaaattgcaattcctaagaaactccaaggatctagaaacacaacaatttcaagctacagtaacccccaaatccgcttcgcctccctcacgggcatgcaaaaggcaggaaggctgcaaagggtgcagtaattagtaacgtaccatctggttgacgacgtcgacggcgtcgccgaggttggaggcctggaatccggtggtggcgagcgacgcgagcagcccggggaggccgaggccggcgtcgttgaagtcggcgccggcgatcctcgtgaaccgcccctcgtcgagggactccgagggcttcaacacgattgagcgcacgccctccagcgcgtccatgtcgcgcactccccctcctcctgcccccgccatcgcccacgaagtcggagcccgagccgccgccgccgccgccgcgagctactgtgagcttcgaattgattttttttttccgagaaaaaaaaaagaatcagattccgcgcggctgtagtttgggtggaggtgttgctttcaacgatgcagatgggccgggcttttcgtcgacccagcagagcgagccggagggcaaggagaaagacggggcggcggcggcggcggcgctgccgcgcttggagaaagcgggaggcaaaggcggcggaaggtgaggtgggggcggccggcggcgccgccacgctgggtctgggagaaggggggagggcggcgacgcgaccgcgcaacatgggccaccgggcgtcgatccatgctgggccatcaaattttgtggcccacgtgcatcctggcttgggctaagaataaccatggaccttacatggcctagctatatgaactaggggtatgaagctaaggttaggtctgacggcccaacatggttatgatcgtttttgcagcaggatggaggagctgaaaaccgaacatgcctgaaatttatctctttttttcctcttcgatgaagtcggacttgtgattggggggtaatatcatgcccataatgatagggatcggtcgac

SEQ ID NO: 53280 - DNA, 11151 bp, Oryza sativa
ttatacataatttttttataaatgtataaattctctttagatctaattttcataggttaattttcacgtttccgccggatattttccttaaatttgtataaaaagtattatcacaatatcataacttattagattttacaaattcatttcttacataaaattacatgtcagaagtttataagtctaaccaaatcttgttctaatcaacaaaaagtcgtccactgtctgtagcgtacaccctacgtccaaaaaaaatcaattctagctatctacgtgaacaagtgcatgtctagattcatagctaagattcgttttgcactattcatttccaacgtttgaccgttcgtcttatttgaaaaatttttatgattactatttttattgttattagatgataaaacatgaatagtattttatgtgtgactaatttttttaaaatttttcataaatttttcaaataagacggatggtcaaacgttggacacggatttccacagctgcacttattttgagacggatgtagtacttccttagccgttggatcaagtatgcatcgcacgcctgatgattaaacatgttcttttccaattaattaagatatattttaactttgttttcattggcatgttttttcaaactactaaatagtgtattttgcatgaaatctttgtatatgaaagttgctttaaaatattagataaatatattttcaagtttataataattaaaaataaaataattatatgctaattgttttcttgtttctcgtaccctaacctcatcaacagtagaaataaacaacaaaccattcaggtttccgtcatgatatgattagtctattctcaagctagtgttgtaatagtgtatactatgctcttcatataaaaaagaataagtttttaggatgaaaatctggataatcatatattcattcatagaaattagtttttttttcctttttaagaacggagagactatgctgtagtacattatagtatggcaaattggcaatggttgtgaacatgcatgcgctttcgtagagattgtataggagtatgtgatagggtccaataaactcacatttccggcccaacttcaagtcaaacccaagcatacccgtaatagcaccattcagaaaactgtgactgatcgaccgtcccctgtcagaatcgacaaatgcataatctgagcacatttgcacagttgcacccaccccgcgtgtgtgtgaaacttaccattgttcacaatttcacatcacatgttaagtagtacctctgatgttgactcacaagtctgaactgattgacaatgtggtgcgtccgccatacctgggacgtgtacgcttggcatgcgacacactagctagccaaagtagtagtcgtacattctgagtgaacacgtttgttcgacgatgttggatactccctttcacctttcaccttacaccttcccattcagttatagtagtataccagtatctttctcgatcacattacgtcttccctaaagatgtttaggagtactccctctgctcgaaaagactaacttttgaaaataaatttttggtttttccaccgtaaaataatctcggaaaattaaacagggtatactcttgccgatccatgcagatgcaagcagggtagtagtagtattcaactagagtactcgctagctagccacctgaatcatgtcatcctcccgtcgaggcatcgctctctcggcggagtggtgagatagatgaggtcaacatctgcaacgctgtccaccactaacaccgtaccctgtgcatggccaagctaagcttggacggcgcgcgttacagtatgcatgcagcgtgcgttccgcagttcatcatctctgcatgctaggccgaaaaggacccctgatctaacgtgtatatattcatgtagcagtagaagtctaacaacaaaccagcatggtaaaaataaacctgctgttagctaattaagcatccggattgcatctggtgctgtgaaaaatgcagaggtataaagtgcaggggacctgggagctagggagggggagtccaggagcagtagaaacggccagggtgggggtgggggcaaggaaaccggttgcaggaaggcgtacaggaggttgatatgctgctccactgccggtgaattgggttccaggtcgcaagcagctggccgaggacgacgccagccaagccctgccccgtctgcactgcagcctctctctccccttttgttgaattgatcaagcaggaacaagtgacgagaccgctcccgatttcacgcaccgatcctcgtggcgcgcccgccgccggcaacaatcccgaacgggggaccactcactcgcaacctccattccttcacgtttacgtttacaccgtagcagcacgtacgggcaaatgccaagcaggccaaccaaagagatggctcggactaaactgtaatgtacttccttcgttcattaaaaaaaaactaacttccacacgtaaaattagatagatactcatccagatttattttcagaaattgattattttcagagtaactacgaatcatcacttgaacaacgtcacgtatggctcgacaattaatgggaggttttagccggattccggggagcaaatcctaccacatgttgaggggcaaatctcgcaaataccgcgcgacggcatgggcgatgatggacgatcgacgccgcagccggccaaaatcatgtcgagcccgagtccgaacccaatgggtcgcactgcacacggtcccccacacgggcgggtgggatggagaccggaggcgaaggggaacgagactgtgggtggggggggggccactagtcagcgacggtgaaatatatcatgaacagcgcggagaggtccatcgcctcgtcacccaacgatgctattccgagctttaacctcgagttaatgacgaccccccaggcgtccacgtcacgtccttgtccgtcattagtacacctttttcatgtcactgtggccaagtggccaacctgatcgatgccaaacaagtatccatccaatccaacagtactaatgttgcaatttgtggtgtctccctccagaaaaatcccacgtaaacctagagacctatccggaagaagccaaacgaaaaataatttataaataaaacttttatatatatatatatatatatatatatatatatatatatatatatatatatatatatatatgacactcatatggggcaccatggtgcccgggcaccatggtatctaatgcacaaaatcactcaaatttttcaaaatttttaaattgtgagtatatacctaattataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatgtacgtatgtatgttcgttcttagcgatctaaaagcaaaggctgaaaaataaacttcgataaaaaaccctcaaaattaactccaaatttaaagttgaaaacgctggaggcggccgagggttgccggatggtcgctccacgcaggaacgacgacggggacgacgacgacagagctggttgcgccccacgacgccgatcttggcgtgcggctctcctgggccagagcaggtcgtcagggcagggggaacctgatggggctcgccacaggagccgcaccccccacccttcccgccgccgccgtggatgcgctgccgacgcggtggacggggacgatgacgggagcccacctgccggccgggatcgtggctgccgctcgtgttcgacgagccgccgccgctcagcaagccgtcgttgttcccgccggagatctccatcgccgcaagccaggacttcacgccaccgtcgccgcagcggcacaaacgacaaggcggtgggcctggtcgcgcttctcgaggggggggaccgacgacactgacagctacaccactaaccctaaccctctctgtgctctctgacctctcgctgcaactttgctcacagatgttggcagagactactgcggcgatggatggcatgcgctgggcagcattgacccgatgacgatggaggtggcgattggggtagaggaagctacccagaagcttcctccaatcccactcagcgcccctacggcccatcctctgctggaggcccagtccgggtttgaggcccaggaggagctggcggcacaggaggagatggcggcccaagccagcaaggaggtggtgcccgacgtggtgggctacctggacgagggcgacggcctggcccacatcgcccctccaggcgcacctgcgccacctcgcctgttcgagcctctacccgagccgcttctccctcagccgccgccccccgctccagcacgccgtggccgctccaaggtgaagatggtgccctctaggcacagtgcgagacaggcagcacgccccttctcggtgcccgtctccaagcacaccgaaggccgcctcctcaaggagatggggttcattgacaaagaggaggacctcaacgacgaggcgattgcggcgttcgtcaaggctttcgacaagccactgccgccacatgtcatcgccggcctccgctgcctcacccgcctcgacgacccagcttccattccgtcggacttcgccggacaggatggcatcaccaccggcacggcttaggcgtgcgtctcaccatcaccatgcaggagcgcgaccatccccatattagtcagtcactgtccgtgttgtaagagattagcgctgggctgtcaggggtgcttcacaccctttgctcccccctagtagttgctctattagccggctcgggccttaagcccccgggctaataagaaataagcagtgcattcctctagtctgtgtgaggctcaggatagtaactagtatttggctactgctgtggcaatgtattggttcaaatgctgagattataagacgctgcctttttagaatggttgtctcgttgtgcaatgattagtgaacatatcatgtgttggaatgtgcggggtctaaactacccggcaaaaagagaagcaatccgcgaagtggcaaccaccaaccgcatatccatcatgtgcctccaacatacaaaattggcaatcatggaccaaagaatgtgttcggaaattgggggtccaagactgaataatttcagctaccttcctgctgatgggagccgtggaggagcagctaccttttgggatggatgatatcctccagcacagtgatatcaacatcagaaatttctccctctcagtccgtctcacccaacggtcctcaaacacggcattcctcctcaccaacgtctatggaccgacggatgacgctgataaggaaaacttcctccaggaaatgtgcgaagtggcaccatcaggacagaccccctggctgattatgggggacttcaacctgatttatgaggcaagagacaagaataacctcaaccttgatcgtcgattgatggggcggttcaaggctgcgataaatagatgtgaactccgtgaattaagactgcaaaatagacgattcacttggagtaacgagagagatgccccaaccctcgagaagttggatcggattttttgtaacccagatggcgatatgctcttctctaaccacaacctacaagctctctcttcctccaactctgaccactgccccctgttgctctcaccaacacaccagctgctgcgaaaaccaactttcagatttgaaaacttttggccaagaccgccgggcttccttgacaccgtccagacggcttggtcccagccagttagcgcttctcaccctgtcaagcgcttgagttccaagctgaaagctacagccaaggctctacggtcctggagcaatcgcatcctaagtgacagtcgcatccaattccatctcgtaaatgagctaatcctccgtttggacattgcacaagaaaacagagcattgtcgcccttggagatctccctcagaaaagatctaaagctacagattcttggtcttgctgctgtagagaaggcaaggagaagacagcgatccacactaacatggctgaaagagggtgatgcaaacactaagtttttccacttgaaagtcaatgcgtgccatcggaagaacttcattcacaaactccaccgtggcaacgtcatcccagaaactcatgaagccaaagagcgtgccctacacgaacacttctcctctctgatgggccagcgactccctcgctcttgcaccctaaactgggaggagcttcacctaccccaggtgacgccagaagatcttgactcccccttcaccgaggaggatgtttgggaagctatcaaacggatgcttgctgagaaggcacctgggccagacggcttcacaggcaccttcttcagatgttgctgggaggttatcaagtcagacatcatggaattgcttgacaaattccactccttatcgggaggaaatttcgggagtataaacagagcgacactcatcctcatccccaaaaagaatgatgcttgcactatgggcgactatagaccaatcagcttaattcactccttagcgaagctccttgcaaagattttggcaatccgcctatccagacaaattaacaaagtgatatcacaagctcagagtgcgttcatcataacaaggtgcatccaggacaatttcctctatgtctccaacctggctaagaagatgcacaggtccaagcagcccaccctattcttcaagctcgatattgccaaggccttcgactcggtctcatgggagtacctcctaacgctgcttgaaaaaatggggttcagtactagatggcgagactgggtggctttaatcctctcaacctcctcttccagggttgcactaaatgggattgagggagaaagaattgatcaccatagagggctaaggcaaggggatcccctatccccatacctttttattcttgcgatggaccccctacatagactactcaagattgcaactgatgagggcctcctcagtgacctagcggaccgcagtgcacgcttcagatgctccctatatgctgatgacacggcaatcttcatcaaaccatcacgacaagatgtggacagcctgatttcgatcttgaataacttcgggagtgctactggacttctggttaaccttcacaaaagctcagtgatcccaatcagctgtggtgaaattgaccttgatgaaatgctacacaactttactggcccccgcgggacattcccaatgcgatacctagggatgccactcatgataagcaggctccgaaaggtccatcgccaatacctaattgacaaaatcaaggcacgattagccagttggaagaaaaagctcctctcggcaggaggaagaagagagttagtactatcagtaccaagctccatgccaatctatgccatgacagctctgaaaataccaaagcaaatcattcaagaaattgacaaagtaagaagaaaattcctctgggacggtggcgatgaagtcaatggcggaaagtgtaaagtgaactgacagcgcgtttgcaggcccctaaagtatgacggtctgggggtctcgaatctcaccaagatgggaagggcgcttcgcctgcgatggctatggtatgaatggacctcccccgacaagccatggatcggcatgccaacaccctgtgatgaacaggacaacgagctctttgcagcatccacgtcagtgacaatcggagatggtaggaaggcgctcttctgggaatccccatgggcttgcagctccaccttgaaagcaatggcacccaatctcttccaccacgctagaaaaaagaaaaggacggtcgcagaagccctacaagataacaagtggatcgatgacatccgatacaacttgacaactgtcctcgtcaccgatttcttcaaggtcttcgagataatctggacctcaggcatcacactaacccaagacattgaagacaacatacgatggaaatggacaacaagtggagtctacacaacaaaatcagcttaccaaatgtagttcctagggggcataccgtcggtatcagcaaatatgatatggaaatgttgggcaccatcgaagtgcaaattctttgcctggctactcctccaaaacagaatttggacggccgatcgacttcagcagagggagtggccaaataactacttctgtcagctctgcttcagaaacctcgagacggcacaccacctcttttatgaatgcccgatcacaaggaaaatctgggatgccatagcaacaaggctcggcatgcctcagctaagaccacagaactggtctaaaacgacaatccttgaggaccggtggacacaaaccgttagtacaatgcctaaggagaaaaggaagggtgccaaatcgatccttatcctactatcctgggaaatctggaaagagagaaataacatggttttcaagaacatagagacagcgacgcagggaatcgttgagaaagcgatcgacgagatctggctctagcgtgtaagcggggcaaagggcatccaatgtctaacgacccacaaccatggaagcataaccgacattacgtaaattagactcatcagctgcacccctcctttgtagctgcacctccctccacctgctttctttttcctttcttattgtaatctcctagccccctgggctattgtacagtttttccctctactttaatacaaatacaccccgcggggtttaaaaaaagaaaaattaaattttgaccgctaagcataagcctgagtgaaagacgaggcttttttagcttagcaaagtgagttcattagagcttaacagtagctacatcattggattttattttattattttgcgaaattttccctgccaagtgccgaccacaattctgtgtgctactgtggcgtcaaggttcgagatcgattcgaaccgtcaagtccacgaaaaaagatttgggaatagaatgtattccgacaaaaccccgcgctgaaactcgcttccgccaatggatatatgtgatacgcctgcgtggcgatcaggacgtgacggagtaaaaaaaagggcatgcgtaagaagcaaacacaagtctagctatgtaatctattttgagaacactagctacgtaatctcgttcgaatatataaagctcagcaaagaacgaaggcatatatgcactgcacttatctcagttttatctctgcagcaccaacatgcaggttaacccacttgactcgatcagattcgttggcttatctaatttgctaagaattctaaagaattcggatgttgtagagtcctaacaaattgagtcaagtctcatcagatgtataacacatttagtcaacatcttcagtcgtttattggacaagtctaaggctgaagttgactgacatactgagtcctgtcctagcaatatcttttttgctttttatttagcattacaggatttatattgaaagatgttaatggcatgtcattgtctgtccgtaagcttatcaactagtagaaatttaaattttgcagttaaggttttgtatttaaaccacaaattacataaatataaaagttttacctgtaaatatttgctttttgtttgattaatttttctatatatgactaggttgcgttcgtttgtagtagttgataactcattctctatgcacgaaaacaaagtagtggattaacacatatttaacaaagtattgactttttttctaaaaaaattggattagtatgatattttaaaccaacttttctatagaaaaatttcgtaaaacacacaagcttatgaagtatgcgcgtgggaaccaacgaaggaaaggttggatggtctgtttgttaaagctccaagctacttcaagctaaaatgctttaacaaaatgaattagaaaagtagagctatattcttcatatgtcttcttcaaactctaatttcttacagttagatttgtaagttagaatcgtgacccttaacagctagccttaacatgtacacacgtacgccacagaagtacagaacgcgtatctcccttggcccagttggggaatgagttaggcgcgcccacccgatcggatcgatcaaccgaagcaccgagctcgatcgatcatttagctgcctcgcaaaataagctgcaagttgccgctcgtcgcgcgcgcgcggcgcggcgaaccacccatccatcaaccgcggatcccatccccatcccagtgggcgcgcgcgcgcgcgcggccgagaaaaaggtctccccgtgtcgggccgcctccgcctctcctcgtcgtcggctatgtctccatttccgagtcattaacaaatccaaaccacacgctagatagatacagattgatgatcgtatcaccgtctcgatcgtccaagggtgactcacatcacatgccgacgcgatcagcacagtagttatcctgttaattgggtcttgctgaatgctgacactgacgatgtgggccccacgagtcagggatccaggcttgaggcgtcggattgttgggtcgggaaaatcaagtgcagatttttttttttttttggctttctcaaccaccgtggcgagccacatgtacatacgtggttgtgcatgtacacgtagtgtatatacacttggtgcgtgcttacctacagctacaggctacagcatgacagctaagctacactcctctcctcctagctaaattaacttaatttggtcaatggctcctccgatcaatcgatcagtttacacgtaactaatctaatgttttttttttcttcttcccgccgcggcgagctggctgggctagtttagctcgatcgatttctcttcgagacggcgggttcaagtgctactcggcaatggcgccgagatcgggcacgaagtcgcggccacggctgtgccgcctcgtcctcgaccggcggcaccccttcccggcggcgcggggatcg

SEQ ID NO: 53281 - DNA, 8237 bp, Oryza sativa
cccgccgccttcaccgcctgcgacgccctggtgccacccgggaaccgccgcagcgcgccgtccgccagcaccaccctcgccgccgtcgcctcccccgacgccgacctcccgttcaccgccgccaccgccgtcgcctcgcaggagttgcacgcccccatctcacagtttgaatgctcgtcgtcgtcgtcggacgcggcgcggcggtgggtgagccgagccgagcgcgcgccgcggtcggggactcgtggtcggggttgggcgtggagcgcggcgtgcggtcgcgcgtatatatacgcgagggggaggaggacgcgtcgcgtcgggtagtgtcgagaggaggaggaggaggcgatcgtgccaacctggaggttgttgaggacagcttgcaagggagcggggctatagtagttgtagtacgcgcgcgtaaatgtgtgtgacaccgtgcacgcatcctagggtgctacgagtctattttgctaccagtgcgcggtgagttgtgtgcacatccctgcttgcgtggcgcgatgccgtggtggggcccacttgtcagtgccgttttaggacattccttcgtttcaaaataagtttatttttagctcattttatttatcccaaaataagattatttttagagtgatcatcgcatcaaagtttataaaaatagagaataattgtatcggaagtagataaagtagatgtttttagtcttttttacttttgtattggtatatgtgtgtgacgggtgaaaaaatgaactaattttgtgatggaggtagtataagagcaggtacaatagcaggttataaacatattttaatgagataaaaaatgagagagaagaggagcggactacagatctgtagccagctgtagtacggactccaagacacagtgtgtgtatgacagatgggaacatatattaatagtatagtaagcaattattgtatgaattggctattagattagctatagataaattggagctagttgtgggttatactattaaacttgctcttaaaaaaccattaacgcatgattaataagttaaaattattataaattttaaaaatatatttatctaaggttttaaaataacttaatatataatgttttcgtacgaaatgcatcatttagcaaataaaacaccatgctaacagaaactgagataaaatatatatcataatcagaaaaagaatggcgcataagcttaactttggaattaatttagagttttttttccttttgtttttttaaccatcattttttgcgtgaaaaaacaaaagtccagtcctgctagctcctgctagctgcttcggtgcattaagccgtaccataaaaaattcctcctagttaatcagcgatacactgtacctattggtggtgcagcagcacgagttaatggttatggcgaaagcaattgaatcacgtgctgatgctgctgatcatgatcgtgcgaaagcggcgcttaatctaaccagagcttttggaagcggaggaaatggcgtcgaagcttagcagtagaatccttagctctcaaagggggcagcaaacaaatcagcagcaaaggtctaaaggagatgatgattgtagggacgggagagggagaggcatacatgatctatttagcaaagcttcaatttctaaatttaataccaagagttagttctgaagtgaagctgattaatcccagcttcacctgtctgcttcattttacggagctgaaattatttagctgggctatagcttttaagaggatagagcctgagctgaaactgtgacaaatgggtccaacgtcacaaaatcggcggaggatgaggagcagccaaagctgggcaacttcgcgccattttctccgcatgttggccgtggatcctccgcgccgacgccgagatctcgcttcgcattttttgcatgaggcgacaaatgctggtaagaatggaccttgattaataagcgtagcgcaagaaactttgattagcagggttattaagatgtgtttaaatgcgcgtgtaccgtactgttttgacataggattcttcctggttgaaagctcccatacagtcctactatatgctatgcatgggcgtttttactcgagagggatgtcgtaactatggtcacacacacaatgtcagagctgtacagccccagtcctgacgttagtacaggactgaccgtcgctcaagatctcgctccgacgcgacgacgctttcatggcgctttgtacagctggcgacatgcagccagccagccagccagtcctctcgcaacgcccatcaagcctagctcgtccatacaccattattcagacatactagatcggaatggatatacttctgtatagatgagagaaatggtttcggatcttgtagaggagaataggagaggaaaaaagaacaaaaaaaaaattaagatgaacttgaacaaggagatggagattcagggttaactttttcgatttcgaattaaaaatcatatctcattggtttaccgaaatccgaaaaaaactagtaaaaaccgatggcttttagtcaacgccgtacgaaaaccgactaatattgaccggttttcataaactaacacctagcggtttcgtgaaaaccccccatggaatcatggaggtagcccatacatggtgatcattggcagtggcccctgcagctgcaggaaatgaatgataactgggacagtttttgttgcgtccgtgcggatcgcagcgtttcttcttcttccacctcctcccatctcccccactgacccacgcaccaatggcgccacaggtccacgtacccaaccactcctctcaaattaatctccaatcatccgagctcgacgcatccatggcttggtcctacatggagtgaatgcgagatgcgcccaagctagccattgaagacgtcgctgagctaagccatatacacttaagaggagcacttcagggattcaggctgaccatggcatgcatgcgtggcgactaatggatgaactgatcattcattcattcattcattcattcattcagcatagcggatagctgagcttgtgctcagcacggcaaaatgaattgtgtttcagattcagcccccagttcatcatcgttcatcacatattcacacgcacgccaccctggcttcacccattactctctgacaggatagtagatcaatcgatttactacaccgatataaaaactgacagactgttaggctattcccaacccaagacactagatatagtttccataaacttcacatcatcaagaaactagtactagacactactcttccaatgcaaacactactatttcatacttaaatttaatgctacttatctcacatgatgtcttggatgttgtgtagaaatcaagtctcatgcaagacatggttttcttctcttttctcatttattcacttgccacatcagtttttatcctaggtggcaacttatttaatgctatggacaccatcctagtcattgggttgggaatggccttagtgcttcattttgtgtcctagaatctgcatgctttcaatcgtccaatgaaaaaaaaaagatattcagtattactacgtaccaaaatataacaatttagaacatgatgggagacatcctaatattgctaatctagacagacgaatgtttagatttataatactaaaacgtgtcctgtcaaatcttatattgctatattttataacgaagggaatatatttttaactagacaggaaaattttcactcgattttattggcttgattagcagaacattgacaagcaagatgagattccaagtgcagaaatctcaatcccccaaacactggtaagatgatcagtacactgtaccagacgccagagacatttttgcaagcaccctgcactcctgcaggctgcagtgccaggctagccaaccccgtagtcaaacgaccagattatactattacaccagcacaacgacacttgtttatcggatccatcaccaatcaccctaatcaaactgccaatccgtcgacctgttccagcgtccaagtcttaagcacacgcattaagaaaatgtgaaatgttcctcctgttcagcgatgcagcatcaatcacacacagcacagaatctactgccagcatgtcgctgcatccggatgtaccgacaccggagggacacgcaaattctcagcttgttttcgtcatgtgccggatccaacttgccccttgactgactgtaaattcagagagtgttcagtgcttgtttcagaatcagaataacaattgatgcttagactaattctttgctgataaaaattagcctgtcagatactgtaagtactcaatcagatcaattacgctcagggataagaggtgcaggataaggtagaagataaaaaagcgaggttaaaagtgaaaatggttggttcatggacagtcgtgcaatgcaggatttgacaaagattggatcggctagctgctaccactaatattcttatgcaattgccgatgtctctccgtcatcagttcagacttcagagacgggagaatcgtttcgttttccatcatcatctcatctgcacgcgttggctggtgtccttttttctactatggaattctcggggttttgctgcggccatggggcgcagctgtacgagcaacgcgattgtcacagatagttacctgcatctgcatgaaagtagtaactgtgttgcgtgtcgacagtttttgtcgaggaagagaacaagaaatcaagatgtgattgctgaaatggtatgctgctggctagctagcatctggaagagggaaaaacataaagagcatttcttgtgtatggccttatgtggtgtagataatcagttcgatgatgtccattgagattgtctgttatccttcgttttgcacgaaataactagccacatagtcgctctttacgcaactgttgatcccatttaagaaattttatatatgtttttttagtttagcttagcttttatgagtgttttgacataagttaatttatttaaaaatatcgactggtctacccaactataaatttacttaagttatattatatgtttattagagaaatcaatggcagcttcttttttttttcttcattgtctttgccctcaatatataagaggaggcactagaaattgatctcccaaaattcccatatgtttagttcatttatgttttttattaatgaatgtaccattttgatttaacgactattgtttatccaaactctttatccttgtgaaaaaaccttgttgctttcactatatacaagatgtcatcgctgcaagttggcataccatatctgatgttcaaaattcagaactatttattcggcgaagatgattatacccaatctttctttctttcttttctggaaatgcaacggcagagttcctgttccagctatgcaaacccgagccgatctggtggtgcaatgcaaaatagtagcagcaggtaccacagctggctacatccagctagtcattatccaaataatgtgccttttcccccttttttgcgtaaaaattaagggcttttagtttaaggtccagctcccgttagatgcgactcataattaactcatggcatgtagtactacagcgtactgctcattgcagatctccctctctgataactctgatagtgatgatcctgaattcagaccactcatcaacagattcaacagttaattaagtatgtggtgtttgcaaagtgatgaagatgaggattaaataaggacatgtaaaatgataaagtcatcagcgtatgattgattaaattttaattagtataaacttataaaatgaattcatttgatattttaagcaacttctgtatagaaagttttcctataaaatacaccgtttatcagtttgaaaaacatgccttacaaaaattgagacagactatatcttaatcagaatggaacggagcctttgtaacaaagaaacctcggtcacaattatcaaaacttgctagataattaccggttggtaattaaacgtcagtttttcaaacatttctttgaatttgaccccatatgagagctgatgcaagagtagttctctgtctgttccaaaataaacgttgccatgagtttccgtgttcaactttgaccatccattttatttaattttttttataattaatatttttattgttattagattataaaatataaatagtattttatgtgtgactgatgctttttaggttttttaaaaaaaaattaaataagacgaacagtcagacacaaaaattcatgtctgcgcttattttggaacggagggaggagtagtggatggacgccattgtcattcctactggatcatctgagaataaacatcagaatcagcggtggaatgtctcactcaacatgcatgccatcacatcgcttattgtcacctgcagttgtccatgcaatttggtgttttcagtgctccagctcttcccgagcatacagtatggtcgcggagtgactagctgaccatgcacatcatgtcgatcgatggccaggcgaaaggtccagacggccacaatcacatggaaacatatcgtagatgatggcataaatatatgaccagcattagctgtgcaaaattttgatctcgcatggtctctattactccctccgtttcgaatgtttgacaccgttgactttttagcacatgtttgaccgttcgtcttatttaaaaacttttgtgaaatatgtaaaattatatgcctacatagaaatatatttaacaatgaatcaaatgataggaaaataattaataattacttaaattttttgaataagacgaacggtcaaacatgtttaaaaaagtcaatggcgtcaaacatttcgaaacggaggaagtataaaattggcaccaaaactaccgtccacaaccaaacacaggaaaaataccatagaagattcaaatattatgacaacaacgatgcacaaagttactacgaaacctactccctccgtcccaaaaaaagacaaaccctggtttccgtgcccaacgtttgaccatctgtctgatttgaaaaaaaatatgaaaaaaattaaaaagacaagtcacgcataaaatattaatcatattttatcatctaacaacaatgaaaatacgaattataaaaaaatttcatataagatggacagtcaaagttagacacggaaactcagggtttgcctttttttgggacggaggaagtacatccgagagcactagttacggatgctcctcctctatccatggtaactataactatcaaggtatcaatgaccttccactgattacgttgctggccatttatttctttttcttacgctatcattatcatacgattacattatgtgtggtatgcgccactctatttaagagagagcttagggtaagagtcttaattctacttctatatctttaacactcaagtcctaatttatatctaattttgtatatatacatatctgatataaattctaacaatctcgccttgaatttccagttcgatgttgttgctgtcacagtactctcagttactctgtaagcagttatccagttgtagatttgaagctgactttaagacgagagagctacagagagcatgagcgctgtagtgtacagtaatacatacagcctggagatcacaaattaaaagcgatcgatcagcagagtcatcgtctggcactgtttgacaatcaaagcaagcacgacgtaaatgatggattgtgatcggcagaacatcccatcccagtgcccatcaagtcatcaagcttccccctttcaattcgtcttctcgctcaggaaaattccatgtcggaggaggcagcttgcaagtaggagggagagattggctagctagccaagtagccagcgaccagctctccatcggccagctgctagctgagtcttccaagtccaagtgtccaacggcgcgccgacgcaagatcctagcgggcgagtttgatgcgcgccacggtgtgggctcccgcccgcagccgccgcgcgagcagttgctagctttgtcttaaaactttcttccaaaaatctagcatgtaaggccctgtttagttctaaagtttttttttctaaactttcaactttccatcacatcaaacatttcatacacacacaatttttctatcacatcgtaccaatttcaatcaaactttcaaacttcagtgtgaactaaacacagcctaagtgtaattgtaaaataactactccctccgtttcaaaatgtttg

SEQ ID NO: 53282 - DNA, 2974 bp, Oryza sativa
tcaaacattttgaaacggagggagtatattgtagtttgtttgtaacttacaatacaattttttttaaaaaaattctatgataacacactatttccatgaagcggatgtctcatgacataatcccctcagctataagcacgctgtgattttttttcttcgattacatgaatcttgaagcaaatataacggttcaaaatttatttgaaagttacattacaattaagttacaatataattgcactacgattttactgtatttatatctataaaattttttagaaaaattttgatgacaaatatataacaaattcggtggtcaggtcctcaggccccgattctttttgcttctccactgaattattgttgtggattatttcttccacatcttcaaaattaagtttttcttaaaaatactttcttttaatgtgttgcaatgattccttaatctatgttatatattaattaatttattaaaatatttaatttacttcaataattattgactgaattattataatagattatctacatggcgtaaatatgtctcctctcttctctgtccactgaatttgttttgcattattttcttcagaattcagacggggtgggtcaactgaatagtgcattgctgatttgctggtaagatttgttattgcagatttataatagattaatcgaggctcataactttgctgtgacttgtgaccagctgccttgcaggagggaacgagcgaacgagcgagatcttgatgggatccactcgcacacagtgcagtgaacattgctcaatgatggtttgcttggtctgattggaccatggatcttgcatcttccctaccattcccaatcattgggacctttgttttggttctggggttcaattcaattttaggtggtgcattatttgggctaagaatttcaattggtggaaggatgtgagaccatccgagcctatgtgagacttctgaaccaaaaatagcatcatggtggtttctctaatgtatagtgaaatagacttttgtcccgttttggagagcttaaattcggaggaacggttggttcgtagttaggtttaaaaaatatggaaaagccgggtttcccaacttttggcacgtagttcattgtcgcgcccaaaaatttcaccaattctcatactattctgtgtataaatctatgtccaggaatcaaactaggatacacaaaatgacaaattaatatacatattcaaacgtaaatacttacagaataaatacttagtcctcataaagaaaaaacaaagcaacagtgaaaaaggacgatcctactggaacttcacctccactccacaagtaaaacgcaactgaggtataaaccttggtcttttaactccgtctttagcataaaagcactaaacttttgaaatgtggaaaacaagatagaggagtatggcgaggctatttataccctcgagaaactggattggggcggggagaggcgataggtgagccaacgataggtacaacataggtgagatgcggctttgacgatgtatgatttgcgggagagtggtggggctaaaggtggacaagtggaggagacttgtaggatcgaatcataagaactaagccaaccagagggagggtgaatggttggtatacccaaaaaccgaaaacttttagcggaaataaaagttaccctcgaaattgatggaagtcggtctgaccgagattgatctgccggtctgaccgagtggatgccgccggtctgaccggtgatgaatctccggtctgaccgccgagatcacctgccgcgcctgtcgccgccgccggtctgaccgccatgctcccgccggtctgaccgccgcaatgccgccggtctgaccgtcggtgagttgccggttagaccgccgaaacccggtgaaacacaaatcaaagaactcttaaagttgatgacgactttattgattctttctgtgtttacaaagtgcaccaacagcactccttacaaaaatttcgactaaactcgaaaccctaactcaaaactcaactcaattgctctcaaaagcgataccgggaagcctcacgctccctctctatttatacccgaggtaggcagcctaaagccacgaaccaaactcatactaggagtcctaaacaccttaggaaaccctctagtacaagaaagaaactttacataaccaatcgtaccatatttggactccttctaaatttgactccgcatcccatacgcacacaataactccatcgtatgccatataaaatctccatcaaccacgtgcatcaactctagcctaagtatctcgcatgatctctgaccaccacggacgtcgtcttatccccaagccgactcccggtccatcaccgcaaatactcccctgagacatcgagtcacctacacatggaacaaacaaagaaaccatattccgagaccaagctatctccaagttgactcatcagcagcaaacaatagtattacatacgtatagtatccatctagaagtcataatcataaaataaattcggatatccaaataaacaacccaaaattgaaaccgacacagtgtcggccggtctgaccgcgcattacacgtcggtctgaccggctaccagagcccggtctgaccgatcacataaaatgacgaatcctgcgatcacatgtgaaatccaatcatcttcaaaaccacttcgtgaataaattccaaataacaaaaccaataatctccaatgcccaattgttcatcacaaaataataatcaaaaacacctttgattttacaagactgtgtccacgcacctggagacgccagtgtggaagcggggaggcccaccggagaggtcgtgatgtggaaaacggttgctggctttcaacccgaaaaaaaaggatgatgctaacaggtggaccccacattttggtggctcaaggcaagagggaggcgaaggggacttcgctgaaagaggctgggccaagaaaggcct

SEQ ID NO: 53283 - DNA, 3590 bp, Oryza sativa
acagtacttcatcaattttcagaattttatagctacatgttcctagaatttgagtgacaatctatattacctggggagctagagatctttggagaagctcccataaacataacctttgtaaaactgaacaactctcgaaaagcgctcttaagcggtacctctatttctctataaaaaaccaaataccactgatgaagtatatattgctctcgtcctaaaattaaaaaaacaaagctttgttttttctaaaaaaaaagttccattttccaacttatattctctcattttttatgtgcatatttcccgaactgctaaatgatgttttttctctctctctctctatatatatatatatatagcatgtcaaaatgaaaagctatccccagaaaacaaagaaaacgaacttaggcttgattggccgaagctccatgtcatgactgaataaagcaagggagtctctgtccgtttcattacgtctttctcttactgatctaggatcaaggtagcaattctactactacgaaacaaaaaagaacttgatttttcagggaaggacagctttctttttggcaggaatgcaagcaagctaggccagaacaaggagaaaggctaaaactgtctgagccaagaaccagacgcgctcatggcttcacactcccaccacactaacacaatatgccatttgtttggcttaataaatcatctgcatcatatcaacctttccgtcaatggtttagtttatgtttgactctaagccatggcaatggattaagtaaagcacatgcaaattcaaccactctctctcagccagccactcgctgtctcactagctttctttcttcgtcttcctcttaagaaatccaataatctttaaccgaacaccacttaacccccataatgctcgccatggcgaccatccagaaataggatgagacggcggcggccacgatgctaggcaggatcatcttctgcgtggtgatcgccgcggccgtcctcgccgtcgtcctcctcgccaccgtctccccgctgccggggcgccacaagggcggcggcggcggtcgagaccatccgtggactctcaccgtgtacatccatacgacgacggcggcggcggcagcggcagcggcagctggaaccgtgtcgccgccgcagcgacaacagcaggcgagcgcgttcgtgttccggcaccggatgacggcggggccggagagcgcgtcgaggacggtgggcgcggcgacggggttcgtgctccctgccgaggccgccggctcggcgatgtcggtgttcgacacggtgcacctggcgttcgacgtgtcggggatgtccgggagcgtctgcgtccaggcggcggcgggggacggcggcggcggcgagaaggcgccacggccgacgaggcggcgcggggagtgcggtgacccggaggtgctgcgggtggtgggcggcacgggcgacttcgcgttcgccgcgggcggggatggcgtgctccgcgcgctgtgcgcgccgcggctgttcggtggcgcggccgcggcgaaggtgttgcggcttgagctgagcgttgcgcacgccaagggctagtgcgcgtgcatgggcgaatattttgctccttcttttttaccttgtgcaaaattgttgggcttttttttttccgcgttacattctccggggaaaatacaactcggctttgatgctggcagaaatgcagaatacatctgaccagtgtgcatataagtgttgagaattgggtgatttgagtgatttgaggcccttcatttttcgtgtccaagcttgaaactgagcgtatgcttcattggttcgtgggacggtggaagcgtatactgcagtctgtttgattcagcatcgggcaacgagacatgatcctttgcagtactgtatttgcagaagccaggctgataggtggacctggtcccacatgtcagcggctgctacagcagctgcagtcctgtaaacaattcccattacggataacggggcaagctactttatcgtattctatggacacattttataagctgttaaatgatacgttttatgaaaaaactccaaaacaattttttttagtttataatagttaataacttatctagttttgcgtgaaacaacttagccaaatgaattcacccattcgaacgcacccaatgatgcatcattcgaatgctaattagcaacttcggtcattgtgtgcgcgcgtgtgctttttcttgggaggggaatgcatatcgttccgtttgtccattccgattcattttggaaaaaagtacgaattacctcccgaactatcgcatcgtccgaattacacccctgaaccataaaaccggatattctttaccccaaactatgcaaaccggacgaattacccccctcaatccaatccacggtagttttggtctacgtggtgtacgcgtggcagtccagtcagcattttagttattaaaaaaatgtgggacccacctgtcatacccctataacattattccccccctctctcctctctctctctcttcatctctctcctctcactctctaaacgcgcacggcgccacagcggcaggcggcggaggaggcgaggcagcagcgaggaagggcggcgcaggtggcgacacggagcggcggcggcggcaggggatgaggcgaggcggcagcgaggaagtaggggagcttcgccgtgtcggccgccatccctgtgcgccagcgcgtcgccgtctgcatctagcggcggcggtggctgcggctgcggcgaggcaagcgcgttgcgggtgccctaaggcctgtctacttaggccctgtttagctaatgggacagggaaatcatttcccaaccactaaaagacatctttaaatcctaaccattcattctcactctttcatttaatcctaacccttcattcatttccaaatctcaatcccacctcacatttcccattatccaaacacaccctcacattacatggcaaaactttgtcctgcaggaccacattttaacccaaacaatttgacgcacggtgcaccagaagatgaagtccgtcatgcgggtgacctgggaaacattgttgccaatgctgaaggtatagccttcatgtaatcactacgaatgcatttttgatgtttctctctaaaacaatcttcttggcatacttattttatggtgtgtctgtttaattgttgtcatacagatgtagtcggccgccacgatggaggggagcttcgccgtgtcggccgccacggcggcggtcgtggctatcgaggaaggtgccgccgagacggcctccgcgtcggcgtcgccgtcgtggccaaggaggacacccatgctccgcgcctccatccccgtgcgccagcgtgtcgccgtctgcatctggcggcggcggcggctacagcgaggcggcagcgaggaagggcggcgcagggggcgggagcgagcggcgactgggtggcgagcagcggtgggtgtccctcagatccgcccgcccgcagcgcccccgcctcgctcgtcgcacgcagtggggctcgcggggatggccgtggacggcggcacgagggggcgggcgcacctgggtaggccatgctaaaacggc

SEQ ID NO: 53284 - DNA, 1316 bp, Oryza sativa
ggctcagcccaccacagtcgccctggtcaccgccctcgcccccgaggtcgccggcgtgcagctcatcctcgacggcgccgacctcgccaagaaatcagtagctagtcagcctccgccagcgccgctcgtccccgtgccgccggtcgccgcccgcccctgcacgccgccattcactgccctcgcgccgccgcccacctctcgcccttgcgatgcccgtggaagagagagagagaaagagtgaagatagagagaggaaggagaggtatgacactatgacaggagggtcccacaatttttttaagaaaaaaattgctgactggactgccacgtgtacgccacgtaaacaaaaaccaccgcggattcggtcgaggggggtaattcgtccgatttgcctagttgggggtgaagaatgtccggttttatggttcaagggggtaattcggacgatcgcggtagttcgggggtgtaattcgtactttttccattcattttgcacgatccatgcctaaaatccaatgtcaaccaaggccatagtccactgtactgtggcccagggaggcccagcccacttggtgttgtaatatctcagaaggaaaaagtacaccgaaggtccctcaacttgtcatcgagatacaaaatcgtcccccaaccacaaaacatgatatgtggtacccctcaacttacaaaactattcattctaggtccttcgttggttttaacctcggttttgtccgacatgacagctgagtcagcgcgggacctgcgtgggccccacatgtcagacaatccacatcagctttctctttccctcttctctcccttcctcgtctctctctctctctctcttctctcttggcatggcgggcgacgagtggggaggagattgcgccgctcgcccaagctggccgagtcccggtggcgccgctcgccctcgccggccaagtcccggcagcaccgctcgccctcgccggccacgtcccggccgtgccgctcgccctcgccagtcgtgcggaacctctccgccggggtcaacggcgacgatggcgccgccgcgcgttcgagctcgaccggtggcgattccgcctccctccatgcacgctccccgccatggccaccgccaactacaccgacggcgagctcattgtcaccgtccccaagggcgccgcccctgacgacgacgacgatggcgatggtgtgcgccgcagcgtgcttggaggctccggcgcgctcgacctgcgcgctcgtcgttggccgccgcccttcgacacgagcacctttttcgcctcggccccgagcgtcgccattgccaccaccca

SEQ ID NO: 53285 - DNA, 2310 bp, Oryza sativa
  unsure (1)..(2310): unsure at all n locations
acacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttattgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctagaaccggccaacacccttcctccgtactctacagtcgggcctagcaaggcttagttgctccagttcactgtaagtaaataagttgttattatcgtacatgcttatttgcgatcaacagagtgttttgtactaacatttcattcttaattgtaggcggaccttctacaccctgacgctgatgattactcggtccgacgctcccttgaggcgtacctgttgtggttgttcgagtgggtgatgttcactagcacccacgggcacgctgtnacttcggctggtccactacgtacggtccatcgcggatgctcagccacaggacgtgccgcagtggagctggggttctgccgtgctagcagccacgtaccgtgccctcttggaggcgtgcacgaagactgacgcgggagcgatcatcgctggctgccctatgttgcttcagctttaggcagccgagaggtttgccataggtcgaccagtggtggacagcgcaccctatggggttggtcgcagtgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttagtgttcgagtttgaccgtctccaaccgagcgacgtcatctgggagccgtacacagaagaggccgtcgctgcgagagcaccgctaggactttcttccttgtgcacacgcgaaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcatgagttcggattgttcatttctaaatttttttgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcatgttgccgctgtcacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagc

SEQ ID NO: 53286 - DNA, 11339 bp, Oryza sativa
ttttggtttcaccttttgcacaaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgcccatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacaggccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccaggccccccgccgcccatttgcaggcggccccccgcacagtacaaaatcgccgtagcggagggcggaagggggccgcctgcaaatttcgttgacggccgtcgcccgagagcgaacggccgtctgccacgtcactttcgccgccctctgggatggcgacttttaaaaatcgccctcccagagggcggtaggcgaccacttctgtcaattttcaaaatgaaaaattatttttgtaaaacttttaataaaaaaattaaaaataaaaaaacctctcgcgactccccgatctcgccctcacccctccgcactcgcacgcgcggcgggcggcggctgatggcgacgaggcggcgcgccagcagcacgggcgcacatcaaagaggccaaacagtcagaggagggaggacgggagaagatccaaggcggtgcggcacaatggcaggcctaatttgttcagcctcacctctaactttttcttgatccactcctgcttaatacttcctccgaaaaaaaaaaacgagactaggattgagtaaggctgagtttagttccaaacttttctttaaacttctaacttttttatcacatcaaaacttttcaacacacacaaacttctaacttttccgtcacatcattctaattttaaccaaacttttatttttggcgtgaactaaacacaccctaagatccaaaattctacattaggtaattgtcaactccacttgtctgaaaaggccgtataagaaactggcacatgctagtctgctatagcaattttcatactactacagtactactgtatagttctcattgcgtttgttaattgcgcctgttaggtttgagtttcacgcggggtttttccacgagcaatatcgtgtttagtagttaactaatgacattggcatccacttgcaaaaacacatttagttacgccaagtgccatctagggtcaactctcctttttgcagggtacattctcccggtaattaattaagaaaagccttgcgatttttctatgtcactgttggtgttgatggagacgtcgtagagtacatgatgacgctctatcagatggggtcaactgttggttaactagcctgaagtgtcatacctggaccgctaatcagtggtggaggcatcaaccatgtatacatacctcatccctcaaaagaaaattgttctacttcctccatcccatataaaacctgacgtttaaaggttctaccggtgtcccataaaacatattgtttgagcaattttatggtcatttgttttaaatttttgaatatgctaatgattgctttgccatgtgtaatttttatggccatagctttagtgtgtagagatatataggtattattcttattgaatgccttgcactcagtgaagtgacaactgattattaataagtaaggacaacttgattatattttttcttcaagctaatttgcttttgaaaccttaaagtgtcatgttttgtggacggaggaagtacctttttactaatgtcctaagaaaatatggcttgtttggtttgataccaatttattaccctacaaaaattttggtaacttcaatagtagcaagtgtatgtttgatttgctaccaatttttatccataatagttcaaattgaatactacccaatttggtagtgtccaatttttccaatgttttagcactaccaagattttggtaggggaaaaattggctccaaccaaagaagcctgcagaaacaaatttgattaaaaagtgggatcacctgtctagtctaagtcatctggcaataagctttgaaagagttcattaatactcgctccgtcctatcttaagtgtagtcatgtgttttcatgtcaaacgtttgaccattcattttatttgaaaaatttattaaaaaatctagaaaaatgagtaacacataaagtactattcataatctgccatctaataataacaaaaatactaatcataaaaaatttcaaataatacggccagtcaaatgttggacatggaagcccaaaactgcaccggaggatgaaagcccaaaactgcactttaaatgagacggtgggagtagtatcttgcatgcaggggttcattataacatgctgagtgcatgtagactcaatgaaatgacaaatttagtcattttaacctgaagctaactagcttaaaaatcttaaagcgtcaacatttttggaacagaggaagtacatgtcaatctagctcatcaccctgattgcttgtagtgaaaaaaatggatatgaaatgatatggttttaattgtctgttgatttttgcatggtctattttatctggaaaaaaggtaacattagataggttttgactaacagcttaccaaaatataagtttatttcgcatatacaaatttataccaatcgatttttcggaagaaacctttgaaaaggacattgagtttctacttttattttttaaaaagaagagatctgatctagagtaatttacaagaaaaatcaggccatagactcttacaattgtacaattaactggagaaaaaaaagggaacaaaaccacacaattgtaccgattgatccatatcttatagagttgtaaaatctgacatagaaaaaacgccagtggaaaaatatgacaagtcataactattaccgtgaaatagacatatctctacctattataaaaatttaaaatgtttttgccgtcatcttcgtacgtcgcaaatctgtcatccgttcagattcctaagcatgtttgtagttggttctttccgtgcaaggtattttaagccgctaatcgctcgtgtatatctcttcgtcagtccgatccttatctgtattctttccaaaaaccacagcccagtatattaagccggtacatgttgcagtcaagcccacgtttccaacgtcccacgtcacgtaaggaaagagcacacccgtgtatcatgcaaagctgcttctgatctatcgctatattctgcctcacgtacgtacatgcatgtacatctgtttcctatcgatcattatatctgaaaacgaatttgattcacacacaaattaataatgtgatatatatatatatatatatatatatatatatatatatatatatatatatatatatatatatatagtatgggctccaacatcatccaccgtttaagtgctttaggattcatgctacttaaaccggattattagacctgttagcgggttaaacccgattagatgtttccatttttactatacccgcaggattgcatgcatgtactagtgaaatactatgaatcactgacgtgattaactcccatcgtttccatataagcttccatgcacgtacttaatttccatttgaaatattaatgtgattgtgtgataattcatttccaaatttgacatgatattgaatcaaatcaactaatttcgatgtaattgatttatttccatcaataccgatttatactttctattctttgtgtacatatacactagtagagatggcattccatattttacatactgttgttgtttcgactccatgatgctacgccgccggacgacgtcggcgagattctccgtcgacaagccgttgcatgaacggacgtgcccgagcttcttcgtcgtgggctgctggttgttcgccatatccgacgacgcagccaggcctccacaaatctttgtcgctaatcttcatgagcacgtcgctggtcgtccgcaagcctcgtcgcagccacgattgttgtatgcgactccgtcctcaaggctcaagctcgttcctcgccccacgaagtaactggttgccacctttttcaggtacgtcaaatcaactggaacatataaattatcgcttgtattttttggattttttacgtaccaatgattattgttcgtattctctgtgtgtatgtacagatgattttctatttttaaaggtattttagtaactgaatccatgtgaaatcgatcatctggaacccaaacaaacatgattatattggatgattgtaggtagtgatatcggtgttcatttccgctgatggtttgcatgtgaactagctgactgaattcacccctcgatcaccacgtagacgcagttcggctgcttcctatctgccgcgcctgccatctctccatgtcctcatcgtcgtcatggagatcaattgcctcgcgtttcgttccccattgcaagtatgttcctatcatcataaagcaggcttcttagtttcaaatgcataggtttttgcagggagtttgacatttggttctacctgtgttttgtaggatgattatgttatgcaaaattctaaagaagattagatgctctttcattcacctgtcaattgtctggacaaaacaaatgatcattaatccgatggtagagatgttcaacaattttggacttgctgaacagggtttctcatcaagacaattttgaatgaacaagtccgatttccagaagaccgatttctttttttttcttcgacaacctagcaatttatctaaattttcacatctacccccaaattgttctttggtttattaattccaacatagttaggttaatttctccttgtaacttgattttctttttgtgtatataccctgtataataataataaatttttaagtaatccctccggttctatattaatgagtatgaaaaattaaatagggtatataaccaatttgatcgattgtgaaaaaatagcttatacccaatttaagcaagtatgaaaaattaaattggtgtatacctaattaatacgattatataaaaaaagacttcgattaaatcgggtgtatacacaaattaaatgagtatgaagatttaaacgtgtatataccaaacttaatcgctaacaaaaaatcgggtatatacctaaattaatcgataaccaaaaatcgggtatatacactggcgtagagataaacatagttggctttgcctggtctccaaaaaaatgctatgagaaacgagcatacaattcattaattcttttcagttttagttaaaagtagaatatggttatagacttctatgagaaggtatatttgtcacatacttagccctcggagatataaccaatatacgggtgaaatccttttttataaaagaattaagcagaagaccgatctataggttctatactccatactttaaataaatttaactatagttaaaataaaccatgcaaaagttctcatttctatatatctagcgtatcgaaaaagtatatgtgtacacacacatatatatatatatatatatatatatatatatatatatatatatatattcacgcagtgatataacctatcgaattgaaagcaattttattagcttataccctgacacagtaggtatattatacatacacataacgatacatagccagataaaaatagaagatagattattcgatggtcatgcaaactataatttattccatggtcatgcaaactaataaggagtgtatatattacatatatacaccggtactatgtatatacctacacgaatgtcacacccgtagcaaactatattacatatgtacatcgcggtactatacatataactacaagaatctatttcatgccatatacgtatccacataaataggggcaactactattttcacaaaacaaaccggttatatacctatataactcatagcacagagaaaccaaatcatttgtgaataatgtagaatttacatttataccggaaaaacaaaacattaataaatactctaattattttttccttggccggctgtgggaatagaatctaggtatatattctaatataattcactcccgtgattttaagaaacaaaaacaaaacaggagtacatatactttatatacgttatgcatacccaaaattaaggattatgatttatctgttcaaatgtttcctttatttgccataattatgtaagtaaatcaaagggcattaaatacggcttaattagtacaatgcatgcgccagttttttgaacagggcattgcaccttccaaataagaaattaaatacgggtgtaaacccgttaatcttagaaacacatcaatctccttgatcaagatctcatctaacggtttacactcatggagcccatacaccatgctgccccatttggccatcctatatatatatatatatatgcatgcaaaccaaaattcaacttttacaaattataagaaaaaaattccagtcatcaaatctctactattataaaaattgaagttgtttttgtcggtacttgtataagtcggtttttaaattcattcgtttttggaaatatttatccgtatttgagttgggttttaagtttgttcgtttttgaaaataaataaagagttgtataagaaatctctttaaaataaactcgcatgttaacttgatatgattttctagaaaaatatatatccaagcaaattcttacaatgaattcttagaaaaatatatttccaaacgaattcttataatgaacaataataagattaagatagccttcactcattacaacgcacggatgttatgaaaaaaaagtatgatatgataaagtacggtcctgaattcaacatcttctagcctccttaggtgacagtatttggcttagcacttcacgtttagcgccaatccagccactccaggaggcgaccgttcttttcttcttcggctgggaacacgacgtcgacacacgtgtagcatacagcatgtcagcatgcgtgtcatgcactgctccctccgtcccaaaatataaaattttagaattagataaaacatttcataatactataaatctggataggtatgcccactgtcctaaaatataagaaactagaatcgaatgagatattttctagtattgcatgcctattcagatttatagtccttagaaaatgtttattatattttaggactaaagaattttttttttaccggagattttcatgaggcttttgttctcgtggaatcctctctctcaacttatctgtctgtggaatctatgctcctgccatctttgtgcagagacgttgttctcaagctccggtgagagtgatgagtcgacgtgcacaagctgtatctcactttgcttttgtcactggaatctagtaagatcccacggtgcacggaccgcttggcttggatcttgtctcagctttccgatgccatgtgttaacaagtactactacgaattttccctgtatcaatttgtttacggtaaacccaatgtcgtgccagaatgactcctctcatcctctggtactactacgtgctttcgtcatggcaaatttttgcagaatcgacggcgtctgagatgctgtacatatacggtacaccctccttgttgtgaaaacagatgtaacacataaattttatggaaaaaaccacagacgccaaccggcaattatcactattgaggagccgattataaacgttcgtaaataaatttatggtttctatgtccgacgtttgaccgtcatcttattttttaaaaatatgattctttttttaaaagtcacgcatacaatataatccatgttttatcatctaataataataaaaatattaataaaaaaattaaataagactgatggtcaaatgtgggggaaaaaggagcttataaatgaatgtatttcgggacagaggctgtagttaaaatcaattcttgtgattgcacgccgcggctatcatctcatcatttgtacccgtgacatggatacgcgatccagtacgtacgtagtacgtcgccaacgccggatgcaggaaaagctggcgccgcacggcgtgaccgcgcgcagcggtgcgtacgtacgcgcgcgcgcgccgcctcgcaccgctctccgcttggcccggcgcgcgcagccgcaggccgcaggccgcagcgtgcgtacggcgagggaagcaaagcgtggaccaaccgaacacacgggcgggcgactccgctcgccgctcggcctcgcccgcgcgtcacgtaggtacgcatggcagattggcagcggcatcgtattcgatctcgcccccaccgcgtcgcgtcgccatccacccccaaagcatcccgcatcccgtcgtcccccgtgctctctctcttccggctcgatcggcgaatccacgcgagaactaacacacacaaaagacacattgacccatcattactatactaatcactttcataacctaacctaaatcagagttactcctccgtttcatattatatcccattttaactttttactagtaaaaccttctcaagtttgataaaatttatagaaaaatctagtaacatctacaacaccaaattagttatatcaaacttaacattgaatatattttaataatatgtccattctgtattagaaatattattactccatccgttccaaaatataagtatttttagaatattgacaaatcaaatatttttaactttagctattaatagaaaaaaaagatcaataatgtaaaattaatgttataagatttatcattaaacaaactatcataatatgtaactctttttatttaaatcatttgatattgttggtcaaataacatctcggagactgtgtcagattcaaaagatgcttatattttgggagggggagtatttttttacaaatttaaaaatatttgactggagaaaatatcaaaataactttaatgtgaaacggacggagtagttaacaacccaaacgcaccgaccgcgaccggtaatctcatgcatccatccatccgctgcatctgcaattctgcattggcagcatctcttctcttttctctcctcctcgctgtttcgcacgcacgcaccgcaccacgccgccgtttatcaacgactcctttttaccgcaaaggtttcgtttcctttttcctccctctcgtcgcggccgcaccccgaagcggaaggaaggaactccgagagcgccatccatccatcagcaccaccgcgcgcggggggcgtagtggcggcggcggcggcgggagtcgccggggagatgtgagagggagaacgacgtgggggccggagcggagatggctgcggcggtcgtcgtcgccggggaggcggcggctgcggcggcggcggcgggggcgggagggaagaagcgcggggcgtcgaggagctggatcctgttcgacgcggcgggggaggagcgggtgctggacgccgacaagtacgccatcatgcaccgcgtcgacatcaacgcgcgcgacctgcgcatcctcgacccgctgctctcctacccatccaccatcctcggccgcgagcgcgccatcgtcctcaatctcgaggttcgcgccccccaatccccccgcccgacttcatccgggattttcggttcgatatgcgatgggatcgtggagcgccggattcgtgacggcgaattcccgggaattattacccccaatttcgcatgttttttaaggatttgttttcggtggggcggattacgttgtgattcatgctctgtcttgctgttgcgcgtagagtcaaggttgtactaggtgcacgtacccgactgattccatgattgcctacctcatcctcacgaggacgatttgattgaacgggtttctgatccaagtgaagggagctagcgaattgatacagctgtttttttttaatgtttgaacactgtattttaatgattattacggctctatcgtggtgatttctaacgaattccgtgtttcttcctgctggaattttccttcggtgggtcgagcagcatatcaaggcgatcattactgctgaagaggtgatgtttaattcctttcccccttctgattgtttgtcatgtaagaaggttccatttgggttgggggggggggggggactatgtgcacaattcaaccgtctcttcacttattggttagctatctataatgttgaaattctcatcaggtgattggggattatatacggatgcagcactactttggagttttgtctcaatttttaggagttgcaggatgctcaaa

SEQ ID NO: 53287 - DNA, 12515 bp, Oryza sativa
tctaggcttctgtcagtttaaaattaaatttgttgccactttgaatagagtacaatattgcagttgtctcaagtctgttttctatataataaactaggggctatagtttataatttatataaaactgtgaggatcttaaatgtcattttcatagatgccaagcgatgctggtggtaactcacagtaaatgtttttatgctgtgctcaggttttgctccgggatccattagatgataatgtgattcctgtagtagaggagctccggagacgacttgcaccttcaagtgccactcaacatgatgtggaaggtgctgaagaagatggtaagtttggcttgtgattctttctgaactgctgatgttcatattggcaacacgattctgtctgtatgatgtttgttgtggtaacttttagtatatgtttcttccttgatggtgaaatgccaatacccttttgatgtcaaggaattggacaaaaacaacgcacaacatgtttttaagaaatatgaaagaattcaaaaatattaattggccgcaaaattctttattgggttgcggccacaccatcctgttgtattcttctttaatttgtgtccttttcagttggacattcagttgaacaacgcgacctgtcactccaatagaaaagtccaaagcatacagtcatgaaacataattattattctgcgatgtctattggactttcttgcactagatcaatatattatgtgtcagtctatattgggattttgtcttaaactgagattttgggataaatgaaagaaatttgaaggaccctgatatggattcaactggattcacgagccatgactaaattaacacatcgtggtgggcatataaacacagaaacttgagaataataacattgatctatcactatatgaggactttctgaccctctacagaatagtatttgtttggtttaatttagtctacagtatgtaatacatattacaattgatgtgccattttataaccataagttgatccccttgcatcaaattgacttggaaactttctatctatcctatcactccatcaatcaacactggctggtatgctgataaaatcctaccaatgtctaacaactgttgtggttgttttgattgtaatattctatttgttgtttgtgaactccatcaatagtttgttaatatcccgcaatacaattttatgaactccagaatctccctttgaattccgcgcactggaggttactttggaagccatttgcagttttcttggtgcacgcactactgagttggagagtgctgcttacccagctttggatgaactgacatccaaggtgactgaatatatgcttaccatactgtattcccttgttatgaacttgattactcctagaaacatgatatgtgtgattttatttgaagcaacaagcataatatgttaattgctagatgaactaattccccttatttttcatatgtgaaataaatatataattgggtacttgattggtaaaataatgcttccacatcatattttacttgtactataaactgttcaattacaatttataaatcaaattctgattcataggttgtgctagtaacatttttcagtaggaatttttgcacagactgaccaaattcatgccacagctgttaccttgattcttttctatagctcaaatgtccatatatgtttcaccatccatataatgccagcaactatgtgataacttaaggttaagaaattatgatatcttgcaatttactgatgtagtgagcatatacttgtctgaacttatgctattcacaattttagcagcataatagtgtagtttgcccaagaagtggagtgctgtattattgatttccgtttgtcgccaaacaaaattgtagctaaagttgcattaagtaattgtacgatgaacagaagttacatttgagaattgtatggcaaatcttcacagctattccttgaaacttctatgcttatcatatagccattataggtctcttaactacttgttacattctcagcacatcaactgcattatgcatactaacttgatctactacaaacacacagattagcagccgcaacttggatagggtgcggaagttaaaaagtggtatgacacgattgaatgcgagggttcagaaggtctgatttcttggtttgctatttgacactactgagtgcagttaattaactttatatttttcagataatagtcatgatgttcactgtatttttatgccatattctcatctgatttctacttttgttgtgagattgttctgataattagccatattagctgaagaatctgtgcacttctgacaggcattgccatgcttttatcatttctttgctatgtcatagcacgtacattcttgtatccagggttagttattttataaacagaattaaagaacctcaatcatctagaagagcattggtaatattatatactattctatatttgacaacatacagttctgctttctattctcttgcatacttggtgtgtatcacccgttatttactagcttttcttgttcatgctttcctattagatcacaaaatgtttgttctctttgccaggtgagagatgaacttgaacaattattggacgatgacgatgacatggctgatctttacttgtccagaaagttggctggggcagcttcccctgtcagtggctctggtggaccaaattggttcccagcatccccgactattggttcaaaaatatcaagagcaagcagagccagtgccccaactatacatggaaatgaaaatgatgttgaagagctagagatgttgttggaggtcttttttgtttttctgcatcacaatgtcttgtcattctctggctgagatactaaaagtttcttaaatttgcaggcatacttcatgcaaattgatggcacattaaacaaattgacaacggtaagttgaggcagctaagtcgaatttacaatatcaaaatgggctagcaaaacatggcctaaggcttttgtttacaacacaacatcgttgaaaattaatagtactctaggctttcaccctttgctgactgtatttgtctgctatactgtttcagctgagagagtacattgatgacacagaagattacattaatatccaggtaacatttccctatgatatagctgtgcacggcatgctgatcttttaatcttggcactcacctcattacctctcgtgcagcttgacaaccaccgtaatcagttaattcaggtaatttctgaactacaagacctcatgattctctcttcttaagtgcaaattccacaaaaatagaattgatttcaaactagcatgctgttaaacccacactgaaataagctaaatgtttcataaaacttggttaccattgattcagctgattgtgctattctagttagtaatgcttgcaagtataaattctagtagttatataaatactctgtcattgtgcctcccgactttctgcaacagtaatataacttggatttgcttcttcctgcagctagagctattcttgagttctgggaccgtatgcctgtcgctttactcattggttgccggaatttttggtatgaacattccatacacctggaatgacaaccatggatacgtattcaaatgggtaagtcaaccattacaaaagggtcgtttaccgtcaataaattgtggcctgtctaaccaagctgtaaactttgttcctgcgtcacaggtggttctcgtgtcaggacttttctgtgccttcatgttcgtctccattgttgcgtacgcacggcacaagggcctcgtcgggtcgtgaaccttgcccaaactgtaaatttgagctagagcaaccttgcgtatgattaatctcttgtaccaaaattcatcagtataaaattgggatgatgaaaaagaacaataaataggaaaaaaaaagagtaaattccaaagagatatatgatgcttgtcttctttacccgtggtttgccacttttaggtgaaaaagaggcaagctggtaccctggacaattttctcgtctgtctcgcatcaccacatgctaattattaatgccctggtaacttcagaagaaagtgttgctacaaatgcattcttccttgcagaagaaagcgttgccatttttctgaaaggtttgtggaagacttttaccatgagttagaagcgaaataacaggacgaacaattcttaatgggaaaaatcaaccaatcgctttcccttctagaagtattaaggcatacataaacataagctaaattacattcgcgggagattacctgcgttagagtttaaatcttgatacaaacaaatatattacacattctctatttaaatagactttaacaggaatttatatttatctagattcattaatatcaatataaatgtgaaaaatgatagaatgacttacattgtgaaacagagtaagtatatgttatattgttacggtgttaagtgtaaagtgttgtgtgtttatcgtgtaatcggaaacaaagaaacggttatgaatgattaattgagatcacaccgcggtctccaacagttcggttatgagtagtatgatcttgtcgatagtacacacaagtagtatgttcttgtcgaacgttcaggggatcggagattaattatgtgcagtaacttcttcacagttagaaaaatcaactaatgccagtatctatcatggacttcacaggtcaagcacaaacagtcaagatggtgtgaaactctctcacatgcatacgcaaggaagaaataaaaagaagaggtatttgcaattccacaaggccgtgagaacgagcattatgcatagcaaatcttcgtttaagtaataaatcctatcaattctgccaagccacattgcaaaaaacctctccgatccgttcatatgatcgttgccctataagtacaaagccagatacaattaagagctgagaaactcatcatgatcatagtactttgtaaggtagttcagacatatatacacattacacaccttttttttttcggagattacacgcctaaaattttgttcctaaacgcagcatcatatatactccataaatcccgtttattggagatcttgatctagcaaggcatatatactaattaagcagtacacatatatatacgtcgttaagcaagtctaaatttggcaaggatgactcccagcttctccttggacagaggctgcacgcacaatagaacaaattaaattaccatatttcatatattacacttacaaagtatatatactcccttaaaaagttatttacacatttatgtcatgtattcctccctgcatggaagattgttaggaaaatgtaactactatgaaaacaatttttatagaaggctaaaatggattatgtgggtctacgggtagtgggccgcctatgaagattatgtttcatagacagcctctttaagtgagccgactgtcataatggatcttcgcagacggacagttatagaacccctaatcacaaatatgcaggcgggttatcgcggctgaaaatagggtttgtttctaaaagatccatagccctcacagtaaaaaagaaagatcttgttttctagtagcgtgtgtgtgtgagagatgtacatatgagacggcattcccatgccattgcatgcatggctgtccctgcgctgcgcgcaggctctcaccttggacgtgaagtcgtcggcgccggcggtgatgaacgcgtcgacgtcggcggggaggccgtcgctcgacacggcgacgatcggcgtggtcacccccatgccccggatccgcctcgtcgcctgcacaacaacaacacacgctagcgcgccgcccgcgccgcgcgtcagccggccacaccagccgccaaatcggccattatttcatccatccatccatccatccatgcgtctcgtcagagatagatcgatcgatgatctcacctcgtggccgtccatgaccggcatctgcttgtccatgagcacgaggtcgtacggcgccgccgcgtcccgcacccgctgcaccgccacctccccgttctccgcctcgtccacgacgtcgccgccgcctgccgccttcagcgccgctctcgccacgacctgcactcaccaccagctcgatcgagccagccattaacgacgatctcttaatcacatattactagctaattaactaagcgatgaattaccctattgatctcctcgtcctcgacgaggagcaccctgatcatcttgcgagccatgaactcttactctgctgctctgcctgcagcagatcattcgcctagctgctagctatatactactcatagcaagcagtaattaacaaagctcgatagctagtagctagcctggttgaactgaactagtagtggaagatcatgaggagagatcgcgctgtccctgttagacgcgctgggctttcacgaagttgcatgggttgcgatccacacgcgatctgcagctgcttggcctatttcctgcaagaatctctctacctccaaaacggcaaaacgcaactacgtgccacgccagccttccacaccgccgctgtccggtttaacctttcatctcttactaacaacgtgtgaacacacatttcataccgctgaacggtacgtttcgtaaaaaaaatatttttatataatatataagtttatatattataagttttttataacataacttcaattttatactaactctgtagttttacgataactttattgttaaatctgtaattttacgatacttcaccttaaacttgtatatttgtgataaatttagtgttaaatctatagttttgttgtaaatatagacacatattaatcgtcggtgtttcaactaatcggtggttctcttttcgtcaaacaaaccgtattccatcattgctggaaattgcacacttccggaagttatagttaggttgcattaatcgttatcttggtttggaggaagattttcaatgcacgtaaaattttaaaaaaactcattaacacataattaattaactattaactattataaaatattctaatagattaaagtttgaagttgaagaaaaaaaatagagtcttaatatctcgcgtccacattgttgcgattgcaacagggatatgtgtacacgtaaaaccgcttacgagcttagccaagctttggggttggtgcaattgtgcagagatcgtggtgctaacatcgtcgatcggacggctggggattggatcagatccacggcacgtgattattcttgcggaataagttcaccggaggtcccttaatttaacggcgagattttttaagacctcttaaccataaaatcagaaatcttcacccctaaactatacaaaaccgttcaccggaggtctctcggcagtatttttgcccgattttactgacgtgacatcctagtcagcaatttttttttaaaaaaagtacttgggcccacatgttagctgcatattctcttttctcttctcttcttcggagaggcgggcagatgcgggtgcggcgaccggcggcggtgcgggcgcggcggggtgtggggaagaagcgggagaggaggagaggagcgcggcgggcggcgcggagcgagctgcaagttgccactcaggtcgagcttgagtagctgcgtgaggtcgccaatcggctaatggtggatggaaccacgacggagctcaacatcacgtcggcgaacatgttgccgtcgaggaatatctcagccaaggtgttgcagttggtcaggttgttcaagaactcccaggcgccgccgtcatcggtcggcgtacggctccgatgagatggatgccccgctcctgcggagcctcccctccctggggtgggcgctcctctcattgtctcccgcgcccgcgcggatgctctccacggcagcatccgacgccctcgttgagatcaagccaggcgagataagcatggtctccgacatccccaaggagcacctccgccgcaaggtgcttctttggacttactctgatttatgtagtgtcgatagattcgctagccctcgcagacccgtgtgggaatcgctcgagatgtctaggtttggtgggttcttttggttgttacttgggttagggatagagcctggaggtgtcggtcgtgaactcgtggtacagactacagtgctattgctagttgatgttcgaatcgtggagtagatagaaatgcgaattcggtgatgaagttttacacttgtatggtttgaactgcgtttagaacttgggaggaatgtgctggtccgcgcgcgcccacgtcgatcggctgggagctcgccacggaacacgttgttcacgagtgtgaggcctcgcaacgacgtcatgttgaagaaactcggcgggatctctccagtgaggctgttatgcgacaaggctaacatgcggagcgctgggaggcttgacaagccgtcggggatggaactttccataaggttctggtcgaactcgagctgcacgatcttcgtgaggttcgccagcgatggcgggatgtggccggagagcgagttgtggctgagccggagcaccgtgagattcggcaacgcgtcgagccaccgtggaacgccgccgacgatcgaggttgttgttgttgaggtacgcgacgtcgagggcggtgcaattgcggagcgcgtcaggtatctcgccggcgaacgcgttgtcgcataggctgagataccacatccgccggagccagccgaggccatcggggatgctcccggagaaggcgttggaggtgaggttgatgagtagctcgagctgcgtgaggttggcgatggctggtgagagctcgccggcgaggcggctcatggacggctcatggacacgtccagcgacgtgacgcaccccgccgcccgcttctctgcctgcggccgcgttcgcgcccgcctccactctgctgccacgctcgccctccgctgctccacctgccgccgcctccctcgctaaagaaaaggagagaggagagaaaagagaagagaaggaaaagaaaaagagaagaaaaaaaaatatgtgcagctgacatgtaggccccacgtactttttaaatttttatttgctgactaggatgccacgtcaggaaaccacccatatatactgcttagggaccttgagtgaacgactttgtatagtttagggtgaagatttctagttttgtggttaagggacctcaaaaaatctcgctgttaagttgagggacctccggtgaacttattcctattcttgcgcatcccggacacaaccgggccagtgttcaactcgtgtatacgaatgcgtgcggaagcccacgggccaaggcccatagttgttgggccctaaccagtccgtactcgtacaggaataagttcacttttggtccctcatgttaacatcaagtttaaagcacgtacttcaacagcgatatcgggtatagcacatcattttataaaaccggtgtaaataatatcccacggtagtgtgggatccggtaccggtattaactgacgtatgttagtgggtgccagtcaaaaaattgcaatgagctctcctctcctctcctctcttttcccgcttccccttccttctcgccgggtgctttcgccacgagtgcggcgtggtcggtcttcgccgcgcccgtccgcggcttttcgtcgacgagagtgttgcacgcctcgttcgatgtctacgacgtcgacggagacggccgcatcacagctccaccgcgtgtgccgcgctgtacgagcgccgagggtatcggcgccggcaacgacgacgcagagcgcgaggtggccgcgcgctggccgccgccatctcctcgtctcctctctccccgacgccacagccgcagcaaggagaggcgccgccgcctgcgccgctcttctccgcgttggcgccgccctgaagaagagtggagatctcagaggagtgagacgaagtcggaggaagaagactaaagacatgcccctgacatgtgcgccccactgtaaattttctctgacttgcaagtgtcagctagatatcacatgggacgaagacctaattcatgtcacgttagcgtcacgtcggttaaaacttgaaagcggacccaatactatcatcagcatcacatcggttaaaattggactcaatactatcttgagacctgatttacatcggttttgtaaaatgatggatgcgttatacaccaatattgcacttgaaggatgcgatttaaactcgatgtcaaaatgacatgagggatctaaatgagcttattcctactcgtacgggggcctctctgggctctgctctggccacttgatgctgctactggaactggaatctcattaatcctgacaggctgggagtaggagtatcagacagacagctcatcacagttgctctactcttcgcaaactggccgctgctaaaatggaatatgagcattgaaacaacagctttgtttgcttacagagtagggaaaatgaaataaataaatgtcgatgaactcgtgtgtatgtgcttttcgcggttttagttacaaagttattctccaaacttctaactttttcatcacatcaaaactttcctacacacataaggcctcatcgtttggcatattcatatgcttatcagccaaaatttgagttttcaacgtaatatttagagctgattttggggggtttttttatcgaagtttagttttcagcctttgcttttaaatcgctaagaacacatatataaaagttttattcacaaattgattttcgtttgcaaatatgccattcagaaaatatgccaaacgatgaggctgataaacttccaacttttccattacatcgttccaatttcaaccaaacttctaattttaattttaaccaaacttccaattttgatgtgaactaaacacaacctttatttccaaattcatagttctagctaaaaattattcttttctgagaggagaaggtacaattgctatgagctacggtttggttcttgcaggctttgcattgcagcatcactccatctctgaagtctgaagtctgagctgattactgaaggtgagaaagggctgtgtcagtcaaaagctctgctgactctgctcctatgcttgttgtaggagtactagaggacatcagatggctggcgttgaatccattggcttctatctgtcttccttgggaaccaaccatacattaattgcccatgtagaaacaaacgatttatggacaacaaaaataaaacccactggttaaaaagcattttgaagaatattaaggtgatttgatctaatatggaaacaattttgtcgttacggtgattgtggcgcgaaaaacaccttatttctgataataaaaatggaggtggaattcccctccgattaaaagaaatactaacatgaaaatattaaattacacgcgaaaccatgttaaattggcgtgaaaattataatatcacgtcggtgtcggttaatataatttatcccgaatataaagtgtaaattgacaaaaaaattctgtgaagctatcactgtaacaacaggtgcttgggaaagcaactttctggcagctgccgcaagcacgaagatgtcataaccttacaagggaaaccacctgcattttctactgttctgggttagatcaagctgatatgtgcaaaactaccaacaaacaaagaactactactatacactaggagaaaaaatgattaaacgaagctgtcgcgacttcccaaagcagtttggttcttctagtatccgtgtgacaattcgtgttcctgataaaaaagacctgcatcatcgtctcatccgacgttcgtgtcacgatcaagttgacactgactcgatctaccaaccacgggataatcgagttgatttgataatctttcaccaagataagtttcagcaatgttgtgtgtgtactatctcctttttttttatcctcccagctattaaatagccctccgatatcttgctatttaggagtattaaatgtagattactgataaaacctattccataacccctagactattttgcgagacgaatctaacgaggtatattaatccatacttagcggatgattactgtagcatctatgtttaatacttctaaatagcaagatccaaacagggcgtatgaaactttcaaccaatgatttctcttccctcagacaatggaaacaacatgatatatcgtgtaagatgtaagaagctacttgcttcttcagtcccaaaatataacaacttatcaatagattagacactatcgttgctataattttttgacggagagagtagccatcattttcttgtatgcagtactccagttattttttgtcgtgaaaaaaataaataattgtgaatactactgcaacttaaacgtgcatatactgtaataatactgtatacgatacatatacggagaaaaaaatacggggagctgaaaattctcccaggtgcctctcggctacgcgcacccggcgccgcccacacgcaatcgcctccttctcctcctctctatttatacacacaaatacgccaataaaa

SEQ ID NO: 53288 - DNA, 1706 bp, Oryza sativa
ccgcctttcgcctggatttgctgcttccggttgttttgcctgcttcggtttcgcgtcgcgttccctccgtggtgttcagctcgacgccgcgttcgcgcacgagcgcgcgcgcgcgcttgctttccccgtggccttggctggccggcgttgtggttggagctcaccatgcttcgcgcgtgcgtgcgtcgtgttcagccagcgtcgtgtcgggcgatggctcgttccacgtcgccatgcctcctccgcctgtgtttcttgttcgagttctctcctcgaacgttctcgaacatcccatggcgtgcagtggtagctccaaacgagcaggtttgtaaccatggattcggtctgctttgtcgtcgtcggcagagtaacagttatgctctccggaggccgcggtcgccggagccactccggcaacgccactcgccgccgccgacgccaccctctgactatagttttctcctcatgctcttgctccatcgcgtgccagcgtttgcccctccggcgctgccatgaccgcgatcctgtcgactcgacaatgtagcaaagctgctgccttaagccaatccaggcagcctctcatcaccgcggccaaagccttcttcctttgagtagagttcatcgccggtggtcgctgttgtcatcctcgtgatatggcgttcgggtccaaattccctcaaagtctgaagtctgaagaaaactttcgatacatgttttctttcggagctttttggtgctgggaaaaagctgtaaagcgtcagcacttgctgcagaatgtatgggggttgtgcggtgttggcggggttccagtagcttccttactgttcgtgtttgctaacggtgggggagcttggaaatggtgggcatttttgcactgattgcgattaggaacacgttatcattttggttaaatgaccgacaccgatgatggattgatgggagttcagtggaaagcaattgtgccatggaatatggttttcccggtgttctggtcagtgtgaccaaatgagtttgcgttaggaaactagttcagatttatgctttcttgattggtccataatttgtatctgttagccacttagcctcttggaatttttcttgttcgttagtcgcataaacttgcacgctgtttaaaaatgcaacttttgtgtaactttactaaatgtttgctttggtctatgtttttggctggttcacctggatatgtttttttgtggtaagttagaaataaatgtaatgtaattatgtaaagtagcgagttgtcggatgttgatctagtggtagaaaaggtgattgatagataagaaaaaataattgcttgattagtgaatgctcacttgttggtatcattgttgcaattggaagtttgtgtcatttgtcatgctatgaaccagatgattgctaagtaggcctagtgcttctgctgcagtgtagatgttaattattgatgcatgaagccatgaatacgttgttaggaaccagagtagaggcagtgctatgctagagtttgcatgtttttaccaaatcactaaaatcaactacgtagtcttagttcattgttgccacttgctgctaaaggagttctcatgcttggtctgaaatatggtagttctgttttacctctgcttgaaactggcatgttctctttatagttactcccctgaccatttcttaaacagcttgcaaggagtgcattatggagaaaa

SEQ ID NO: 53289 - DNA, 4698 bp, Oryza sativa
agcgtaaagtcctcccacctgcttctgactcatccatatcatttctgatgcgtctagtttggcgtcgaccctttttcacccttaacttagatggatctggaacataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaatgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaataacaaccaatggaagtacccgaactcctcgcattacccagttgtacacctctgccaaattggttgtcattatgccataccgagatccatcggtgtcgaacaatagagaccacttttctttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttaggtggaagtcccttctcatcccaaccgttctgcaagtagtcaatagcccgcaacatacccgcatgacgatcatgtataaggcaaacgttgggcctcatacgcaccactgcaatatgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcaccttacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtctagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataactttctgttgcacgactcactacaactgatactgacattgtgtagacttcttggtctattctaaatcctctcaacaaccaactataaattgactgaaatgttctctccacaggcctatcgatgcccttagatgtcattacaaaatctgacagatcaacacaatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccaaatcaaactaaactacatcttacaattaacactactgtctatgtctcatttcatactattatattctatgctctggatctacacatatgtgctgtgtgctacagatatgctaaaatatatgaaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatggcccctcgccgcccatttgcaggcggccccccgcacagtacaaaatcgccctcccccagggcggcaagggggccgcctgcaaaattccaggccccccgccgcccattgcaggcggcccccgcataatacaaaatcgtcgtagcggagggtggcaagggggccgcttgcaaatttcgttgagggcggtcgccggagagggaagggcgtgtttgccaggccattctcggcggccttttgcgatggcgatttttaaaaatcgccctcccagagagcggtaggcgactacttccgccaattttcaaaatggaaaattatttttgtaaaacttttaataaaaaaaattaaaaataaaaaaaattcgagtcgcgatttgggaggaggggagagaggacgacggtgacggctggtccggtggtggacttggttatgtttgctgggcctgggagcggcccaaatttgctatgcctcttcgtgggccaaatttcgtggttgtgacatgtgggctggtcctggtagccagcccaaatcgcgaaaatcttctttttcaacatcccgacgcacagaaacagagcttttaaatccgcttctgatattaagcaaaaggttaaaaaactattatacactttattaatacggagagaaaataagaagtggggaacactattggttcgatagctaaaaacaagaagaaaaaaagatgatgcagtgttaaagtggtctagtggaatacttcaaaattagatcattccaaaaataatttcttaagctaaaactatactttagcaaatgaaaatgtcattggtatccctcatcatcacacgtataatcaactttgatcagtgattactactttcgaagtggattctttattcgagaattctctcggcctaaacaataatatgcttatgcgcaagaggccatatgccaagaaggccaccacgcccggcccactttccttcactcaatgggcccggtccgcctaagatctaccttttccttttttttcttttgtgtatatgtctagacaatctgtttggttagagggagtttaaaaggatgagactattaactgttttgtttggttgggggatataggaattttggtgggatggggatgaagaattaaggaatgaactccctcctttccaaacctgggtaggggcagggaattaggagggaattcctcctttacttcgccttaaacaaatctcagtcatcggttttcattagtgatctaatctccaactaaactccctatcaatttccaccacctctaccaaacaaaagactgggatgaaaaattaaattcccatcttaatctcaccatcaattacctcgtgtaaacttccaatccccttccctcatgtcgccaaacaagccgagaaaagaaatgcgaaaagaagagaaaagaaaaaggcgagaaaaaggcaaatggcaaggggggaagaagagtggaggaagaacctaagcagcaaaccctagtcgcgtctacaccaccaccaccaccattgattccgatggacttcgcggagctggaggcggtggagggcctccggtggccgtggcacgcgtggccgccgaccgcctccgccgccgcgtcgctcgtcgtcccgacctccgtcctctgcacgccgctgcacccggcggcgcccgacctcctcccgctcct

SEQ ID NO: 53290 - DNA, 2806 bp, Oryza sativa
gccgggccctccgtccgtcgtgttggtcgtcgacgcggccacctcggggccagagctcgccgcgctcaaggcggaggtgctcagggtcgtgcaggggctgcccgagggggtcagggtcgcgctcgtctccttcgcggcgtcggtgtgggtgcacgatctcggcttcgaggggtgcaccagggtggtggtgatgaacggggagcgcgagctcgagtcggagaaggttcgtgaactgtgaattctgggctaattgacggagccgcttctcaatgctgtggtttgggcaagtttgctcaagttgatccagtcactaggcatgggatttgctttaaaaattatcatattacagagtaaaagctatcgatctcgatattctaagtaaaatgggcattgtgcatttaactttaatagtctgctctcccaattcatgtgagttcaaaattcacactacaatttctgtggtgtataggagttataacaggggatgtaggggtgttcatgtacggttcagaagaaatcatctagagctgcgcatgagcaagtttagtttgtgatggcattaggctaagctgtcagtgggacatggatgaaaattaatacgaccagtttcaagaaactgcctgtgaacagacctaagtggatgccacacctttgtttgctatgttgctcctgtcctatgcatggttcatttatgcatgtagggcagcaactcttagatatgtacaaatgacaatgtatccatgactccatgtagcctaaaaatgtctgaaatgttataattgtagtatgactggagagagtttggcactatctaaataaggcactcttgggatcttgttaatatttggcttacatatgctgttgctatgttgctgttgtctagaagatttggtccttgcaacttgcaagtttgaagatgtttggtttggataggaaaactgtgtggtcatattttcagttgtcccataggctcatatcaatcaatgatccacttatgcaactgctttgcgctttaggatttattatcatcattatgtttaccttacaaaccttctcttattgtttcagatacaggaatttctaggtgttcgtgatgctcgatacaataagttggctatgccaaggtccactaaagtgcagagatttttgctgcctgtttctgaatgtgaatttaacatcacatctgcgatagaagacctgagatccatgtctgcttgcccacgtgggcatcgccctttaagagccactggtgctgctatttccacagctgttgctcttctagaaggttgttgttcacctaatgccggaggtcggatcatggtcttcacatctggtcccacaacagttggtccagggcttgtggtggaaaccgatctcgggaaagcaattcgttctcatcgcgacattttcaatggcaatgctcctctcattgacaaagcccgagaattctataagaaagttgcaaacaggttaacagctcatgcattagttcttgatctatttgcttgttctctagatcaggttggggctgcggagctgagatacccaattgaagtgtctgggggcttaatggtgcatacagaatcatttgagtctgagcagttcaaagcctgtttaagacacatattcaatcgtgagggtgttggttaccttaacatgaactttaatgcaacaattgagatagtaacatcaagggaggtgaaaatttgtggtgcccttggtccctgcatctctcttcacaggaaaaacagctctgttagtgataaagaaattggggagggtgggacaaactattggaaaatgagtacagtggacagcaaaacctgcatcgtgttcttcttccgagtggactgtagccataatactgagcccccaactgtcttctttattcagttcatgacgaggtaccggcatggtgatggtagctatcgcctaagagtaacaactgttgcgagaagatgggctggacctcgttctcctgagattgcagcagggtttgatcaagaagctgctgcagctgttatggccaggcttgccgtgcacagggcagagacataccatgttagagatgtgataagatggcttgataagatgcttattcgctttactgccaagtttgggaactatgtccctgaagatccatctacattccggctgtcaactaacttctcgctgtatccccaattcatgtactacctgcggaggtcacagttcattgatgttttcaatagctcccctgacgaaactgctttctttcggttgatgttgaatagggaaggagttgtggggtccctaatcatgatccagccaactttattccagtactcgtttgatggcccacctattcctgtgttgctagatgtcagctccatctctcccgatgtcattttactatttgattcatacttctatattgttattcattatggctcaaagattgctcaatggaggaaacttggctatcataaggacccaaatcatgaaaatttgcggaagctgcttgaagccccagaagttgatgcggaggcactattggtagaccgtttcccagtgccaaaactcataaaatgtgatcagcatgggagccaggccaggtttcttctagctcggttgaatccatctgtgacgcagaaaacacagctttcagatggttctgaagtcatattcaccgacagatgtatagtttgcaagttttttcattgaacacttgcaggaccatggctgttcaacagttagtgaggcatggagcctggcgatgtttccacttttgcagtcggacccaactctgatcctgaagatatagctt

SEQ ID NO: 53291 - DNA, 8052 bp, Oryza sativa
tgcaggattgatggatcatgtggactgtttatatgttactttctggtcttctgttatcttgaaagttccgggagagctttactgcttggaaggatgggatctcctcgagttgttgtacatttcaccagctccagtttgatgtaagccatcacttaatatttttgtatagaatgctataatgtctattatttatgctctacaagtgctggagttctcttgagacatttgctaatttctgagcagtaaaacaccctttgccttccaattctggtaatgcaataggaccgttatgttgttttctggtggattgaggattttaagtcactcttctgttggcatcatacgcccttaagcgcagccgtttaattctctgtaaacacttaaaattttgatatccacaattcttttggttgcggtttcacactttcactactgtgttgcttgtgtgattcttcaagaacgtctgttatttaatactgcccctagagtttatcatatgatgtttgacatattatagaccaaacataacataggcatctttatatgctggaagcatttccctgtcataaatgtgtgctgaatagattatggtttagtttgtttatgcaatgtacttagcttaggtatcaccacagctctagaaagagcaaggaagcttcatgctatgatcataccatcatgtgtcaagacccaaccttcttaataactcaaaagacagataggctagagttatagtaatggattccccatcaccaagcacatggcttgttccccccacttgatcacaccaggttacaaaaatattgtgctgatgattaacaaacatgttaacttaccagataccataataataatagtctcattgataccctttacttcacaatcacacaaacttaaattaacaacattggaataaaatcatcaagtagatcttgggacacacggtaggggacatcacataacaccaatccagctacacacaaatagattattgcttctggtccataaacaaattaaacatgacaactcttccttcttttaatccagctaaacaagtaaaaccttatatttctaaggaaaccataacacactgcaagaacaccattcttatggcaccatgctcagcatcttaatactgcaacattttcagctcttgttcttgtacttgtcctttgctcttggtgctggaagaaaaaccacacacacaaggggtgtgaattaagatataaatcttgacacgaaagcaaattttagctgaagatactgaccaagaccaatggcttcggaacccttcatgatcctcaagcgtttgcatgactcgacaaacatcctgcagagtaaccaatcagctaatgcgagaaacttgaacgtggtatcgctaaaccgcattctaatcatgaggtggaaaataaggaaaacagttaagggggcacaagaatgaagtagtaacatactgccacgggacatctccaacaagcatccagtcaccatccttgtcttcataagttgtaacagcatcagagccattcacctcattcatattgttccctgacagagaggttcatgcacagtgttttcatcaattccggatcaaactttgcattcaaattaattactagttgataatctgtttctgcaggttcccgtggccagcgatttaccagttgcggtgaaggtgccgaacatcttctgcagagcaagggagaggtccttgtagctgttgtacatcttcaggtccaccttgcgcaggtagggtgccccgtccatgctgaccttcacgaaggcagagctgttgctgccgctggcattggcagcgggctgctgctgctgcttgtcagcttcctcttccttcttgctcttcactgactggacggtcatgatgttcctgcggaacgaccgaactggtggccaacccactgcctgcgccctgatgtgtaacattggaaattagctactacatcgatttttttttcttttgctcagttttttcacatcttgttctaacttattggcgctgtgaaaaaactgagatgatttactttcgtgactggaagttccatccagctagatcatgcatgttacaatattcttgctggcgaccaactctgtgttaactaatgtattatgtgtgtatgcctgcagcaactttatggtagtactgtgtgtataatgaaaatgccatcaactttagttattgccacatgaatcatggccaccatgattatttcaggaattaattgtatacagatgtactccttttctgatcgttctaaatattttgttgtgatcctatcttcttttcaggaaaaaaaataaatcaaaacaatacgaaaacaactcctttttcagatggaatctgccaggagatgaaggaaaaaataaaccaaaaacaatagtagtaccactacatcgccagcaatttctgacacctgctgcacaaagcaggcatcagatgagccaatggtgattaaaaatggtgataattatctgctcagcactttgcaagcgacaaagaacatacacgatggtgtcgccatatgcactttctgccagaggatctcttttatatggataatttgtgcttcttttaaaggtgttgcttcatgggcatctcaagtttatgcagcaagctcccaaatatataaatccaaacaaaagaaaggaagagaagagggggggggggggggggggagaactaactaataacctaaacatgcatacaccttttcaccaaatgccattatgctgctactatatgtggatctttttccataaatcaaaactaaacatgcataaagttcctccaaacagcacaccaaataattcatcttttatccctttagcaaaaattaacaatactaatcccactaaattctcactaattattaagtaaactagtaattagacgatgcaactatatatacgaaggatcaaattggaactactgtaacatattaatgccagatttatatatgaaaaaataataaaatcatgctaggtccagtacatacttgggagcaggtggcttctcggcgtcggcggcggcggcctccgccggcctcttggccttctcggcggccggcgcctccgccttgccggcggcggcctcctccatgccggcggtgggcagcttcagcttcaggtcaatggtctcctcgaagcccctcttcgcggccttggccgccgcctcggcggcgccgccgccacctccgggcagccccagccggagctccgtcccgacgtccacgtcggcgccggccatcgcagcagccgccgctgccagctgcttagcctatcgcggctatcgcgtctcctcgccccaaatcaagctgccttctcttctctctctttctctctatggagactggagatttttaagcctttgtggtgattaggaggtgttggaagaagagagaggagccaagaacagcttggagatgagtatatatatagagagagggaagagaagaggagaggagagagaatgcatggtaaatattctaagctaggtagggtggtagagagagagaagaaatatgagttttattttattttttattttttattttggaggggaagagaaagagatcagttagttagagcatgagtgaggccacttggaggttagtagacaataatttttgcatccatgtttcctccggttggattctctattacaacttacaagtatcaagtaatcaaggttaggaggctagagagcaaggtgtgtaactagtgaagttccattggatggttgttcaggatttgtaaagtgttcctgtgccataattgtagctgtggttagtaactgctcctagctacacccaatgtgcataaatatatgacttctggaagcttgcaattagagtttttttttcaaacgtattcaaaaacatatatttgtcaaacaaacacaccttaaaaaatatttgtcaaaaaaaaacaatttccatattgtatcatccctctgccttcaaatacttgtcgttggacgcttttcatcttaaatatttggttgctcgtcttttttataaaaaaaatatttaaatacttcaaaattattctatattaacgaagtatgttgcatcctaaactattcataatactttcatacattatgatctaatcattcagattttattgatagtctaagttaaagtcgtgttaatcaatggtggtatttatttatggaaaccaaagggagtttttttttatttttatttcatgttcatgctacatataacaattgttaaagtaatattggaggagccgcaccctcttgaacaatgagagcaacattaagttgaattgtacatgttttttttccaattacagatttcttgtaaaaaaattaaaattgagaagcagaggtcaaaagtagtcatagcaaaggctacagagaaaatcagtttgactttaataccggataaacataagaatgtaccttattttttataactatatttttttcatcaataaaagagtgcaaaaataagggggaaatgatcttggttcttaggagtattatcattagcaaatttcataaaaccccacctattatgtagtcttagttgaacaaaaccactaaaattttggcacgtgacacataaccccggttctatggctatcaagttttacaaaaccataccatcaatcatttagactttgatataccatattttgaagttctaaaattacatcccaaattatgagttttgtatctattatttaataattgttactttcatggaggtaaagttttataaaattttgatatgtgaatatgttaaattggttaatgttgtggttttgtgaaactttaagggcccctttgaatcgcagggtagaaaaaacggaggaataggaaaaacataggattctgacaagaattgaagtgtaaaacagaggattgcaaaacacaggaaaaacacaggaatggtcgtttgattcgagcgcaggaaaaacgcaggaatcggatgagagagatagactcaaaggaaattttccaagaggttggagctcttgctaaatttcctccaaaatctacatgcaatgtgtcattccataggaatttcataggatttgaaaagcttcaatcctttgaatcaaagggccaaataggaaaattttctataggatttgaatcctatgaaattcctacataaatcctttgattcaaaggggccctaaatccataatacttgggatgagttatgtggcacgtattaaaatctctttggttttatgtaggtttgatcatgatacgtgtgattttatgaaatttactctgttattattacactgattttcttgctggcaatgcaactgatcccaaggctgcaggatgtagaggatccgggggagcctagctcgcgccggtgcatggacccatatggcgccgggcccaccgcgcaggccccggtggcacgacacgtgtcgcctgatgagctggacggcgccgattctgccccctccccgtctccccctcctccggcgtgagggcgtgacgcgatgcctgacgtcaccgccggattttttcaccgtggggccgggctgcaggtggggacaccgtggcgtgtggggctcacacccctccgcggcaggatctaccttcgctttattctttgggtgatgatccacttgcagagatgcatgcatgcattctgaactctgaagccaaggctcaagggaagaatgtgcgtacgtgcaaatctaaaaggaattcatgtacagtttgtgctactaagttttttttttcttgttctagataatgtgaaaaaaatatgaatgtcaagggtcaactctaagtaaattcaaaagtacaaaatggcccacaccaaaaagagatactcagtcgtatccaaatgcatggtcaaaatttgaaatttaacacagtcgtatccaaaataatactccctccgtcctagaaaaaaaatatagagttttagagtttgacacggttattaagaaagtagatagaattaaataaggagttgtgatttgttgagaagtggaaggtatgtgggaaaagtaaatggtggagggttgtgattggttgggaagacagtgttggtggagaagttgctatattttgggacacattctaagtgctaaagttgttatattttatgacggggattttaattcactctaaaaaaagcaatatgttttcgtcggatggaagtaaaatggattcgagtaggactatcaaacaaagcgagcacattcaaaattcgagttcttttgtctcaatattggtactgtccttatagatttttacttcctccatactaaaatataagaatgtaatattaaatgggatattttctaatactacgaatttagaagtatattattacattatcataaaatgccccatctaattctagattcttatattttgggactgatcttgaaactttgtgagaattcatattttttttgctttgattagagtgtactaatactagcttcggaggcctcgctcgtttgtgctagctaaggcaaaaaatagtgaactgccggctgtgcttttgggcgagctgcagcctgcagaggcccaaaatgtctcaaccaccaaacaaattatgaacaacaattactagcagaaaaatgaacaaagcgataaaaaaatttatgtgtataatttctacgtttatatatttgtcaattaaaagctactgcgtcgtaatgttgtaaaataagtacctcaaaatcaactcaaaattaagtttgtaaaatttattttgtttactgcggttgataagaagaaaaagaagaagatcaacaaacaatcagtatgaaaaacacatgtactctacaagtactagggtgtagctctatccttctacccttgatctactgtatactctacaagtaggctgaaggaaaataaaaaaataaaaaccgaagtgaaaaaaaaaacatgacgtatatctgactttgatgggcagcacagcagcaagaagaggagttgttggattcccaggcctccagggtggtgggccccacgtgccgggaggggtggggacaggtcaactcaggtgtcggccccaccactcctgcgtgcatgtgggttgtgaaaaacggattctcagctccacgcgaccaccttatatattcccgcccaaattaatcaactactaaaaccaaattaatcaactaattaaaccgatcgagagagcactagcctacctagcttaacataatggcataggattagtgctgcataatttaatttagtagcagcagcagcatttcttggcttccaatcattctccagccagccagccatggatcgatccccaatttaacttaattattagtagcagtatagtagtaagaagagaagcatgatttgatttgtttaattaaatccgtttgctcagaacatagttactcgaaaaggcaaattagttaacgctgttaattagtggcagtgtgttcagggaaatctctatcagaatctatgcagaatttgacggtgcatatatatatacacacacacatctgccatgtcctactactgagtactgactgatggagcttgttaattgtaagcccctgcatgtatgatcagtttgaacataatccgccctgttttacgcaaagatcgaattaattgtgcagaactcatggactaatatgcgtcgcgcagtccccgggataagctaattgagatgggtgatgagagggcagagtgatgcctagcaagtacaagaaaagtcctgatcgaaatgcccgtgtcccctcaaaagcaatacgccaccatctattgctagctagctaaaccagcaatatcatttgatttgtttcagtccatcagtaaatcgaagtgatgcatcagtagtacatccatgatccatatgcaatggattccctgtcctggtgaggcatcggatggcactactgctttttttcccctccagacggctggaatcacttttcccatgtgggtggagcaaccgcctgaaattagatatacgtacaaaccaggatttttatagacgggcgccacaaccgtttgtaaaaaccgatttttcctggtgagca

SEQ ID NO: 53292 - DNA, 719 bp, Oryza sativa
ctgtcattgtctctgctctcagtgcccaccgacagcggatccgtccttcacaagactggcaccatcaacgccgccactactggggtcacaacgatcaatgttgccgctcgcatgcatatcggcagtggatccatcattccagaggctggcatcgttgtcgtcgctgcttctgaggttgttggccgccgttgacgaaaagaggaaagaggacccaagtggcgtcgactcactgcttaagagagggaaaaatgaatagaggaaagaggacccaagtggtgtcgactcaccgcttaggagagggaaaaatgaatagagtaaagaggaggagagaccgagggaagagactagggggaaagagcgggctcaatgcgccctttgattttaaagtggtcgtacgtcgttggtcgatgcgtctggttgtttagatcaactaaaaaaccaccacatgcgaaagttaggttattttcatagacagactgtttaaaagcatcttatgtgaaaatcaattttcacatgaaaatgttgatcaagtgtgttctccgtattttcaccaacaggttttacttaagccattttatatataaaaaaaggagggtgtttatgaaaatagtttattcatatatagttgcggctgatcaaaactcaatgcaataaaaccagcgtgccacgttactagttgtggtgtttgcatgatatatccaatataattaaccatccgt

SEQ ID NO: 53293 - DNA, 11353 bp, Oryza sativa
caggaagctgaggataaggaggtctatcaaagtccctgcaatcagtaataaggttgctgacattccagctgatgagttctcatggaggaagtatggacagaagccaataaaaggatccccacatcctaggtatagctaaatgctcaatctcatgtagtcatttagtcattatgttgccaggtgttttttctggtacaattgggtgccattgctagttcatactgcacatgatatctacacttgtgctttgctgacttgtcactattattcagtaatcagtactagtatgttaggaaacggtcctgcctggttacattgagctattatttctgttcatgaaatttttatcttctctgttcttagcagatttaagtatatgcacatctcatagaatgcatgatatgccattaattattcaccagaaaggttttctaatttggacagcaataaatgattgtagctcatgatactatgtgctgtaagtttcaagctagatttctttccacatctgtttagaggctggttatagcaaagggagattgggatctcgagaaagttatagttttggttttaagcaactcatgtggttggtgataccttcagtcacacatgtagttacaagaatgccaagctctaattttggtaacatgcctgttgcaatccaagaaagattacagctaacagcctttccctatacaaattactcattctttttgtcgaagagattgctgaagaatattcacgtatgctcatcgtttttcaggggttactataagtgtagcagtgtaagaggatgcccagccaggaagcatgttgagaggtgcgtcgacgacccctcgatgttgattgttacctatgaaggtgatcacaatcacaaccgggtcctagctgcccagccagcctgatcgacatttcaggctttcagtcgccggatcacttcgatagcatccctttctagacaagagattaaaaagtaaaaaaaaaaagaacaagaggagcctagtttgtacatactgctctgttcctaactgttgggtggtagagacagctcttgcagaagaatccatggcgaaaggaatttaccgcatagatggagtattttctcatcggagactcgtaattttgtagccttttctctcctttttattttgccctcttcatgttggtcctagaaactatcttgtgttgcagtgtgacattcagctgctgcagttatatgtctgggggtgtggtggtggtgaaggtgatttactgtttagaggattggagaggacagtgcctgtaaaagtggcaacacctaggaacaaaatgtaccctcatcttcagtctggaatggtagtacaatctttgttgtgatgggaagcatcgggttgtttgtgatgtgtttgctagcacaagtgtgatcctgcgacgggatcgtcaggctttaaaattctgaccgtgttttgtcctgcgaaattcagatttcagaggccagtttctgggcgatctgaaaacgcatgcagccattgtacctagtgcctctcttgtcccttgattctttgacatgtccatgtagcgattcagaaggccagttgatctctctgtttggaggtcttgctgagatcatggtgttcacgggatttcttcggtctatgccaagatttggtgattttttttaaaaaaaaattccttttggactccgaactcttgccatgtagggttaaaaattccttttttaaaaagaccagttgtggcttcttaattggaaaaatatgagggttaaaatagaaaatataaggggctaataaaaaaggagtagaaaaattgaaaataccacttaaacacctacattctaaaagaaaaataagttttttttacacatgtggcttaagcctatatgacacatttgtagaagtggcctccagggtgaatgtggcaaggctgtaagcaataatggggtttgatagatttcagtttttgaagcaaatgtttggttgcttgcctccaagctgtagactgttgtgcagttggctggtataacagaaaagacaacggaatgtgtgctgtattatggtcacaaagaaaacaaaaaggtcattagaaaatgttctgtttttgtgctcttattaatgtgaaattcgattacagagaatatctccattcccattcttctgaaatctgtaatcagactgacaagcgcagtgacaggcaaccattcgtatccgttctactctgtccaaagtccaaaccgtgcaagtctgaaatggtacagtgcaactgcaccatgtccagcactaagcatttctcttgttgggctgtgataaaggcctgtttccttgtagccactagcccactaggcaagcttgaactaatgccagatactcaaggcccaactgccccaagtactccataaatagaagatttcactttgtgtagttttgattatttgattattagtgaaataatttactgtttttcatgtgtcaactcgtcgattcgcaggacacggagaaactttttactgacaatatccataaataattgttttttaatcaacgaagattaccacattaatattcgggggcatgataaacaatggtttttcagcgtatttatcatcctattcagaataaacgtgtttttctaccttttgttttaaatgagaaaatggatgttctggcatgaatattcgtaattacttattcaaattcttcatactgatcattttatactagaatcaagctttttctaggaatagtacgtatttgtttttgtgttttcatgttttctagttacctgtttttcatgtgtttatcctttcccccctatcttttttttcatatggtcttaaaagtcattcgaagttcatcgtcttaggaatagtgaccccccacttgaacttaatttgacatgtctcagttatgtacgtctgtagaattattgcaaattcatgttgttttttacactttaatactccctccatcccaaaataaatataattaacctagctagtatgaaatatgacttttttaaaactacgaatcatgcactgtacagatcacagtacttagtagaaaatatcacatcatatactagggcagtagggctgtgtttagatccagcggtgtaaagttttggcgtgtcacatcgaatatacggacacacatttgaagtattaaacgtagactaataacaaaaacaaattacagaatccggctgtaaactgcgagacgaatttattaagcctaattaatctgtcattagcaaatgtttactgtagcaccacattgtcagatcatggagcaattagctaggcttaaaagatttgtctcgcaatttacacgcaatatgtgtaattaattatttttttgtttatatttaatactccatgcatgtgtccaaacattcgatgtgacatggtgaaaaattttgtcaagggatctaaacaaggcctaggttaatttattttgggatgagggagtagccttttcctagagaagataattgttcatgtctgaatacgtagtaacatgtgctccacgtttagttaagatgaactcattcatgcactgaagttccaaaacatcaagcttgccttgagtttcgtttactgcaatctcaagctggcctacaagtgcaggtacactaatggtattagccagctcccatctaaccaccggttggtgattaaacactgaccccaacccaaaaagattcaatcttttcatatcaaagcacagtagtacacgtacacacacttcgtgtccaacatgcctgcttaagacacgctaattgcctaattgatcacctgataatcattttggtgaccctaattagccatagggctaactatcctgtcaagcacggcgatccggcaccattagtttcacgagaaaatcgagaaaaaaattatatgggaccccatcgaacatatgccacgtgtacggataggatatcactattttgaacagtaaaagtacaagcttgacttcgcctgtgacaggtatcaaaaggctacaaaatcgtccgaagagggacaactctttttttttctatgatttctagtgatgtagaaacgacaagacgatgtctcaaggaataaaaaaaaatatatcttcgaaagttcaaatcatctgtactgaattataggttcatctttataaatttgtagcaactagcaactttttaatagaatttcactgaattcagtaggataatacagcaaaaggaactagatctgccccgcatgtacataagttaaattccttgggcaaaaatgattcgatgatccgattgaaatcgatcgaaaattgtggcgacaatttttttagcactatcgaacagagtatctagctagttactaacttactactactattttagagaaagtcaagttaattagctaaaaatatgaactgttgcatgcatgtgtgatgtattatggttgacaatgtagtggccaattagatttcctttctttgtcaggacgtcctacagattcatagctgaccaattgtcttatattttatactcctacatacacgtatataggccattgttttcgacaacttgaacaatactcaacaactttattttccaaactaatagtacaaggctagtgaaccccataatttgggcatcaaagggttctaacctaagatatatcccttggattcgttttcctttttatgcctattattcatagtggcatcgattggtttgccctgtctattaagtctttctttttttttctttttggccactagattgacaaccacgtatataatacaacaacttacatgtttagttttttaaaagtaacttattctaacttaaaaaatgtattaagtacttgtgtgcaacaatttgaaaagaaaataaatgctcctaaacgtagcaaattgaaatcacaaccaaactagagaagttgtgatggtaaattaaagctgaaattactgggctactggaattcattttactacaagtttgggtcagacatacaaggtatatatgtcatggctgttatgtgaaatacacactacacaccacacgcatatatatatatatatatatatatatatatatatatatatatatatatatatatatatatatatatatatatatataagaaagggatggtaataaacgcatgcatatgcaaattaaatttgttttccctaatacatcacagaggctctccacaagcacacgaatggctaaaaaaatgttaaaatatacaaaccaaatctagctgcacaaactcaagagagcaccaacttgctaatttcattacatagacaaattgagctattggacaatagaaaattaaggtcttcgtgacgccttcctttgttccgatccatttctttacatgtgaatgtattagatctattccatccgccccgtaaaaaacaaatctaagaccaggccaggtgtgatatattctaatactatgaatctggacatataactagaatgtgtcgtatcctatactatgttggttttttatgtaacgaaggaaatactttttatctatatcacaccctctagagaactgaaagttattttactttaattgtttaaagggagcaatggtacaaaatatataaacgtgtatagagtaatggtttaacaaaataaaacaatatatatttgccgacaacacaaaacccgtatattagcacagacagatgagcggtactgaacatcacttaagacatttacattagcaataaatgaatctacacatgaccctgtcaaatataggtgagtgttgatatggatgagagaggagagtcaactcggaaatgctactgggtgagcgcgctcgcccgctcagggcgatcgattccccccctccccctccctccctccacctggtttccttttttggcaccgtattactttcctattttaataaatttatgcacctaaagtttatacacctcaagtttacacatctaaagtttagagaccaaaagtttatatatccgattcaaatttgaatttgaattcaaatattttttaatatagtatttctatacatctaaagtttatacacctaaagtttatagatccaaagtttataagtcaaaagtttacatacccgattcaaatttgaatttgaattcaaattttttatacataaatttttctaactttttgttttttttaaattttttttgtggtgtactgtaataggaagagaagaacgggaggaggaagggcagaagtgggaggaatgcctataggcggagcgcccccccccccccgggcgtcgtgagatagatataggctagaaaaaaaaactaacacgggagaagagaagggtgaaaaaaatgagagttgattagagtcagcaaccattgtatgacatgtttgtggagctgtcatcaaatgaaaacatggactatatctatctgagtatgagtttgaaccatgcatgctcaaagtgttaagcttgtccttaattaggatttaaaccattattgtggtgggaattaattaattagccattttatcccatcttgacagagggagaaacgatacttgattagcttagccaaccggccacacgtttttcacaaaccaagaagctagttcccacaatacataaaattatatctcagcatccgcgattacatggcccaatcctctccttaattagcttgtttgcctatataaacccttattctgtccaagccatgctgcaattaacttatcactcatcagcactgcactaaaagcagtgtaaaagctagctagccctagctgctgtaagattaatcagcttaattagcagctataactagctagttaattaattagcttaattagttagctttagctagccatggacgactacttcttcctccagtcgctgctgctctgcgtcgccgccgtggcgctgctgcagctggcgaaggtggccgccaccatgaggcggcggccgaggacgccgccggggccatggaggctgccggtgatcggcagcatgcaccacctcgtgaacgcgctgccgcaccgcgcgatgcgtgacctggccggcgtgcacggcccgctgatgatgctgcggctcggcgagacgccggtggtggtggcgtcgtcgaggggggcggcgcgcgcggtgctcaagacccacgacgccaacttcgccaccaggcccaggctcctcgccggcgagatcgtcggctacggctgggccgacatcctcttctccccctccggcgactactggcgcaagctccgccagctctgcgccgccgagatcctcagccccaagcgcgtcctctccttccgccacatcagggaggacgaggtgacggcgcgggtggaggagatccgcgccgcggcggcgccgtcgacgccggtgaacctgagcgtgctgttccacagcacgaccaacgacatcgtggcgcgcgcggcgttcgggaggaagcggaagagcgcgccggagttcatggccgccatcaaggccggcgtcgggctgtcgagcggcttcaaaatccccgacctcttcccgacgtggaccaccgcgctcgccgcggtcaccggcatgaagcgcagcctccgcggcatccacaagacggtcgacgccatcctgcaggagatcatcgacgagaggcggtgcgtccgcggcgacaagatcaacaacggcggtgccgccgatgatcagaacgccgacgagaacctcgtcgacgtgctcatcgccttgcaggagaagggcggcttcggtggaaaggcggcttcggcttccacctcgacgacaacaaaatcaaggccatcattttggtaaccctatacattgattgcatgtgcatgaaggcaaaagtgttactactccatgggtcattgtaacacatatgatatgtacacttgacgtgcaggacatgttcgccggcgggacggggacgtcggcgtcggcgttggagtgggcgatgtcagagctgatgcggaacccggcggtgatgaagaagttgcaggggcagatccgagaggcgttccacaggaaggcggtggtgacggaggccgacctgcaggcaagcaacctgaggtacctgaagctagtgatcaaggaggcgctcaggctgcacccaccggcaccgttgctggtgccgcgggagagcatcgacacgtgtgagctagatgggtacacgatcccagccaaatcacgtgtcatcgttaacgtgtgggctatcggtcgagaccctaagtactagtactaggaggatgctgaggagtttaagccagagcagttcgacgacgatgctatcgattttatgggtggcagctacgagttcatcccatttggttctggtaggaggatgtgccctggcttcaactatggcctcgccagtatggagctcgtgctcgttgccatgctctaccacttcgattggtcgctcctggtgggtgtcaaggaggttgacatggaggaggcgccgggcctcggcgtgcgccgccgctcgccgctgctgctctgcgccaccccgtttgttccggccgccgtctccgccgattattagttagtacgtagcttgtcgctaccttgcaatggcgctcatcacgtctctcaactcatacgatttgcctagtatgatctctaaataaatctcgcgctctgtaaattgatcagcagtacctgcgtactatacagtgtcgatttacatgtgtactgtagtgtatacgtactacagtgtgtactgtaagtttaataatcaagattgttaattgtaatagttactacgatatgtgtatgctacatatgcggtggtaatgaattaaacacgataaactgtgaccagtatctacaagacgtactccaacaaaataacgacgatgtcagacggagggataaacatttagggatcttctggctagcttcacaaagtggtgggctagcaatctgaattcgagccttaccccttttaattatttaatattagatcgttccctgatattcatgtttttttttctatttgagacggaggtaccaaaattaagaccggtatttggttttctgggctgtgttaaatgcagtatatgttaattttgctaactccatcttataaagaatttaattttagcaattatcggataaattagtagtaggagaaatgattagtgtgccccttattaagagagtggattttaaactctcgaggagatgtctcctactactccctccgtcccataatataagggattttgactttttcttgcactgtttaaccacttgtcttatttaaaaaaatttaaaattattatttattcttttatttactttattatccaaagtactttaatcacaacttttcgttttttatatttgcacaaattttttgaataagatgagtggtcaaacagtagaagaaaaaaaactcaaaatccttattgtatgggatggagggagtagttgtttgcatgtcattcaaatatttatgaaaaaaaactaagaatatgcattaacatgtgatatatcactttacaaacatacaacttaaaagtcaacttttatcacaacgataaaaaaaacaatttgagacatgtagaagttgaattttaagttgcatgtttgtggagtgatatatcacgtattaatacatctttttaaaaattttcgtaagtattggagtgacatacaaataatgataggacatcccttttcgagagattagaaccccctccagagcaagtactcttggtatatttcataggttctaattaaatgccaagttaccagagttgacgcgaattacaaacaaaacaatgactatttggttcggtcgtgactcataaaattttcatttgacatcgaggtaagaggacttgctctggtcggtcggtgtagctaacaaataaccatgcaatcaaacaatgtcaaacaggcacatcagatctggtcagtagcttcatccgagggagctagtaattaataataactactccaagaatcatcacggtcaaaaaaaaaaaagtactactccactacaagaatcaaaccaagcagcgtagtaggaggctagaagcccagtccaaaaacaaagcaggttggagacatagcgtgaagtttcgtttgtgttcccgaacaaagcgttttctcggtggacttctgaacaataccagacaggagcgttttctgtgttcgggataagtgcgcaaagacttgaatataatgggccctaatttcgtcccgtccttataaatgggccgagaatttgggctaaatcaccgatccacctccatctttttaaaggaaaatggaaaaggttcatttttaatccctgaactataggcgaagctttattccctcaaccatgaaaccgggtataggcatccctcaccaatcaaaaccagtgaaagttgagtctctcggcggtttgaataatgattttttcctatgtggcaatttgatttggtcttcaatcctatacggcgcttgcgtggcattattatcaaggaaaaaaaatttaaaaaaagaaatattgagacccatatgtcagtcacaagaaaaatatataatcctcccctaccttcttcctctctgcctctctctcctccccgacgaagccccctccttggacgagaatcaattctacgtgaataccaccagtccaccatcgtcattagcagcaatactagaataatcaagcaccagctgactcagtagcgcagcagcgggcctcaccttgggaagccgtggtgccgctggggtgcaacaggaaggccaggtcctcgtcgaagcctcaccagaagagacgatagaacataggatctcatcctctcctcagcagcgctgtaagccctcgccacacaccacgccatatcactgccgtccatctgtccagggccagttctagagggcacaaacttcctcaagactaaatatacttttacttatatatatatatatatatataggacactcatatgggggcaccatggtatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatatatatatatatatatatatatatatatatat

SEQ ID NO: 53294 - DNA, 2864 bp, Oryza sativa
ggattagatagatgcaaatgagaagatgagatgatcacaagatctcactctaaatcctagccatgaggaaataaggtgtggtactggttgtggttggttggtgatgggcctaataccggcttgggtcatagatggtcgcacaactagcctatgcccctaagacggccctgtatctgtcccacgtcgttgtgcaagcggcccttgatgacaaatgcgagcctacaatggggacgggctcaactctaaacatccgctgccccactacatcgggagcaacaccagcatgacaccgtcatcgttggtgttgaccgaggcgtcttggtggtgaagctagggggcggcgggcgaggcgatgaagttctgggaagacggtgagattcgaagggaggagcgccgccagcgagattccacatcgactccggtgactctactttctcttcgacccagcgacactgcgtgctgcgtcgtgctcccttgcaatttgcacattgtttgtccatatcgtgggcgacatgattgttgagctcaatgaggaagacaaccgtgcagccgtggtgatcacgttctgtgagctcgcactgcttcggcacctcaactctttgaagccatccttgtcggccgtcaggtggcattggcaatgactggttagaaaagatggagcaggagagatgggagggaagaaattagggctgacgcgaaggtccactattttttatttttcttccataacatctactttttctctgtactgatagatgataataccatctagggactcgatttatactggttttaatggttaaggggtgctttatatccggttttacggttgaggaatgcgaacaaaattcaacccaagttgagggacataaaagggacattttccatggaaaattagtaacttcatgggaaattcaagtcgaagagggaaaacaaaaaaaaactctagttaacgtcaacacgatacgatgcgatgaccaaagacgagccagacagaaggtgctttgccgataagcaaaccccgtcgttaaaaacgcgcgactccacaactccacgccgtccgttccccccacaatcccagcgaagcaaacgcaaactcaaagcgaaagcccaacgcgaatccagcgaaatccaccacaactttcctcaatccgatcccctctccctgtctccgctcgccgatctcgccgccgccaccatgcgcaactccacctcctccgccgccgcccagcccgcgccggcctccgccgccatgtacggctcctacgcctcaccctcctcgggagcaggagggtacgccaagatccccacctacccgccccctccctccgcctaccccgccgccccgcctcctccggtgatgggccagcccgtgccgccgccgcccgcgcagctgcatgacccgacggcgccgccgtccccgatcgccaaggcggcggagctggtgacgaggttccgggagcaggggcaggcgctcatcgcggcgaggcggccgtggggggaggtgttccgggcgccggccttctccaggccgcccagcgtcggggaggcggtggccagggcgcggcggaacgcggcctacttccgggccaactacgcgctcgccgtgctcgccgtcgtcgcggcctcgctgctctggcaccccgggacgctcttcgcgctcctcgccctctgcgccgcatggttcttcctatacttcgcgcgccccgcgtcgtcggcggggcagccgctccgcctcctcgggatggagttcgaggacggcacggtcctcgccgcgctcaccggggtcaccgtcatcgcgctgcttttcaccaacgtcggctggaacgtcatcggctcggtcatgatcggcgccgccctcgtcgccgcgcacgccacgctccgctccaccgacgacctcttcttgaccgagcaggaggccgccggcgacggcctggtggccgccggcatgagcgccgccggaccaatcttgcccacctacgttcgcatcgcttgatctactcggcttggtatgatgatatccccccaagatgcatcaatctctttatccaacactcgtagctaattgatgttcttgccttgcaaattagctatgaatgattgtgtgtgtctcctggctggaatttatactgtgtaattatcaaacctagcagttgatttgatctttgatgatatatatggtacggtgtttgttgattcttttgttagcgtgtacaaatactagctttgcgtgtgatcatactatgaacatattgagtcgcaactgaattgagtaaattagtatggtggtggtgttaatttgcaaatatgctatacatgttgggcagtggccattgaatctgattctttatcttgcaaatgctaatgctcatgcttatggcgtggttcgctttgtgaattatgcttctcttttttttttctgcacatgtatgatgtgcttgtgcctcttgttgaaacatagaaagtgaaatctgcttgataggatgcatcataatcttttgtaaattgtaatgtttggtgcatgtccatcgatccatctatgtttgtgtggtaactgtcatggactcatggcaatgcaaatatctcagttatgtttgtgttctctcgttgtctgctttggggaagcatcagtggagattgtgttgttctgatgtgacttcttttccaatgttatggctttggatacaagggggaaatgccaaaatccatccatttctacttgttactgttcttggtctgaatcactaaagattcgatctggtggacaggagaagattgaaggcagattagtgcctatgccccatttgctccgttggcttttcactgtgcaaactttgttgcagcttgaatgtttgatggtgcct

SEQ ID NO: 53295 - DNA, 3108 bp, Oryza sativa
cttttcttgggcgagaatgaatgatgttggccttttgtttcctggacggctggaccagccgagctgctcagatcagaacaagtgctactacaagcacaagcaccagaaagctggtcgccaatttctttcagatggacagcctatattccagaatacgagccatttgttcgtagcatgcataaaccgtatgatataatgataaaatataatattgtgaaaacatctctaaccagaattctagttattcaattaaaaatacaacaaaaaatagatggcttcaaatatagcagagaccaaactttacaaagtttgactccaaggattctattatgttaagtaaaacaatagatacgttatataacaaattaagggatcttttgcaacgtgaaaattttatatgaattagttcaatacctgttaaattttacggaattccttgttctagagggagtctaagggtaaaacacgggggaccgtttgaaacaaattattcatcagattattgttgtagattatctacttgatcgtatggataataaattaaagatcgtaaggaaaaacttaacaaatggattaaaaccaagtaatacaaattagcttttttaaaaaagaaaatgtatttcaagatcctgtgacaatgataatccactaaattagctgaaaagaactgcgtgttcagcagggtttcccaaactgtcggggctggggttactgtgccttggcggtaagcatggttaccagccgtataccgtaaaaaacatttcgaaaccgtgtaaaatttatcaaaaattcaaattattttttaaatttatttgaatttaaagaggttactgtggtttttctattatcgtactcccgcagtaaggccggtaaccaacggtaagtcgaaccctggtgttcagtgcgtgaggagcatgagctgtgtgccggtagccagtcgctgccatgtacgcgtatacagcagtatagcacagcacagctgccgtgtacgcttatacagcagtatagcacagcacaatgcacagatatagccccagacagagaccgttactggtcaaaccagccaaaccagtagaccgctacgagacaagctgatggacagttgctactcctactacaactctacaaaaccagcatagaccatctcactcagctgactaatttactacagtaattataattactattttactgtagcacagcacgcgcgcacacaggcccagcacaggttaacacaggagatgggacttcacctgaaaacttcatcggatggtaaacaagacatagttagggtacccttttagattatcttagtagcctaatgcactgttctacctttttttttaatcttttgtccctctttacatgatctaagaaatgagaaaggtgtaattttttcttctctttttttttctaccctagtctgactgacggatgaacatgatatgagctgatgaatcggtagtttcagagtcttctttcctcctgcaattgcctgcagattttgcagcagatggattgtggcactggaggagtagaggttgcagctagctaagaggaaggaggccgctgtggccggcggtagccgagctccatgacgaactccttggcttgagcgcccagcgacgcctggacctgctccaccggcgagctcttcagccacagctcgagcaggccttgcaatgtggtcgagggggagattgcctcgccatggcatgtgatctccacctgcatttgcggatagagattagaatagagggatcaggcaaaagagcagattcatagctgttcatgtgcattgctgttgttgtcaagaaacatggaacagaaaggctagtttacatcccgcaaaaaaaaaaaaaagaaaggctagtttacagaggacaaattcagagcccacttttgaagggtagagatagctaaagattgtaggccagtcatatgtcaccatccaaatctacaaaatcaacagcctctgtagcaaagatagttgagagttgtttgccaaccgtctactttgcgtatataccagtctagtgagtgatgttgcataactgatgtctttatagcaattgaactgaaaagagaaatctgaaagcttacctcatcttcacttgctaggtcaagcttattcatgatgtacctctggatcaaggaagtctgcagacttccatctctgaaacaaggacaaaacacaaattgaagaaaataaatagaagttcttggaaatcggacacatgtttgtatagctcagatcgttggtagtagtgataaaaaagtatgtaatatttttcaaggaaacatcttcatctcgagcaaatttgttttgtaagtatatactgttaaattatataaagaaatagtaggacgcagttgcaataattagtggacaacagaacaaggaaataacactattggcattccacactggacaacctaaaacaagcagcttaacattccacacaggaataataggatcctaaatccaacaggcttctttgtagcatattaaaaatcataagaaactgcaggaccaaggggaactcacttaattctcacgtaatatgttggtagctgaggcagcctgggatcttgtttcctgaaaaatagtttacatttgatatgaaattaaggggagaaaagaaatgcccatgagaacccaaatattggatatgatgcaaacttactggtcaggtgaagggacaagcaaaaaccatactggtctagttattccatcatgcaaagcaccagttcttgtagaaccaatctgtccctgctgtgaatcagcatgttgtcctttcctcagctcatagtctgaggtggttttatctttcgatgatgcagattgtgaaggactgcgattattttcctctttaacttttaacttatttgagcatggcataacctttctgccagtaactaccagtttgtcttctgtgtcatcttctgccagtaacttaattgagttttttattttgtcttccttggcagcctggccctttaggaccttgttctaaaaaatttggtcctgtttcaagtgtcaaccaagctatttaaaggcttcttgagatcttccttgtcaattgtatgatcatccttcctatcttc

SEQ ID NO: 53296 - DNA, 12977 bp, Oryza sativa
  unsure (1)..(12977): unsure at all n locations
aagtcaccttgttttgtcgtttgtcatttatagcataaatctttgctcggttatgatggtatctcttaagtcacagtgtttcgttcgtatgtagagtcctatttatagcatacatatttgcttagatatgatgatatcttttaagctatagtgttatgtttgtatgtaggcttcatttatagcataaatctttgctcagttatgatgatatctttttaagtcacaatgttttattcatatatatatagctcatctatggcataaatatttgctcagttatgaaatgatatctttcaagtcacattattttcttcgtatctatagctctgaaatcactttgttttgttcgtttatcatttatggcataaatctttgctcagttatggtgatatatttaatcatttatagcataaatctttgctcaattatggtgatatattcaagtcacagtgtttgattcatatatgcagctcatttaggccattctcaacccaatgactaggatggtgtccatagcattaaataagctgtcacctagaatgaaaaatgatgtggcaagtgaataaatgataaaagagtcttgcatgagacatgatttctacacaacatccaagacattatgtgaggtaagtagcatttaatttaagtatggaatagtggtgtttgcattgggagagtagtgtctaatactagtttcttaatgatgtggagtttatggaaactatgtctagtgtcttgggttgggaatggccttatagcatacatatttactcaattatgagatgatatatttcaagtcacactgttttgttcgtatctagagctaatttatatcataaatatttgctcagttatagtgatatatttaagtcacgatgttttctttgtatctatggttcatttatagcataaatttttgctcacgtatggtgatatatttaagtcataatgtttttttaagtatctatggctcatttaaagcataactttttgctcatttatggtgatatatttttattggtttttctacctagcgtattgcttatattgcttgagcagttttgtgccatattcatttatggcacacctgattacctgaaggatgtaaaacaggtttctcattaatgagatgatttttctagtcactaataaaggatctaaggagtgcacaaatgatttctcaataatagcatatacttgtatttagatttatcattcatacaatgtgtcatatttatgtatagtattcttatagcataaatttccattcgtagcacaatccaaacattttaattattgtactttaagaacggggtttttatccgtaacacagtttcatttttagcacacgtgaaagggttttacatatatagtcatttataatatctgaaagagtttgatgttgattagtcatctataaaatagtttcatgtcacatactcatatactggaaattagttatattatctaaaacatactcgtagtcatttacagcacacatctagatattacgagatatatctttgagattgttcattgttttttctcacgagaaccggcctccttaagtacatcgtcttagatagcagaagtaagtcatttcatgacatattcgcaggtgcaaaacatatttatcatagcaatattgtttctctagatcgatcacatgtggtaacttctttttggaacatcctatatatatgtcgtgcaaacatgttttttcactgatacaataatttcatatctaatcatttacaccacattcaaaacgtacaagtagacatcaagcaaacaatcaatcgaatgaacaaagccttgatgagactttaggatttgtgggtcatcctatatatatagtagatataattaatggagcagtaactattatttcttctcgtttttcttttgcattagtgaggcttgaatgaaatatatatccttacatggtcatcatatgccctttgcatttttcaacaggatttaccactctagcaaacatgtaattcttgttcgtatagtaggaacacatccttagagttgatgatctagatgatggacatacatgtcttactcttacatgatcgagctagttacttttgaaccatatcacatactagtgcgcagtacatcagaacaaagaaacttaaaataatatagaaaaaattggaaccgaatttgctggtgtttggaggaatacatcttttccttaagaaaaaagtatgttagtataaaataaagatgcatcattagaatgacctaatagaatctaatatcattgcaacatatacattgttagaaaaatcaaactttgccggactcaaaaaacaactttctcgtttttttaccatgtttctcgaactgctaaataatacatttggtgcaaatacttttatatataaaagttttttaaaaaaactatataaatctatttttcaaatttataataattaatacttaatcagtaattagctaaaaatggcgtacccgttttccgtaccactgactctaaaatagaactcctcacaaagccagcaatgttcctcacatcttccaactgcaagtctgcagcacacatgggccgcacgcggaggccgccgcacccgatccgggccttcctcccctgaagccgttggagcccagcgaaccaccccgcgacacgtcgcggcaacgaggagttcgagatcgagtctccccggtgcgggccgggcccacgcccgcttggtgggccccacctctcgttagccgaagcgaggcgcacgcgcgcgcactacgcagacccgaccgcgaccggcaccaccaggtcggtctcggcggcgagggcgggcgactcggccgccgggtctcgcgcgcggcgcgagcgagccatgacgcgaacacgtacggggttttgtggtgcgcgagtgccgcgtcgtcgcccactcgatcgatcgatcgtgcgcgtgctgcgtcgcgtcgtcgatgctgtcctccactgaggagtactccacacccacacacacacacactccactgctatttctgtgctcctccggtgcgctgctgtacgtgttcatgggtactggactactggctagcagggagtgatatctcctccacgtgttcatactgcttctggttattttccactctcttcgtcccagaatatagcaacctagaattggatgggatgtatcctagtactagtaacctgtacagatacgtcacatcctgtcctagcttactatattatgggacggagggagtactatgtattatctctgttttttaatatatgacgttgtttactttttataaaaacaaatagagtacttcctcctatttaggaaaaaaaacttctaataatgaagctgaacaaacatctgttgagattcatctttagaattgttgattttctttttattacgctttactcccttcgttccaaaataaacaaagctagtgcgaaatgtggcattttctaattttacgaatccgaatagatgtcctctcatactagctagttttgtttatttgagacaaagaaagtacaattttatcaaagcattctttctaacatataaagtctttttaggatggagaaaacaaatcattatacaatgagaatctgagatatagggtgctaaaacatataaggtccaaacaaagcaaagtaccacaggcctacaatcatactccggctaaaacagctatggatcagtcggcagctaggctctcgatcgttttgggcggccgtacgcgcgcacgtgtggacgtcgttatctttgggagaagaaatgcatggctagtaatgatggcgatgattcaattccagcacctctaattatggtctctacactgtttctagttaggatggtcatgaatgggcaatcatcatgttcctctcaacaccggaggatgcatgatggtgatcacatacttgtcctcatgatctgatatggtgcgatatatatggagtatccactgaatctaaacaagactgactaattgcaagcatgacagacgccagctgcttagtctaagctaaccaagagtgttccaaattaatcatgggttttcattcggaacttgacataaaactaaacccaaaactcatagtttgaactcaaaccgactgaaattcaaatttaatcttataaagtttgaaatcatagtcttttattcattacccccccccccaagttaggaaaaacatcattaggaaacggtggtaggatgacataggagcacgtgagtttcctagtttaaaattcgtgacaatcttaagtaaccagttcagttaacgtaacaattatagagaattaatcctatggcccaagtcaggccaaagagaaagaaaacaaagactgatactctctccgggttgataatacttgtcgttttagacaagggcacggtcttaaaaaaacaactttgtctattattttctatcataatatgtaaaaaaaatattaacaaatatatgatcttattaattttaagactaatctatacatatggtcaccatatttaaaagacaaatattttaaaaatgattcataatcaaagattctaaaatttgacctcacccttattcaaaacgacaagtattatcagcccggagggagtagctaattaacggtgggcaagtatttccattggaaataaagggttcaataactgatgtacagccccagtatttaaggttaatttatatttatacggagtcaattcaacgccgattttttctcttcaaaaaaaagaaaaaaaaaagaaaaacagcggagtgctaattaaagcaccctatcagtcaatgctgccaaaaaaaaaatccagtgctactatttaatttgctcatgcatactgttttccgttgctaccatggatccatacacatgaccatgcctatacggcatgcactacagcctctacaccaatcatacattcttcagcactagatagttctacgcaatacatactacctctcgttgtaatctctcatcgttgtgaataaatgaattagcaatggcacataataacagtacacatgtaattaattggagcaactttcggctgatcgatctgcggcaaagcacagtacatgcgtgtatactgtagagcgacgggtcaggtgaacaagggtgtgtttagttcacgctaaaattaaaattttggtcgaaattgaaacgatgtgacagaaaagttagaagtttgtgtgtagaaaagttttaatgtgatagaagagttagaagttttttttttaaaaaaagttagaaactaaaccaagcccaagtcgaacaattggtcggggtaataccaatactcctacgtgcaagctagctagcttgtcatttcactcatcgacgcaagcgtgttttttttttctgctggatggccaggtgtttttttttcctcggcttggctcgagatcgatcggtccgtgacgaacgacgtacgtactatacgccggcaaaacggtcgttgctgcggtggaagctttgacccgtcgcgatcgatggaggcggcagctagcgggtgtgtgtccaacagtgcacggcttggacctgcgcgcgtgtggcgcggcgggttgaaaggacatgcatgcggtgcctgcccgggcgagatcggttgatgaggatgcgcccatgcagatgtgcagaggctgagagggcagattcgattggcattggcttgcccatgcatccatgtatgcatgcgcgcgcatgcagatttgatttggggtggaggggttggccgttgtgttgagctgctattgtgtactgtttgtttcgaggtcagatttattatattgtttgttttcgcggaaatcatcgttgggaggtcaatcttcacttcttcagccctgtttagttggcgagcgaaaatatctgaagtgtcatatcggatataccgtcacccattcaaagtattaaacgtagagtaataacaaaataaattacagattccgcctgaaaactgcgagatgaatttattaagcataattaatatgtcattagcaaatgtttactgtagcacccattgtcaaatcatgacgtaattaggcttaaaagattcgtctcgcaatatacacgtaatccgtgtaattagtttttctgtctatatttaatactttatgcatatgtctaaacatttaatgtgacagcgtgaaaagttcttgtttgtgaactaaacaggcctcgtctcaaagaccataatccgtacttaccttgctcaccacgatctagattaacatctattaagatccatgatagtaccttatgtgagactgtatcctattttatactatccatattttaatgtatgacaccgttggctttttgtccaacgtttgaccattcgtcttatttaaaaaatgtatgtcattatcatttattttattgtgacttgattcatcatcaaatgttatttaagcatgacataaatatttttatatttacacaaaaattttgaataaaatgaatggtcaaatattgataaaaagtcagcagcgttatacattaaaatatggagggagtactgcttagtactctccatcatttcgtctactagcactagaaaaggtcaattaacggagttactatttttaaaatttataacaattaacacttaattaataatgtgttaatgattttgtcacgttttacgtgcggctgttgagaatgcaaccatagtaccgaccgtacttccataaacgtaacctcggattctttctttcttttttttttctttttggcaacgttatgagctttccagatttaccgatccctacacagatagtgccattttttttcacactgcctactgggcagctagcaagctacccagctatagccagccagccagcgaagacagcagaacacagcagaagtgtgatccaagcaatttcgcaacatccatatgcatccacccatcgatctcgatcacggcatcacgcgcaccgccgttatttttctcaccacactaacgtattcgtaccagtctaccaccacaacatcgaccacatatgcaccgtccatatccaagtactatctcctatctccaaccacgcgcgcgagacgcggcaaacgcttgacacagtacgtgcctagctagtgctgctttacctgaaaatttactgcttctttccagcaccaactcgctatcactgcattaccaccaccaccccaccacggcacacaagctcttgccattttcttgttagatcattgaacgatattattgaaatatttgttccatattttaaaaaaaatatattatcaaaaaatgagtatttgttagagtcgactgtaattattaagtttatttattaaaataccataacctgctcaataatactcacttcatttcatgttataagtcattttgattttttaagttaagtttcttaagagtttataactaagcttatagagaaacataacaatatttatagcaccaattagtttcaatgcatctaacattgaatatatgttgatagatttttgttttatgttgaaattattattatagttttctatgaaacttagttaaatctaaagaaaactgaattaaaacaaattaaaacgacttgttacgtgaatcagaggtagtataaaacaactagtcctgtcagcgtcattttggctctacaccccatgagtggttttcttgaccagtactttttactttacctctggttgaaacgttcctaacgacgccggccattttgaccagcactgacgagatgaaccaacttaaggcccgctttctttcaatttgagattattataatccagattattgagagtaagctgagaaaaacagacaacttattaaaatagcttattataatctggaatccagcttattataatctgataaactcatttaggtgagcttttttctaaattattgggtgaaaaattacccaccatgctaccccactctctctttagacttgcaaacccaataatctaggctctaataatctagaaaagaaacaactaaccgtttaatctactacagattataacaatctagtttatagtaatctgacttaataatctagatataataaacccaaactgaaagaaacatggccttattaattaacgcgtacagatttttgtttgaacgaaacaagagacctgaaaatggagctaactgctgttaacctacgtaagcctgttccaaattaaccatatggtactagcactaaattaataacctatcgacgtgttttcttttccctaaaagaaaaaagaaaagcagctatcatcatcagtgatcgatggatgccacgccaatgcaagcacgcatgtgatcgatcgatcgatccgagatgcctatctgaattgaacccggggagagctttaaccaaatcctgtcgccttcaagctgctgcctaaagctaccgcacattcgatcgaatacggaatactaacccaagcgaaagaaggtgaagcccagggcgatcgatcgatcgatcaacgatctacctttcctttccggcctatccatcatgcctaccacttggacacaaggggaaaaaattccattgctttgctttaattgccttttcctcgtcttcttcttcgtcttggtcttctttttggtatctgatgaggttttcttccatggtgctcgagattatatatacatatatgtagtataaattaatgtaggatatatatatacttggacaaattaaagcagcatgcatgagtgagagcttagaattaatggcccaggtcacacggcacttgggaggcgagtgattgatcggtgcgatgcgtggtggatcgttggtgcgtgtgatctgatctgatctgaaacctggaggggattgattgggtgtagcgtgtagtgtaccgacatgatagtcactgtacgaagttgagtttgatcggtaaattcgttgggattattgctagtgagtactcactccgtttcaaaatgtttgacaccgttgactttttaatatgtatttaaccatttgttttattaaaaaaaatttaaggaattatttattcttttcatacatttgatttatggttaaatatactttcatgtacacatgtagttttacatatttcataaattttttaataagatgaacggtcaaagatgtgctaaaaagtcaacggtgtcaaacatttaaaaaggatggaattaagttgttgagtactcgatctagtgcggtcctgggaggattgcttcaatattctttgtgatttctgtggggttttgcactgctcttttctgtaggttatcccatgttcatgtggctaggccgtgatctcgccggcggcttgccggagctcggccggccggcgtcacccacatgagccgctctgtgtagtgacgtttcagccggcggaggtggttttggtttgggcaaatgaaaactcatggtcggatggtccgattgggaaatttggcccgtctgggttctggataattgggccacccctaatccttcatgggccttatgactcctagggcagcatattgggccggaaaggcgtantatctggaacatgggctatatcatccacagaactcgaccaccgaaacattgggcctgtatgggcgttagatctcaatccgtacacttttactttttggtcccataaattttgtcctcccaccgtcccaaataaaaaactaaaaataacccagtaggatgtgacaccacctaaaacaacgaattttaacaaaagattcaataattttttaggaaaatcgtaaaaatcatccaataagacgctagaaatttgatattccaccgcataaatcattttattgcatatgcccaccacttacttaattttattgtaaaaaccaccccagtgcgcatgtgcttaattgaatcagcccattatcgttgatgtagagccaccacagactaagctaactgagtcaatcttattcaagtgcttatattagactcttttttttcatgtttcattgaattttctttcatatagcgaaactcagtgcgacaacgtttaagcttttatcaacaattctatttgtggtatctccaaaaaaaaaaagggtcaagattacactcttagaagtatttaattttggtaaataccacattaatagctcacaattttataaaaatatattgattcagctaagcacgcgcgtactagcgtggtttttacaacaaaactaagtaggtagatggacgtttgtaacaaaataacttatagagtgaaatgccaaactttaagtaacttctggtgtggtttttgtaattttacagtttttccaatgtttcataatataaagcgcgcatgcatacatgcaatttactagcactcccctcctctttaatttattttctttaatcctccatacacaatatctctaatttttttggtgtatttagggtgtgtttgaggagattgggaagatacgcaaaatgagatgagccattagctcatgattaattgagtattaactattttaaatttaaaaaatggattaatatgcttttttaaggcaactttcctatagaatttttttttgcaaaaaacgcaccgttgagtagtttgggaagcgtacgcgtggaaaacgatgtactttctccctcaatgtcacccgaacgaacgctgctagcagtagaaatcttcatactgaaaactaatagggttaatttacaattacaggttggacatattcgtcgtccattgcccgccaccatcaccgaggaccaaatccatctcttttaggcccatagtcaaggcccataaggtagaagcatgcctcatccacctctaccgaaccgtccccttcgtggccctcctcaatcgccgttgcttctccccttcgctgcagctgagcccccttcctaagctcagtgtgacggatccgcctcgcccaagctcggtcacaaccttcgtcatcgtcgaggttgctgtcacgtgcagtcacaatcgtcttcatcattgagatcgccgatcgcaaccatcatcaccaaccccgttttcgccgccaatgtccttccctctagccaaatctggtagggggaggggaggggagtggagtggaggagggagttgttgtcggccgctcctatcgagaaagtgagggaggtgagttgagagagcctgagagggaaggaaggggcaaatgtacttagggcctcttttggggagctcctgtcagttgcagcttctcctagaatttccaactgccaaaagctcccccaaacaattcagattttcacccatattttaaaaagctgtagttgtataatccagaaaataaactagaagccaaaagctgggtttactagcttctccatattctcacctgctgcttcttaaaatcttaagctccaccaaacagggtcttatgctcggcgacttctcgctcttgctgtgctgatatttttgtagtgtttccatgttttcgctagtgggcctctttatgcctcgttggtaaaaatcaatttttactaaccgtgtctaaagagggaccatgtgtgaaaatgaggtattttttaaagctgtcctcttaagactctgttagtgaaattcaatttttactagcgggcctagggtgtgttcggtgctctcagtttccaactcatctccctcattttccgcgcgcatgcttttcaaactactaaacggtgcgtttttttaaaaaaagtttatatacgaaagttacttaaaaaatcaaattaattcatttttttaaaaaatagctaatacttaattaatcacgtgctaatggactgcttcattttctgtgtggagaagatgggttcccaaccccaagttacaaacacagccctcttgttatttttataagcgagaatttttagatccacctggaaaaaaaaccatagtgagtatgtggacggtgcagcatggccagagatcatagttgatagcagcaggcctgaagaatgtttctgaaattgctcatcaacaatatggactcaataattgattagaggtagaaacagtgtttcattgacataattctctcatttgtgactaaggcagtggtcgcaatgaaaacatggtaatgcatccagcggcgatggctgagggagaagggcagtgcaagggtggaagtgggaagggggtgagtttatgtgggatgtgaaattgatccctttgtgattggaacaggaagagactgagatatgacaaatctgattcccttttcttttttaactgataaacaagctgcttaaatcttttttgtactcttctctttcttttttccttgtagaaaagagaggaagctattatttgtatgattgtatctacatggacaaaaaaaaggtacattgacaaggagatatggagattttttttccacttgctccatcacaagcttttaaaaaaatgaacaaatgggggtcccagcaggatcatgtttcaaaaccgatcaaaacacattttgcacatgagatgtctgtgtccagcctttgcttccaggaaatggggcatcgctgtcaggctggttcctctctacttccttgagagcctcttccactgccttttccacttcacaagccgcaatctgtgaaaatgacacatgcgaaattaaacgtcgttagttagagtgtacaattggcttactattattaatcaactgctagtgttataattataataaactttttcagtttaatattggataggcatggactgtaattggccccgattgttgctctgtagtataaaatatggtatggctgtttggaatttggatgtttccttttgaaagatcatgtttggatgtttgtgaactacttgtaataatcttttgaggaaagattgatttggcagttggatgaccagtgctaactaacaacagttgctgattaattaaacctctaattacagctatttgtaattggggtcttggggttgaggatctgctaaatgatttatgcataaaccaaaagattcgacaagaactcttgacacggttgactaatgtcaaattggggggtttcgagtgga

SEQ ID NO: 53297 - DNA, 955 bp, Oryza sativa
attcctgcagcagtttttgatgccccatgcatcctctgccttttaaaagaacaggtaaaaattcatatctggagtacttactgtaattgctgctgcaatctaatggctttccgggaaaaaatcgcattaagttaaatgctttggacatactcggtcttaatttttctctgcagtgcgtatagagcatttaacttctgcacaaactgacttgacaaatggtgaccactggtctgcctggccacttttaaatgcacttacattgcacggctttcacttaatatgtaggtgttttgttactgtttgttgatcagaagttcataacacaatcatggctttgcatactactagctatagggggtaaaccctttcaaaatgcactgggagggcacagttgctaccctgctgatctactctgtcatttatgtcttgttcacatcacccgtaggagccaggcggttcctggaactgcgaggtctcccttgcagaaacaaataagatccaagcaagatctttagctttgcaattggtttgttttgaatgaatggtagcgactctaggaactgcaatatttatggtgcaattttatgatcatacgttacccattttatggtcatttcatgatgcatcactgggctgctctgcaggatcagctgaatacagtggtgggggagcagaagagcattcaacaaaatctggaggacgttaagaagaagaaactaaagtatggtaagtctttgaaagctagtgccatgaaaaataaagataagacattgatgcaagacttatactgtatttaatggcatgtttagatccccttgcaaaaattttcaccctgtcacatcgaatgtttagacacatgcatggagtattaaatataaatgaaaaaaataactaattacatagattgcgtgtaaaattgcgagacgaatcttttaagcgtaattgcttcataatt

SEQ ID NO: 53298 - DNA, 2606 bp, Oryza sativa
ttgaagttgtcatattttcaaattcaaattcaaatggttcaaaaaatgttatatagaaaaatgccaaaataaaagttatagattttgatgagttatacaactttgttgttgatgactttttcagttgaagtcgttcactgatctaaaattctatttgaacttttcaaactttgaatttcaaatttcaaattgtttaaatagagtcagatggagaaatgaccaaaataaaaattttgcacctcgatgagttctacaactttggttttggtgacttttccatttgaaatcatttaattaccccaatttaacatcctggcctagggcataataggattaatagaatactcatactaacatgttacaattacttttctggaagccaatctctaaagaactttgacgttaagtgtgcttggtgtgcttggtctcgagcaatttcgggatgggtgaccgatcgggaagtacagatgaggcgctagttgtgacccgattgagatttgactggtcgtctgggtcaaaactatcggtgacgggctttacttagggcccgattgagatagaatcatccgtaacggccgtttgcccgattgagatagctcttcacatcagtgacttctagcctgtgacggacgccatgcccgattgagatggggtttaccgcccgattgagatgagggtatccgttctagtgatacctatggttttctgcaacttaaactataaaatgtggggttttcttcagtttactataaaaacaaggatgataatttaaaggtgatgtttatttttgtttaggggcgagcatgagataagaagaaagatccctaattttcaacattgttgaggctagtttgattatcacactactcaaaaaaggttattgggtattggatttcccaacaagcacccaacaggcgacaccttcgaggactcaaaggtgctggtctaggaactggcacctttgagattctaggaataaaaaaacagctcgatgcatcgactcgaattgagccgcttctcattacacccataccaccatcgatcccgaaacatccccaaagcagcacaaaccaccatcgatccatccatcaacacaacacaaattacaaaacacaatttcacatagcacaaatcgatcgatccaaaaaaacatccccaaatcacatagcccaaactgcacgccacgggagccctgatcagccgaaggaaccgccgtcgacgccgcgcctcctgccactgcgcctcctgccactgctggatccgccgcggcagccgccaccaccgccctgcccaccgctgacgccaccgacaccgcatctgccacgggagccgacaccgccaccgcctgccgctaatgccgcccaccggatgctgctccacccgccgtctctcacttggccaacggagaggggaggaggagttatgagagagagagacgaagatataaatcatactcttccgtcaagaaaaaaaatcaatagtccatacctagatttatagtcaggaattacgaagggtgtagttatgttattccaatacaaagaaattagatataatttagataagtatgagagggagggagagagataaaaggggtgaaggtgacatagagagaagtgagcacgcgtagctccaagcataggcatcatttatgcaaggaaacaaccacgtgtgctcactctcttctgtcaccctcctagtacgagtagatatcaaacctttcatggaactatatatccttgcacccgtgctacatcattcccctatctatatatccatatgtgcatggttagacatacatttgaggggtctagcttgttagttataaatggatgatcgaaggggtttatatatagctagagaaaagttatttctcttttatgtcctcttgttaaaatactaatcttcttttttttgacaacaaatatactagtcttcaacttgtacatagcatatgctaggactctaggattaattagtggtgtttaagtatataagtatataacggtcatcggaagtcatcatcattcctaaagtactaaagtaatggttgggtgtgattctgttttgatatatatctctatctctactattataaaaattgaagatgtttttttggtattttgatacgccctccgtatttgagttagtttttaagtccgttcgcttttggaaatacaaattcgtgtttgagtcggattttaaatttatttgctgttggaaatataaaagaagtcatataagaaatatctttaaaaaactcgtatgctaacttgagatgatagtcggcctcctaattgtagttcatgattttctaaaaaatatatatccaagcgaattcccaaagttaatttcatcctagctaagccgtataacaataataagattaaaatagcattcactcgatacaacgtacgggtatttttttctagtatagtattaagattcacatataccccaattatttcacatttattcccaagctcgaaccattcgcgctcgaaagcattttgtgaattaaattctatcgagtaggttgtgcaagggtattcattccaagggagcccataaatatatcaacatgcatgagccgttgttgccttcgt

SEQ ID NO: 53299 - DNA, 1740 bp, Oryza sativa
attctgatcccatatataacttgtccgatgctcatttttgtgtagaagaccgatacaatttttatcatgcctcagtacaagtaagtcttgaaaaacattttgatttttatgtataaacactccattttcatcgaattttatggtcagtctaaatcttaaaaatatcatgcgaatagtaattattgcatattttgtcagcctaagtttgacgtgtaataataattacatatcagtgtgcgttatgttaaatcaattttgcttgcatggatcatttgtgctcaggtttgtacaaactagcttgcttgttttttaacatatcagcacacaccacacaagtaaataatttacttataaatcaatttaagatgcatataactcatgcaacaagaaaattttccgatcgagccactgcaccttcctttatatttttaataaaggaatctttattgatcttagataattatatcaagatgatacaatcactctaaggttgtgttctttgttcagtgttcccaacacctctccctcgtgttccgtacacacgctttttaaactgctaaatggtgtattttttgcaaaaaagtttttatacgaaagttgtttaaaaaatcatattgatctttttttttaaaaaaatagataatacttaattaatcacgcgctaatggaccgctctgttttccgtgcgcaagagatggattctcaacccatagaaaagaacacagcctaaggttacattcggtctctgcatagctaggatacgcacgacgtaaattttttttaaaaaaaaatgatatggcaacacatgttatgccacagtgagctacaatcaacagagatctttatcctcatactccaccgaagcaacactaaaaattatgataaaaatacccttcaaaaacaacgccttcaaaattaaataaacgtgaacgtgtagccgttgccatgattcaatcaacaaaggtcagactataagttatttagaaaaaccaaccgacaaacgtacatgacaaagaaacaaggatgctatcatgattttttcccaaggattttacgatgattttgcattctcatataacatcaaaactgccacagcgtatgtactttagattgttgatgtatataatgacaaaaatagggactcgatttcgttttgagattaattcgattgtagggtcatgttgaagttgttattagtagcaacgggaagaggactggcttcatccgaaatgcattcggtttgcagcgcaaatttttaaagggaaagaaaagaaaaggagatagtggaattgtagaaaggatgaagaattagtgctcagtctcttaatttggtaattaactttgtttctctctgctctgtcgtatagatattggtcgtttctcctttgaagctcactttgtctgttccaatatgcacccctgatgagactagacgtagaaagttttcttccagaatcgaatactagtatttttctttctattttttaatgaattttttatttgcacttgtgacagacagttcaaagtttccagacatgaccaaccatttggcggctcaaaaagagaataaaccagatatgggtgttgcacaaactgcagtattattggatatatagtgaggtcaatgagcactgtgcgcatcattactgagtcgacaagctaatttacaagtagattcttattcaaccaagatgtgacattagccaaactaattaacgtgtcttctttttattccgggaa

SEQ ID NO: 53300 - DNA, 4875 bp, Oryza sativa
  unsure (1)..(4875): unsure at all n locations
aacttgaagcagtttaacttcgaccaaagtcaaaacatcttataacccgaaatggagggagtagttgctataagccgataatcattacgtgttcaatgatcgtgcgaatttgtcataagtgtggacagataactaatatgaccgcactagtttttttgtttattcggattttggtgcggttttaatttcatccgtgttgcgtttctggtttggtaaatttggaaatttagttttcttggccttttttcgaatgtatgaattgtaccaaaattatatagagctcatacacagaaattactacatcgttttgtaaacactgacctcggggtactatttgttgggaaataaatttaagagagataagtttattgtgcaccaatctgaatctcagcataaaaataaaattcaggcaaaatttactataagatatatatctaaaatttatgatctttgttggtggactctgtaagaatgtggcacggctttaacacactttaaaaacttggtaattataacgccccacaaataattagagaaaaaagaaaaataagaaaagaaaagaagagataaaaaaaagagcaaagcagcagaccagcagcagcagcaggccttggccggcccatacaagcaaaacagcagcaggaatttttttcatttttaatttattttaatatttacagaaataatctgtcggcgaaaaaaattacaagaatagaccttgacgcccctacagagggcggttagctgacgtggcagacgggggagggacgggcggtgacggagggaaggttttttgcaggaaaacccttgccgccccaacagagggcggcaggcctcgctgnctataaaaggcctgccgcccctgcccccagccctcattcctcccctcacaactccagttaaaaaaaaaagagaagggggaggagaagaaaagaaggggcgaagccctgctggattcagacaccgatttcagataatattcatagatcctatatgtgactattaagttaactactgtgtattttttaaaactttgtttgaataatgcattatatttttaggggtttagttgtactaatctagaactgcgtattgtagatatcggtaaatacgtaaatctactagtttgaaatcaatactttaccattacattggtgtacatgagaagatattacgttgctggtgtttattgcatgaaaaaataatatgatctagttatttcattgacagatatgtcgaacaaacaaatatttcaagtttaccatggcccaggaaacgtccattactggccaactggggtagatctgtcagaatttattgtatcagaaaggggaattgatagaccagcagagaggagtgtaccttctataaaaggatggttgatgagtggcttgagagttgatccacagactagtgacataacaatcaatgttatagtaagtcggacaactgagggtttttattgggaactaatgccagttcaaaactctcgaatgtggagatggtatgtggagaatgcattgcaacgcgggtggcctctagctatggttccgtttgttcacccgaaggatccaggtgtgcagaagaacatggatgatggcgagggaccaagtgctgaagtaaatgagagttatgtggaagaggtcaatgcacgagaggaagggggcgccgagaggaagggggcgtagtagctccagtgggcaatcaacccggtgatggagtggccgatgagggggagactgtcggtgccattgtggatgaaatggagagagaggattctgacaacgagcgtgtggaggaaggtgattcgtcagatgatgagacggatattaatctagccgaatgggctagtcaggatttttctggtctggtcgtatctgaagagaatagtgtgagatgggagtacaaagaaaataaggttattcagagagcgatttataatagagcagaagatatgaaggaggcggtaaagcattttgcagtgtcacttcatagagagttttgggttgccaagtcgaaccgaccacaatatgaagttcggtgtgttaaggaaaaagatcgttgtccctggagagtgcacgctaatatcaatattactactgtaatacctccttgtcccattactacatcgtcgttgtgttcaactcttgcactacctccctcctagttcgaatctaatatcatctatgtaaccgcaatggaaatagatgtatcatgttcaaattcgactactatttcttcatgttacataattctccttgtttaagtgcatataatgtttctacgaccgagactgcaataggcctatatcaatttcgcacactaatacgtcgaataagttacaaaataatatttcacttaacatatgaaattgcgaaacaaccaacttcaatacatttttataacattattaacaagttttaccaataaatacttctttaattattattaacgtaacatagaaaaatcatttggctggtaaattttgcatctgggtcccttgccgctctagcagagggcggcaagggacctcaatgcaaaaaagctagccccctccacaccccttgcatccaattttgtatctctccgcggagttgcaacctttttatttttattttattttttgatatttttttcacgattaggagcacacaagaaccaaccatagaaaaactaaactcaaatggacgaaatatgtgacgtggaattttctaacccctctcccctctagtgtagaggagagagatgtgcaacttttttatttttattttatttttttgatatttttttcacacttagaagaacacaagaaccaaccatagaaaaaataaactcaaacggacaaaatatgtgacctgtagaattttccaaagctctaccgaaaaacttctctcctaaaaaacacaatcttgcaagtggaatttggaggttttaatatcgccgaacccggtgaagcggggaagaatcggatataactttttctgtagatatccgtggatatattatttgcctgattccgagtccgtaagataaagttacgcctgttttaataaatgacactcgaatgacgtctattttcggtagagatttagaaaattttacaagtcacgcatttcgtttatttgagtttattttttccacggttgatttacatttaaataaataattctttaattattatcaacatatctggaaagaagcatgtggctgttttgcatctgggacccctactagagggcggcaagggacccagatgcaaaatgcaccagccaaatgctctagagggctgggaaaattgtatttagccccttgccgcaaggggctaaatgtaatttttccagacggcggcagacggcgcggtcaagtcgccgtctgccacgtcagcttgccgccctccactgaggcggcaaggtctatttctataaatttttccggcgatagattatttctgtaaatattaaaagaaataaatttaaaaatgaaaaaacttccagcagcagcagtagcgcggcggcagcagtgctacagtgccatcgtggaataatcccacctcaccaataggaaaggttgactagtcactggaactctgattttggaatttttttgttaaatcgaggacgaaaaacgcattgagttatactccctctgtttcaaaatgtttgacatcgttgacttttttacgtgtttgaccatttatcttattcaaaaaatttaaataattatttattcttttcatatcatttgatttattgttaaatatactttcatatacacatgtagttttacatatttcaccaacttttttgaataagacgaacagtcaaagatgtgctaaaaagtcaacggtatcaaacattttgaaacgaagggaatagcagtgttaggggtgtgtttagtttacatcaaaattgaaagtttggttgaaattagaacgacgtgatggaaaagttggaagtttatgtgtgtaggaaagtttcgatatgatgaaaaagttgaaagtttgaagaaaaagtttggaactaaacaggaggtgtggttatccaataccgtcactctaatctattagcacaattattttattacttttgagctaaatataaaaaagaaacatgccaaaaagatgaaaatgcctctcaggccacgagcatgtaaattgcttgggaggagagagattgttaactgacatctacctctacaggaaaggaagtcttttttttttaaggataacaggaacaactttattaaacaagacagaatttaggggatacaccccagtacatcacaaaggatatgatttaaggcaataatccatctctaacagggtagaggctaaccaatctaaggaagcaaatttcctgatgaaagtaaacaacaatagaggatcagatcgatagagttctgcgacaaagccatgacgactgaatactttggcctccattgacatgctcgtcgcttgacaatctggaagactcctacagctgtcaccacgaaaacggtatagatcgaaggtttgatgctaagctctagattttagtttaggtatcactggactcagcaaattggttctacggattctgtcgttagatctgaggagcagagtttgctcaacctgaacggtagaccttgcaaggatactgtcgttttgaaacaaaaggaagtaaaatttagaagaacagttagtcaacatcacaggggaaatcagatgttgcgataaaacttgtctttgtagaaggcctatgtttgctatagattcgtagtactgaagcagagtacgacagacgaagaggagcaagctgccaacaaagaagtagccttcagatnnnnnnnnnnnnnnnnnnnnnnnnnnnnnnnnnnnnnnnnnnnnnnnnnnnnnnn

SEQ ID NO: 53301 - DNA, 1737 bp, Oryza sativa
  unsure (1)..(1737): unsure at all n locations
ttactatagggcgaattcgagctcggtacccctccccgaaccgaagcccacaacgaagggcgtcgccgccaccaaatcgcgttcttcgtcgacggcggcgaagaggccgcttgacgacgaggacgacgatgatagcgtggacggccctagcgtcgacgtggatggatgtgggctgctgtacgctgactgtgccggcgagcaccgcacgtggtggccgtactcggcgtcgcagcccacacctccgtcgtcctatccctactgctgctcgccgtcgaggtcgctccccgccgttgatggcctcttcgccgcacctccattgccctcttgctcggggaagaagggcaaatgagtcattttttatgtcaactcacatgtttggatggcaaatgtgacgggagtgctataaatcacaagaaaattggtgtcctgtgcttctggtcgaaatagaaaatttgttgtgctattttttggtaccggattttttcctatgctatggatcgaattttctcataaggataaggattgaggcattgagcgacacgttcgtggataggaggatagcgacgccaggtcgatcggctcggcttgcggctcgatttggtacattataggtgctggttcttaaaaaaaccgatacctatagtatttgtaccggttttaactaatgaaccggcacctatacttcgtaaagatgtcggttcattatttttacatcatccggacataggaaaaggcctataggtgtcggttttaaatgaactgccacctatacggccagcacgtacgaaggttttttagtagtgggcaaaactctagatgcctctgagatgtacgtagtacactcttctatcctctatgacggagatgatattcttttcatgcacttcatcggattattacggtgcattatttgttccagtatcaaaaaatacgtttacaaaattattagaccacttattctaagttatttgtagtttacttttaaaaatatttaatttattgacataattaaatatgtagtaattagtagaataatctccttccaatatttgagcagtgtcgcttcattaaaaatcatgtgttttctctgacgaataggttctcacagtcacatcggactgccggagtaagaatgtactaggatctcaaaggtttcgtctcccgtaatactcctactactagtgcatgaaccctatcctcttatcacaattctaaatgatgagactttcttaatgattttgtgcatataacaggagtaggttgatatctgagtcaccttttgcatatcctattcgatttctacagacgcatcatatcttgcaggaatcctaattggcgcgtgcgcgccgcgctggcccacacggcccaataggcggcaagacacggttagttttttttccgaatttttccatatatatatgtaaactttcaactccgacttgaaagctttcaacttcgactgaaaactttcaattcatatttgaaaactttcaactcaaatttaaaaattttcaactcgagattcaaaaacttttaactcagattcgaaaactttcaacttgagatttgaaaactttcaactcgagatttgaaaactttcaagtacatatttgaaaatttttaagttaagatttgaaaaaaatatgaaaactttcgactcagatttaaaaacttttnnnnnnnnnnnnnnnnnnnnnnnnnnnnnnnnnnnnnnnnnnnnnnnnnnnnnnnnnnnnn

SEQ ID NO: 53302 - DNA, 2583 bp, Oryza sativa
aaaaatcgcttggatgtatacttctcatttgaaaatttcttttaattaacatcttgcatagtaaacacggaaaacagaacgatttattagcacgtgattaattaagtatttgctatttttaaaaaaaaatggattattttgatttttttaagcaactttcgtatagaaactttttttaaaaaaaacacaccatttagcagtttgaaaagcgtacgcgcggaaaacgagggagatgggttaggaaaaaggggttgcaaacacacccaaatttgtggtgaaaaggaacgaacagaaagggagatggggaaccgcagtcgagtagcactcgtagaaatacgggaaaaaaggtttgatggataagggcagtcccaaccctctatctaggatggtgtctatgacattaactatattgccatgtaggacttttatcttatgtggcactatattaattaagagagagagtgaagagaggaagaaactgggtctcatgcaagacacagcttcaacacgagaacttatgcactagacactatcaagttttgcattgggagataatagtgtcttgataatagatgaagaataaatatgattggtagagaagagagatgatgtactatctccgtctcaaaataagtgcagccatgagtttccgcgcccaactttgatagtccgtcttatttgaaatttttttataattagcatttctattgttataagatgataaaacatgaatagtactttactcgtgacttatgtttttaatttttttaaaaaaattttcaaataagacgaatggtcaaagttgaacgcggaaaaccatggctgcacttatttagggacggatggagtatttatgtaacattctgaaaatgtgtcattttctaatcttgcatcatgctgattcttatgttcttaataaccttctaaacctaggaaaatataattagagggacctcctaaaactaactcgcataaaacctctctggtatttaatcccttttgtgtttttcatttaaaaacatatttggtatttcttgttgaaattctattttcaaatattaaaccttctttcgactaaaactcttttattcaaatttagtttaaaaaccatttttattattatgaattatggtccaagaaatcctccaatttttgtccttgaacctagaccaaagtaattccaatctcattggaattaattgttagcccatcctttgatcttaaacccatcctttgattctcgatccaaatatccaaattcctccttttgatctagccaccaatttaatttatgtggcttgatttcctcttcggcacaagaattgtattattgcaatattgtgaataattgctcttgtgctaagaaaattccaatttatattcttcactcaacttccccttttagccacaaatatacataacaccaattttagagttcaaatcctatttattgccttcaactaattcccttctatattcccaaaaatattttgaggaatattattaatttccattcctatttgagtgcttccaaataaattccctcaaactccacctctaaatattgcactcaaataaattaggaaatctcttttgtgaattctttccaaattcaaattctttgcaaaacctagttatccaaatcaagtattcaaattaggcttctttctttttgtcatcgggccgaaactccattctttcttcctttttggcccaatcccttttcttttatcttctattttcctcctccttcttgagctgccggcccagctaagccgagccggcccaaaccagcccacaccccaaccgagccgccccctcctcctgtgcacggctcacgccggcgcaactcctcttccttcgccgctaaggaaacgaagccggccgccgtagttcgaatcttcacgccatcgtcgcccgtgcacttctcgatctcctccacaaccgcctttcaccaccgcctctctcccctataaatagccggccatccctccccttctctacatacaatcagagctccatctctctctctttctctcccatgtccggccatggccgccaccacccgatctccctcaccggagcttcgcaagccaaaccatcgcgccatcgagttcgcctcgacgaggtgattccatttttcctgtttcccccttctcccccaccccatagcaaccaccaccgccacctctctttgccgccgaagataagctcttctactcgccgttccggccatctccctcactctctccgccagccaccgcccaccccaggtgcgtcgttctcgggaacatgtgtggccgccgacgtcgccgcctttcgtccaccggagagccggcgcccactctctccctctcctgtgtagccggcaagaaaaagaagaagagaggaagaagatgacgggagaaagaagaaggagaagaaaaagaaaaagaaagactgacaggtgggcccctgcacagtgacttttctcattttctagatttaattcaaatcctattctttagaagcacatatctcctaaaccgtagatccgattctagtgaaacttggacctaaattcatctaaattcaactcttcat

SEQ ID NO: 53303 - DNA, 6694 bp, Oryza sativa
  unsure (1)..(6694): unsure at all n locations
ggagaaagaagaaggagaagaaaaagaaaaagaaagactgacaggtgggcccctgcacagtgacttttctcattttctagatttaattcaaatcctattctttagaagcacatatctcctaaaccgtagatccgattctagtgaaacttggacctaaattcatctaaattcaactcttcattttgatatcaaatttgctattttaagattttatttgaatttccttaatttattcaaatgccatttgaataaatatttgatttaatcttataattgaatttacaatttaaacttatatttgcttttcaaatattttcttttatttccaaaatgcccgttagccactaaaaagccgccggttggaactttacgccttccatggggacgtttgcgcggtctacggacctcaacgtcgaccgttggttgtaaagcccggcaaaaaccaaacctaaggtcgaagtgctgctcctgccaccccacgccttgatgcgtacagcggtcggagcttcactatcccctcgacctccattgcacgccgcacagttagctcttgagctctgtgtgatcctagccgctctgccgccactcacggttgtcggagtaacacttccgccccactaaacctgcacccacctcctattcttctagccgatatgttgtctatcgacacggctagaaatgataccaaacctagtcgtcatgctgtccaactctagcgacaactagcaaacacccaaaaccctagccgatatttatcctacctcgatatcggcctaaacaactaaaccttagccactattctatcaaagccaaccttaacccatattagccacatgcctatttaaccatatcaactatccagtatatttcctatcgtccaaaccacgagagcctccacataaaatatagagcctagccgagatactgtcctactccacagtcgactcccatataactaaaccctagctattatactaccaaaacctaccactagcaaatactagccccataatccctataccctataaaagagataggttataccttaaaccctagccctcttagtcgtttatcgttttcttattattttatggcttttattgaatttggttcttcctctttctcagtaaagactattgtcttttggatggcaacctatggtatttcgagaatcgtataatcaggttgcctatcttggatttatttgcgttggagcaaggcaagttattattcctccccttgagcataattatcctatattctatatctctattctatgcattagccattcatgattttgaatgcataatctgaacatatagcaaaccagttatatgctagcttttgcttagccctgcctagttagattgcataaaacataatgaacttagattgggacagtacgcaagatttggttgatttccgggtggctagtactgtctcggtcgatataagtttaccaagtacttatgtcaaacgaacgagtacgatcgcagcttctagaatggggacagacctagatattatgttaattaacaatgtggtacctctgtacagtggttcttatataagtcctcgcgaaggaggcaaatatatgccgcgaagggcaaatgtgatatttaccgaggcgcaggtaaatatcttgattatcgcgcgatgtgtgtgtgaatttatgaaaacctggttgagatgacatggggtctctcatccagttctctctaaaaaccccgggaacgccagaactcctctcgctgctgataacattacattcagagcgcatgtggactagagttcatggaacaggtgccacaattgttaataacctaatactaggccatgactaagctaatgattattggcaagtcgtagactgcgggtaaagcgtacatctactgcaatatgaatatccttgaatctattcgaatagccgtgctcacggattgagcatcgggactcatatggtactttggttagaaatataattcaagattttcttaaatactgttgcatatcaagcatttcaggatttctacctctttattctcagctttctgcaagtaaacctagctctacacagatattaccatttcatatattcattattggttaatataatagcttgctgagtacgttgtactcacccttgcttcaacccctctttttcagagtttaattggagtttttgccgaagctgggagttcaatcacataagttagttccctttaaacctaatcttcaagtctagtgtagttagatggtttaattctatagtaaaacggcagagttgagtcatcgtatagcctctgctgtaatagttagccacaaacttgtaaatgtcctattattttatataaagatatctcctttggagtctttaccaaatgtatgcgatgaagatctaaattgttgaacctgtatcaatctactgatccagggcttgatacagttaaacatgtcggtttccgaatcgttagttttgagagccgacaatttattaatagcccactttaagaaaccatgggttgtagagtgtagtttctattataatgtcttattgacatggtactataaacattacttatgaatactatgggttgggactatcctaagcgagatatttccaggacggggatggataacgtccaacatactcctatagacttgacaatatatttattgacaagtagaaaggcacaacctgatggggcgatgtgcgctgcgtggggtcgccctccgtgcggtccaggacttgagggacagagactgaacggagctgagacagaccatcatgaattcatggtcatccacgccaaccgaatctttaaacttgaaagcgaaccattctttccaataacgtactccggtgccaagcaaagcagcaggcaacgattttaaaattcgaaactttttacgttccgaaaaatagtttaaagaaaagatgattttaagaaggaaaaaaaatttacttgtctcgttaaccatcgcaagaagaaaattgaacagcgaaattggggacgtaaatccgctataattaatccaaaacttagaatcgtttttgaatctaaaccaagcataaccttagaccgtgttcggtacaactccagatcacaactcactcgcgctggatttagacttttcaaagttaaattagagtggttgtgttatttaaaaatataatcaaaataatttacttatccatgtaatcatactccgtatttctagatctataatttctagaatttaaaatcctgacctataatttctaaagttaaaaataccgagctgcaaaaactttggagccagagctgtacggctgatcacataaaacattagttcattaccggtaaccatttcctaaattttggatggattcgtcggtaggtcccggcgcgaagcgcctcgccgcctccggccaaagaatttcagcgctagccggcaaaacgcgcacccagcaacacagtattctctccgcccccaaaataatttattttttttccatttagcgcgtcctaataaaagaatctatagatgaagttagagatttgattctacggcacacgaaactaatccatttaaaacataactaatcgagtattgattattataaatttaaaaaatagatttctttacttttgatagaaacctttatatacttttttttatcatctagaagtaacaatttaaaaagtatgctaatagaaaacaataaagttataatttgaagttagaggatgggatagaagtaagactaagagtacgtttattaaatcttaatataattatttttatttattttattgtatttacatcttacttttataaactttgatatgataataattatttaaagaaataaatttattttggataaacgaaaggaggtactaatagtgaacttatttttggacggagacggcatcttttaaagagtttgtctcctctgtatatagagagatggggagaggcggggtgagagagaagcgcacgggtgattgatcttgcatccatggagtcgggctacggcttccgcttctccgacgacgacgtggtgggtcggtggctcagctacctgttcgtcgccggtcgccggcggcgctgccgtttcttggagctatgtttgattggattttggattttggatttgcaggagtcggcgagctcgctgacggtgggggagcggctgtgcgcggcgttcctgccgttcgtcgccattgccgaggccgtcttcttcgcgctcaccgactgcctcgccgaccttctcccgccgtacgccgccggctcccgccaccgccgttccgccgtttcctcctacctcgccgccgtcgccaggaaatggaaccaccagcagcgtggcagggtcggcatcggttgcacctccctcaccctccgccagctcgcccgcctcgccgacgaatccagatgctgtaatctctaatttcacctcacccccctcccattgtttgtatcgccttcttcttcttctcgagtccaatttcgcaatgtggtccgatctgatctggtgtttggtgtcgatcgcatcgggtcaagtctccgtgaacgaggtggaggcgctgttcgagctctacaagaagatcagctgctccatcatcgacgacggactcatccacaaggtttgtgttcctgtcaatttgtcattttggatcaggttgatgtgacaaaaatttctttcgatacgttctttcgtggcaagaattctcggtgattatcgaataaactaatagttttttttttgagaggttatgctctgcacttcgatgtctgttcttgtcttggtctctgaaaattgggttcgtcaggcgaaaagaatgatcgattgattagtagtcggccttaagaaggcaatgttgcaatttgacccagtaaaaaaattgcaactaggtgtactagatcgaccgatccagaggtgttgcactgcacgcaatggattagtgggtcacccatggagcattattgtattttggtttcacaacccatagaattttttttgcctctagtttactttttgtcacagcttgcatgtcgggtggctcccatgtgcaatttgaccatagaatagttcctgtttctcagattgtttggttggcatgttcgttctcatggtacactatgtgagcaactgtaacgctgattggtaaggggaaggcatggcatggctgttttttcgttaagaaaacactgtagtatctttgcaatacaaacattcgaagtcaacagaaaccatttaatttgtattttcaggagcatcgtgatttattggagtgaatgttttttttaataaaaacttgagaaagacaaataaaatctgaaatgctctctatgctggatttgtcatacgtaacagttcctatgctgaattgttctttaggaagagctccagctggcattgtttaagactccaagcggccagaatctttttcttgatagggtgagtgtttacttcatttgctctctttagtactataaattttatttgaccatttaccactttgtgcactatgttttccattgatctccttttaattgttagtttatttccatggcatgttactttcagagggtataagtataaccactgaaagaaattctctctgatacaggtttttgatttatttgatgaaaagaaaaatggtgtaatagagtttgatgagtttattcatgctcttagcgtcttccatccattggcaccattggaagacaagataaattgtaagtacacttctttcagacactaccttcttaaattcatgtatcgaggtatatttacaataaggcctccctttggattgttttagttgcatttaggttgtatgacttgagacaaactgggtttattgagcgtgaggaggttagttcatcaaggcactctgtattaatttgcaacaagtatgttatttgtgttctagtacaaatctggtagtgacggcatggtctgttttgcaggttatgcaaatggttatcgctattttgtcggaatctgatatgaaattgtcagaagaacttctcgaggccattattgataaggtgatcaatcatttcctcggctctgtcctatgtgaacatgccctttttgctgcatggatttaagttttgctacaatttttctgtatttcagacatttgaagatgctgatgctgatagggatggaaaaataaaccaacaagaatggaaggaattcgtattgcggcatcctaatctattgaagaacatgacactgccttatctaaggtattaaatatgagcttgagagctttatgaactggactattaagttctgtcaaatatatactgttgcgcagagaaatctcgtctggaaactactgctaaattgtttgaaaaaaataccagtcaggacttcattaaattcctcgttatttactttgttatttttttgtccatcttatactacagggacatcacgacagttttccctagttttgtcttcaacaccgcggttgaagattgaacataatctaggaatcacttgaaggttgaactgcgcaagatccccggatgatggtgacaggttgcctgctgatcctgccaactttgtgctgcatgtttcttggccagctctcaggaatggaaacagatatgagaattcatcatgagnnnnnnnnnnnnnnnnnnnnnnnnnnnnnnnnnnnnnnnnnnnnnnnnnnnnnnnnnnnnnnnn

SEQ ID NO: 53304 - DNA, 785 bp, Oryza sativa
aaccattcataagtcaagagctatattttcaatcataaaaaaatatccagataactaaattattgcatttacttgttcttcaaataatatatcttttagttggtttattattattttcatcacttgtcaaaagctgtaaacactcatcatcattaacattccaagacataattctacacaagaaaaatatatcaatcctaaatgcaaaaaaaaaaaaattgagagagattgcatcagagtaaaaaaaaatgtaaaaataaaaacaagaggagttcagttacctcgataacgagattaaccgtggaggctgtctgctctgcctcctgcagcctcagcgcgagctccatgttctcctcctccagcccggcgttcgccgcccgcagcgccgccgcctccgccgccatcgccgcctccctctcctagacgttcttctccagctccgccatcctccgccgcgccgcctccgcctccgctgccagggcgccctccctctcggcgccgtccttctccatcccggccaccctgtcccggagcgccgcggcctccgccgccgcggcgacctccctctccgcgccgctcctctccagcgcgctcgccctggcacggagcgccgccgcctcgcgcgcggcctcctcccgctcgcgctccacgcgcgccctgagctctgccagcttctccctggcgcgcgccagcttgccgcggacggcgtcgagctcagacgcccgcgcctcctccaggcgacggttctcctcccgcagcgaggcggccttcagctccagcatccg

SEQ ID NO: 53305 - DNA, 1018 bp, Oryza sativa
tccacttccgttatgatgtgctgaccctcaagcttcttcgctgcacctcgtgcccgcgtgccctcttttgtccaacggagggttgactaccactagcctcctcctcctggttcccctccacatccctttccacgtgcccctgctggttcccctccacatctctctccacgttctcttcctcgtttaagtattggtttggatcctcgttcccttcttcttcattccagtactagctgcttccctccgtgattgtatcgtacaatatctgttcctcatcgcggtcagccatctgttgatacaagaaatatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatagtaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactacacaatcttatatactaagtctaattacaagtctaatattcttaattgcattacaaatataacaatcatttatattattacgtcacttgcctgcacgaattccttctagggctagctcttccactccggcttgagggacgactccgacaacacgtcttttctacaagatacaaaaaatatgtattaggataaatgccgtgtaacatatatatattgcatttcacgttcacgttcgttcacgttcgttcgatcgttcacgttccctagctcgttcacgttcgttcgctcgttctcgttcacgttc

SEQ ID NO: 53306 - DNA, 8242 bp, Oryza sativa
aagaaccaggactaaagattatagccctgcatattattttcgcttacatatgtgtttctaaaatagaagttaatgcattaacattatttaaagtacaaagattaatgacaattaggccgaaaaattatttgtgtctgtaataaattaagtggataaatcgtaataagcaaatatatgacttaaaattaataaaaattccaataatcatatatacttagcatatgaatgatattattaaattggtaaaaactctaattaagatatgtatgtacatactgcatgatttaaaattaataaaaattgtaattatcatatatacttagcgtaggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctataaatgccacatgaatgatttaatacttttaaaaattctctagtcaattataattagcatatgaatgatagtcaattaaatgtagcatatgaatgatagtaaattatgccatacatcaattgatttatatggataatcaatacatccaaaatagtttacatcgtgtacacaataattacggcattacatcgccggtgacggttgactgcacataccttttcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgactggtagaaccacttgacgttaggctcgtcaggccctctgcccttctttcctttgatagacatgtccttcacgaaaaagacttgcgttacatcattggcaaggacaaaaggttcgtccgagtatccaaccttgttaaggtcaacagttgtcataccactgtcatcaatcattacgcctccaccagtcaacctaacccattggcaccggaacagaggaaccttgagaggaccatagtcaagttcccatatatcctcgatggcaccgtaatacgtggcagttgttccatcgtgtcccatggcatcgacacgaacaacgctgttttggttcgtgctcttcatgtcttgggctctcgtgtagaatgtgtacccattgatctcatatccctggaatgtcgcgattgacccagacggtcccctcgccaggaaggcaagttgttggttgatctccggcgtgcccatgagatgttgtcgtagccacgtggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctatcgtcattattactttccttccaagagttccctttccccgtagtctcccttcatggcgtgattcaggtacctcgattgggcgaaggtcttcgataaattctacgcaaaattcaatgacctcctctgttccataacccttggcgatgcttgcctctggacgagcacggttacgaacatacttttttagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgatgagacattgcaccacttcattctgaagggcttctaatctatccggatcgatgaccttctacgaaattctgttcatgaatgcacatagctttgttattgttgcccggacattgtctggaatgataccccttattacaactggtagcagttgtgtcatcaacacgtgatagtcatgagactttaggtttgtgaacttcttctccttcgtgcttattattcgcttgatattcgtggagtatccagacggtacctttatgctctccaagcattcaaacatactttccttctctgccttgctaagagtgtagctggttggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcatgtcgattgcgtggcgtacgtccaagaattcccaatatggtaactcccaaaatatagagttctttttccacatcgccgcgtgaccatcttcgctctctataggctggcttccaagcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacaatgacccatgtatacaaccttcctacagtgcttaagatacgtactttctgtttcatccatacagtgagtgcaagccttgtaccccttgttggactgtccagataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacatcgatgtcgttaccaggttgcttggggccttgaataataatcggcatcattatgtacttcctcttcatgtatagccaggggggaggttgtagatacacatcgtaatgggccaagtgctatggccgctgctcatctctccaaaaggattcatgccattcgtactcaaaccaaaccgtatgtttcgggcgtcctttcctaattctttaaattttctgtcgatgtttcgccactgcgaaccatcggcggggtgtctcagcatcccgtcctgttgacgctcttcagcgtgccatcgcaacattctaacattccccttgttcctgaacaaacgccttagccgtggtattatagggaaataccacatcaccttagcaggaattctcttcttttgtagctgcccgtcaacttctcctggatcgtctcgtctaatcttgtatcgtagtgttttgcaaacaaggcatgcttctaggttctcatactcctcaccgcgatataggatacaatcgttcggacatgcgtgaatcttatgaacttccagtcctaacgggcagactatcttcttagcctcgtacgttgtctcgggcaatttgtttctccccggaagaatgttcttgacgagtttcaataaatcgccaaatgccttgtcactaacctcattttttgccttccattgcaagaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgattttcttcaaatccaacatactaagcaaagtccggaatattgtcgtcttccacttcatcttcttccatttcaacaccttgctctccgtgggatgtccaacaattatagcttggcatgaaccccgactcaaacaagtggaaatgaatagttctggatgcagaatactccttctgattcttacacttattgcatggacaacaaataaaacccctttgcctgttagcttcggtcactctcaaaaaatagtgcacgccgtcaataaactctttggaccgccggtcagcgtacatccattgccgatccatctacatgagtcaaaaaaaaccgtacacaaataattattcttacaataatgacagtcatacaataattataagatatctttattcatacaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacatacaactaaattttggagacaaaaaaagtgtgcaaaacataggtgcaaatgtagtatgacaaaaaaaacattggaggatgaagttgcaaaccttttaggcacctccgatttgcatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagccccggttggtaataccaaccgggactaagatctttagccccggttggtaataccaaccgggactaaagttacgatctttagtcccggttggtaataccaaccattaccaaccgggactaaagatcctagaggggcctgacatgccctgacagcattcgaaccgggactaaagatgatccttagtcccggttggtgtgttaccaaccaggactaaagatcaaatatgcccgttacccttttgaaccgggactaaagatcatctttagccccggtttttattgcatccgggactattgtggaaatcgggcgaccgacgaaagatggtttctccaccagtgattatatgcatatctagattgtatattctaatcgtctagtgttgatgtgtttgtacttcatatatgcatatggttctaggcgacaaagtctaactacaatggattacgcaactgcatgtaaacatatatattactaatgtcaaagagaaaatagccaaaatattcaatgattgaagtgtgactccaagagcaatgaacccgggcttgtttgatcaactatttttcacttactaattcgaggaggacgcaatcaacttatgaaagttattttaagagcttgctctcgtctaataaacgaagatagttatgttttggagcctatatataatatcggaatatgtatatatgtagtgttgcatgcgtacggtctagccgtctaggcggctaggcctacaccagtacgtacaacacggcagtcaaacaagcatattatagtcccgataataaaatactactccttccatctgatgaagatttcatttttcagttttcgaaatgaatcttcgtcttatttaaaaaatttctatgattagtactttaattgtcataaataatattttacgcgcgactaatttgtttaaaaaattcaaatatgacgaacggtcaaacgagtactactggagagatgcacatctctcccggtttgtaaccccctttatttctaggtaacgaactgtgagaaagaatctgggaataaagatcgtcatctttagtcccggttaaaatacctagtactaaagatgaatccttagtccctgttggagtcaccaaccgggagtaaaaataaaagcaccacatggagctttctctttctcttttctttttttatttttttttgcttctttcatattgatttcgcaccgaactcaacaacaaattcatccacagacaaaatcattcaacatcacagattcatttgcaacttcatagaaacatctaaaaatcatccataaatttacatcacaaaatcaaccacaaattcacaaaaacatctaaaaatcactcacaaatttacatcacagaattatctccaaaatcatcccagaatcatcacaaagtcatcgcctccggattgcccgccgcttgccacctctcctctgtgtacgccgcctgcggccgcctcccatccgcgccacctccaccgccgcgcggggccgccgcccgctcccgcgcgcaggccgccgcctccctccgccgccgctagccatggccggcacgctgccgccagccacagccatgagcgcctgccgccgctcaccccgccgggcacggccccgccgccgctggccgcctgcctgccatcgtcggccgccaaaattattatttattttcattggaccagattttgttctgttcataaaaatatttttattttgtatagattgtaaatggcttaaaaataataattataattttcactggttacctaggaaaagtatttagtacaaatataaaaaaatataataatgataataacaatataggaccaaacataatattattcggaattaaataaaactgtacttaatcataaaattatattttatttcaaattggaaaaattttatctaggatttgaatatcttggacaattataagcctttcaaaatttaaaaatcatatatacacaagggctccaaaactattttagatttttacaattatgaaattagttcaacaaattatagcacaattcttagtttactattagagtatttaggaactaaataaatcttaactataatcaataatacttatttgtttaacaaaagatgacaaatgcaatttttatttgccaatatatttttttgtgcttgtataaaaattttattacgaaatctccaagattgaataaggattttttttatgaaattgtttaaaatagtttaataaggtgccgcctacgaagatgaattttgcagccggacgatataacgcgccgcctgtaaaattgcatcttcgcaggcggatgacctagtccgcgcgggaaggccgatttcggccgtttgcaaaaatatttctagtagtataaaattgagtaagatatatatagaattcaggaaatgaattagtagccatcaagactcatactcatcaactaatggtgcacttatcatattaataaggcatggatgatattattaaactcccacttctttgttgtcgaattaagccaggaaacacattcccgtccgtacatctgcagttagaagtaaaaaattacaaaaatctggccagttatttcattttaaagtgtcaagttgatgaaattaactactcaggttttggtaattttagccagcgtatgtgttgatcttatgagcctaacgtaaaaacaaggtaattaagtaccgtataattaattaggtattaactatttgttagtgcactaattaaaatagtatgccatgcgtggctttatatgtaattatgtatacgtgagttatatttgtgattccgtaataccgtccaatggcgtaagcaatgatgaatatatgcattagataatcaagtacatacagtacaatatatgtaagatacagatggtggcaatataatatatatgcagcaatttttgttatattctactctctagaatatatccgaaatttggctggcctaccatacatgcacgcacatcactaattcattaatcttcaaaagtctccaacaaaaagaacttaaaattatcaaattaagcttgtttgtatttatattctgcgtgcaagtacggcaaggccggtgcaaggaaagcgatgtgatattgtacggtacgagtacgacatcagtgacagcataaccgagatgttatgtttctgatgaatgttcgaaagaaaataaaaatagtcaagttgcaccgatcgatttcaacaaataccaatatttttgtttgtatcagttttactcaactatcaaccgaggtttgttataatatattttggaatacatatatagcatccacatatatctatgcatacccctttaaaataccctaatagtgatgatgaaagataaatccgccactacccaccactatcgatcatatggatacttaaacatatggatacctaagtagtgtgataggtgaacttttaacccttccaaccacaaaccatcaaacaaggaaagtttattttataccactgtaaaaaatgatggcaagcctatagagttgaagctcttatccaccatttctccttagttcagtgatattaaatttcccctactttcatgtgtcaaataagaacgatatcttcgcacaatggcagggagctgaaaggctttcgttccagcctacatccgaattcatgta

SEQ ID NO: 53307 - DNA, 1395 bp, Oryza sativa
atcccccatatttccccttccacccctcgacacaacgctcagttggcccgcctctcgccgcactccctctcttcctccgccctgcggcatgctccctatcttcctccaccttgccttgtcgcatcaccggccgccgccgccgtcgtcgttcccgcaagagtaagtttttgggagacctagccgggttgggccgtgaaactatagccgctaacgtcgtgtttttcttctttctcccgcattatgttggtgattttcttgatggatgtgttctcgtgtgtgtgtgttgcagcttgttctcatggatcctaaccggtcaagtgggtacaacaatttcttgaaggatcccgatctggtgcaccccttcggtcaagcctccacccaaagcgatttttgtcatccccacgacgacttccccaacgctcatgctcagtttccccccttctctacccagccaccaccactagcaaccggcaatggtggcctgacattggcctccatatctagggtgaggcagcgtgtgcaggcaaatccagtcagccaagacgatgggaaggcgaggatgtactacactcatgatgaggacatacgcttggcaagcatatttgatcacattccaaatatttgaggcccagatctgaactaggtgcaaaaaaaaaaacttgatttggatgaagctgagcatgagcagatctttttttttgaaaggaatcagcacgagactgtgctatttcattagatataggcgtaaaaaaatacaacccctaggggcaaaaaaaagagctatacaaaattacataagcgctatgattaagttggtaagaattctccaagtcgccttgcgcctgccattatccaggttcttgcctcttcctttatttttgccataaggttgggggccgccgtttccttgtgctcgaagatcctttggttcctttctttccagatttcccaggctatgagtaggattaaggatcgcaaccatttcttgggcacttcccttttgttggctaacatttcccaccattcgtgtacgctttggcatggctcccaattgctcggatccaattgctgataagccacctagttggccgtcagtctccagatccttctggtgtatctacaggaagctaaaaggtggcatgccgtctcttcgtcatacggcatagggggcacactccgctatttggccatcctcttgtagctcgtcgatcggaagtccagactctattttgaatcacaagccacgcataaaatttgcattttgcaggggcctaagatttccaaattaggggattgaagttggtgccgactattcctagacactgagccttgtatgaaaaaaaggccgagtattctccatgattcgagagcttccagacaatgtgatccgactca

SEQ ID NO: 53308 - DNA, 5312 bp, Oryza sativa
gtgatccgactcattttggtttagcatgatgtcctggggtgcgctccatagggacacaagctggctgatcagttccactgtaaaagtagtgttcccatttagctccaggtcatcgatccaggtgtcattttcaatgccttcacgtagcgatttgcttcttttcttggaaattgcatagacgagcggcatgctgtcctttggtctttgcccgtctagccaggcggactcccaaaagcggatcgtgtttccatcccctattgttattttggtagctgcggcgaagagaagtttgtccgtttcatcacacggtgtctctagtcccacccacggcttggtggggtctttccattcatgccagagtcatctcagtcgcaaggccctcgtaaacatctccatgttcagaacccctagtcctcctagtgcggttgggaggcacgtccttttccagttcaccttgcatttccctcctgtaatgtcccccgtccctgcccagaggaattttcttctctttgcatctagaatgcccaaggcttccttagagatcttaagagtagtgagcaaatagataggttgcgcagtcagtaccgacttgactagagttgatcgccctgccggcccgatgttttttcccctccagccggtgacccggtttgctattttatcaaagatcggttggacgtccgtcttgcgcagccttccaagtagaagcggcagtcctaagtattttatggggaattgggcccgtaacgctgggacgccatcaaggatggagtctagatcaatgcttgcacatctgattgccgccacctgcgatttttgcatgtttgtgaccagtcctgtcgcatgtccaaaacgcacgagaatgtcggtgaaagcctagacatcctctctaacagggtttatgaaaaccactgcgtcatcagcgtacatggagattctgaggcgagccgctctgcctcttagcttggttatggcgtttagttccgttgctttggagaggatccattgtagggggtcaattgccaatatgaagagaagcggtgatagcgggtccccttgtctgagtcctctgccatgcgctatcttttctcctagtatcccgttgagcagtacttgtgaggtggaggtagtaagtatggccgtcacccagtctctccatttctgcgggaacccatgatgttgcatcatggctaaaaggtaatcccaacgcaccgaatcgaaggctttggtgatgtcaagcttgaagagaagctttggccgccttgttctatggcaacttcttgccaaatttctaacatagaggaagttgtcgtggatgctcctgcctttgatgaaggcgctttgattgactgtgacgagggttcacatgtgtaatcgtagtcgcaaagccaaggttttggagagggtctttgctatactgtggattaggctaatgggcctgtagtccgtcacctcatccgcgccttccttttttggaatcaggacgatgttagctgagttcagaaggttcatgtttgcacatctcagattattaagcgattcgaagaccgccataaagatctgaaacatgtgtagaaaaatttgtgtgtttgtgtggttttttatgagactgattgatatagtttgggatgcctagaaaaaaaaagttgttttgcaaactgatgatgatgagaagtagcagtacccatgtgtagaaaatgttgcttctttatgggtagtttatgggagtgtgattcatgtacatgtggttgcctacataacattgcgcaaattttgacaatttgatcctttccaaaaactaattttacaaataaaccacggccaaaacttatttcagaaaggcaaaatttgctacaggctatccaaaaaagtgtaattagctggaggacaccgtaaaaacgtgtatttgctatagggcatcgcaaaaaactggtaattggctgctggacccccgcagcattattttattatttttggaggaaaaggagagagaaacaataattaaagacaagtttacccttggctcaaatgactccaactcgggcttcacatggaagtcccctctccctctccctctcctccttcccagagaggccgggtagcagagcggcgatccacggccgcggccgcagtgccagccacgttcgccgtcaagaggggagggggaggggtttacgtgcagccacgccgacgtgcgctgccggccgctaacgctcatctgcgtgctcggctcggcgatgagtggccgggacgtcggttgtgtcggagtaggcgctcaagtgcggcggtggcggcccggtgctcgtctccctcccggcgtcgtcgttcttcgccggcaacctcgccgaggtcttccttctcacgacgctcgccgaaactcatctgcggacctggaggccggcaccggtggcttgcgcctcgccgccgagctgtcctccttcttcgcgtcatgcacgaccacacgctcatctggggcaagggcggcgaccacgccgacaacggcaagccactagccgccgccgcgcccccgccgcgccgccgctcgctggccgccggtgcctgcgctgctacacctggccgttgccccacatcaccctgcgccagccgcctcctgcatgtgagaaaggggatcgagagagaagcaagaagaaataatagagagaagagagagaaagagaatgtgaaagaaaagaataaagaaaaaggaaaaaaattcaaagggtataaccgtatttacacaactatttctctctctctctttcctccaaaaataataaaatgatgcttcgaatgtccagcagccaattaccagttttttgcgatgccctacagcaaatacacgttttgatggtgtcctctagctaattacatgttttttggatgtcctgtagcaaattttgcctttcagaaatcacccttttgttcagcgccaaatcgtatagtgctgaacttagacaccttagcgccacgtcaactggcgttgaatgccgtgccaccatggatgagaggctgagtcggcgtgccaatgtacattcagcaccgtgctatttggcgctgaggtgtctaagttcagcgccatacgatttggcactgaacaaaagggtcctttctgaaataagttttggccgcagttaatttgtaaaattagtttttagaaagggtcaaattgtcaaaatttgtgcataacattgtcttgttgatagagaagaagcacaaacctttgtgatgcatgcatatgtatctgttttgttgaagttatgatgtgtccgaagtttaattttgttgacataaatgaaaagtttttggtagctataaataattggctccttgatttgcacacttttgatgtattgaagttatgtatggagcatccaagaatatctgtgttgactgattatgggtgaaagttgcattttttttatgacaattggttccttttggtagatagcagaacatgtattcctcgaaatgttctgtgatgttattaccaatgtgtattttgcatttgttaggtatatgttgagcatttgatgatatgtaggtgagtgcctggcttgagaactctacagatctaattgagggaaatgctagaaaaggtgacacatattggaggcaagttgtagctacctataactcaaccatagaagatgacaggaaaaaggaccccaagaacctcaaagccccatcaatttgcctgagattttgaagagcccagctatgagtacccccgttgggagaatagtgtctcatgtagtggcttcggttagtgagggcacccatgaagtgtctttgttgtagatgtcctaactgtttctttttcaatttaaattccatagtagagatctgtgcatagcacaattggccagaagtgtcgtcatgcgcacgtggctacctaggtttgagctatgcatgctaaacacatagtgtctactacttctctccttaaatcaattgatagcgaggttgttagtatgaaaaaagaatacaattataaaggaaaaaatatataattatcacatcaacttagtatgaaaatcaccatcatcatatttggcattgaacccatgtcaactaattgttaaagccaatacaaataacagggaaacaaatcctctactgtagagctagccctataattttgagtaacggataaaagtgggtttcatgattaacaggcctatatgtcagtgatagaggacaatattatagaggagactcatctaaattatagttaacccgtcttacattagaagtcagattgacaggcaagtagaaaaatacagttgcttgctggagcttgagatcttcccagccggccggcaagttggtcactgtagagtagctagaggttgttcagattgatattatttcaaaccatatctttttttaaaaaaatatcaaagatatatgcatttacttttttaccaaactttcaaaaatacataagaaatcatgttaaaattttaataatattgtcaacttatatcaaaattttgacattaccaaaattgataagatttattttgattataatctgacatcctctttggtatccacagaaagtggagtatactatctagctccccgacgggaacaagtggtcatgagctaacaactaagcaaagcgacggcgaagaacaacgatgcaggcatcgccccacgtgtggttaccgacggcgatatgaccaacggaaacgccacacactcgctgcaaaccaaaacaaaaacaaaaacaaaaactctgaacaagactagctacgtgcgtacgtacacactctccaagccttgccagcctccatctcgatcgagagggatatatatatctctgatgaagaagaagaagcaagattcttgacgacttggcttgcgtggagtaacatgtagtagcagtttattcactgtttctgttcgcctcaaactgtcaagacatatgtgggtgtgtgcttgaatggtcgcttggccatgagctttcgccgtctagtttttaataattggcagatttggcttcagtgatattttgaattctgatttgtgaacagcgtgttgatattaccggccgtatgatcaaatcgacatgtgcgaattaaataaagacacatgaaacgttcagtagaagacgtgcccacgttcagtaggagattctgtttttcaaaaaagtttaatctggatggacctgtgtctgtggtggtaatgtattgagtccttcattcaactgtgcgtgtcatctgcttttccgcggaagcatatggtacaatcgaagtaacatgcatgcatcaactcattgagtcacttctccagaaaaccatctggtt

SEQ ID NO: 53309 - DNA, 1713 bp, Oryza sativa
  unsure (1)..(1713): unsure at all n locations
ctctgaaggcatccattatgtaattctcccttcgttccaaattgatctacatatatccattatgtaattctcccttcgttccaaattgatctacatatagttttttctgaaattattcctaaatgatatacatatttgtgttaatttattaagtctattcgttatttatgcattggagtaaatgtacgttgatgcatgcagctatgcacacaagtatttataacccacatgcaatatcttgatttgctattggctaggaaatagtaggaatggtgcctgcattgagtttgttgctagaataaatataggatgagagagttatttgcttttcttggttttggtgtacctatgaaatatatatgtagaccaatttggaatggagggagtagtttttagaaagctagctctggtaggatttttagcagaggttttgggttttattgtatcaggtttttagaattgattattgggaagagaaaaactaggaagtttatctaagaagtcttggtgacttgtagtttacattgaactcatttaatatttctacagaaggtttttatgattntttgtacggaaagtctttagaggtttatttgatttcaaatcctcttctatatagaaagtattatgatctcaaataaaatctatatattattgttaacttatgcacgccaacaattgtttgccttttggcctagggatgaaaatggtcacatgaatttccaactgaccgagcatcgtttacatataaattatatcattttcgattcttgacatatatatttttttaatctcttttagcatcgttattgacattatatatttaaattaataaatatgatcaattctctaccaacggggaattatttctgaagggatgttagtgttttcatccctattttagcgccaaccctagtaggcagtagtactataggatcaaaaacaaaaggaaagtttgcaaaaaaaccaaataaaaggatagttttcaagaggtttgatccctagcttattttcttatgaaatcgagccgtacacatgtttacactaacattttgttttctttcatgtgaactaaaatatgcagtatttagaaagtaccaatatcctccaaaaattaggtcccattttgttttgaaccaaaaacataggaattttatagaattgtaagtttataagatttttttttctatatggccttttggaataaagggttcaaaactattgaatcttatgaaattcctaagaaatgccttaatttatacaagttttgaaggatttttaatatgagatctagaaaatttcctatgagtctatctatctcatctagcatatgtttttcctgcggtccagtcaaagaattatttttgtatttttctgtgttttataatcctctagttagcatttaaatttctattaaaatcgtgtatatatatatatatatatatatatatatatatatatatataaaatccagagtttcgaagtagccctttttatctactcaatcctccattcaaaaggggtccttcgtgctctttttttacctggcgagaggtgtgcgtgtgggcgggaaaaaccaagacgaaggagtgcgggggaaaattgggttaatttgatccatgtctttgcaaatataccatattgaaaaaatattattactattagtgaaggggacatatccggtgaaaacaagctaagtgttggaaactcgtg

SEQ ID NO: 53310 - DNA, 800 bp, Oryza sativa
  unsure (1)..(800): unsure at all n locations
nnnnnnnnnnnnnnnnnnnnnnnnnnnnnnnnnnnnnnnnnnnnnnnnnnnnnnntgtgtgtatgacaggttgatgtgatggaaaatgactgaagtttggatccaaactttggatctaaacacagcctaaagtaagtttttttttagaattggctaaatgtgttattgccaaaattctctatgtattactaatgtttgataacaaactaactaatgtttgataacaaactacatccacatgtttattcattaaaaaaatagaatgatttaaaatgacaccaatctaaacaggtccttaatcttcatcacgagcatttgataaaagtactttatcgtctccttgaaatgtgtgggggtataggtcccatctaaattgaattataatcaaatcaaaagatagtatggataatttgtgataaacgatagtattactattactgcgatgaaatttgaactctattaaataagtatttaaaggttcgccgtcttaacacacattggaaaaagacgggactaaccgaaaatcactaaccttaacatttatggacaccaacatttaagtctatttaaatcttggtagataacaccacaatcacaccgtacatatgtttctaacaattatgttagcgcacacgaacatgtacaagctgcattggagatggaccaagcacatatcaaaatgttgggtaaccaagccttgtttagaatttacaaagatttttgccagaacaacttaatagttgattaaaaaaaaagagaaaaataacttatattcgaaaggccttaccaagtgacaccag

SEQ ID NO: 53311 - DNA, 822 bp, Oryza sativa
  unsure (1)..(822): unsure at all n locations
aagagctcgatgagctctcaagctggcttcatcagagagttctacatgagagtggctagcaccctagtcatggtgcgcagncccacgggaagtagagnatgtgtgtcgacttcactgatctcacaagggcgtgtcncaaaggtcacttccctcttcctcgaatagaccaattagtggactcaacggcgggttgtgagttgttaagttttcttgatgcctactccggctaccaccagatcagcatggcaaaagaggacgaggagaaaacatcattcatcatgccattcggtgtattctgctacgtcaagatgccgtttggactgataaccgtaggaaatactttccagcgcacggttcaaggggcactcaacgaccaacttgggcaaaatgtcgaggcttacgtcgatgacatcgttgtcaaaacgaagacaagcgactcattgatcgacgacctccgggaaacgttcgacaacctccgacgataccgcctcatgctcaacccagagaagtgcacgttcggagtaccgtcgggcaagctcctcggattcctcgtctccggagagggatcgaagcaaaatcccgagaagatcaaggcgatcgagaacatgaagtagccgacaagactaaaggaggtccagaagttaactggatgcatgcagcactgagcagattcgtcgctaagatgggagagcgatgacaactcttcttcgccctcctgaagaaacaagacaaatatgtgtggacacaggaagccaaagacgcatttannnnnnnnnnnnnnnnnnnnnnnnnnnnnnnnnnnnnnnnnnnnnnnnnnnnnnn

SEQ ID NO: 53312 - DNA, 10259 bp, Oryza sativa
ctgacattttgatcacaggaccctttacatgtgtaaacaattattgttgcccaatcaagtgagtctggttcattttcaacatggaagtaatggagcagttgtggcattatctgcatacaaaaggaaatagcgatgaaaccatggaaggatgtaaccaacaacacaaactgtatgagagtatgccaatcagtgaaatctatttaaaacagtccattcggctacaaggttgcctttcctaagacttaatatggtcagtaattagctgaaacacgaccacgctagaatgtccacatggtatagaaacgatgttgtaacttgctgatataattgcattatggtagtgttcacaattatgtgattaattcatttactagtggcatgtacgatgtgcttaaatcacagtatatgttaagagctccttagcgttatcttatgtaaattgatttcaaacatacatgctacagctaaatacctgataacatttgtaattgaaacacgcatcagtaaataacagaaatttgccagtttgcaatggagaggcctctgcaaatcagcaacttaacaataccaatgagaatatgcgataaatggtgggacaatgatatcataggtttgcaaattcaatattctcttggtggctaaaagtaaactgtaatcttaactctatgaattacatagaagataacactgttctaaccaaaagttgtgaataccatttactctggttactatagagaccagaccacacaagactaggttcgcaaggtttgctgtgacccatcaaatatgacctaaccctgcagctggatacaggttgggtggctaggagcaacaagctaacagaagtatttcagagtatgcagttttcatgacaggatggatgcaaatgctcttcctaaaatgtaggtccataaaaacatgcatctacaagtcttttctgtttttttagagagagaagtcttttatattttttcctgttggtcaactagtaaaatcaatagcctaagatatgaaacctgtccaacctgaaattcatagcaaagtggaccattacagtatatacaagatggcttagctgcattggttagagacccagaatatactacccaaagtggttttgcagttgattccctgcagtatctgcataacgaagtaatcaaaattatgcttaagataagttgtctgcgaagtacagacatgcaagagaggtggggaactgaatatgattatttcaagtttaccatatgctactgatggcacatttcactgcataaagacacaaactacaactggagttacaaatgtgctgaagtgcaaacatgctaggttccaggcttccagctaattggttattaaacacagaagtttcccacagtacaataaaacatcgctagttgattttgttttccaagttgatataccttcccgtcaactgacctcccaaaccacattaaacggtcccagtggaactgacaacttaagcctttaaaatttcaagaaacataatgctgaactcagaaacccatatagtattgaagcccatgcaaccacaaaattaaacaaagcatctattcaactttaaaaggtaaatgaagttccaataagagttgtggcaaggcactaccgcactaggactttgctgtagtttcttaattcagaattgaaaacactgacaaagtaaagacactattccaaaaagtgataacaattaacaacccaaagtaaggcatccaaaatcacctcaaaacttgatcctgttctcttgagatgcgttctagaaaagatgcccagcatctattgtcatcatcaacctgcaacacaaaaaaaaaaagtaataaataacactctagaagtgcattagcaaacatatggcaaagcataacaggaaaacaaaaacctcaaactgatccatcaatgatgccgtcatgtcatcctcttcactttggccttgttccatcaacaattctgatctattctcacaactagcaaaacaagaaaccttttcggtttcatcaaccaccatgtattcaggccatatattgccagcaaatactgcaaatagttagaacaacaaattagatggagaaatgtttattttatgaaacatggaggaacaattaagagataaatgggcaattaccttttcctgcatctggcataatagcagaagcattatgtgagccagatatttgatggcactcattcttgtgctttgcacgccaatgcaattcctgaggaaggatattaccgagtgattaatccaaaacagtgatatctgaaaactctagcagcgcaaacaaactgattaaactgaaaatacaatataattgcctggttagttgatacctgatgcttctttgaacagtaactggatttcctacaacgactacaaactttttcccctttccatgtgccacaccaacaacaaaaccaagtttgggatcctaatagaaacatttgaagacaaaaagcataagtttgtgttcatgatttatacacagcatgcataatggattatttaagcaatatatcatatcaaagcaaagtgtttcctggacgtaaagctgtccataaaattatcaaaagcatagtgttttcaagaggaaatgtgagaataaaaagtgcattttctacacaactttaaaagattgtttcaacaagcttgtgaaagtttcacaaaatagacggtgataattcctggaattcagcttatgattaacgcacaaaattcatctgaccttcctttatcgaacaaccatttatgcaataacaaatactacctccatacatatatgtatgacgttggctagtataaatttgaactagtttcctctaaaaatttgaactagccaacgtcatataaaaaaaactggagggagtaatatagaacagtgacaaggggtattcttgtgagcatgtcccaaaattgccatacagaggacaccacactgcaagcaccaaacaagcagaaagtatatcaaacaagactaccttctgcacattgtgatccgatggatccaatacaaccctcaggctctttcaatgaataatatgaattaatttggggaagttggcaccggaaaactctaacactgcaacagctcaccagaagaggttaacagaatatacccaaaaagaattgggtgagaacactgtgtagaagaacaacaaaaatattatgccagcttcaccttcttctaggattacctgccctatccttcccctgctcatgctgatctagtagtaagcatgccatggatgggcacatgaacacaaataatgtgcggtgataggctgtctccttgcactgaattggtgcataaacctgcatataaatgattgttaacaaattgatggcttatatgcataaacctgcatataaacctgcagtttgtcatataaatgaaagacaacctggagaacaaaacgtagtggttcgccacagaagtcacagcacctggacttgccagatggcaaataacaggatcaagccaggcctgaagaaagcaatagatttttcacttaagaaagttcaaaatggcgttctaagaacacatataacgcagactgtaccgttgtacgtaccggaacaccgccagctttattggggaagtgttgagggagaagaagatgccagtcctctggtccctctggctcctctatgaaccctaaggttacttgaggatccatgtcctcatcatcctcgtcatctacgtagtcattcttgaatacagcgacaaggtttgtttccttattggggttgatctgaaggctctgaagcttgtcagtgtcaggttccatatttcacagcaattgcctgcaaggaaatggatgcaggaggggatgagtgtcaccaatccagctgaatagaaaaggcaaaacatttcgctccaacaggtgcaaaagggtgcgaacacagagcatgagggtttagttcagcaaccaaaaaaaagaagggaaattaggatatgagcatttcatgttggagtgaggtataattcttcctaactatctttactatttcctccttttcacaatgtaagtcattctatctatctagattcattaacatcaatatgaatgtgggaaatgctaaaatgacttacattgtgaaacggagggagtaattattaaagtgaagtcggaagttcagatttcagcattttacatacagcatgcatccgtatcaatcaatcaaacaatatatctaatgctggccgtgatgggcagtattgattagaccacgtgtcacactgtcacctctcacttttccgcgttcaactttgaccgtccatcttatttaaacattttttgaaaaaattttaaaaatataagtcacaagtaaaaacatccttcggaaatagattagataatatttggtagatgacaaatattaaaaagaaataatatttcattgaaaaaagggaagcttatatgattttggactgatgagatggcgctgacatcagcgatgacatcatcgccggcgacgacttcgaagggcggtgctccggtgagaggcgacagcatcgggagagagagagagagagaggaggcgacggcgaactcaccaatggcggcggagacgagaaacggcgacgggaaacggccggcgcgaggtactgtccacggtggaacgactttccggcgacgagcggcgacaacggaggggtggccgggcttcgtcttgatgctgcaatgccgaaggaggaaacagtgacgaccagtgaagacgacaacggcggcgcgacggcgcacagcggctggagatcaaaacacattggcaacccactggttcacggcgaggacggcttccggcgatcttcggcgaatgaaacgtggaggccggtcttcctctctttgctgcggtcctgttggtggcgacagcgctgacagaagatggcggagccgacggctacagctggctggagcggcggccggaggtggagagagaaggcggctacggggagagccggctagggcatgggagctcgagctacgggttggaaacgagagaggagggcttgggaagagggagagatcggctcgggaacggatggattcggtgaaggaaaattaggccgaaatccgcgggattgagcttagatttgatgggctttattgggaaacgtagaggagatcaagggaaatccgttcccggaggccggatttggtgggaaggtggcggcggcacagtgcacgggcacgggagctcgggtcctggctggaggttgaagatgaactagaggtggccaaacggccggcacggcccggcccggcacgggcatggttccggcacggcccgtttcggcacggcccgttaggcacggctgatgaaacgggccgtgccgtgccgacccacgtgccgagccgccggcccaagcacggcccgtggatggccgggccgtgcccgtgccggcacggcacgcccgcggcccacgggccgttcgggccacgggccgtgcacagtgttttttttttttaaaaaaaaggaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttggtaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaacttacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaataaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaaagttagagtacaatcataaaaagtttctagaaattggtaaaatttttgtacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaattttttatgaattttttagcctcccaacggttattttcaaatttgaacggtcaaatagccgttagtgccacgtgtcgccttcccgttggaccgccgcccgccctgtcacgcgccgccggcgctttcggcctgacgggccgcccgggccgtgccgtgccgcgggccgtgccgtgccggcctgctacaggagccatgccgtgccgtgccggcccgcgggctcggccagcggcccaagcacggcacggctacacgggccgtgccggcacggcccgttactgtagcaggccgtgccgggccgtgcctgctacaggaacgcccgtgccgcgggccgcccgtttggcccggcccatttggccacctctaagatgaacaggcgcgggtgaagcaaactagacctttttttctgggccaaaaagggcccaagctgaggagaggatttttattacttttccaattaaccaatgaaatgaactacttccaatgctcacataatttcatgaaaaaaatcctgaaaatacttggacacttaaagtatttaacaaattaaaatcagatcatttaatgattaatttattatttaaatattattgaaatgttcttttattattaaaattagtaattgagctctgaaaaatctgaaaaaaattccacagagtataattaatcatggagagtttaataaaaattaaatccaaccatactttatatttagaaaattttatttcccacatttaacttcacttgtaaattaataaatatttaatataaattctaagaataatttattaaataatttataaatcctgaaacgaaaatcatgatgtgacaatggtttctgccagtgctcctagctcccgcaatacccccgtgcccctggccattgaacatcactcggtggctcgggtgccattgacgacatcggcaagatggagacaaatcggtttaagagtagtaaaaaaaaatactccctccgtccaataatatagtaacctagtaccggacgagacacttcatagtacaacgaatctggacagtaagcctgtccagattcgttgtactatgaagtgtcatatccggtcctaagttgctatattatgggatggagggagtactcgctaacatataggtcccatggatgtttctttagctctttctatataacagccacatatatgctatgttagtacaggtggaccaaatcagcgtgccaagccatcgaaaactgcccttaaaaccacagagggagtcattttgtgttgttttaatagttagaggggtcgatataccctagttttagggtcgagggagatgaataagattgggccactagctgagggactcagattggactttctttcccctattttcacagttggttttgtgctgggcccaaaataaggagggcctctcagtcgcccacaacctcagaccaaaaggcttgtgcactcgtctctcatctcgtcctcctcgtgctcctccgccaaaaccccaatccaatcgggctccgactccgactccgaccaccgcgccggcatggaggcggtcatcgcggagtgccgccccaagcctctcttcaccaccgggcccttcctctccgccgtcggcggcggcggcggcggcgtcgaccgcatctccgggctccccgacgacctcctctttgtcatcctctccaagctccccgtcagggatgccgtggcgacgtccgccctctccccccgctggaagagcctctggtccagcgtcccgctccgcctcgacgacgccggcctcctccaccgccgcgacggcacgcgcctcggccgggaaggcgt

SEQ ID NO: 53313 - DNA, 1937 bp, Oryza sativa
cgcttgagacagtggagattcttgcgagccgtaacaaaatccccaccgtgcgaatgagtagccatactatccgcaatactttgctatggaagtcggtggccaaggaagtgaacgttttggacaccccttgcctcagcagggttgttttgtggcaggatcttctgctgccccactcaagatataattctaaggtcacaatcagccgtgccaccaaaatgcgcatttccggttacctggacaccggcatcaacactttggtgatcaacgaaaccacagttaaggtatttgtccctttgttggatatatatctctaatcatatcgaatctgtgaaactgtgttaacgcgttttaatcgttgaatttgaaggtaaacacaaatataagcttcaagacacttatccccagcgtgaaggttttgggtctctctgttcatttcggagtacgaaaggaggctttgatgtccatcagcttccttaggtgttttccagaggttgagacactacatataactgtgagatttctttccttctttcattcccgacatatatatacataaatgtgaggttgcgagatagctgtctttcttctttcattcctgacatatgcatcattttacacactcactgcagccattctttcattcccgacatatgcatcattttacacactcactgcagccatatgttcctttgatagctggaggtgatcaatttttcttcttgtgcagagcaaaacggacaaggcttcagaagccgaacaattcagtttctggggaaaggttgatcctgttgagtgtgtgacctctcatctcaagaagttagtgttccatgggatgccatggtgtcctggaaaccttgagtttctcaaattcatcgtggaaggggcatacttgctagagaaggtgttgattgttcttcctaaaggaacttacactagcatgcatagcgttatcaccaaactcaagttagcacctttgacctctgcaagttgggctagtcacatctgtaaaatggaggttgtccaatccagtcaaggaactttgagctaccaaagggcatctgatcattccgtcgatgatcctttagattattccctgtaggctgttctatctgtttgttgtgattataacatattgtcgatatggttatcctttaggtccttcatgtctgtatgccattttcatgtgttttggcttgttatctagagaaaaatgtatggtttgttggatatgcttagtactatacttgatggggtgcaagtaatagaatgcagagcatccgatgtgtcagtagttcctctccattacttcttgtggcaagacagcaagatactctactctcgattttgttgcctctgcttctgtttcttgtggattaattcatcatgcgtcatattgggcggcatcggtctctcatgtctgagaattgtagtaagagcaggtacaatagcaggctataagccagctgcaaatatattttaaggagataaatgaggagagagaagagcagcgggctacagatttgtagccagctgtattacagactccaagacgcagtgtgtgtatgacaggtgtgaccaggtattaatagtgtagtatgtaactattgtatgaatgagacattagattggctatagatgaattggagctagtagttggctatactattaaacttgcgagcaacagatgtggaggaagtcccaacaaaatttagagacagcataaaacagctgtaattccattcgagccaatatatcttttttccttcttcttccagatgttaactggttactatagaatttgttcaattagatggaaaagacaatctgatttagcgaacaataatggtgtggtcgtaattaagcacatcagttttgggctaccagaactgtgtcacttggtaaggcctttcgaatataagttatttttctcttttttt

SEQ ID NO: 53314 - DNA, 4348 bp, Oryza sativa
aacatgtggatgtagtttgttatcaaacattagttagtttgttatcaaacattagtaatacatagagaattttggcaataacacatttagccaattctaaaaaaaaacttactttaggctgtgtttagatccaaagtttggatccaaacttcagtcattttccatcacatcaacctgtcatacacacacaactttttagtcacatcatctccaattttaaccaaaatccaaactttgcgctgaactaaacacagccttagcattgctaaattttgaaaatattcattttggcattaatatgaaaatattcacatacttaatttcgttgtaaagatggatgagggttagagctagaggttgattagtaagtactagtaatactcgtagtagttttgcgctaaacccagtccctgcccatttcgccctccccggccgtccccgtcgatatcacccgagccctaactcccgactccttcctcgccgcgccgccatggcgccccctcggcccgcttcaccacagagcttgccgcccgtggctgccacccgatcccgcggtcgcccgtacgagggctggactctcaaggagctgattggggaggtgcgccgtctacgacgagccgcctcctcggcgccgccccggccggcgggcgtcctcgacctcgaccagggggacgcgcgcgcctcggacacggttcgccccttcgcgccctcaccgtgtgaatcccagaagcaaccccaccatcttggccaggttttgagtactcatcctctcatccacgtcctttttcaagctcaaaccccccaccctttttaatttgttcgttcgtgcccgcagaggctggaggatgtgcttatttccctacgggatgtcgccttccagttcatcaagatcggtcgacaagacgaggcaagcactacaaaattttaacgcgttgtctctctctctctctctctctctctctctctctttaaaaaaaatctatatatgccattccaaacgatagcattttgggggaagaaaagaacagtggacagctaatcatgtttacagtaggaacaaacgacgagacattacaggttttcagatagaaacaaagatcctgaagtgcgtaggattcgtatcgtgactaacaaggacataatactataatagccactaggcacagaaaatgcttcaacatggtatgcagtgtgcaccctcgctgacaccagtatgttgtttggtagatgctttgcaaaattgtatgcatctcttgtcaggaatgatgccattggcaggacaatgatctgtgaaaccaccagaataaagcacatatatcttggcttagcgacacatatatagccatgcccattgtatgcatcatgaacgacttacacatggactagcttgctggacggtagctctcagccagacaaccacactttacagatgcgcacatgcttttaacaaacaatttttcagagttcaagctagttcaaaccattaaacttggatgagtctaatatatcttttggagtttgatacatgacatattcttttttttattggtgtgactatacacacaacagacattgcgaatctaaaagcacacctatgggtattgatttgagtgcctagacacagaggtgcttgaaacgctgccctaagaatgttactgagaatggcaccaacactaacattagttaggccattaagattatcccatgaacaagaccttccttgctcattgtaaaacttcaggttatttgaatgcttatgcagttatgtggttatgtctgattgcaattcttttctaggtgcgtaaaatcgtgaatgtagcacacgatattgtggttaacttctgcaatgccattagagcgcccgaagcgttcaaattagtggctgctgctgaggtatctttttttaaaatggtcgctcttttttgagcatttgtttctatttatttgcttattttctttgtcctgtctgttataatctgttgacagaatgtgaaaccacatctgttgaagatagatcatgatgacaaccttctgtttctacaatttaaggctgcactggaggtacacgctgttgatgcaatatacaagtaaagaagtaaatgtcaccttttttccctgtagaatctaatctgtataatatgcagagggaacagcaggttcacaatgttaaccatgagattgctatatctcttgacaagtacaccaattgcccactgtccgggacggagattgcagagttaactcagccattgagaaggtacatcgtcagcaaaatatacttcagttattagctcctctatcacaaaatagtgctgtttagacagaaaaaagtccagaatccagatatcggattggttgctaaaaattccaatgtgcaatattgagcatataatttctgggtgtgaaatatttgtaacacctaataaaaatattatattttcaatgcaatatttgatcggacaaaatttataaaattggaccatgaataaataacatttatttgtgattagatatttggagggagcactccctagcctaataactgcagcctacttcactgattattttttttctttgattcattatgacttgtggccacatattcgagcggcagcacatcatgaactacatgggttcctctctcaaggggtgcccggtcattggttagtataagtgttcatttgtgaggataatttttcaaatgtgccatcacaagtatacaactggatttgcacaatgttacttgaaatgccattgacttcatcagggaatactattctgaaatggttaataggaaccttgcatgtaaaaacttctccatccatttgttagcacttagcataagtctacattattaggaagtatgatttcacaatgtaagtcaacaaaagaattcaagaacatcatcgatttatcattgcaatatttctatattctatctctgatttaataatgtaaaagaggtttgatatttctattatactataatgggggtatatggcccaatgctattagctttgtattggacttttaggtctttcaatgttggggggatgggagctactgtaatatttatcgtgaaacaaggagggagggggtagtataatgccgccattatttatatgaaaaaaaagaagaagagagaacttggtatgtataccattccattgctttgctttatttggtatacaacaaaaacaacagctatgtgatggtgggaagtgtctagcactgtagtgggtctttttatctggtttgttcaacaatgtgctgcatggttgtggcaagtccaacaagtggcatgttgtgtgggtgagatccatgggtgatggtgtgagagtggtggcaaggttgttgcaagctatgtgctacctgattccatggtggtgacctggtggggcatatgaccgacatgtcccttatggataaggtaaacagcggtagtctgactagtatgactggcagttcctgtggttaatggctgagtatccatagggtataagacgtgtgtaattcttttcaagaagtgactagcaaagccattttggttaattttgtgagtgcaaccagtggtgctgagagggagggataaataacgctgatagtccttgacatatttttttattaaaaaaatattctagtaaggccattttgagaaatcttgtgcaaatcagttgcatagttgcatttagccgatttctgatgttattttgtagttaagaaatttaaatgatggcatttgaaaatctctctttttttaaaaaataatgttttgtgttgaggttgtatgaggttctaagtcttctttaggttgtcctggtgctgtgtcaaacgacctggtatttgaggatgcagagcttaggcacgacataaagtactgccactgacagagagtaagcaaatggtttcaatccagttacaccaggtgaatagctcggtaactggatcttatatgaaaagagactattgttttctttgtatgcaggaatgtgcaagaggtttggtttggttacaggtcgaacaggcttcaattctgcaacgcgaggcaaacgtctgctgtgttttgtttctctgggcacctgtcatttacctttggcttaaacaaggcattcagcggttgatcgctgtgccatgcccttgtacatagaaacaaatattattctgtacatggaatggaagagttccaacacctgcaaatgaatgagcactgtcagcgttgggcaagtggttccgatttcggctggtgtggattttaatccgggattgaagatgcgtgcatcggcagatatcatatccggtcatgctgttgttgccgtaacaattttttgtttctaattgttgctacttg

SEQ ID NO: 53315 - DNA, 2040 bp, Oryza sativa
cataataagttcatttttttatctccccgtctaccccaaaataagttcaaagttcatttttagtaattgatacatctgagtttgtgaaattaagtaggagatagatgtattgtgataaataaagtgagaaataattgcattgggatttaatagagtagaaattttttaatccgttttatgttatattggtatacgtggaatggatgaaaaataaacttattttgagacggacgatggaggtaataattccagcgatcgagctggatgaagctgtcacaactgtatcaccaaggttcgttacgttcacacaagacaatagggagaacgccagccaccgggcgcccgatgcggcgcgcatgcatccgacgctgctgccgtcggggtccaccacgccgcctgctgagccgcccacgtctctcccacacgcgccctcgtgctactatgtttcccaccacatattccgttgcaacaaatcacccacatattttgaaaaccctctactaatctatttctttttttccactaaaaatgtttcacatagtgtactcaatgtttcactatgtatagatctaatattgcagtgaattgaaacattcttttataacaaatcacccacatattatggaaaccatctattaaggatattcgtttcatttttttccacaaaaaatatttcacctagtgtacttataatgttttattttgtagtgaattgaaacattcttttgcaacaaatcacctacatattatggaaaccctctattaagggaattcgttttattttttgttccaccaaaatattttacctagtctacttataatgttttattttgtatggatcaaatgttgcagtgatttgaaacattccttcgctatttgttaaaacattatttttaataagatgaaacaacgcccgatttaaacaattgaaacatttttgatctacttagtgaaacaattccgatatacttggtggaacaatatgcaacatttaaaaataattcaataataagctattttttcatcggaatatatccatgtgtggtcttgtttttcaaaatttaattgcaacgaatttaatggtacattcggttcatgatttggataaataatttaagagaaaaatagtttaaaatagttttgtatgcatgcatgcctgatgacgtcatgctaacgtgggcgcccgatttttctcccaaaaatcgggcatccgattcctagtcgcctctagacaatagtctagtcgtaacactttcctgtttgcctgagcctgacatgttcaggcctagtcatataaatccaattgtacgataagaacatgagttatcctacttctgtcttatgatgtgtcttaaaagacgtttttttaaataagatatatttaagtgctataaatttagatagaaaatatgtttatattcgttatactataatatattccatccaaccaaaaccccatatattttaggatggagggattatgaaattatgaatcatttttccaatttagctattgttttttgaactgctaataaaaaaattgtatatagaaattgttttaaaaatcaaataaatcttttttagttgtaataatagattatattcaattaattaattatttattatttttctcgttttacgtgtggctgaaaaagccaaactatttacctgtatccaatgaagtctttctttctagtggtggtggcctggtgggttaaactgagttagtttcagcttatgggctcagatttttttcctcgtactctatatatatatatatatatacttcacagtgtataaaacttttatatagaagtttctttaaaaaatcagcaaatattttttactatggtctttaatagttaatatatatcgaatttgtgctaataaaatgtctccttctacatacggtgataatccttatctacaacatgaatcgaacggccgaacgggaccttagtctgaccagaagaatcagtaagagggtaatatatatgcaagttgtggttaggccgatatatggtcggattatcacaaggg

SEQ ID NO: 53316 - DNA, 1991 bp, Oryza sativa
cggatcctacgccttcttcctccccgccggcgccggcgacgcctccgcgtcttcctccttggagttggacctcgccggcctcttgcctagccccaccgacagggagctggcctacctgctcagcaccggcgccgccgatccggacgccgcccgcaggagcgtcttcatcgtgcactcgtcgtcgtcggccggcctgctgctgtgctgccgaggctatgtcaacccggtgcattactacgtctgcgacccggtggctcgccggtgcgtggccctcccggagctgccatggccgcccgccttcgacaagtccggcatgctctcggtggctgccggcggcggcggcggcttccaagtggtcctctttgaaaagaggggcttcgcgcatggtggagggcacctagacctcgaggttttctcctcggactccggcgagtggccggcgatgcgcatccctcgcccgcaggacctcgccgggttccggtgcttcgcgccgccgcacctccggcacgacggcgccgcggcgtactggctcgggttcgagcccagggaccgggccgtggtgtacggcgccgcggaccactccatccgcctcatcccggtgccacgccgcgtccacgaccccagcgcgctcaaccggttcgtcggggagcggcgcggcggcgcgctcctccggtacgcgcacttcgacgcggcagagttcgaggtgtgggacacggacgacgccacgccgacgcggtgggcgctggtgcaccgggcggcgctcaaggacgtggtggcccgcagcccccgggcggtggccgccaaattcgtgcacggtcgcatcgtccggcacatccaccaccacgacgcgaactggaactggtgctcctccttcaagctcatcggcttcgacccggtccacgacgacgacgtcttcttgttcggggcgaccaatggtagtggatgcgtcgccgcctactccctcacgctcggcaagctgagcctccgctgcaagattgacactgccgacggctcgtcctccttgtgcggctgtgacatgttcccgtacgtacgcgcgtccaccacctcgctccgtgcggacataccaggcatggtgtataccaatgcctagagtggaatatatatcatgcatgtttgtacaccagcgtgtaggttcataaacttgacataatgaacttctctttaaacttattatgcgcatgtttattttactaaaccttttataccaccaaattcgttgggtacaaatatagatggccataggcccaacggcctggcccacggcacaacattttgacccggcccaagcacagcacggcccgtgcctgcccccccccccaaccggcacgaccgggccggcagactaggcccgatacacaaagaatagggagtaaaagtagacatgttatatgccatggtccaaagaatagggacgtcaaatagacttattttagttatatatacatatatatatatacatatatatatatatatatacatatatacatatatacatatatacatatacatatacatatatacacacacatatacataacatatacatatatatacatatatatgtatatatacatatatatatacatatatacatatatatgtatatatacatatatatacatatatatacgtgtatatacatatatatacgtatatatacatatatatacatacgtatatacgtatacatacgtctatatacatatatatacatacgtatatatacatatatatacatacgtgtatgtacatatatatacatatatatatatatatacatatatatgcatatatatatatatatattggatcatccaatagaatccagttaccggattgaaaaaacaaaatatttaatacttgatgtaccaatcgatgcatgcatccagctactattttaaaaattacttgttgcatgcaaattagttaggtatgcagtgtgcttttttttcttcataatattcggtatg

SEQ ID NO: 53317 - DNA, 1829 bp, Oryza sativa
aatctaaaattgctatggatgaagcgtttataaggcattgggaaatttatcaattggtttgcgagataaatcatttagccgattgattctcctatgtttggagaggtgatttatcggtcaattgttatgggacactaatagtgataaagggaccaaaaaatttttgaagattagaaagaggtttaacgatgatatgaagctatagacaaagcccataataacacaactggggtagaatcgtttcaagattaaaaattgacatgaatagatgattttaccattatggtctagatgcaaaaggcttgatgggtaatcatctagttggaaatgtctataccgaaatgtgtgaattgttcttagaagattgatgatttgacgggacgctataaagagaatgatttaattactaggcatttgaaagcacatatggccgatagaaatcatcaccctgagaccacgtgttctatgcttttcagctcacaagtttgctaaaatgacaggggtcagacatgtgttaacaacaaaatttagtactaggacaaatttatagcaagtttgggccagagttggaatagaccggagctttcccgaggaggatgagctgaccgtcatcagatcggagggtgaactgtagtctgactgtaggtggccagtcagaccgaaagccccgagtctgagtctagctaaggcaattctcgtgtttcgtagcttccgtccaaggtttctttgagtcctaattgatctcacttaatagaacgtggaaaaaaccctatggaggtaacaccaaccccttcataagggttatggccaattatattctaacaccgaccataatcccctacacaatttatcaaatcgttccttttacttttcagtaatgttttctactttaccctagtttcgtccatctttatcgatttacgtcataaattgttcgcctacgctgcgagagcccgataccctttgtaggtctgtcccgtaaaccttccgattcacccacgagacgggtgtttactaccatatctatctaaatcagcctagaggctgatttgatctctaaattaaatcggctccactggctggttttgctctttcctaaacccatcttgattgggagttttctagatcaaggtggttggtgactctgttaacaccgtaaatctttagataagtccgtgttaacccaaaaaggcaccaacactctccttcagtttggtaaaaggttgaggaggctccggaccgcagattaattgtccaatgtccatgacaaggaacaagaataatagcctcactctggtgcaagcctatgatagtgttgccctagacaaccattaagtttctttttgttaagcaccaaagcatctgtattgtggataggtagcagtgtagcacactctagcactcctatccctttttaccaagaccactgtagggaattaagcccccacagttaaatagcacccctatcctaactgtagttaccctaacaaaaaattagtagaattccacttgataaaaatatgtaggccatctaaaaactgagctagtattcttatagtcgtcctaaaaaaggcatgtattctagtggttgcagtgacctaagtagcacctaaaggtcataatttcaaatctccatatataggagcgaatttcagattaggcttgagggattaagttcataatttaaaaaggctgcatatatccgattggatgcatgtaaaggccaggtaaaaaaatacccttctcttaaaaaaaacgaaatcttatttgccatcctgagaccctctttcgatgggggccttaatcctggcccattcacatgtataagt

SEQ ID NO: 53318 - DNA, 2332 bp, Oryza sativa
tggccacaatgttgatgcttttcaccgcattgtcccacttgccaaccccgtcatttgtcagagctccatgtctagtcaagcttctttcaccttgtagctcctcccctcctatacctagtcagtccatatcaggtcacggggagctctatatgataagtgggaagctggtgatcagatggttggcccttgcctggtgctatttagggcgatctacgcctggatacagaggtggtcagcatagtggaacagacatcgacgaaggatcatcttccttagggttgggtccccactttctccttggagctcctaccgtcgtatgtccaatccgtttctcgatctagtcgaggagctccatggtgaggatgaatgtggtggtctgagggccaatgagggttgccgacggagggtaacagcaggagtggagactccttgaagcccatcgtcgagcaggggttggccagcagaggggtgttggtttgtgggccatgtgacgaccatgtgtaggtgatggtgtttggtggtagctgagttgatggatgatgaggccaccacagataagatggcaggcagtcgggctccaggcgaaggtttaggcccagagacaataggccgtgcttagccgtggccgacctggtgctaggctccttcctcagtggcttgtgttgttggcttatggcacgacgtctttccttcttgactatagatagcctcttaggtctgcagtcttggtgtttttttcctactatattttttttcgaggaaccgatgataggagtttctcctgtcagaatttatagaagaagagaaatggcccagttaataagggaaaccgggtccaaaaaccgaacaatcacggttaattgaacaggaaaccggcaaaaacctatacagaaaaggaaaagaaagcaactattgagacctcatacaagtcgtcgttgccgagcttgccaaaggcaagcagcttcaacaaggtctccataaccacccaacatcctctagtggagcagaaaccttctgagcgaagccttcaacaaggaaaacaacattaagaatgttgtcaacgctcgtccccaaatggaacccggttttcacctgaagggagagagagccatcatgacgatacctccaaggaggaaacggcacccacaggcatcgatatcatcagcctaggaaagcactaggcaaggttttcacccgagactctctcaaaaatgctccacctccaaaccctcgtcgcgttgcctggacgtctgttgagggtcatcgttgccgagcttgcaagacaagcagctccgactctgcctcaacagtcaatcacaatgcagctcgaccagagaccacctcacacacaggaacccaactgcagcaaacctacggcgcggccgacgaacaacgagatagaacgccggaatccaactccgcacgccacccctaccacaccaaggagctccccggcaatgactggaagcagcctagcctaagaagggaggagtacctaagatgaggggagcgggcgccgcaccgccggagagcactggaagaagaacaactgaagaagaggagagccggatctggaggaaaaggaaggagggagatggaggcgtcgtccccatcgtcggcaaaccgcagcaggtcggcagcccccggccgggtccgtggcagccggcgccagagcagccgtcgtcgccgacgagcccgcgccggagaagcccatcgtcgccgccgcccggcctcgacgttgctgcgggatcgagggccgccgcccaccgccgtctcgccagtccctcgtcggctcgccgctgccggtggaagtaccagatccggccaagggagggccggatccgagctcaccacgcgctggcctgggctcgtcgcccgtcgccaccgcccggcctggtgtcgtgtagcacgcgccgtcgccgccgcccggccacgttgtcgcgtagctcacgccaacgccgccaccatcccgccagcccctagtaggttcgcttgccgccaagcgagggccggatccgagctcaccggctctagatccgaacatcgtagccggtgccgtgctcccgcctccggtctcgtcgtcgccccaaccgcgttgaccaagtgagggagatggggagccccgccgctgccgtctttgcagctgcccggctttgccggcggctgctcgggcagcggctaggcggggggaggaggggaagggtggggcggcggcgggtttcaccgcccgcgtcgccctggggcgaagcgaccgagcggttttgactacagctcttgatatttttcctactatattagaatttaacttgcattattttgcattgtctgatgc

SEQ ID NO: 53319 - DNA, 2328 bp, Oryza sativa
  unsure (1)..(2328): unsure at all n locations
gccgacacaggtttaccatatgccgacgagaggggtcccagaccaacaacaggttaggtcccagaccttactgtgccaggaagcccaggggtcctccccgacaccaccccggcgaatccacatgtctctcggcatcaaggctcccctgataagctagttactcagctaggggtgtcccattccacccatgtggtcgtacttgtcttatgtttggatgaaattccaaggaaacggtccttaggtgcaagagcgggaaaccgtatacccggtacgttccccggtccgcggttttggaaattcatttagttcgcaagcaccgacccaggtgtcgggttttccaagtcttttgtaaaacccaagttttacccaagaagtttttcagattttaagtttgaaggcgcccgtcgatactcgcacagggtgcacgaatatcgagacgcaactagatggttacaaggggacacgatataacaattatcaaaggaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagatttttggatttttggtctaaaggaaaaaggatttaattaaattctttttgaaaagaaaaagaaaagaaaaggaaagagggagggattatagactnttcctcgggcggctagggcgtggcccaagggaaaaggagcggaccgaccgagctaaatgggccggccggcccaaggcggcccaagtgcgcgcgcgcgggaggggaggagagagagggccggtggaccgggctcaccgtgcgcggtcccgggtgggacccgcttgtcagcggctcggctcaccgtgcggagggagcacgcggcgtacgcgcgcgggcggggaagggacatggtgcacgcgtgctattagcggtggaagcggtgcggcgggcccacgcgcagcctcacggctcgcggtggaacgcgcgcaccgggaggggctgaccgcggtcggccccgtcccgacctcggctgagctggcgccgacgtggcgcctacgtggctgccacgtgggctgccgggaggtagactacgacaccggccggaacagacggcggacaacagcggcgatcggcggagcgaaccactgcgatacatgcgaaagcgagcacaccgggtggttgcacgagacgaggggagacgagccacacggctcggattcgccgtaggaagcttgaccgcggcgaatcgcggcgctggcaaccggcggggagggaagagggaaccgcgatcgaggtcacgaggggtcgattcccggcggtgagagcatctacgcggccacgggaatccgatgctagcgttgtattgggcggagctacgccgagcgaggcttgcgacgagcgggtgctacggagctcgacggcgacggcggcgagcacacggcgaacgacggcaacggtcggggcggcgccggctagctacggggaggctactcgtgctaccaccgaaaactaagggggggagatggagcgaggaggaaaaacggagagaggcactaccgagatgaggaggggcgctgtgacgagaggccgacggcgcgggagtgatctctccggcctcgggctgaggaagagaaagaagagggcgcgcccggagtccccttccgtgtccttgctcgtgccggctcctccgacacgcgcaacgacgaacggcgacggcgaacagagcacgggaggcggcggcaatagcgcggaggcgaatgggagaagaaagaaaaaggggggggggagctcgggtttatagggggcggcaatgtcggtttcgaaaccgactttggcggtcaaggcgcgagctggcgctccggctagcggccaaaacggcgacaggagggagggaggatgacgccggcgggaggaaaaaggggaaaaaggagggggagaaaggggcttgtccccttgcctcttcgggaaaaggaggagggagcgggggcgtcgcggcagagggaggagggaggctctgcctctgtcccttggcggcttgcgcgggagtggggtaccgagctcg

SEQ ID NO: 53320 - DNA, 1579 bp, Oryza sativa
gacgcgggcctcgtccctcccggatccggcggcggcgggcctcatcccgtccagatccgacggtgcgggccttgtcccgctcggatccgacgagaccgggggtggccggcggtgggatcggaagcggtatcagactgcgccgggaccggatcgatcgacggtgggagcggggtcagtggctcggcagcggcaggcgagctcgggcggcggcatcgccgcctgcgggctaggttttttttttggaattttatttttttttggcgattttttctctttgcatgcggtcggcttaagcgcccgcatgcgaaaatgcgggtgccgtggccacatgcaaagttggcgattttcacagacaatttcccgcatgtggttgcgccaaccgcatgcgaaaatctctcctgcccgtgtgcaaagacctttttttagtagtgtctagtgttatgggttgggactgcccttatgctccataagaagttgctagaattaaatgggctaggctcaatttaatcctaggaaatttcatgagccataattaatgttaagagattaataccattttgaaaaccaacatgggggaccttgatttaaatagcttactaattgagagcacatgctgagcgtttgaggtggtcatgggactgccatgcctgcgcgcgccgagccaagctggccgtggcggggcgggggttgggctggctgctctcctccccttccgagcattgcattattgtgagtaaagatgatataactgatggggagccattacgactgtaacatatggagcaattaagcgtctcaagtactcctgaaaaaataactgatggacagtcattacggctctaatgtatggagcaattaagcgtctcaattactgccgaaacgtctctctgttaaccttccatcaccgggatatacagagataagaactcttttctttattcgtccttctcgtattcctctcctctcacggtacacatcccacccttttgttcctccatccatctaagaagctgcatgggtaagtaggcgatcaagattttggagagcggttctttgcgcgactcctctcggcactgcatactctacaccgcggtcttcttcctctgcatcaacatatcgtccaacccaatcacaggcagtggaggaggagacagcattggcaacgcagaaacagagaacgtcatcaacggaggcaacaacaataatacatcatcatcatgtcgagcgttttctgggtatatgtgttcgacgatattttgtacattttttttatatatgaaagaaatgaagtgtgtcaaagtattaatttcgggaatggcgatataataacgaaattggtgattaattaccactaatagcacaacctggcgtacatggcgtatacgtatgaataatgtgagacacttgccgtcggctgctctagtatatacgtactcacgacattttgatatagggtgatcgatccaatttcatggttggctggtggaaggaaaaaggtgtgaatgtttcatgggaatggaagcatgtgccactgtagcactgtcattagaggaagttaatcatatgatttgccggccgt

SEQ ID NO: 53321 - DNA, 3242 bp, Oryza sativa
atactaatccatgtatgagctagcctgtgaaccgacttatcacccctataaaagattgtccatttcattttacagggagacaggacagacacagagacggaggaacacacacagacagaacacacacgcatacgaaagtgagagagagagagacacacaccatttttggccggagaatctcggcgtccagcgagaacacgttggccgcagtgcctcggcgtccggcgaggaggcgcgcggaggaggagacggtcgccggagcacgtacccagccattgccatgggtacagcttattagctttcttttatttttcctgctctttctgctcagatcgtcatgcatgcacaacacggcgacgaggcgagtttctggtgctgcccggcccgctggatatagcgtcctctccgcctgtcggacgcaccgccggccggagatcgcgtcatcggagacgtcggtcgccggtgacacaactacctgctgccgcgacgtccttgcctcgccggccgcaacctctatcccacgacgcctttacctggcgatgtgatgtcgccgagacgctggacgttgtcgccttgccggtcgcagcctcctcttcgcgacatcactgacgtccgctcgctctcgtcgacgttaccatcttcttcgaactcatcggctggttgctcgaggagaacgccgaccggagcgccactactcggtgcccgcaaggcgtctccagctccagctacgtcgcaagccatctcgtcggagttgccggggacgtcgtcgagccgcctgagtccgtagacgacgcaacgctgccaagcgatgctcgtcatcatccgctgcttgccggagaaggtttttgtcattttgcctcaccggagcacgccaaagggagttgaggcagccgccagggcactacgccgcagagccctcccatgtcgcggatgctgattgtcttgtgcatgctattgtatacggtgacaaaccaacaaaacaagacatgcatgcatgctactgtacacggtgacaagcaaaaatgagtttgcagattcatactcatttggggctgctccgtattaaacctccaagccatgaccaattcggctatcgcgttgatcattttacttttataatctaattccgatgcaattcctacctcgtcgggtcatccaagctacacaattccatacatgtcttcaacaacaatataaaccaacacatcgtccaaggccgatgaggctaaacagcagggcgggaggagtcgacatcaagacgacgtcaccaacaccggcgtgcggaccgacgaggccgcgaataccgacggcgcccactcacacacatctacaccatcatcaccatcatgcatggaggacgtgaagcgaagacggatgatgacgaccagcgtagcttaatcggaggtatctcacgggtttaactcgcgagagtaattaaccgggtgtcttcgagaccccgggaacaggagatcacaatcgccaagtcagatccaccttacctatgagccgtggaacgcatttgacaaaggattttgttttttttaattcttcaagaattataataaaatgcattttcctttgtccattttatttttgtgtacctagtacactggcacgcccgcgcatttttattttattttatttccctgggcggagggatgaaaatttaatttttctctccaaacaatatgattatcctcatttcggtgtaaaacatgtttttagatgctattgttcctattagcatattcatgtttatcactatcctagaatcactcttgtttagggcccctttgatttggaggaaaaacataagaattttggaggatttcaatcctataggaaaaattcatacagatggctttgaatcaatggattgaatcatatccaatcctttgaaattcttatggaatggacaatactatagagattttggagaaaaattagcaagagctcaaagctcttggaaaaatttctgagtctatctctctcatccatttcctgtgttttttttataatccaatcaaacggttattcctgtgttttgcaatcctctattttacacttcaaatcatgtgtttttcctattctttgttattttcattcctgtgattcaaatgggcccttattgtgttatattaatttctagattaaaatatgctgaattacgactatatttctatcaatccaaaaatttaatagatcttttttagtagttgatattgcccttttgatggtgggatattatttcccaatcccaattaccaaataaagtctcgatggttcaaaatataaggttgtacctctctgtgtatgtcattaccgtaatttttttttaatctttctgctgtataaccaggaaaaaagaatcattcggacacctcaaaattttgagccaaccaccgcagaacatgttaattttttttgtcaactgtacaaacaccaaggtatttaaggatttacaccgacaaaaaaagaccgtaaatgtaccgtgtgaactccaccctctcctgtgactctaaaataactgacacggcctcccgctagcttagctctccgccgttctccacgacgcgcccaccaccgtcggcgagccgacgttgtcctgggcgtgcgcggcggcgtcggcggcggcggcgctcatgcgcgcctcgtatgcgtgtccgaggttcctgaggcggatgagctccggcaggatgacggtggcgaggtccgggcggtccctccggcgcatttcggtgcacttgagggcgagcttggcgaaaccgatggcgtcgtcgacgggccagtccttgacggtgacgtcgagcatctgggcgaaggtgccggcgtcgatggccttctcgacgtggtgggtgaggcccatgggcggccgcgcggtgagcacctgcagcagcagcacgccgagggagtagatgtcggacttgacgcccagcttccccgtctgctggtactccgggtcgatgtagcagaaggtccccgccgtcgccgtcagccggtactgcgtcacgctgtccgccaccgccggcggcacgaggcgcgccagcccgacgtcgctgatcttgctgacgtagttgcggtcgagcaggatgttgcccggcttcaggtcgcggtgcaccagcggctccggctttgtctggtggaggaacagcagcgcggtggcgatctccgccgagattctgaaccgctggctccacgggatcggcggcgtgccgccgcggcggaacaagcggtactcgagg

SEQ ID NO: 53322 - DNA, 1513 bp, Oryza sativa
gcagtcgggcgccgccctgctggacagcacgacgggcttggacgacgaggacgggagcgagcgctcgcggaacggcggccgcgtggtgagctccggcagggtgcgactgtccaccgaccgcctcgacgagtccggcgacggcgtcgccggcggcagcttccccctcgagcacctcctcgtgtacaggctcctgatcgatgagtcgccctcgtagccaccgccaccgccgcaaccgccatcgacgccgcacttggcgagcctcacgttcaccgacttgcctttcgccaccacgtagatgttgcagtagtccggcgcgcccttcatcaggctggacggcacgtcggcgttcttgaatttcctgaccatcaaacaatgcagcaccaccatcaccaccaagaacaacaccttaaaattggatcgaaatcggatcaaaatcaaaacgaaactaattattgatctttgattgatttacttggtgaatgcatttctgttggatgcgccgagcgcgatgctctggatcttgttcacggtgatgaactctattaaggcctttgacacgtctgcctcttccagtaccaactccgatacatgcacctgatcgatcaacaatggaaaacaaaatgcgttctcgtaattaagtatttttttttgttcatgtctttgatctgaaagaattaatttcttgtgttgatctgaaactaaatatttgattaccccattcctggtgcagaatcctctgaaggggacaaagatctccctcatctcggcctccaacgcgccatgcgtcgcctcggccatggcgaatccatctacgtcaccaaaaaaaaaaacaaaaaatgcacatcagttttacgatctcttgcagttgcagcagagagacgcatggcaatggctgatccggcgatcgacgtacggttggcggcaggggggtggacggcgatgtggaggaggatgatgttggaggcgccggtgaggaggtggtcgacgacccacttcacggcgagctggctgttccggtcacggtccacggcgacgacgatcgtcatcgccggctggtggtgcattatccccggcggcgaggtggcccggtgctcgtcggggctgagtggccctcctccttgcatcctgcccgcctgcacttctccggtgagatctcacccgccttcgtcgtcgccgccgccgacgccgaccgtaatgtgatggatggatggaggtgatatcgccggccggatcagtggatgatgcgacggtgagtaggacggtggtgcaaggaaggagaagaagagagagggagagagaggctgagagagagagagagaaagggttttccttttccctcccctcatgctcttctttatcctctgtctctcttccttgcctccaaccttcctctcaaactgtgcaatggcctcctcctccctcccccctttttctgggacttaaatgccatggcaatggagcaaggatagcctcacactattcgggcaccatctcttttttttctctcctcttt

SEQ ID NO: 53323 - DNA, 822 bp, Oryza sativa
aaactgtacatttcctaatattcttgtagactgctgaaatggttttacaaggtcaggtaggtcttgatcatcgttgagccggtcggatcagagaggagatgtctgacaaggttcattcgcatttggttcggcgcaattgtgaacatgtagaatgcaaagagtatgagatccactgaagaaagcgtcgaaccaaggaatcctcgccacatcctgatagtaacaaagaacagtgatgaacactttgttgggtggcaatcttcaggtcatacataatggtatttgtaaatagactgaaaacagaggcaaatgcaatcaagagtagaattaccatttgggcaaccggaaaaaggtttcaaagaatgtctgaatgccttcgttattcagttggattatcaaagccagcccaaaaaggaagaatgatcgttgacgtttccgttcttggggccataatgttctccatgctgcaacaccgcatagcaattagtaccagaaaatgttcctgacatttccaaaattatactaaaatactgccctcatctgaagcaatgtactccaatttgtaatactggtgtgcttgtcaataaaattgaataaatatcagaagaatgcttaccaagcattgatggactggaactttgagaggttccaggcaaatattctccagggtagacacggtttctcaagatatcagatatcacagatgcatatcttggagcttcagacaatgatctaaccaccgagtatcctatgtttttgacagataaatattatattattgcctgtaaatacaagagaaattgaaagtacggattgaggatttgt

SEQ ID NO: 53324 - DNA, 1271 bp, Oryza sativa
tgtctaatccggtactctttccgtttctcttagttctagattataagtcattttgactttggccaaagtcaaactatttcaagtttaaataagtttgtaaacaaatatagtataatatttatgatcccatattagtttcattgaatcgataattgaatacctttttatattatatttgtcttcagttaaaaatgttactattttcttttataaacttaatcaaatttaaaatagtttaactttgatcaaaatcaaaacgatttgtaatctaaaatagagggagtactttataatactatattttgaccaagggcggatctacagtgttatcaccggcgtcaggtgacaccgacgattttcgataaaagttatgcttaaaatacttatccatatattataacactatattctataatataattaacatggtacgacaccgatagatacgttattacaccaacaaatcaaatttctctggatccgccactgattttgatatggacagatataacgaaagagcatgaagatttctcgtttcgattgcgacgcggcgacccccatgcatgaaccagcgacatggaaaacatcaccgcatttcttcgcaccgagcacaaggcggcggcgctggattcgccggccggccggccggtcgccacctaccgctgatgagcccctgggttagccgcagaaaccgcgagcgccagcacatgcgtgcgtgcggccccggcgcggccaaaagcctctgtcggtaaaaatcgtcgatatgcagtgcaggtggcagagaacgatggtatgcagaaaaagccgatgcaattgctgcagaattttcgtagaaatttcacacgaaacagcttgctttagttttcataggagatggatttttcttttttttttctctcccacgttctaaatagtagtgcctaggtgcagcgggcccagctttttgaacttgcgtatttgaaatgggaggaggaaaaaaaatgttcatacacctaaaagcctaaaaattagcttgtggcataagatactaataagtataatatatagcgtatataatataaaattggtaaatatatcaaagtgtcaacatatggaataaaaaatgataggaaatgataaattgggaaaaaaattagattaatttttcgacgcttgatattttgaaaataagcgatgatgtccttgtccttagcttgaaaaagaattccctttcaatgaatataactagacaatcattcaaatatttttgccccatcttgctttctcaactt

SEQ ID NO: 53325 - DNA, 4428 bp, Oryza sativa
  unsure (1)..(4428): unsure at all n locations
acccatatattttgaaaatcctataaggaattcgttttatttttttttcacaaaaaatgtttcacccagtgtacacacaactatgtatagatctaatattgcagtgaactcaaacatttttttgcaacaaatcactcacatattttggaaatcctctattaagggaattcgtttcattttttgttccaccaaaaatgttttacctagtgtactcagaatgtttcactatgtatagatctaatgttgcagtgaactgaaacattatttccctatttgctgaaacatttctttttatataaggtgaaacaacgtcaaatttaaacgattgaaacattttcgatctacttagcgaaacaattccaatatacttggtggaacatcatgcaacatttaaaaataattcaataataagcttaaaaaaaatttcgtcggaatatatccatgcgtagtcttgttttgaagatttaattgcaacaaatttaatgatgtaatcggatcatgatttagataagtaatttaagagaaaaattagtttaaattggttttgcacgcatgcatgatgtcagtgtccgatttttacatgtttagatcggacgcccgattctaagtctcctccgtaaagttgagttggtatatgataagattgcgccattgcgacatgccgggcggttcaggtccaatcgttataactactatttatttgctgagggtcacccttgtcatcaatgttacattataaatggggtataaataacaaaattcggggacatagaatagaacggaccccatgaatagctgacgaccaacttttaggtccaaaacacatcaattttatcggaggtcgatttatctttatctatacagtcagtattattacacaatctaatagagcttttcttttttttttctttctgcgtaaatagaaaaaaatagcccatatattagatgatcgtattattatggtcatatattatattgagaattcgttttagacaaaacatgactttgattanaaagattaccgtggactccttaacttttatttagatgaaacatcacttaaaaaagaattaatggtccatatcaagtatgacccagtataaatgagacaataaagaaatactccctccatctacttttgatagtcatatttcatcttggcacacagacaaaaataagtaattctacttatcatccatttaaatatgctactagtcattcctcgtaaacaagcgatttattaatatttacatttctcaatgcccatgtagccaatcatgtgtggaagaatgaagagtcatgcattaaatccaagaaagtcattaagatgataagttgttcgaattgaaatatgtctatcaaaaataaaattttcagatttggaaatatgactatcaaaagtagatggagggagtactctataaatgagactataatgttcaaaccgagcaaaacttgatatttattaattccaaattttagaattattaaatcagaaatcatactaaattcggactccaacacatattctagcagaaacttattcataaaatattaaatttaaaaattgcaatggaggatatatttattaagatggattctagtagtacatattattctgtattttgtttaataaaatggaatctatatcagtattaaaacattatcgatggccctaaccatgattctcccatcttctacttatttgaattttgagaaaacggacgatatgttgctccattcgcgtggttcaatgaaaagccattcaataggatacaccaaataaaataccactcaatatattgtcttatgattagaatgtcacggagggttttaagaccaaaacgaccctagctggttgagcggagtgagagggagagggtagcgggcgcgacaggaggggttgtctgcaacgacagcgaagttgatgaggtggagggagaggaggaggaggcgatgatacgggggtgggggttggaccgcccttggctccacgaaggaacggagagggcgcgtcttccagcgtggcccgcccgcacgctcatcgtatgttgcacaccgcctccaacaccgcctatgctagaggactcgctaggaggcgacagtggggacgacggggtggagccatggagggaggagggggaggcgacgacgtgcgagggtattgccctcatcagctccctgaaggagcggtgaggacacagcctctagcgccgcccacctgcacgctgtttgttgccgctcaccactcccctctccccttctctccgtacacaaccagttaagggcgctttggttttaaaatcatgttctcctgaattttggcctacaaaaaagaaaagtgaagactaaagataattaagataggactaggggtgcacagtcactgctccaataagtttacgcaactataccttggtacgcgtactgtgatgtgtgttattttttttttgagaggtaaaagcaggagctctgcctatttcataaaaggagaagagagggaaaccgagtttgtaccagcaaagttacaaaaggatcccaaggggaccccttccgaggtgttgacagacacctgtgatgtgtgttaaaccctgtgatgtgtgttaagtgtcatcaaacatatcacctccaagcagttgagaacagcactctgcaggtttcatgtctctttcttgatataaaacaagcaaataagagatgatggaacgtcgaaaaagatactctcgaaatggataacgtgacaagcgatcaatctccgttgtttaaaaaagaagaaaaagaaatgaaagaaaacgcaacaagctattccaattaatgcatgccattggatctatgacctagtagcaaacatgagagagatggatggttggcggctcgatcagcttgcatgaaagcaaccggaggaaaaagaaatattatcccatggctcgttgttttgtcctctcaacccagacacccagttcttgatttctagcaattaaacccggtgtaaaatagattttgtgcaaattattagaacggattgtttatttgattaaaacgctaaattaatatttgataaataaacttcaggaatagcttagatatcgatcacatgaaagcttattattcgatggtgcaaacttattgtttgaaatttccaaatcctcaactcacagattcaaagtttcacattgaaagtgtgaatattaaaattacaaaagttcactaattaattaatttaagagtaaatttcatgtaaccctagatattatggtctaaattgcataaaattactgggttttgacttttatctaccacaatttcaagttctcaaatttataagtttttatccatcatatgaatgtcgcatctatgtaagcaaagcttttttgaattttgatacaggattatataaaaatgattaatggtgtgatttataaattttaggaccataatacttaaggttatgtgtcacatgccaaagttcttgtagttttgtgtaacatataggtgggtcttatcaaatttaagaaacaaactttcactccttagcacttatgtaatttttagattttaaaatgaaacaagtcccttatttttacgtcgaatttgaatcgtatccctaaagcgcaatactaaaattgaatcaccatcttataaagccggattaaataaggtcctaaaacactatggatatctgttttagctgacatggcatcctactcagaacaaagaaaataaaagtatggggcccacatggaattgggttgcgtctcccctctccttatctctctcctctcccttcttgagctcatgctcgttggcccatgtcaccggtcagcctcatcgccgctcccaaaaaagacccgtattcagacccgatatccgtgaaaaatcttgggtacctgaattctttacccaaatttatcccaaaataatgtgttcgggtgggcgggcgggaaatatccgccccgttttcaccctagtcacagtcttctcgccccatgagccatacatagccttcccacctacctcatcatcgtcgagctcctgatttgcgtcgaggtgcacaggaagagccacacaacagcagtggccgaatgtcgaggggggctctcagggacctcaagccaccaggccgcaccgagcctttgccttctgcccctcgcggtctcgccgcccagccgatagaaaggatgggggagagagaaggggatgaggaagaatatgttgtttcacatgcggatcccacgtgggtttattattattattattgcttctatcgccatatcaacaccacaacaaccaaaaatgccccctcaatactgctgtaggacccatttgacctggttttgctagattagggacgcgttgtatctgataatgtgcttcaacgacgtttttcaaactcaccctcgacagaagggacctgaagtgaacttattt

SEQ ID NO: 53326 - DNA, 6461 bp, Oryza sativa
  unsure (1)..(6461): unsure at all n locations
ttctatcgccatatcaacaccacaacaaccaaaaatgccccctcaatactgctgtaggacccatttgacctggttttgctagattagggacgcgttgtatctgataatgtgcttcaacgacgtttttcaaactcaccctcgacagaagggacctgaagtgaacttatttcttttaaatccaatatccagcccaagcagggccagcacggcccatctccccatcggcgtggaaagtcgtgcatctgatcgtgatgaacggctacgattagaacaacgcggcgggggagaagatttcaggctcagaagcagccgccgccgccgccgccgtctaagccgccgcgcgcccccccgtcgaccgcgatcttccagtccgcaccccggcgcgatggccgacgccgccaagcccgaccccgcgtcgccgccggaggcgccgtcggcgaagaagggggtcttcatgcgccgcatcttcccgttcctcctcgccgccaacatcttcatcggaggtgagagaccccctgtgcctggatcgatctccctccctcccatgtggtagacatgcctcttagggatgatgcggttctttcgttgtgtggatccgagcgagaaggatcgcaaaagcctagtggatggatgatgttaggcatggttaggacttaggacttaggagcggttgtgcgactgtagggttagctgtagtctcaagctaaatgcgcttagtaattgttcatctaggtcacctcagtttggtttcagtgttatgttgtagatatgatgtgcatttttactaacacatggagtggattttggaccatcagatagagattattattagagcatttgtgatactagtgttataggattgtgtaagtaggatgaactgacatagctcggttattcctgggcctcgaatttactatcagaagcaacaagcggaagtgtttatgttctcctatagtgtttggttttgtattatgcaataatgtttgtgggactaggtggttagctccttgtattctggaatgatggatggtttgtggctgggaacatcaaatttcgcttataggggaccgacaaagctacttcctccgtttcatattataagactttctggcattgctcacattcatataggagtatatgttaacgaatctagatatatatgtgtgcctagattcattaacatctatatgaatgtggacaatgctagaaagtcttataacctgaaacggaggtagtagaatttattgctgcaggagggataaaagaagcaagttgtggacaccaagtggtaccaaatataaatacctctattttacatggtaaactgatgttttgtattggagtatatttcgcactggcaggactagggtcaaaatacactgaagcctggtttgggatccacgatctgtgagctatccatggggatgggctggggattgtgggttgcaatccaaattttagctacatttcttgccgtggagtttggattgtctagataaaaaaataagcgagtgggccagtgtctgctactctgctctactatttagtagggagttaatgggtgatattgagtgaattcaatttgtcaatgagaaatttgagggctttgctgttacaaagataaattcaatatatattttacgtattttccattttagtcaagtataattacaatgaatcatactgggcaatagtagcattccttatagagtttagaatgtatagtacggtatactcatgaatcttttctattaaaggatgggctatgcctcaaactagcttgattttcttgtattctgggttctactgaatggagtaaatatacagctcgcttgacgctgtgtgcttgtgtatcgaaagttacatttatctgctggatttcttctttgcaagaaggaaagggaaatactgtggtggtcatccatgagtgtaaaatggccacagaacacaaaaccattggcactaaccgtttatttgccctttgtcccacttgcaatatgtctttgcaactactcctggcctttgcatattgaaaatattgaaagcttaggtaggtttgcctctgaattctgatagtacatattgatggtactgttcatttcttgcgtgttgactaatatttggtttactgaaagctattttcatacagtaagtttgttccttttacatgcagtttacgtatttgcaaagacctacaagagagaccaggaaaagaagaacgctcagactgctgctgctgcagctgcagttgtagcattgtcatccccagctgccccagctgctgagactgtagatcctactcctccaactcctccacccaaaagagtgcttccaccaatacccgaagacgaacagcgccaggtctacaagtggatgctggaagagaagcggaagatcaagccacgcaatgctgctgagaagaacaagatcaacgaagagaaggcgcttctcaaggagttcatcagggcagagtctcttccccgtttgtgattagcatttcactggctgccctgctggccttgtttttttttttcttttgcctgctgttccatggaaggacatgttctggattttacacttgtctcttgtttgttggcagaaacggtagcattttgtatggtgtcaagtaatcatttgttacccaaaatactgagtcaagtggctccagtttcagggaactctggcattttaacatcattggcggcttggcgctactggagattttcttttaactaattcttgcctcgaagttctttgtctattttggttttttttaaggaggctgctataccacgggattctgtccaaacggtatgatactaagcaagtatcaaattctgataccaatcggtaacaaatttggtaccccataggtgctagacagtgttgcactaataactagacgaccatcaaatttttatcttttttttaagcatatataggcttcatctaggcgtcgcatggcaggtatctgcacggggcgagcttcatatagagggagatcatgctaaggccctctttgttcaggcttagacttatttgcttagacttttaagtcagcttattggcttacatgatttataagccagtgaatttaatgtcttaagttaagtggtggagtcatacatctatctcatataagccaaaaaagcttctccaacctaactattaagtggcttatggcttcaaaaaagccaaacgaaaaagctgcttatttgtttagacttagactttttggcttataagttggcttataagcctaaacaaagagggcctaaggtcggtgatagctacttctcagacaggttatcaggttacaacgcgcaacggatgtagcttgtttcgttgaaaagatttattgcgacgctttattgcttattcaaatatggtacagtttcagaatttcagttccaaaccaataaatcagaaccaatactgaaatactgaatgcacacatcacaatggccaacatccaggattcttcagatggggataatatggcaacttcaacaagcttataaatggtctataagtgtacagaaacaacccatcacaactcaattcatcttatgccgacgagttatccccatcctgcagacaaaaatagcaactcccagggtcagtcatatgaaaacactgttgaaacagactgtaagagacagtgcctacaaagaacaacaggtgaataaattgctttctctgcattatacctcactggatgtaatgaaatccaccacggcatcagaaagctctttacggtgagcagtgtagcagtgatttgctccctcgatgacatgtagcttgtggttcggtatatgcttcgcgaattcgtatgcatcttccacaggaatgatctcatcggctgaaccgtgaactgtgaaaaacctgaacaaagacaaataaagttgcctcaaaatctggtacaactggaaacctctgtccaaaacataagagatatgcattcaatatttcagctgtgggaatgcaagagaatagcatgttcagctatgttaagcacttatactgctgtttatttgaatataggggtaaaagcggttgagttagcttcctgacctgcattctttgctgatggaaaggcatgctttatgcatatcagtggtcaatcgttccatcaaactctcttttgttaccttatataaaacctttcctacattggaaatgacggacagtcaactaatgcgcgtgaaagagaagtaagcatacacagtgtatatgatttatctataaagtatctttgcaggtaaaggtcgcaataactgataggaacttccttacctgagttggttttgacatcaatgtaaccctctttgtcaattatattcataaactctttgcctagccgttcttcaatgcctttctccaaatgaaatcgaccagagagattaaccactgtgcgcacatcgtcatagatagaggcatacagaaccaccacatctcctcctggagataagaaatgttaaattcagtgactggatttttaagattaccaagtgtagaacttgcaacaaggcatggcaaaattcattgatcaagggatgcgatgtgagacagtgagagtaaattaaaaaaatccagaaaaagtgctatgctaaccatttagaaactttatagtattttctagcagtagattgttttgatgtacagtcaatgtgatagaaaatattcagccatgaatttctccacattttaactcgtgcatagattgtatatgaacaagagtataaatgccacgaccctntgctgtgaccacaanttgctttcacatcatatttctcctgattaagatgtgaaataacagaatgcaagtcatcagcctcctttctgtagttcccgtactggaattccccttcactttctctgaaaattgtatggtgacaggcttataaatcatgcattgatgccttcaggggaaaaaaagtgtagatatgaaagacaagtaacatcttaaaattcaaaggaacaacagataggaacctcagctcatttagctaattagctctaacttctaaccaaacctctagaaaagggaagtggctgccacggatgctgaagaggcagcccactggcgcacagcaggagcgccaatctgatggcctaccctttggtcttccacccacacaaccaaccgcgagatgtagccttcaattgctgttattctttttcttaccctttttcactagtttagctgatgtgaaaacaaagctctacttgaaatctcaatacaaagttacggaagtcttatgcatattcccgaaaagaactccagaaaaggataaaattgaatgccaccggtgaaattaattaacagaggatagaatagcatttacaacactagcttttgtgaacttaaatcagcatcgtacatattatctctagctccatgagcaacctacccatttccactgaaatcgaagcggaagattccaacccctttcttggtaagtgcattcgctagatcaacaatgatgctatcattctgaaaacaagagaccaagagtcaagcttcattacgttggtaaaaaaaaaagctaaaaattagaaaacttgttgcttctcagacaaaaatcgagaaaaaaaattagtgacccacatattttgaatagtacaaagggaatttcttctgtaacgacatatttatgcaccttggaagctgtaaagccatggcagatcactacaatcttgttggaacccatgtgctgcagcaacccaacgagtttctctccatgtttattcgttaccactaccctttcttcctgagcagctgtttagaaaccatataatagagttagagccccattgtttcgcttatgcttatgcatataagccaaattttaaaagttaaaacaacgagaggcccttaattattatatcggagtaacataatcttcttctccttttcttccccttcttttcgttggccaaaacatcattgaattatatacacacaaaaagaacgccctcttgtccgtcagctagcaatctaaacaatccacgttcaagtaaagaggatgaatccgggaggtaaaagaaaaaaagaaaaaaaatcaagggggactcacagggaaccgatgaaccctgggaagaggaggagagcggctccgccatggctgccgtatggcagcggcggcggcggtggcgtgctccggattggatcggaggattcccgggggtgccgcagcgaagagaggggggaagagggatcgccgaatctaatcggagagttggtttgggtagctaaagaactgtgttccactagtgactgacagggaggcaactgaaccctggagagggagagccaggttctacaattctgacaggcccttccgtttcggacactagcggaattcgaaatttcgtgaaatcaagtgaaaaaccggtaaattccgaacaaatttcataaaccaaaatttgaatacaaattccctaagtttaccgacaag

SEQ ID NO: 53327 - DNA, 749 bp, Oryza sativa
aatagaggtagtttgctgaaattttttttcttgatgtaagttttagtaaatacacgcaatacatcatttttttcgaaaatttatatcccaataggttctatgaatatcatagtatttataagattttattttatttttttcttttttatcaatttaaatttaaatttggatgaaactcctcgaaatctcagacggtttctactttcgagcctcgtcgaaatttcgtgaaatccgaccggatttcgtcggaattgtaaaccctggggagagccgttggcttgggctgttggaaggttccctggcccgttgaaccttggggcgtacggagcatagttttgtagtatagtactatatgagcttctacaaaaatggtagaaaattgatgtcaaacgtatctgaaagctaagtttgtctttgtgccgtgtgtgctactccctttgtattataagtcatttaacttctttttttagtgattttttttatgttcgactaaatttatagaaaaaaaatagtactctctccaggctgataatacttatcgttttagacaagggtaatgtcaaactttagaatttttaattataaatcttttttgaaatatttgtcttttaaatatggtgactacgtatatagattagtcttaaaaagtactttaataaaatcatatatttgttaacacttttatatatattataatgaaaaataatggttaaattgtttttttaaagacagtgcccttatccaaaatg

SEQ ID NO: 53328 - DNA, 4748 bp, Oryza sativa
  unsure (1)..(4748): unsure at all n locations
attttttttattttagaagttgaacctttcatgttgaaattttgaatttgagttgaaattttgaattttgagatgaaaattttcaaatttgagttaaatgttttgaatttttagatgaaagttttcaaatccaagttgaaagttttcaaatcttgacttgaaaattttcaaaactagatatggaagtttcaaaatgtaagttgatttttttaaaaaaataaattgaaagtattcacttgaaaattttcaaatctaagttaaaagttttttaaaaaatcttgacttgaaagttttcaagtctaagtcgatagtttttaaatctaagttgaaagttttcaaatttgagttgaaagtttttaaatctggattgaatgttttcaaagctgggttaaaagtttcaaatccaagttgaaagttttctaaatctgagttaaaagttctattatgtattttttttaaaaaaatactaatactaacagttatcattaccgctaattaatatcatcaactataataagtgttattagcactgaggagaggtcgagagagagagagagcgtgcgcggctgcgccagttaggaaggcccttgatcaactcaattacaatcaccgaaaaccacggccaaccaatttttggtccacataagagcaggtacaatagcaagctataagctaactgcaaacatattttaagaagataaataaggagagagaagagcagcgggctacagatttgtagcgagctgtagcacggactctaagacgtagtgtgtatatgacagtgggacaagatattaatagtgtagtatgtactatgggtatgaatgagctattagattagctatagatgaattgaagctagtagtgggctagaggccntgtttggataggctcgaatcntaggctatcancgtgtatataaggacttggcccctaaggaagcagcccaactaatgatcacatcaaactggctcaatagcggcccagataaaaactccagctaccaggaaatcaggaagcagcagcagttgtgctctgaaaccttttgcacgcagaattcttagtacaaagtaaaaacctgaaattttatacggttctactatagagtttgatatttacaggaatcctgtaggtacacagacatctgcaagaaacaattcatatcagtaattcaatatggacctacgaaatggtacactaatatacacggatacacctgctttctgcttatttgattccccaaagatttatacctgtttagaggagaaaaggcagagaaatggcacaaaacctacacaaggatcctccatcacaagaagtcatctctcgtgaatgaggttgtctcagtctctcagacatgcagaactgtggagaaaagagtaatttctgaagggcccatagagaccaggatgaataattcaacagataggttttctatacctaattagatgtgatgaaatccactacagcatcagccaattcttcgcgatgcgcggtgtagttatgatttgctccctcaataacttgcagcttgtgattcggtatatgcttcgcaaacttataggcgtcttccacaggtatagtctcatctgctgaaccgtgaactgtgaagaacctgaacaaagacggcaagttatctgaatatgtgcatggcatctttgttatattatagcacaaggtaacattgttgacttctaagttttttagtatacacgtctatgttataaaccgtaaacactaatgctgcagtaatttgctgtttcagtttacaagttcaaaagcaagggacaagtagggcccaggatagtttcctaacctgcattccttggtaatggacatgcttacagcacgtatatcggtgttgagccgctccatcaaactctctttagttaccctgtactgtacatttcctgcaccaggtaggacagatgcccatgaaagtgacaacaaaatgtaaacagatatgcaaagctcgaggcatacatgctgcaagaaacttggaagattaaggttgcacaatcgcacatgctgccttacctgatttatccttgacatcaaggtagccttctttatttattctatcaattgatccttcccctatacgttcttcaatgcctttctctaagtcaaatctaccagatacattaataaccaagcgtacatcatcataaatagaagcatatagagttactacatctccccctggaaaaatagatacatattcaaatttaacttagtaatatatggcaacaaagaagagaggacatatacattctgtgcaacaaaaagaaaagagcaccattaaagaaaaggtattgcggattagggacatcatgttggtattttgcttagtggaaagatgcaaaatttatcataaattcataatgggagtaaaacaaattggatatgatatgctccatgtgttccacagaacaaataatataagaatgtcatgttctgttcaaatgaatgccaagacaaaaccatcaaagcaatatatctccaaacagatgctgcaacaaggttttaacattatcactaatttgctatcgaacacagaggagcgtaataggcaagttcttgttaaagaactggacgatcttttttacttgctaatgatgaaaactgaatggaataactcaacagaaatgagaattaccagaccagatctacaaaatggcatatatcacctacctttactatggccaacaattgctgttacatcatacttttccttacaaagatatgatacaacggagtgcaaatcatcagcctcttttctgtagtttccatactcgaattctgcttcactgtctcctgaatattgtcaagcagcacggattgcaacaataaaagacagcaattaacaagatttatgcaagtaaaagtcagatagtgtgtactataatgcttcactaagtgcatttcataatggattacattttaaagaacaacggaattacagaagcacctccctcagatacaagaagatcaagtctcagtccatcattagttgtacattctaagagggagaatagccaagatggtccctaaagtttcgctcctgggccattttagtccttaatttttcatattgctcaaacaagtcctttaaatttgtcacatgggctgatatagtccttggtcccatcaaaatcgccacatggacatgccatgtcacccttctatgcaaaatctatatgatttgtccaatttatatttacatatatcataggaaaataaaaaacaaaaggaaaaattaaaaaatatatggtatatgtaagagcaaaaatatacgtcaaaagggtgaaaaaaaggaaaagtatttttttccctatggtatgtctaattcacccttacatttatttttctatgatatacataaaggtaaactagacaatttatcatagattttgcatgaatgatgacatggcatatccatatgacgattttggtggacccaaggattattctaggccttatgacaaagtttaaggatttctttgaactatttaaaaggttagggactaaaatgatcctacatagaaactttagggactacagtagctattctccccattctaagacatactcatgcgaaaaagaaccatgcccatagtctaagattaaagcagtattactatagcttcttctaagaactgaaattgctgggggaagacatggttttctggagcaaacttacccatttccactgaaatcaaagcgaaagacactaatccctttctttgtcaatgcagccatcaggtcaagaatgagactgtcgttctggaaaacagaagtgaatttacattgggaagcaacaagacaaactatctccacacaaatttatgtcgcttgcatttctgctaaacaaacatttgttcgcatctcactttaaacttattacaaacgcatttttccaaatgttaccttggtagatataaaaccatgacacaatacgacgatcttgcttgaacccgtgtgatgcagcactcccacgagcttctccccatgcttgttggttactaccactgccctttgttccaaagcatctgaccaaaagaaaagatttgataatcaaacaatcgaaacccattttaagaagtgttaaattaccaaatctcacagcaaaagagtggacagcacatatttcagcaactctgactgaactgaatatcagttgtgaccaaaatcagccgaaacctgatagcaatcaactgccaaagttttgctagttgaggccatatatatgatatgccccatatatcaactaatctcttgcttgcttttgattgttgaaggatgcctgacacgacacggcgcatggaggggagggcggcgcttacgaggttcggaggagagcgggtgggacatcgccgccgggggtaggggtcgtcttccccgcgggctggcgtggccggagccggtgcggttgcagaggagggctccggcggtgaggggcggggggattcgccggcgtggagacggaagagtgagcgcgggaggaggaggggagggaatcgcagctgctgcggcggatgtgctcaccagtggctgcataacgctccgtaccaagggtacatacaggtggggagtgactataaattcttcaaataaaccaaaatcactttattttattttgatctaattagttgagtttgttgggttaatcacttacaccccccgctacgatcacagggggatttcaaaaccatttgtcgaaactcaaaccgcacgaaaaagaaatt

SEQ ID NO: 53329 - DNA, 3834 bp, Oryza sativa
tcacagggggatttcaaaaccatttgtcgaaactcaaaccgcacgaaaaagaaatttccctgattttctcactgatgatttcaatcatacgctcaacttaaatatcatattataaactatgcaaaaaagttgttgtctgatatttggaatttttcatccaagcggtattttggtcattataataaaattgtacaattttaacaaagacaaaccagacgactatagtatatcataaaaattcagaaaaatgcaatggcatattagaacttggcaaacccagcaacatattgtatataacatagaaaaaatcagagacaaaaaaaataccctgtggtgtatttgcagaaacctatatgattcacggcacgatgcaaggttggtaatgcctagttgtgaggatattcttatcagatatgattacaacaactgttcaggatgatcatcccttatgctgcttctgttggttttgaaagatttcgaattcaatctcttttttttttcaggatgtaatcccatagatttcgaatttaatatttttttctgcaggccgaaaatgcagttgaaatgggccggagagtgaatttccacagcccaaaaggcccaaaccatagggagaaattcactctcctcctcgactccggcgacggcgataagcggctccttctcctcctccgcgactccggcgacggcgacggctgcgcctcctcctcgtcctccttccactccccatcgctagccttgcgctagacaaagcgcggaaggtggtggctgcctcgctgcaaatgagccaccgcaggcgacgtaacgccgctggccccgccgcctcccgaaggcatcggcggctcgtccacgcagaggcctcttcgacggggaaggagaaggcggatctgccgtgggcgtggcgctgggatccgagcgaagggtgctcgcgctggcgcttgctttcgcgcggcgaacgcgctgttggtgcgcacctacttcaaccccgacgagcactggcagtgcctcgaggtcgcccaccgcatcgtcttcgggtaaaactcgccgccctcttcgccggtgtttagcttcgaatccagcgggcactccagtccaagggagtgggatgcttaagctgctgcattttgtgagccttctctgttcgttcgttgcaggtatggccaccttacttgggagtggaagcgtggtcttcgaagttacctccaccccttcatctttgctgctctctacaagattctttcgctgctccacttggattccccatggttcatggtaactattttttgaattcacgccaaaaaattcttgtgtatttctctgaatgaagattagaaatgaagcttagagttataggattctggtttgagtcatggtgttaagtcacatgtaaaagaaatagaagtgctcagtatcaacagtttctcatgtaactagattcttagttgggaattgattgggatagcttacagttgggttcttaattctaaccaatccacaatttgtatcctgttctatgttcaatctcaatcctaagcaaacaagtccttcactataaaaggataggaaacctatatatatgtgaatcaaatatcactcctctctgcatggctttattttttttacgcactgagaagcagaattttcttattttttctttgtttttttttccccacaggcgatggctccacgtcttctacaatcagtctttgcatcttttggggatctctacttatataaactttcaaaactcattttcaataatcacgttgcccagtgggcagtatccttgaactcatttatgtagatatgatgttcctttttcgtaaataaacaagtccattttcctggtgaatggtgaccttaacaagtcatttccagctattttcacagcttgttaactggttcatgttcttctgtattacacggactctctcaaacagcatggagacagttttgactgttactggactttactattggtttgttgcaatagagtctgtaaagggaaattcggttgtttcaaagcagcaggctgccagcaagcaaagccctccatcaagaaaaatggctctactcatagcagccttagcttgtgctattcggccaacaagtgccataacatggctatatgttggtcttttggattttattcagatgaaatcaaaatcccggtttatttttctcgaggtcgttccgctcgggtatgaaactattttaaaattcatgtcaaacttattctcacagtatatttcgttctcggttttttgcactggatatgtataaattggatgaatttaggatgctgtctatggcaaatttttataatgcccttatctctgttatttcttgaatttttgcatcataacgctaatgcctattatttattgaaatttcgcattgaataagcattatgctggtgatatttaggatggtgttgcccatggtaagttgtctcgctagtaggttttctgaaaaacacaccaaacatattggatagtaggtatgtgtttccacatgctgcaccgttgttaagaaagtcattcacattgttcaagacaggaaggatcagcattaccatctgtcatgccaaatggcaccaaaaggaagaatgcatggttgattaccatatggtcataagtaagatggttatgcacaaacactagctttaggacacgtgcgatagattgtttatcgtgtcatcagcattatgcatatcatttcttagatgagctctcttgatcccttcagtttattttgttagaattaggattgccttgttatccaaacgcttgatgattgaagcattgcttttcttgtaaggtcatgttttctttttctcacaattgaggaatacttttataaaccttacatgctttctaatctgtctgcagggtctttgtccttgccgtgacaacgtttcttgattgttggatgtatggttcccggatcatagtgccacttaattttttgaaatttaacctcttctcttcaggaggagactactatggaacacatgtgttccactggtacttcagccaaggttttccatcgatgatttggactttcttaccgttttccatttctggaattttgaagtctcgagaatggaggcttgcaggtcttattgtctgggtattagtggtttatagcatacttggacataaagaattcaggtacttatctcttcgcacaagtttgtaatgttcaatctcttatcactagactagtacacacatgccctgatataaatggatcggatacaacaggtttgttctcccggtgcttccttttatgttcatgttctcaggacataacttagctgcaatggcacaactcaagggaaaaggtcacaatgagaaaggacgactttcgaggttgaagctctctgtcattctgctcatcctaacaaatgttccaatggctttatatatgtccttataccatcaagtaagtactactttaagtaaacatgttctttatgtgtgtgttttgggttaatttggttgctttctatttgtgcctagttaacttttcttttcaagattcctttacttctgttatgtgtatgtgtaccttttcattatgtcagagaggaactgaagatgctatgctttatctatcacgagaagcccatgatggaagagtaaagagtgtcctcttccttatgccttgccattcgacaccttattactctacattacattacaacctacctatgcgctttttggactgtactcctaggtgattattctttcattgtttctagtccagtagatatagcatttctttttaccatgttgtacccatcatagcgggtaccgagctcgaattcgc

SEQ ID NO: 53330 - DNA, 4944 bp, Oryza sativa
tgtctaacatttctaatcatgtttcaccctactttaatttatcattcgagaaatgatctatagtttgggcctttattttgatatattgattttttcccatcctttgtgatgtaattctatttctatgtattagcgccaacttccatgttttcacaaaaaaaaaatcatttccataactagaggtgtgaagaagttttagaggtttaacaaaacgaagacaagagacgagcagagctcctcttctagagaaactggcgccatcccaaccagctcttcaggaacaagttccattccatccatctcaaccaagtttcaaaagtgagcaagtaacaaagaggcaaaaggtggttgttttccaggaactcttcatagtctccaacagtccaactctccatcttgacctcccagcatctttccaatcttcctctgcatcactgaagtcatccacttccagtattgaagtgccaactatgtctttctctgaagatcttccatggtgaaagtaggacaaaccatcaggcaaaacaaaaaggggacagatcattccatggcaaatctttgtgcggacatactgaacctcataaatcatgtcaaatgtaagttaaaatcatgtcaaatgtaagttctcattgatttcctgtagtttttattgttgaacatgaacgatacatttttacaagatatttatgtcaggaaatgctaatcgaaactctgctataacctttcattggtactttcatactcatcgtctaccagtttctaaatgtagtgtcatcaagcttccactttgtccagtgatggaagggtcatactgtcatgagttttcaagcaaacatacagtttcaccgttagcactctcaatcaattgttcacgccaggtgcttcttattgcttttaacctttcagctacttctgtcgtcaatgtccgttctccccccgttgtactcaagcaacattttgccagttgagcaacatcttggaacagctctgttccaacacctaatatgttcttgtccaagatagattgaagcctgttctctttcagtgccagaaggaaaaggatgatgcaaggcttttgttttcatcagcactgtcagaataaattgccgtctttcctgtaattagctctagaatcacaactccaaaactataaacatcacttttctctgttagctggcgctcttgtaactttttaagtattctgggtctaggtagcctggagtcccctgtaccattttcataaattgtatttcatcttttggaagcatccttgatgctccaaaatcagtcacttttgctatgtacttgtcacctaggagaatatttggagatttgacatcgccatgaacgattggaggggatgctgatgaatgtagatatgctggagcttctgcagattcctgagcaatccgtagacgagcatccaatgaaatggatgttattctactatatttaccatgtataagctcgaacaaggtgccatttgggatgaattcatagaccagcatgggaacttccacttctaagcaacaacctagaagcctttaccacattcctgtggttgatctgtgaaagtataatcatctcttgcacaaattcatctttctcaaatcatattcatactctttgagcgctttatctgttgtctttgagaatccccttatatacagtgccatgaccgcctcttcctagggcctgtttagttcccaaaaacttttatcaaaaacatcacatcgaatctttagacacatatatggaacattaaatatagataaaaagaaaaaccaattgcacagtttgtatgtaaatcgcgagacgaatcttttgagcctaattaggccatgattagccataagtgctacggtaacccacacgtgttaatgacgaattaattaggttcaaaagattcgtctcgcggtttccaggcgagttatgaaattagttttttcatttgtgtccaaaaaccccttccgacatccggtcaaacgtccgatgtgatatccaaaaattttcatttcaccaactaaacaggcccctagttctctgcttgagtcaaaattgtctgttgcattctctagttctcttttgtgaatattctcacagtatcaacttgctttgaccggatttgctcatacagcagcagatccccattttgttgaaagaacctttccttttttctttcatcagctttcttttctggcattcgatcatttgtgcaaaaatgcagctaagcagcagaatagcgcacaccgaaatacctgccaagaacgaccttcttttagttaccacaagtcatggagcagttttctgggggtatataatttcctcatttgcatcatgtatactgtatctttgctatggaattgcagaatgtatcaggtaaatgaaatcaaataaactaatgactcgtgataattctcctattgctgaaggcccataacatttctcaatttggttacatacggtacttttttttctttttgcaatagaatgcttaatgtaatctgtgttgtgtgtaactatttgctgcaaaacgcgcgagtattccagaatcagagccgaacaacggggttcctgtttggcgcaattaaagatgaagcggtaatctggaaagaagctggggttttcaatgttttaggagagtaacaaccttctgtaacttgttttttcttttaggaagttgctgcggtggcaacatcctttcacttcgatactgaaacttgtatatgtgtaaatactccttttattaagtaaatttggtccgtctttcttaggccggcccggctaaaaaaaactatttctctgtgtcacccgtgtagcgtgtaacaatacaaggatgctatatatactcctacttgactactcgttcgaataaaagcagaaaccagtcgagaaaaacacgacaaaaagttattttctcccacaggatcggctatgtaggtacgtacttccgctttcccataggatgggcactactaatcgaggaaagtgataaatgaaagcgagcaccacaccatatgccatgtgtgggcacaactcaaaattatcttcttttccacttggagactatggccctgttcttttctccaactaaaattggattaaattttggatactcgtggcacgcttttcaaactactaaacggtgcgtttcgtgtgaaaactttctatatgaaagttgctctaaaatatcatattaatctatttttcaagtttgaaataattaaaacttaattaatcacatgttattacaaccacgttttgcgtgaaacacttaatctccatcttcatcttcatcttcagaactttcaaacaccaccataacatactcttatcactgtaagtacatcctccccacccaccaggccaccactgcgagagccgagagatacatgatgcgtgcacgtatgcacgattcatttccctagcattgccatccaccaaccgtaacgtaaccactaaccaaccagtgatggctgcatgcaggatcggactttttcattcccatgcatggcagtgatccaacatttttattttctttttcatttttttgaatttagaaacaaaatctcttccaaactcattgcgaaaattggaacttttttggacgcagcgttgtcacgccggccgaggggcgaaatcaggattatttgatatcaacaatgtatctttatcttgcttgctttgtatcatctaaataccatgtaaatttgaaaaaccacctccaatgtctccttgtcaccttgagtttaagattctcactgtaatatcgagaccgttttttcaatctattatgtaaaaagaatgtatggctccgggttttgggggggcccttagctattactgtcctttcgtcccattccttctcccctctctagtgcccatgttagcggcgaggaaataggagatctcttcatatgttcaataagtttctatgcatttttaattaaagtctttagaaagatttaaatatgtcaagagtctagggtttgttcttcacaatgtttatgaaattagattttgttagtctcttagtgcttttcctatgattttgtcagcggttattttgtttgtaagttctccaatgaaggtttgaaaatgctcgtatgtcaggtcattgattaactaattgggtttcttgatttgtgagaggaataaagatgggggctaatgcctttttatttaattttaattttgcatacttgtctgcttatatctattgtggtattgtggtattttttgatccagagcctccttttctttgttgctatgtctttgggtttcttttattgtaagaacaaggttataataccttgtcatttttaatccggagtcactcatgatagacgcgaagatggtgaacttcgttcaggggataaaccgcgtgatctagctcttggtgctcttagagaaccctcggaccccgttcgaactcctgtcgaacgccttattgcggtcaacttgctattgagacaaactccgttcaatccagtcattttccctgaggcagaccactgggtcggatagatacattctacaatagccgacctcaacaacaccttcttggctacaataggaccaatagctcaaggcccttcttgccctccagcaccccgtgatggagagtgaggtgcgaggaaccatgtcgccgaagaggtccccagtgaacatcccagtcgggacccaatcctcaatcccataaatcaatgacctattaatattattttcaacctttaaatttacttttagaaaaatctttaagtcgaatcatatcacatcttaaaaattagaaaaagttaacccataagaatccaattcataaacaaaaacaccatacttttaaattacacttaatttgttacatattcttctaaacaaacttaggttacctacgatgaagattatagataattgcttatagggattaattaaatattgacgatg

SEQ ID NO: 53331 - DNA, 3275 bp, Oryza sativa
agtattttatagaaacaccccgaagttttccggttggctctacaaaatgatggactagacgacctgagtttgaagtctcaccccttttaattatttaatattaggtcattccttcgtatttagatcttttagggagcatttcatctaaacggcccgtacaaatgcacggacaggattaaaaggggaacgcactatattaattacaaacccagatcatagcaacgttgacgcgtgtttattaatcatggttgttgcaaccatgattaaagtcttaattaaggcctgccgttattggccacattgtcactcactcatgcaccaaagtgatcaatgcatcacgctatgcttttcccccctctaaaacttcgtaaggatattatagatttctaaagtttaaggtggtgttttcttttaattaagatatgctcttttcttctcaatttatcatcatatttgtaaataagcaacgatggtatttactcatgcacagataaataaagagatatgtaacgatgacattactcctcctattctgcacacgtaaacgaacaaacacgcaacgatgtcatttaattctgcaagaataaacaaatagaactggttagatgatgaataatttgaaaatatcttaagggatgattaaattgggatggagatagtggattttaccttaatttgcgttagtacactttttaaactactaaacattgtgcagaggtggctccaagtgggtgttcaggtggtctatggaccacctgaattttggctcaacgtatctcatttatcccaaatactcgacctagtaataacctattccattttccaccacgcccaattctaggtttatcgtgagtgcgtcatacatgcgcagttgttgtgctcatctcatgtccctcggctgcggtgctgctattcaagtatatatgctagaatttttagaaggtgaagtaggcacacccaacgggaatttcttggagccgccaatgacattgtattttgtacgaaaactcttcatatagaagttgttaaagtatcaaataaatctaggtttataataattaaaattaatttattatgtgctaatagcttttttaacatggcctaacttcatcttcatttttattagaaaagaacaccaacttaggccagatgaagtttcactgtgcacatttttgtagaaaaaaaataacatgctgaaattaatttccattttttgaatacatacaagggtggtttaatttgatcttggagtggactggtcgttgctctaactaattgtaaggttgtactatatgcaactaccattgcaggtatcgactagtgataaatagccccaaattccgtgaggctctgatcgatatatatacaaccgtgcatatactagtgtacagtgtactggatgatcgagttggtgacgcatctctatccttaacgcctgctttatttgtcatctgtcaccgaagagcggccaaatctcccacccactttcttcttcacgagattattaatttccctcctccccggcacgcagttaattaatttcaccttaatcacactcaacgacgtacgcatgaaccggctaatatgatatgtttttttatcccaacagtataatactcacttcgtcctaaattatagggcgcccccattttaacaaaaatcaatctcaataacttactaataatcatactgagtatatctatactaagtgttatatcactagatttatattttgaaatactttcttgtgatgctaatttcatatttgttggaaacatactctctccaggttgataatacttgtcattttggacaagagcacggtctccaaaaaataattttgatcattatttttcattataatatgtataaaattgttaacaaatatatgattttattaaagtacttttaagactaatctatacatgtagtcaccatatttgaaacacaaatattttaaaaatgattcataatcaaatattctaaagtttgacctcacacttgtccaaacgacaagtattatcaacccggagggagtagcatgaaataaaatgctggtcaaagcatgtcattgaagacagtgtaagaaaaatatatgccttatcatttgggacagaggaagtagaatttattctggcttttactttataaaagctataaccagatattataaatattacaatacaaatgttatggattataaaatcataagttgatttaaaactacttaaaataccactcaaaagaaagatttttcatctatggttagtgagagtctgcatatccattgtttcttcacaatgccttacatgttagatgtaatcactatattccttaaaccaaaaatagaatctccgaaatcagcggtcgatcgaatcaagcacacatcactgccagcaactaatgtcgaaccaaagcgaaaagataaaccgaataaaaacttagctgtaaacaatcattcacccatatcttgcgaccaccatatccatcaaagccgattcaatgaaaatgcggtcactaacaatgccatatcaacatgaaacctccaatgaagcgcttttaagaaggccacaacatataggatcggtgtcacggttgctatttcaatcatccggactggttttcattcgaagactccacataaggcaatatcagaaaagagaatgtccattacaccgttcacatgcgtcaccaatgtcaatactccattgaccctagatctatggcgatttgagcttgacctcagcatcgagtggcgggtagcgacaatgatggaggtgactagcaacgggaagagggacaagacgcccgtgccaacagcacaacgttgtcccaccatttaaagagactgatggtagcaatgggtagggtggaggctctctctcacagtggctcgatagtaacttcaatgggcataaagagcacatactttggccatcctcaacctagaaactattaaatagtttccatacttgtcatgtcatatagacactatacatagaaactatatatctaatggatggtgtcttcaaattaaattctcatccaatcatctcccttctctctcctttatcgacctattctcttgtttcattcttcttggttctcgtgtagagacggtttcttcatcttttatctctctcctcattaactcttttgccacatcagatttttacttatgtgataatgtatttaatactatggacactatatgatatggagggatgtgaattgccttatgtatcaccaaattaaagccggatccggccaagccc

SEQ ID NO: 53332 - DNA, 1352 bp, Oryza sativa
  unsure (1)..(1352): unsure at all n locations
nnnnnnnnnnnnnnnnnnnnnnnnnnnnnnnnnnnnnnnnnnnnnnnnnnnnnnnnnnnnntttcttcatcttttatctctctcctcattaactcttttgccacatcagatttttacttatgtgataatgtatttaatactatggacactatatgatatggagggatgtgaattgccttatgtatcaccaaattaaagccggatccggccaagccccgctacttccttcctcgaaaaccacatgttcgtttctggcgttcccctccagcggcatcaagaaaagaaaatcacctcgattacacgagatcccctgaacacgcaagggtgttagttaggtgcagacggtaagcgtagctagatttttcctgaaaaaaggaaagtatgtaacttactagatgacaggattaacatggtttgtatatgttagttgtacgtaatggtaatctgacagccatgcatgtacgtacctgtagctaatacttgtgtaatgcgcataagtagttaccatgttgtaacggtgaaaaaaaaagggaaaatgcagcacaacggaactacatccattctcaaattgccagcttaggtagtacgtattgctgtgttttgtacagattttgatttttgggagcatggcagcaggtactagtactacgctactagtacttctgtagttctgtgcagaagcatgtgtacatgggagtgaaaccttccaacgtaatattgtcgttaacatgtgctttactttgatacccacacatgtcatcgaccacgtcactgaaaagttcacatcagaggaacttcttttgtgtatatggcatattggcgtacgcataacgccggagacagctcccgagcaaattgggcgatcatgaaaacaccggtgtataaaaaaaacactattaatcatggtttgggtcctagtggaaaaaactggaccgatgagtgacaaggacgacccctcggttcaccggtccgacggtctgaccgaggaaccgttggctgaaccacagttcaataactaatatatgcaatatgtatttcctctattacacaagtgaaaaagtgtaggatagctagagccaagtgcttctagtgcaaagacccaggtttgagtccccgcgccacaagcattatttatgttatttttgtacagacgagatagtcacgtgggcctggactgggccttgatatagcccattatctcctttgtccggtccgaccaagacggtttaatgctaggtttattcaaaactcggccggttcagccggttcaatccgagttgaatacatgtccggtcattcagcttaaccgtaccgtgtagacctctggctcggttttgtccggttgaaccttc

SEQ ID NO: 53333 - DNA, 4837 bp, Oryza sativa
gtaatgaaccaggaattaatttcttcaaccaccgggcatgactcgccatttacccgagttgttcactttgcttcaagacaacgaagtgagattgcttttacagttttacgtggctgcgaaaaataaagttaggcatgggcaacgtggcaaacacgtgcattatcagccttatgatgatcagcacaggtactaccacgcaacagcgagtagatattcatgctttcagatgcgccgcttacttacacacgaggcaacccatcgatcgatccatctgcattcgagctcacatttttcatcacaagaagggctgcaattaattaggcagctccatatcataagccaaagtttatacattaaaatttggatctgtttgaaaatataagtttttccgaaagttataatataaattataagatgaaaaataattgtgattggttgagatggaaaaaatagtgaaaaaatttaataacatgaggctgtttttagttgagataaaagaataaaagaaatatttaaactatgacataaaattttaattatattatattttagtacagtgggaacactttgttttgttaaggcagttgaacaaagaaagttggaacacatgtctcctccatgcggcgccagctagtctggttgacagtccacgtaagcaaagggcggccccacctgcagagcaggaaaaataaaacagacagaaaagggttggcatgtgggacccaccatccatcatcccaactcccagtctcccatccagattttccatttcattaattattaccgctccaaccactatcctaaagtagctaacatagggccggcaccggtcttccctgtgggccccaccagtcagcccccacccacacacactcttttctctctcctctctcctgattagcaacagtagcagcctcacttccactaatcacactctacagtctcactcctagaatctggtgcctccctctccctctctcatccacctccaacccaaacacaactttttaacagttaattaattagagattaaagcctttctctccccaatcccaagaagcaaacctagagagagagagagaaaatcatcagcaaaattaccaggagagggtgttcacctttgcccctgaagaagtggagattagtagggagagagagaaagcaattagccactaacagagagcaaagaggacaccagctgtgacttgacttacgagtccagtgacgcgtgaggcgccatggaaatggagatagaagcactactataaatatcatcaacgtattaaaatatagtaacctttgtatagataagatatatcttaatattaagaatttgatactcttcagattattggacacattctgatactatgtctagattcatagtattactatgaatttaaatactgcccaaatttataatattataatacgtcttatccgcttaaggttgctatattttttaatggagatagagagcaggagtagacaagaaaacctgggcgaggagagagaaagagagccaaggagagagagagagagtgtcctcatgtgccgtcagtgagagaggaagcctctcactctctccggtggagggaaaagcaccgaaaagcgcggcctttttttcttctttttttccctcccttgttcttccccacactccactccactcctcgcatcgcatcccatccatggccgcctccgccgtcgccgtcgcgttcgtcgtggcggtggccgccgtgctggccgcggcggcgtccgcggccgtgacgtacgaccgaaaggctgtggtggtgaacgggcagcggaggatcctcatctccggctccatccactacccgaggagcacccccgaggcaaggcgcacacgcttccccttcctcctcctcaccgtgcttctcagacggcgacgcctcctcctctctctcgccggaggaatgccggcgaggcggctggttgcgtggctttgctatgcttgctaacttgtttgtggggggtggtgcttactgcttgggttgcagatgtggccggatctgatagagaaggccaaggacggcggcctcgacgtggtgcagacgtacgtcttctggaacggccacgagccgtcccccggccaggtagttaccggcaacaataaccgtgaaaacaagttgtttttcgtgttcttgatgtggttggtttggtttggttgatttctcgcagtactacttcgaggggaggtatgatctggtgcacttcatcaagctggtgaagcaggccggcctctacgtgaacctccgcattggcccctacgtctgcgccgagtggaacttcgggtaacagcaccaagaacatcttgtgttcttagttttcctgcacttgcagtaagtagccaattggtgtttgctgtgagatgtctgaatctgggggttatgggaagtggcagaagtctttttctttttctttttggtgggtgtgtcaaattgctctatttataaggtagttaagttgatattgttgctgatgggggctgtttgtggctgcagtttggctgacgaggaataattagaatagaattcttgatgttgagttgatttgaaatatgctaattttatgctcctttaaccccttttggtcgcagtgggttccctgtttggctcaagtatgtccccggcatcagctttaggactgataatgagccgttcaaggcaagaatcctttgacagcactaactttaacctttactaatctccttgacccctctgtaaaaatttcctatgatctctgtaaaaaaaaaagaattgacttttgcgtgattctccaaacaggctgagatgcagaagttcaccacaaagatcgtcgaaatgatgaagtcggaagggctctttgaatggcaaggagggcctataatcctctcccaggtacgcttgtaatcgaaggtgcattcttggtatttgttgatggcattctcttcaatgcaacctacttttctgagtgtcccctgcagatagagaacgagtttgggcccttggagtgggatcaaggtgagcctgccaaggcatatgcatcatgggcagctaacatggcagttgcgctcaacaccagtgtgccatggatcatgtgcaaagaagatgatgcccctgatccaattgtatgtactgtaccacttctctttaatacagagtacatgtactgggggaagcagttcctcatttctttaatgttctttgtgaccgttgtccaagaaatgaaaggatatgatcgatcatacattgaatttcctttgttttaaaataaaatctcctccgctcttacatgacacatctcatacagtacatgccaattggggtagaaggtttcagctgagctacgtcttacttcgatttatctatgacagattaatacatgcaatggattttactgtgattggttctccccaaataaacctcacaaacctaccatgtggactgaagcctggactgcttggtagtgtcccttttctttattttcctgaggttcttatgatggctatgtgcttagctttcgccttacgtatatcttctgttccctctgcaggtatacaggctttggtattccagttccacatagaccagtagaggatctagcatatggtgtcgccaagtttatccagaagggtggctcttttgtgaattattacatggtaagtcccatcaatacgctttaaagctgaaatgtaccatgttattgagtagtctcaagctgtgacactgttgcttttcagtatcatggtggaacaaactttggacgcacagctggtggcccattcattgccactagttatgactatgatgctcctattgatgaatatggtgagttaagcactttacatatcttgcatatgattgcttattaaaccttaagaaatacagtatccattagtaagaggtatatactttgcacctgtttcctgcatgtaggcatttctgctatccaaacattacagacatgttacatctggtaaataatttgcaacacaacgggtgatgctctacgcaaaacgaaaagatatgggttgtaaaaggtccccttttttttctaccatctctgatactatgcaaatatgtaaaagttttactatatttttgttactgaaatttcactcaaaactattctagtagagctttattgaaacttttagtgtagtttgtttttgtatttgtaaggcatcttttaaatttgtctagatttgattttgtgaagtttttgaatttatggggattcaccaaacggtaataatttatttgagttaaaatatttttcattttaccccccgacaaaataaacatgtgagctgttggatgtttatctagttattgaaaaaagtgagttaaaaataagaaggaaaaactggatacctgctgaataggatggtccctatgtgctacatcatgtttaccaaattgatatgaactttcttcccttcgctacctcaggtttgttgagagaaccaaaatggggccacttgaagcagttgcataaagccataaaactttgtgaacctgccttggttgcaggagaccccattgtaacttcacttggaaatgctcagaaggttcgttacacattccgttctctattgtcccttagacctacaatattttgttctgaactgactcctccttaatttgctgttcagtcatcagtttttagatcaagcacaggagcttgtgcagctttccttgagacaaaggataaagtatcttatgcaagggtagcatttaatggcatgcactatgacctgcctccgtggtccataagtattctcccagactgcaaaacgacagtcttcaatactgctagggtgagatagatactt

SEQ ID NO: 53334 - DNA, 10519 bp, Oryza sativa
cccgccatatgcaggtgtttcttgatcctcaatacacttttcaatttgctggcaggaactgtttatggcagcgtagatgacccaaaactgacttatactgggaatgtgaagctctgggcaggcagcaatacaatttcctgcttaagtatagcagttggcctcccagtaagtagatgttcagcctcaggctcaaatagtactcttggttatatgctgtttgatccatttcagactcagttaccattttcctctatcatagaatgtgggagaacattttgagacttggaatgctgggattcttggcccagtgacgcttgatggcctgaatgagggaagaagggatctgacatggcagaaatggacttatcaggtatatatcgtttgccatttgatgaggtaataactgtttatctaataatctggagtgtacatgagaaattgttgtgtttgtacaggtaggactgaaaggtgagtctatgagtcttcattcactcagtggaagctcaacagtggagtggggagaacctgtgcagaagcagcctctaacatggtacaaggtaatgaagaaattattaattcttgctcctataataaaataatgtctatcattacactaatcctgttatgtcgcctgtttaggcttttttcaatgcaccggatggtgatgagccattagctttggacatgagtagtatggggaaggggcaaatctggataaatggacaaggtattgggcgatattggcctggctacaaggcttctggaaactgtggaacctgtgattatcgaggtgaatacgatgaaacgaagtgtcaaaccaactgtggtgactcttctcagagatggtaggcattccataaaagtatcattctatgataacattgtagtactgtttacacgagaagctcttataaatctaatgtcatggtctgtcaggtaccatgttcctcgttcatggcttagtcccacaggaaaccttttggtcatattcgagaagtggggtggtgaccctactggaatctcaatggtcaaaaagaagcatcggaagtgtctgcgctgatgtgtccgaatggagccatcaatgaagaactggcatacaaaagactacgagaaaccaaaagtccacctccaatgtgacaatggacagaagataactgaaataaaatttgctagctttggcacaccacagggctcctgtggaagctacaccgaaggaggctgccatgcgcacaagtcgtacgacatattttggaaggtaaaggatttgcgttcactgtgtcgactaaagcagcactgctaaagttagtctgtctgtctataccatgaacttatgtcatgtattgatgcctgttgcagaactgcgtcggtcaagaacgctgcggggtaagcgttgttccagaaatatttggtggagatccatgcccagggacaatgaaacgggctgttgttgaggctatatgcggttgagaaccgcaaactcagatcctcccaaatcatcctatatcttagtttcgacacggttttcggcttaccgaccttctggcaagaggtgaaagtcacagcaacagtgacgcacggaccgtcagaagttacagaaaatttagttgtaattgaagcatcagtgtatgtacattattctacatagaaattcactgggaaggaaagattcaggactctgcagtgcaggaatgggaaaccaaggggctgtatgtatggtcctctggacagtattggtttttggctggggaagggcgcataggagactctgctgatacatgagtccatatgcgcaatggcttttgcatattggattggaggatcaactctgtttcatacgtgatgtgatgattcatttttaagctcactgaaaactactgcaatgtaatgctggtaatgtgcagggtccatcattgatgtattaaattgtcctcttaattagctaattagcaatgtactaccttttcagcttataaataaatctgctgtatgttattcaaccgtatgtgaatgaattctctcaggtggtcatctcaatgcccacttgatgattaatctgatacacattcctgccccatttttgactgattaaagcagtggcgaacccaggatttttatcctgggtgtgcctacagcaagccaaaacaaaaacctcaagcacaaaagtacagttacatcttaaattatccaaatgtagtacaattagttcattttggggctcctcactccgaattgaattagatgctcttgaagttgaatttgatgctctaccactacctacagttatatcttcttgctcttcattttggggctgtactggtggtggtgttggtgaagcctgagcgtgtggtgattcctctgttgggattgaagaagaagaaaacaacaccaattgcaaagtctcattttctcgagtttcttcagttactcttccttcctatagttaccccatgagaaatgtgaagccctgtcctaggagatgcagaatctgaattagggaccttgctcaataaagaaagtatgcccatatttctgttgttcctttttatatctgacaaattaattcaacttgacctctgcctaagtgcctactgcctacaaaatacaaatcacaaaaaatgtaccctcaatttcagtttccaactttgcaaattgaatcgatgaatcgaatacaaaaatctcaaagtgaattagtgaaatgacatacctgcagctggatggactgctgagcgactgagctgaggactaggagctaccaagctgagcagctgccttgttgctgccgggctggcctgccagcgccacagaacccatgccgaatcgccgacccgccggccgccgcccggcgcccattgccagtcgccaccacggcaccaccgccggccgccgcagtgcacgagaaactgagaaagggattgggaaaagaggaaccctagagacgagaaaattgcgattctactgtcgtaaaatggtttcgctggataatgcaatcctaaaagtgttcactaaaatgctattttggtctttttttaatagaaatgattttactctattttatttttttgcctgaccaaaatacccttctctcttatctctttgaccagatcgaatcgatccagaaacgccaagaagcaggtagttgcagagcaggaatgccctgtgcgtgtgcacccccgccattgccgcaagcacaagcaagaagaagctttctcacgatctcttcaaggatttgcgaggaatcgttggctgagagagtgcgagatgaagtggagagcgagagatcgatgagttgaagggagagtctcgccggcgaggaggggatttaacgaccgttggtgctctctctgtcttcggcatcggctctagcgcccctccgcatcgactccggctccggcgccggcgctggcccccggcgctcccccacttgctcctcccctccctcctcccccaatccactcgcgtcgccgcctcccttcgcgtccgccaacaccggccgatgcgctcggagtggcgagctcctcctggtcggcaagcaccatctccgcatcctccttgccgttggtgcgcccaccgctccaggcagcggcggccatgggatcgacatggagcccgttcttctcggtgaacccggggccggcggcggcggatgaggaggaggggccggggaacatggcgcggccacaccggtggcggcggcgaggccgcgataggatgggggtaggggcggcacgccgcgccgtggcccggccgccggcgcgagggttttgggcgagtcggtcgccggcggcttctggtgcggccgctggtggagcgacctcgctagagatcgggatggtgggggaggaagaggggaaagagaggggagagtgtatgacaggtggggcccgcgtcaggggcattttggtctaggaaaaatataaaattgagaaaaaatatttatattcacacaaaagaatgaaaatagcattttggtgaaacctctcagtttaggatggcataacataccagtgaatcagtttgaagcgatagcattttaacgaaaccactcttttacgataatataatccaattttctcccagactctagcagcacatggcacattggctagcagattgggctgcctccctgctagcacgttgggccttgtaggccttgcttttgatccaacgaggcaccaatctattgatttggcccgctgctaatactacatactatatttttatgccggtgcacacccggcaccccacataggtccgccgctgcaacattatattcaacaagaaaaagttacaacctcattcttacaaaagagatataaacaaaacttgccaactaaattacttattggcattgcttgtacttgggtttgctaacatcacgtcaccaaggaatgggtcttcatgcaactcaatcccagtgcgcaaaacaccgtcatttcttacttgaaactcctccaaaaatttgtctagcaatgaatcatcagccattcccaattcatcccagctaatactatatttattatcatccgcaacacttgcattgattattcctatatcaatgctttcatatatctcattttgctgatgatgctcaacatttgtttccctctcatgttcttcttgaccattgataactatagcagcaacatcactagcaacatccatggtgccactaatatctacaccctccggtatagcaacaattgtgtcattgttactatgtaagaacgaaggacatgatgactctcgaaggatagcagggttaaaacgtccagagggagcaagacttgcttgatttgcaacattaatgtcaccaatactagatccactaggatcactcgagttgatcatgttcattgtgcagatggaatgagagtttggtggatttagtgatgtccctgcaacttctagtaaagcaggactcatcatacttgcaagaactgtggggctactacaaccaacaatattgtctgggatattattgttggcgaacgtgctgatattgtttccttgtaagcctagaccccttgctatgttgtgaatgagcaacattgatctattcactatgggtgcagaagccatcatcggggacacttcttgtgataaggatggatattggaacggtatatagtgagaaattggtggcattaaactaggagtaatagggatggccggagtatatgtaggagcaaattgtggcagctgatgttggtagggcatgtgagatgtggaaggttgatcgactaacctacaacgctttgtagtaagtgtagaacaaggagtggatttgtgtttcacacgatgattatggaggatatcaacaagaaagtcataagactctgtggaggcaatggctttagcaatatccgtgtctagtatgatgcaacgattatgggattgagcagatgcccatgcacgcacagcaagttcttgtacgaagagctcacacatcttcgataagaatgctggcatgtcaaaggtcatcatcatgttacccttttgagaagatacgatcttcttcaagcgggccatagggatcgcatgctcgctaaagtcctttgttgtttcaatctccttttgtcgatccctccaaaattcatccatttgttgttgagcttttggcgccagtagtctcaacgatctaggtacgtccaaagtttgctccattccttcccttcgttgctctgaataatagacctacatagcaagcacacacttttgttacttctttttcttacttttctagttcaaaaattagcaaaacgatgttacattgcagtctaacaaaaagagatagctagcttaattacaaatcaaatagcattgctcaaatcacaaattttcacaagtaccagtacaaaaactaattaatactaggcacaagaataataagctagtaggtgcattaccttacttgagctgcaactacagaaaatgctacctattagcactaattggttggtagtatgaagatgaacacaatatgacacgaggatgaacatagtatgcaaggtggggtggtttatataggcctaaaagattctggtttctatgatatctgtattgttgagaagggagacgaaaaagagttgaagaaagaaaaaaaggtttattagtttcttgtgggtttggtgaaatcttttagccttgcgtgtatcttttccagtgaaacagctagctttaatatatgtggggctcacaaggctaaaccatgcattccacacttcttatgctaaagacaaccaagataaagtagtgcagtttatttgcgtaacatattagtcatgtcacgaattgacttgcttgttaattgaacatatatttgtttgtcctctcctataccatgcatatgcatcatgatttcaaattgatgtgtcatacatgctaatctatctctaagttagctagctgatcaacggacggttagctctagatgtgtgcaagatatatcgaggagtttgttttgctttagattcacgcatatatgtgatagcttgattccagccaatacatgctacgtggtttaatgatggatggatgcatggattgatgactagatcagtagataagtactcgatccattgctagcaaactaagtgtactttcggcgcctttcctgctggagaattttgtattttagcttaatatcctacatttcttttgtacattgtgtaacgcaagcaattgtctaatgacctatttaataataaaccatgatgtccatacatatatgcatgatggactttggctggcctacttgcttgcagtaagtgcatggtttgcatgcataccatgcatagatcatgtgttgtttgtggtcctagctacataacttatactccatgtacttaatactttattacttttgtatgttattcagcaaccactagctaacaagctttgtatgttagtactttacttttgaatgctaatatagagtttgtttgccacattgctctctctcatgactcgccatcttttcaattttatacatacttaattacttttgtatgttagcagttagctacaagcgacgcctaaggaaaacgggctaatcaaatataccactccaaattgtacattgataaataaactcatggaacttgctagcttaacaaagagtaccataccacatacaaataaatagtgaaacacaataaaagataaacgaaatagttcaaggcatatatagcactccctttattccccaaaaaacttgattcctagtcatcccaagtattttagtagttaaggataaaaacaaaaagtgcccctcactaatagaaaagtagtattttttttttgacatgaaaatagcaggagagactcctactgcaatatatatatatatatatatatatatatatatatatatatatattataagagagagatatttacaaaggaagggagagagggagaaaacagaaaacagaaaatttacataaagctatctatccatgattgccaaagtatagaaaagtagtattagtataaggggtatggaataaataaaacttcataatttatagaccgatggtaggtaagctaggggctataaatcaagtactttacccgcaaaaacaaaagaaaccaagtctttttttgaataaattttaaatgctagaaatcaagtctttctgggtggagaaaatcacataaactagagggacttacatgggtataggtagatcctgcctttggctcgatacatgcaagatgatgtagatggaaccttgtttgtaacccacaaattttcatgtttctagttcctactatagttgaactattacatgtgatattcctgtaaaattcctgcgtccccgacctaatcttcaccctcatgttataaaaaaaacatcacttgaattagtaaattaatattagagactaattattggttgcaaaaaaaaacttttgagttgaaaaactcataaggagaagataaaattaccttgtcatttcgatatatggcatgtatcaactttgcccatagataattataacactggtatcaaccacgaacagtatactcatcaataacgaaagagatccacgggtagcataaaaggctaaatatacacgaagaggaagagatgattgaggcctagtagcccttagagggtaagtataacaactgagcgctaggagatcaaggctagagaagctgctcaatccatcggtgctcctagtgcacattgtgggtcgacttttatagtgctttctatgctttgggacttcatctttctggagggttcggtttggcacgatatgccaattgtcatgtgctccgcccgttttgttttcaaagcatattgtatttcaatcattttgcgaatataagtatgcacataaatttactgtttttcctattttcccacaataaatcagatagcaattctcttctataatttaatgaggaacatcttcctcaccgatcacccatccataggttttactaagtttttttgaggtagtgaagtgtgcatgcacgatcattttatcacctatatattttttttactcatatataatcctctcaatacttgtgtggttgctaacgatggaaatgtctccatttggggcagggccctacaaagaccagggacatctagccctatatatctaattagatggttagccgaaatcatataggccatggatgagtccatgtacttttgatcggcgaggtcttggaagtataaaatgcatggaacaaagtggcataatagaccaaatagagatataaagatacaagtatagtcctaacctatgtggctcgtttagttgatattagtcccatatgatgtttacatggcactacaaggaaaaagtaaacgacaaaaaatcaatagcaccctgcatgtcaattggtgttagttaaaaaaatagtaaaaatgtttgtgaggcccacatgtttgttttagggcctgttcactttgatgccaaaaaaaaccttaccaatttttggcattgccaaaattttggcatagttgccgaaattttggcaacttgccaaaaattttggcaggatttcttatatagttaccaaaatttggcagtaaactaaatgcagccattttttttcgattttgctatatctcactcgaaagatttttttcttatctctcactcgattttctcactcaaatttacagtgcattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcggattttaatccaaagattaaaaatctgtgtgatacgatcataaaaatctttcgaaagatgtataggtactcccttttttttgacaactttaccaaaacttggtaaggttgaaaatggcattaaagtgaacaggcccttaatgacacaataaacagtgcatgggctaactcggtgacctacgatgaaaattaaggcccaatatcatccaaaagtgcaatgccgccggctggcatagagataaattagcattttgattaatacatttgttgtgtgtgtctatatatatatatatatatccgtgtattaatacccttcagtcttatcaaattttcttccgtgtatatatatctgtgggcgatcgctactagtactacctagtagtaatagattagtattgtgatttatacatttgttgtattaatgaccttatggtcacaagacccatggctacctacctagccaggggcgggcccactagtgattcaagggtattcagatgtatacccaagatttttggacaaaaataagtatacgtgctctttacttcgtatatgtattcaaaaaattaaaaaagaacgcttaaattagtcatcttgagccctgtttcatcatttatactctattgggccgaaatttcccactcccctccactttcttcttagcctgcactcagtttagaccgcaactagtccatttcccctccccgcctaggcacagcaaacaaaatccttaattcccaaatcgggcaaaccctaaccgagtgaggagaggacgtgcggcgcggcgacggctcgggcgtgcggcggcgactacattgactgcggtgtgcacggccacgtcggcccgccaatccgccatggcgctagcgccactgcccactgagctgaaccgagcgctgaggagcaggcgagcagcctgcagccaagcccctcctgggctcctaacctccttcaccggtagtccggttcgtcctccttctcctgttccccagcttcctattgattgttgtttggtgaaagtgttgtttggtgaaatggattgggaactacattcagtgatttagtatacttgcttgcttgcttagtttgtagaattgtagttgcatagttgagtatttgagtaattgagtagtggtctagtggacactgggcagtagttcatagttcttac

SEQ ID NO: 53335 - DNA, 1186 bp, Oryza sativa
actcctctattttagatacaaatcgttttgattttgatcaaagttaaactattttaaatttgattaagtttataaaagaaaatagtaccatttttaactgaagacaaatataatataaaaaggtatttcaattatcgattcaatgaaactaatatgggatcataaatattatactatatttgtttacaaacttatttaaacttgaaatagtttgactttggccaaagtcaaaatgacttataatctagaactaagagaaacggaaagagtaccggattagacacattttagtgtgtgattaatagcactaggatgtgtctaatttagtaatattattatattttagatcggaggcagtagatcatttgactaacttctctaaaaccacgttttgtattaaaagggcatttttttttctatcgcattaggcggcattgcatagatcatttcttctaagctatttttaagtttttatttaaatacttaatttatctttatagtaataaatagctaattcgaagtgataatccggtgaacaatttgtttcaaaccaccgattgacaggattagcgtcgagcacgttctgaaactaaaagacgcagtataggctacacagacgttctgaagctgagaggaatgttcatgggagacatggatgtactgtacgtagcagagatgaccaagataggagtggccaatatgcgctggaaaaattgtcacttgtgcggctttagacccacacgctggcacgcactagttcccagcttgatcgggtttctcaccaacttctccatttctttacgactccctactccgatctcaaacataaggtatctttgaaagatttgtgggtaagtatcagtaagtaggtcaaatgactttgttgctttctactatcttcgtttttaaatgtataatattattaatttttagatatacgtttgatcattagtcttgtcgaggagctctctagcgggagatcgtgagatccccttttttggttcggccgggcagcgggtgagatccgaggttttcgaggcaaaagagacacaagggatttatacaggttcgggccgctaaggagcgtaatacctactcctgtgctatgctcctttagtgaaggattacaagatccccttgttgaagtaaaatgtggtgttgatcatccggggctagagattgctct

SEQ ID NO: 53336 - DNA, 1211 bp, Oryza sativa
  unsure (1)..(1211): unsure at all n locations
tcacgacgaactgcaaaggctatttaggtcccttaacgcccttccagagggcgtgaggcgtctagatttgtaaattttcaaaactaaaaattatttttaaaatattttaataaaaatgtaaaaataaaaaaattccacatatggatacatatgtgtatcttctggtgtaatgactaggtgttagcattatcacaagttgctcatcgtttaacgatgaattgaaaataaaaaaatctataaaaaaccctacttaattttgacttaaaaagaagaaaatgtagtgtaaatttcacaacaccgcttttggggcacccataacgtaaaatccaaggtattatatatatatatatagctagttgaatgcatgtgctttgctttcgatggaagaaaatatattataatattccataaaacaaataaaaatatattttctataaaatgtgtttcacattcctttgctatagggaatattgacctcattttgattttatgtggctatccatttatatatgattattttaaaatatgaagaagtttatgattatgaatggtcacattatggttgaaatactgaaacaatttgcaattagggaatggagggtcggccttagcgagccaaccgtatctatttccacaaattatgccggccatatgtcttgatagccatacaacacccatggattgatggatgtggcacacatagccaaccgaccctttttaattcctacccatctcataccgctcctatntgtagcctcctcacacccgctcccgcacaactccccgaggtggtattattcagatcctcggcttgcgcgggtgagatgggcctattgttattttccaccctagcggattgttttgcaaaaagatcatcgtgtttgcacggaatatcgcatacgtactcggcagcctgacacccccattgtatttattatgtataacccctcggcgtccagtaaaatacaacgcgaagaagagaaaattccgtttctaagggtagcgttgtaaacaagacaaccatatggggttttctgcaaaacgtgatacactagcccccaaactgaaaccctcccggattcagcttcagtgacatagggtatgtatgtcacacgatgacataccgtgcatctcggtcatccaaaccgaatccaacggctgcaataattgggcccacctgcactctaaagtatctttgcaggtaaaggtcg

SEQ ID NO: 53337 - DNA, 797 bp, Oryza sativa
cgattttttttattttttttcctggttggtataaataaccgggactaaaaatgaatctttagtcccataataagggtctgacatatttttgaaccaggactaaaaattatatttagtaccgggactaaagatcaataaagtatctgcgggtttttaaaccgggactaaaaatatttttactcccggtttttactcaaaccgggactaatgtgatttttacgtgacccatcaaagatatttctccagtagtatcactgatcttttttaaaagcgtatgttaaggagtgcatcatggatgttaacgcaatccaatcagaaaatcaattgtgtgtacgcggaaataagtcttccatgtaatgtctaaagatatgttgcgaggagtagcttgctaagcataattggctccaagatgaatcctcactcttctctatctcctcccattcaccttccccagatgtggccggtggcacttcctttccagatgcggctagcagcggatttcaagctcgagtgtcgtcaccgtctccctcgagaacaacccctccctctcccttggctgcgcatgactctggtggtggccggcggtggctgctgtgggcgaccggcgagaaggaggctccaacgtcaacgagggagtagctgaagaggaggaggctaggcggagctcacgaaggagaagggaagcacaacgaaggctgaatcggagcgtcaccggcaagggcggagatagaacgaaatagagagcggtgccacttacttaatttactctactttagatccagtttaagccaatgcca

SEQ ID NO: 53338 - DNA, 3570 bp, Oryza sativa
  unsure (1)..(3570): unsure at all n locations
nnnnnnnnnnnnnnnnnnnnnnnnnnnnnnnnnnnnnnnnnnnnnnnnnnnnnnnttttgaaccaggactaaaaattatatttagtaccgggactaaagatcaataaagtatctgcgggtttttaaaccgggactaaaaatatttttactcccggtttttactcaaaccggactaatgtgatttttacgtgacccatcaaagatatttctccagtagtatcactgatcttttttaaaagcgtatgttaaggagtgcatcatggatgttaacgcaatccaatcaaaaaatcaattgtgtgtacgcggaaataagtcttccatgtaatgtctaaagatatgttgcgaggagtagcttgctaagcataattggctccaagatgaatcctcactcttctctatctcctcccattcaccttccccagatgtggccggtggcacttcctttccagatgcggctagcagcggatttcaagctcgagtgtcgtcaccgtctccctcgagaacaacccctccctctcccttggctgcgcatgactctggtggtggccggcggtggctgctgtgggcgaccggcgagaaggaggctccaacgtcaacgagggagtagctgaagaggaggaggctaggcggagctcacgaaggagaagggaagcacaacgaaggctgaaatggagcgtcaccggcagggcggagatagaacgaatagagagcggtgccacttactaaatttactctactttagatccagtttaagccaatgccaatgcctatgtttgtattacgggagtgcacacatgataaaaataggtgacgtatagctaaaaacttttattgatcggcccttgggcaccccccctcctacatactatagctctgcccctggtcaccggcctggcctcttcgcgcgctgcacttgccgccaccgataagcccgcaggcagcgtgcctatctgcttgcttctagtccgtgcatgaggtgcctcggcgcaccgtgaaccctgagctgggagaggggaggagcaatgtgtgtccttgctgttgttgtcatcaccgccatggccgtgcgatacaaaggtggaggcaaaggggaggaggagggcaaggtgttggaatcgcgcttcgcaggagagttgtctgagttggcaaggagctttgaggtggcggtggcttcctcttcctcgcccttccatcaagctgctcactagcctcctccaccaccgccatcgagcacgccgcacgttgtgccgctgcacgcggtgaccgtgctgctatccaactagccgtcgctcctcagggacgcctgagtggcagggcttgagtagccgcacccgctctagtgccgcatgctcaacctctgcttcatcgtggccctcgatcgcctcctgacatgcacggagcaccagcattaccacgggcggcgctctccaacgcgctcgccgccgcgctcaagcgagcgcgtacacacatcactgccgcatcggcagcgtcgaggcaaataaccaccgcgtcggcttcgaggcgaagagggagaagagagaagagggatgtgttgcttgcatgtgaggccaagcggctcaacctcacagttcgcacatcgacgtcggttctggtttgcccccgcccccccccctttatcgccctccttaccgacatggacgccctccctgtccaagtgaagagagagtggtgaagagtgaagaggcccttacatgtggggcccatgctgattcaacactgttgactcgggtcaaattgccacaatatacaaaaccacccgctatattgccatggaactaatattgcaccggctttgatagttgagggatccattctatctattattgcggttcaagtacaacaatcgaactcgtacccaagggatctaaaatgaacttattcctcttcaattttgtcacattgcttttaagtaaaaaaaatgaaaatttataagggttaataaaccaatgcataggtccgaaggcccagatgttctaagcacagatccaccctgggccagccagtgtgacatgtgatgttggagccccactatacttttgatgggtctaaaactttctctagcatcgaggcatccgagcaaattaggctcttcctttgcaaagctaattctcggcccaatataaaaacgatcaaatctctgccctgtttggggtaaactttaaaggggcccaaatggagatggtcacacgcatcttctcttttcctttttccaaatcgattttaaagtcaagaaaatcttccgttttaaaatctggagccacaattcgggctgccatcgtaatcatattcatagcctttttacatcttttcctctcttttttttttctcctatcgaagaacacgtagagcaggtactattagccagctataaacatattttaataagataaaatatgagagagaagagaagcgggttacagatatgtagccagctgcagcgcggactccaagacacgatatgtgtataacaggtgggagcatatattaatagtatagtaagcaactattatatgaattgtttattggattggctataaatgaattggagctgataataggctatactattaaacttgctcgtataccgctcgtgcttttcgtagctttcagtgccacgcatcatatgctatagcattgcagtatggcaggcacacacaaaatcatatcaaatcatgggcatctaggcaacaacggccgtgtgtcacgtgcccctcacgttggcggtggccatcgacgaggaaaagaaggccatgtattccgttcctacttgggccggggaggaggaaaaaaaggtcacatgaatacggccacaaaagacgcacatatagccgtagcttcctcttgtctctaccctacaactttggaaaagcgctttggagatgttggctgcgttcaaagatagaaaaagatttattgtgaaaaagaaatctgcgcacacgcttcttaaactgctaaacggtacatttttcacaaaaatattctacagaaaagttgtttaaaaaattatattaatatatttttaagttaaaaataattaatactcaattgatcatgtgttaaagactagtcttattttacgtatcttctcaatcttctattgtctcctctcaaacacagttatagtggatgcattgacacccaaaaactagaaaaaaaaacaaaggaagaaaagaactgatctcacgtactcaaaaccaccggcgccatcctgggacaaattaagtccgtgtgctgttggtaatgtcgtactagtagtaatgaactctactcgagccaagaatgaacgtagcacgaatctttggctgcagcaacggtcaagggaaaaacttctgcataaatcatggacggaatccaagcactgtcaggctaggttcaggtgatgtttaatttcagcacgaccaactaaacagatcatgtctcgtcgtgtagctagctcatgtgcgtttaattaagtgcccatagtcaataagcagacatgcacgagctttgagtggatttaatctcctctttaactcttcttgctctgaatttgctgatgaacgggagaagcgg

SEQ ID NO: 53339 - DNA, 4711 bp, Oryza sativa
  unsure (1)..(4711): unsure at all n locations
actaaaagatatattatttgaagaacaagtaaatgcaataatttagttatctggatatttttttatgattgaaaatatagctcttgacttatgaatggtttgaagtaataatttaaattattaagcgtaagttattattataatctagattattagaagtaggctgaaataaacagatagttttataatagattactacaatctataaaccatattagtataatatggtaatccactttaaaggaatatttttagattattaggtggctaacagctaacaaacagctaataattcaaagaaaaaaattagctaacaacttataatccagtttatagtaatctggctcaataatctaggttataataattttaagctgaaacaaatacagtcttacttgtttatgacttttgcaattttgtggcaaaatggccttcgtcgtctccttttggtttggaataaaagtaggggctgaaaattgtgccaagtattcctttgataatgtcactatcacagctttaatttaactcaaaggttgtaaggttgttttagcgaattagccttcgacatccttgatgctaaggtcatcgactcatggttagagcttagaaccttcagcgattgaattattgcttgttactaacttattcagacaatagcgtgacacaattaaacaacaaggtaagcgattagtttatgttatggttttttaatttggttactataatttggttactataccaaacatatcagtccttcaattggttggtaggcaaaaaaaattggcataccaaattatttggcttagttgaattaggcccatatatggaaacacattttggcagtaaccaaacaagaatctagctattttttaccaaaataattggtagtaactactaattcttgccattgctaaaattttggtaaggataagattagcaaagtatcaacatgccctatgatccaagcaggaacatttagtcatctactcttgtaagaagcaaatttgattctttcacccaacctcttttttttttaactatcctggatttccgtttgttaaatcaatcagattgttttattttcatttttttttctattctgaatttgtgttgcttagctaaatgggattattgttttcttcctgatttcatttattaatgctatgctcaaactgataatccccaagataaatacttgatgtttatgataaaatttgattaaaactttatttttatattaaaagataagtattaactcaataagtgtaatggtaaggtcaaccaacgtatataatttattttgtttaaaaactaagcatgagtattatttctcggattttttttaagcaatatcgaatcttgtcttaaacattggaggaagtatattgcaaatgccagatcatatatttcaagttgtaaaatcttttggaaaaccgcctaaaaaaataaaccccatcttttcgcctacattattagattacaagctgtagcattaattagcgactgaaaaaccaatacccgaaataaactacagtcaaaaacatcaaaatcaaccgtaaaataagatttgaaatttaattgttagatgtggttgataaggtgaagagcaaacgatggagctccttgttatgattttcatgaattccttgttaccatttgacgaggtacctcaagctagcttgcctttttttcctaataagaaaatacgagtaactctagagagaaaaaaaaaggtaattctagtttatggtaaaaaaaatatagaactggtgccactgttggggaaaaaaacaacgcaaatatgccaccttttagaacaaatagaacatccgcgctctgcaaacttttgggacctcatcttttcgcatatgcttatgcttatcagccaattacttttcatttacaaatatgtcggttcccttgctacacacacaatttttccaagaacttggtgatacactgccttttgcaactgtcaatttcaagccaaactctccaacaaaacaccagtatggcctctctaaaatagactctctaaacatccatatggccagctatccatcatttgatttagcaagtcaaagtcgttgctcgctccaacagcctctctatctaccctctattacaagtctattacaaatgagacccatttgtcaatctctactacccttcttcctcctcttccacccccattttccccacccatactactgccgacctcctccccacaccctctccgatgcaacgacggcggatggcggtgcaataagcggcggcggcggggaggcgggctgcagcgagcggaggcggcgggggcggtggactgcggcggtggcggctgcggcgagcggaggcggcgccgcgccggtgggctgctgcgagcggaggcagttggctgcggtggcgactgcggcgagcagaggcggcgggtgcagcaagcggaggcgggctacggcgagcgaaggccggcggctgcggcgaggggaggcggngactctncccttctnctnctnctnctaccactcgcctccgncaccgcgtnctctacgaatctcgcgccgacatgccgcccccgatccacctctccgcggcggccctctcgcggcgggcgaagtgccgagagctgaggcggtagtgccggatgtggccggccgggagcgaaggcggcaacgcttctgccgggggagcagcgcaagagggatggggatgaagcgggcgccggcgggatcggtgcggccggaagaggacgactgaagcgcggcgcggggatgaagccggccacatcctgcgagagcccgccgcttctcggcccagcgtcctgctgcggtggccgtctctcatcggagctctgctcgtcggtgcccgcgcgccgcaccattgaagtcaaagagagaggagagattggggtggggggagcaatgtggggcccaccactagcaactggtttggctaggcaggcaggatggccaaatttagctagctaaggagccaatttggccagctagatggcttggccagctggatagagtctgttagagtgctttttcctcctaaatttgctagaatgtcatctagccattctctcttggagatgctctaaaatagtactcaatcatnnnnnnnnnnnnnnnnnnnnnnnnnnnnnnntctttttttcttctttttttttcacgtaggaagacgtggttaaggaggcaaaatacctgagagagaccaacgagaggctgacgcggcagatcgagcagctgcacgccgaccactgcgcccacgtcgggagctcgtctacctcaagtgggtcaacgcctgcctccgctacgagctgcgcacccacgacggcgacgacggcgccggccggatttcggcgagggacctgagcaagagcatgagcttccggtccagcgagaaggccaaggagctcatgctcaagtacggcacccatggcctcgacggcttcgacccctccatcttctccccgctccacgagtccgtctacggcgacggcgacgggacgacttcgagcagcgaagaccgaacggcgacgtcgtcgtcgacgaggcgccgcggagcccgagcacggcggtggcgatggccgccgcagctgcgggggccgagtcgctcgtcgagacgtggcaacaagctcaagttcttggggaacatcaagaagctgctcccgaccagcaagaaggggcacggccgcggcgaccggagagcagcaggaagcaatccgcggcggcggaggcggagccaccgcgggacgagcacctggagaaggcgctgcagtggctgtccagccacgacgtgctggacgacgacgactcgtacgagagcacgccgctgtcgtcgtgcgagcggacgccgctgagcagcgtcacgacggcgggctccacgcacgcccgcagcaccggcggcgccgccggcgagacggccgccgcggccgcgtcgaggctgctggaggcggagacggcgcgggcgaggagcgacgtcggcgcgtcgtcgtacgggcgggaggcgccgagccggtaccacgcgctccggccttaccaccccggcgccggcgcaggcaatgtcggcggcgacgggccccgcgcgtcgccggagaagcgggagctgaggcggcggtcggaggagctgagaagccccgcgtcgatgttcgcgggtgcaagggataatcgcatgcatcagctgcagagcaatgcttaattaaccactactactattactgaagtatttacagattaacagaaacctgctgcatatgcgagatgggatataatgcaagtttttttttctttttcccctgcttgtgtttatgcgtgtacgaactggtaattaatactggatgttagaagggtttgtgacttttgatcttggattggtgaagaaaatgatgcgttaggatttggtctacctaagtagtatttctcagcacacatccaactctaaataaatcgaccaattttcccataaattaattatttgtggacaaacgtatagtaaaatcgttagggatttaggattggagagggcaatggacaagtttggattggtaaatttggtatggatgaatgcctgaaatccaccggcccaccagaactggcccatcattaagtttccacagcctgtaatattaagtgggccggtggaaaggtaaacagaaacggtacctctccaattagtcttgatcagagacatccacgtgctagtactttag

SEQ ID NO: 53340 - DNA, 3437 bp, Oryza sativa
ccggtttcgatactgcctttttagtttaactatatttacgttgtttctataaagatgaggcatacattatatctggttttacgcctaggcgatacaattaaaattaactcaactacttatgtacgacccaaacccaacacccacctgcgtgggctaccgggtggcgaaaaccctagccaccacttgcccaaaacacccccacccctggcctcgccgccaccagagctagccatcagcaagtcgtgtggcaactgacaagctaggaaggcggtggcgttggagcaacaccctagggcggcaatggccagtgcggcgcggtcggcgatgcgcgacaggccatgcgtggcaggaggcttgcgggaagtcgacacggtggtaggaatagtgcagcgcgggcgacggccaaccacagttggttggcgtggcacagttgatggtggcttctattttcaacaggcgacctcgacacatagggtagatagatatgggcgagagccgagcctcttcaggtcagcaatggcgacgcttgtagccgcggctttcccctcgaggtattgttgagtgatcttccctgccttacctgatggatttctttaggtgaaaactatgttgtaactacccagggagggcaatggtgtcactttcggtgctatatccttcctgaaggcgccgtttagaagattcattcccttaggcatatcgtgttcatgtttcttcaatagcgggatctagttataggcgcacgttgtgattgttttttttccctggctatagcttcctaaaaccgtagacttgtaaaatttttattgttgtatcaaatgttgtactgtcatgtgtgggttgtttaaaaaaaacgactaggtgagagaggaagtaccaaggtaaacaagagttcgtcgacccgctggcatgggcctgacaaagtaaccgacgaacgatggcaaggagcccaaattaggcctacaattcttgggccgatccataacctggacttagctttctaatttaatccagcacgacttgatcattcaccatcatcatgttaagggtcgtccattgtttgcccctgagctgagaagttcagaaatgaaaaagggaaatgtaggttggttgtgagatgatgagttcttcagacctttgttgggggtgaattcgcaggacagtagcagcactccttgctgaaaccttaggttgcagctttatcgaagcagacaactatcattctcagggcaagtgtgtgctgaattccctgacaacagcaaagatgagcaaggaccaagggcatccactgtgtgctgaataaatcatgccaaaaaccttatttataagccacagacaagtgcagccgccaagctagctcaccttcctcctcaccaccaagaacgcaagaacacagcaagagaggaggagattcaagaaccggaggaattgatgtcatcttcggctgtgattccgccgccgtcgccggagaggagggtgccgatggtggccgacaacggaggtggaggacatggggcgagatggtggcgtccgtctccatccactacttcatccgccacatgtgccgccacgccgccgcccggggctcgtcggccttctccgccgcgtcgtcggcgtcttcctctgttgcgccggtgcttcccgtcgtggtgcgtcccacgtcggcggggccgtgagggagcaggtggagaaggcgtcggcggagcacgcggcggagatggagcggctcaatctcggagctgccgctcttcacgctggtggtgctcccgaagtcgtcccgcgcccgctgccgccatcccctgcttctccgcgccgtcttcggcgaggaaggcgactgccgccgtcgaacagaggggtaaagatggaaacggtttttctgattgtattgcagcgtcaaacatttctagggtgagtttgagggatcagggatcgagaagattgaaaagatacgcaaaacgaggtgagccattagcacatgattaattgagtataaaccattttaaatttcaaaaatagattaatataattttttaaagtaactttcctatagaatttttttgccaaaaacacgtcgtttagtagtttgggaagcgcgtgcgcggactacgatgtgctctctcaccctaactcactagaacgaacactcctttagactccttttaaaatgaactgcaacgtcaaatattacacgatgaagggagtattatacaccgacgaaatgatttttgcgttcactaggcatggacggtcggctcaaagacaaacaagtttcttgagactgtgagagaccgcatgagaaaacataagacagacaagaattgaacaactgaacatgtacaaagactatatgttggtgcctacacacgattattcaactgataggatgcactagtcattaacaacaccaacacattagctactactgtactctcatcacaacaccacgtactatcaggtttacagaaccgtatgattatctgcgcaattttcgaaaccaaagatatatctcgtggtaactatacggttttcacggtaaccactggattactacaataaccgttaaaccgtggggtgacaataatcccacccaaaacagttgggagaaccctaagtcctacacgacaattgattcaaaccaaacaagtatacaacaccaacacattagctactactagtctactactgtactctcatcccagaaccatcacaaaaccacgtactaccatgtttacagaaaccatatgattatcacacgattattatacttttcgaaaccacgatatatctcacggtaaccacatagttaccgtgataaccacccaaccataagtgacgttaatcccacctaacacggttatttggggaaccctgcgtactacacgacgattgattcaaaccaaacaagtatacaaagttacaaaccccgattagcgcacgcgattttaatcacatcacaacaaaatataatccccaagtgcttaatcagctgaagagcttcttgacggcctggaacctagcggtcttgtcgccgaacttggtgccctggtagtagtccaggtagtcgccgtacctgtacggcccggggtacggcgccgccgccgtcgccggcgcgatcacggcgtcgggcccggggttgtagaacgtggcgacggacaggcggcggccctcggcgccggcggcgacgcggtgcacgacgctcttgtaggcgccgccgctgagcaccttcacctggtcgccgatgttgacgaacagccggccgcgccgggtcgggccgacggggacccactcgcggccgccgcggtggaactcgagcccgccgacggcgtcgtcctggaggagcaggatgatgccgccggcgtcggtgtgggcgcggaggccccagacgaaggtccgggcgcgggcacggtgggtacatggcgaacttggtgccgacgaac

SEQ ID NO: 53341 - DNA, 1489 bp, Oryza sativa
tgctcgtcgtaatggcggtacacgaagctcttcacctcctccattaacgccgcctccacgccatggttttccacctgcattcgtagcgagcatttcaccgaagcagaattaattttgcgacagccaacatagaggtacacatttgtcagttttcacatttgaagaatcaaaatctgaccaacagttttttttaaaaaaaatataatctaattatttagcatcaaagttgtactactacatttataatttcaagtactttgctaacatgttacatttagacctgttcgattttgcattgctaaaaaaacagtggtgctcaaaactgttccactctcaaataatctctgaagtgttgtcacgtacccagaagaagccccagtccttacaggcctcgtggagctgggccatggtgcgctccctttcttcgtcgccgccggcgagccccttgagatcaatcactggaatctccatctctcccaaggttgggtagctacttctacttgtacgtacaactgtctagtagtactgtactagtgctgatgatgagctaacttgtatgcactaggaagatgatttgcttccgatgagcgagtggctatgtggcatgcagctgggctcctatttataggagacaatcaaccattctgccatgccggatagtatagaagatttctactaatatttttattcatcctgaaaatatagtaatcagtattaaacgagacacattcgtaatattataaatttgaatagaattttatctagatttatagaaacaaagctgaatagaagtttatccagattcgtaggattatccaattttagattactatattaatctaaaatttttttagattatccaattttactgtagtactccctcagtctggaaaaaaattaatctatgacgatgcatgtgatcccttctaatacaataattctaaataacttttatttgtctttgttgtattaggaggggtcggtcacatcccctcctagggcctgttcggctgcccgcgctgcggctgcgccggcacaaacagtgcttcacacactgtgcgcagccacagccgcagcaatttgcctgccgaacaggcccctagttgaagtatttttgagacggagattcgttgtactatggatcatatctcgtatctgggggtgtaaagttttggcgtgtcaaattgggtattatatagggcgtcgcatggggtgttcgggcactaataaaaaactaattatagaatccgtcagtaaaccacgagacgaatttattaaacctaattaatccgtcattagcaaatgtttactgtagcaccacattgtgaaatcatggaggaattagacttaaaagattcatctcgcaaattagtcgcaatctatacaatttgttctttttttagcctatatttaatacttcatgcaagtgtttaaatgttcgatgtgacagtgtaaaaacttgtgtgtggaaactaaatagggcctaagg

SEQ ID NO: 53342 - DNA, 1607 bp, Oryza sativa
acttaatgatgagctttcttacccactcatggttggagattatcctgatttccagaaattagtggataaggctatacgtcaggaggacaagtacaattgcatggagcagaggaaacgtcggattgctcacttcaaggcacaacagggaaataatcagaagccgcgtcttactttaggaccccagtccatgccacatggaggttcttcgtctgttgttcgtccgcagcgtcagttcttcaacaacaatgctggcaacaacatccgtaatcaagctccacgtcctgttgcagctccagcacagcaacaacctgccaagagggagcaaggcaacaagcccgtggtgtgtttcaactgtggagacccaggacattatgctgacaagtgtccgaagccccgtcgcgtgaaggttgtccctgcccagaataactctgctgtaccagcatcaaaggcccgtgtcaatcatgttgcggctgcagaagctcaagatgctccagatgtgattttgggtatgttccctgttaactcagttcctgcaacagtgcttttcgattctggtgctacacattcattcctatctatgagttttgcgggaaatcatgggatggaagtagaagaccttagacgtcctttgatggttagtaccctaagtgatcaagcactttctttgcaacgtagcccctctgtcagaatagaaattcaaggagtaccatttctggccaatcttatcttgttagaatccaaagaccttgatgtcatcctagggatggactggttaaccagacataaaggtgtgatagactgtgccaacaaaaaagtaactctcaccagcaatgttggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggaaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcaacttaaaggtgccactgttttttccaagatagatcttcgatcagggtatcatcagttgagaatcaaagaggaagatatacctaagacagcttttaccactaggtatgggttgttcgaatgtactgttatgtcttttggacttaccatgcccctgctttcttcatgaacttgatgaataaggtgtttatggaatacctagacaagttcgtggtggtctttatagatgatattcttatctactctcgaccaaagaagagcatgaggaacatcttcgccttgcattggagaagctacgagaacatcaactgtatgctaagtttagcaagtgtgaattttggttgtctgaagtgaag

SEQ ID NO: 53343 - DNA, 2449 bp, Oryza sativa
aagttccttggtcacgtcatctcagccggaggagttgccgtcgatcctagtaacgtggaatccgtaaccaattggaagcaaccaaagacagtttcagagattcgcagtttcctaggcctcgcaggatattaccggaggtttatagagaatttttccaagattgctaagcccatgacacaactgcttcagaaagatgtaaagtacaagtggtcgaaagaatgtgagcggagttttcaagagttaaaaagtcgcttaatatcagctcctattttgattttgcctgatccaaagaagggttttcaagtgtattgcgatgcgtccaaacttgggttaggttgtgttctgatgcaagatgggaaggtggttgcctatgcatctcgtcagttacgtccgcatgagaagaactaccctactcatgatattgagttagctgcagtcgttcatgcattgaagatttggcgtcattatcttttcggtactcgtacagaagtgtataccgatcacaagagtttaaagtatatctttactcagccagatctgaacatgagacaacggagatggttggaattaattaaggattatgacatgggaattcattatcatccgggaaagactaatgtagtagcagacgctcttagcagaaaaggctattgcaatgctacagaaggacgacagttgccattggatttatgcaaggaattttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaagatgagcaaggaactgtatggttgggtgagagaatctgtgtccccgacaacaaagatttaaaagatgcaattctgaaagaagctcacgatactttatactccattcaccctggtagtactaagatataccaggatctcaaggaaagattttggtgggcaagtatgaagcgtgaaatcgcagagtacgtagcagtatgtgatgtttgtcagcgagtcaaggcggaacatcagaaacccgccggtttgctgcaacctttgaagattcctggatggaaatgggaagaaatcggtatggattttatcactggtttgcctagaacgtcatcaggccatgactctatttgggtaatagtcgacagacttaccaaagtggctcattttattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcaaattttggaagacatgttgagagcttgtgctttagatttcggtggaagttgggataagaatctaccttatgcagaattttcgtacaacaacagttatcaagctagtcttcagatggctccttacgaagcactgtatggtcggaagtgtcgcactccgcttttgtgggatcaaacgggagaacgtcaggttttcgggacggatatcctaagagaagcagaagaaaaggtaaagatcattcaagaaagattgcgtgtggctcagtctcgacataagagttatgccgacaatcgccgcagagatttgagttttgaagaaggagactatgtgtatcttcgtgtcacgcctcttcgaggagttcatcgttttcacaccaagggaaaattggcaccgcgttttgtgggaccttataagattgtcagtagaagaggagaggtcgcttatcagttggagttacctcaatctttggcaggagtccataatgtgttccatgtgtcgcaattgaagaagtgtttaagagtacctaccgaagaagctaatcttgaccagataagtgagagaagaaccaggaatcgagttatccgtttttgcaaagtccagtggagtaatcactcggaagaagagtcaacttgggaacgagaagatgaattgaagtcagctcatccgcatctgttcgccagttcttccgaatctcgaggacgagattctgtttaaggggggtaggtttgtcacaccctgaaaattcaaaatatataaaatggtggttaattggaatttttagaaataattttaaaagtcttgaaaagaaaatctaattttaattaataaattccaatataaaatggggccagataaaatttcattaaatactttgcttaattctataattcctagatttttctgggatttatttgagctaaggaagtatttttaataaatggaattgcattaaggaattattttaattgaaaaaggttttaaaaagtctct

SEQ ID NO: 53344 - DNA, 6290 bp, Oryza sativa
  unsure (1)..(6290): unsure at all n locations
nnnnnnnnnnnnnnnnnnnnnnnnnnnnnnnnnnnnnnnnnnnnnnnnnnnnnnnnnnnnnatcccttcaccgacgcgcgcgctgcctcgtgctccccgcgcctcgtccttatcacggcctcctcctctcctcctccactctcttgttctctcctccccttcccctctcctctccctcccccctcctggcctcctccgatgacggcgatggagacagcgggtggcggcccgacagaagctgccgacgaggctgcgggcggcggcctcccctgcggcggttgggaggggaggcagcgcacggtcaggcggccttccctccgccagatccggcgggaggggaggccgggcggcggtggcgacttgcgatttttttttaatttttggaatgagttgtaaattttattatacattggtttagatttgggggatgattttgtggatgattctatgaatgactttgtggattggcatgtgaattgtggatgatttggtgcgcatgatttgtagatttgttgtgcatgatttgcggatgctttgtggggatttgagggtgacggataatgcaggcaacaaaaaaccaagaaagaaatgaaagaaaaagccctaccggacctaaagtagtcctgggtgtaccaacccggactaaagatccatctttactctcggttattttaattgggtatctttagtccgcgaatagttgccccggttcgtaattaacctagggctaaatggggctatgaaccgggacttaaaaaacntgttctccagtagtcgactatctaanatacttaagggatggagtcatgtatcactgaccccagcaccatactttntgtgcttcctctacctgtgacattattttaatcnagttatacgtgcaactcgccgcaagtctgcagaaagttccaaaaattacagatttgtataacatgtcctcttgtcatcggagctttttatttttcatctgagggttttatgttacatatgtaaacttaactgtaccagttaataaattcatttcatccccttagcataaaaaactgtatattgtgacctgaatgaactatataacttataaaatttggtcaattctatactaatcaatactgtggatgccatatatgataaaaatctctcaatatatatatatatatgataaaaagatcggggtgccacgaaaatgattcagtccgtgcgccggatcaaacgaaaaaaaaaaaatcggacactggcttcgctctttcctaaccagtatattatcagtgagtcagcttctctctcactatttttctccttttctcattcacggtgcatgtggcaaatgcatgtcatgtcatgtcttgctggctcatttgcaacttttctctcttcttcaaatgttttttttcttccaaagtaattatccgttctatgacccgtttacaccatcgtactatttacaatttctttgtaacaagatatcacatgattacattctgataaaaaaaattgaacgttgtttcaccccttaaagaaaattgtttttgttcactatataaaatatttcacataaatacaacattagaaaatatcaactgcaacacctaaccacctatatgaaacattgagtctcaaagagtgaaacaagaaaagtcatatgagagatataatatattttaaaaacttgatattgttgaaatatttttatatcacatatgaatatcaaattgtaactattgaaatattataaaatacttgctgaaacattccaagaaaaccatgtacaacattacattccaagaaaaccatgtacaacatttataaattaactagtaaaacatcatgtgtactagctgaaacattaaatagaacatgtgcaacatttgaaataaatctatttaaaaagctaaatattcttttcatcaaaatataaccatgtgtggtcttttttaaaaagatttaattgcaacgaattaaatggggtaattgcatcataaattggagaaacaatttaagagaaatttaaaaattacttaaaaagacttatacataccatactaatattgtactagacgcatgcatatgcatgtagacttagctatgtggctaactagttgcttcacgtttctgtgtctgctgcgcctgtcacaccctgaaaattcaaaatatataaattgttgtttaattggaatttttagaaataattttaaaagtcttgaaaagaaaatctaattttaattaataaattccaatataaaatggggccagataaaatttcattaaatactttgcttaattctataattcctagatttttctgggatttatttgagctaaggaagtatttttaataaatggaattgcatttaaggaataattttaattgaaaaaggttttaaaaagtctcttttggctttgggccgaaagtcggcccaaaacctctcttctctctcctcggcccaagccggcccagtccgccgcgcgcgcgccctcgctgtcgctgacaggtgggtcccgcctgtcggagtcgtcgtcctcctcgggccgaaaccctagtttcgcgccgccgagctgccgtcgccgccgctttccaaatccggccgttcctttccttctccggccgatttgttagaggggaaacaatctccgggatctcctctaccttttctcctttggaatctttggctcaatcggtttggaatgagtttgattcgagttcgaatcggatcggctttcctctctccaagccgcgagtttccttcgccgttgccgtcgccgtgggcctccgtcgtcgcctccgagcccctttaaaaggatccccgtgctcttctcttctcgccgccaccctcgccttcgcctctcgtcgccggagtagccctagcgccgtgtgccctagctttgccttcgccgccgccgctccagccgtgcgccgccgtcgttccagccatcgccgtcgctcgggaaggccgccgtcgttgtcgccaagtcgtcgccgtcctcgtccgctctttcgctgccgtcggagaccgccggagcatcgtcgccgtcgtcaagccgaagaccgccgccgtttcaacctcgtcgccgtcgccgtccgttggtcgtccgccgtcgctttggtcgtcggtgagttcgccgtgccgtccgctacccgttggtgtcctccgttcgtgccgtagcgccgccgttcgccggtgagcgtgcgccgcccgagccgttcgctccgccgagctgccgccgccgtcggtgacgtcattgccgacgccatcggggccgtttgccgtgaaccgccgtggacccgatcgatctcggccgtccgtttggattggatcgaatctcggccgtccgttcgcgtgaaccgccgcccgtgcgcccggtccacccaaaccctagccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattgttatagcccttttgtacttgattaccttattccttgataccttgggttattacaatttgactagttgagctttatttatattggttcaactagatattagatataattgcttagccctgcttagaaacattagtacatttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacacctctcattataataaaagatgcttaaactgataataatttgattagctcctggtttggaatggtacattcctggtttggagatagaactgtgcagccggggtggttgttcagaatggttgggcctatacaacagggtatgttgtatagcgttggattaatattgtttaattacttaactattttattaaattctcaaatgtttgttaaatgctgcttttgcaaatgcaaccctattatgccatcctttgttatcctgtgcacttgcatatttgctgcgtggcttgctgagtatgtcatatactcaccttgcaatcattcatcagaggaagaattctacaatgaggctgatggtgtggaggattaggtgtagccttggtcaagctgcctgtggagtggagccgtctgcgccgtttattttatttttccgctgcttagatctttattggttgagaggaactatctacctctgtaatgacattttattcgcttattaattagagtaatatttgtactctattatcaatttgttattgtgtgcctcggctgattcctggacaagggttcacacacatgtaagcgtttggaattttggatagaaattccgggcgtgacaagttggtatcagagcctctttgaccctaggttatgccaaatggttatccatagaagccctctaaaaatattggaaaagtagaactgttcttctccctttctcttttaattaaaccaaactaatggcacatgcacttcataatctcttttaatggttctcattcaaaatttattccagtgttattagtactgtacatctattactgtactaatggctcattataccagcaaaagttttacaatactgttttatttaatcttgctgcaataaaataaatttagcatgttgattttataattttcttttatttcttttgaaacctattgttcaaaagtactaaaattgtaaccttgtttccaactatttcaacttattttgcaagcttggtttaccttatttacttccctttttactttgattttctaactttattcaaattaatccaaaaacttgtgctattaattggataaaggacttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatcgtcatgaagagaagtgccgagtcaaagtcactttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgttcccatcctcgtcaaccccagggaagtgaccgtggtagttaccttgagactgaaggaattgagaatgatgctaccacgaagcatttggttgagatgttgtgggctatggatgaaagtcgtgcggagattgtgttagcagctcaagatcgtgaagaccggaatcgtggtaagatttgcaagttagaagacaaggtggatcgtttggaaaaggaattagccgcattgaagggagaagcaccgccgcagaaggccaggattcgtctcaccgcaaggaagagagctctatttgtccctcgctatcaactggcgccaaaggttcgtgtggtggagaaagaagttgccccagctcaagcggatcctccgg

SEQ ID NO: 53345 - DNA, 1273 bp, Oryza sativa
atggtgtggaggattaggtgtagccttggtcaagctgcctgtggagtggagccgtctgcgccgtttattttatttttccgctgcttagatctttattggttgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacagcgcctgcacgtatagatggccatatggctcgaggcccgatggcctggcgcaaggcccggtgatttggcccgactcgggtcgtgtccgtgccagcccggcccaacagccgtgccctgcttgggctcctacctcgacacgctgggccggcacggccctgcacgaagtttagggatgcaaaacaaacttattttcaaccatatgtaaggcacaatacaaagaatagggagaaaaaatagacgtattatatggcatggcccaaagagtagggacgtaaaatagacttatttagctttatatatgtcatagcccaaaaaggagggaggggaaatagacttatttcaaagaaggcacgatgggccgcccgtgccttagggctggaatggcacaaccaactactggtgggtcgtgcctgggcctgaggtgcagcccgtgggctggcacggcttgacctaaagtaccgatcgtgccgtgccggcccgatcgcctcggtccgtgcctagcccgtgcctgggctaggccaggtcgtgccgggcgagccttatagccatctatacctgcgtgtgtgacaggctaagatgggcatctacgcatgtgacagcggctaaggtggtatttgattttttagcttaaaatcgggtgcccgatccataatttttttatgatcaaagttacaagaaaccacaggtattagacacatgagacttacctcaggtattaatatatatggttttaaaatttcacaaacccccacccttgtgtatttgagcgtgaatttactcaaaatttctaaatcgtagagtttatatgaaatttgtagtcattaagttcttgacttggtttgatagtttaaatcttcaccactttaaaaaattgtttaagatatgctgaaattaatcaggatttcaataaaggtggggttttgtgaaacgtttagaccataaaaacgtatggttttgtgtcacacgtcataatacactagtacagatccttctatctgtgacgggct

SEQ ID NO: 53346 - DNA, 1076 bp, Oryza sativa
gccacctcacgtcgggcctgactccccttgggggagggccacgtggcattggggggcagcctcctccctctaaatatgataccctcagacccatatcaccgacaagtcttatttaaaaggaaatgttcaaatataggtgagacttgaagtacctttaacgataaaacaagtcacggcaaaacaaataatacttatataacttttaaaataagatgaatggttaaacgtaggttaaaaaactaacagtattatacatttcaaaacgaagggagtatcgtattagaaaagatccttctatcattcacctcatttattcgtgacaatataaaatacgcatggctttacaatacaagtatgcaattggctgagcttcttccaggcactggaattgtcatctgccatggaaaatgtgtctttgaaggtcatggttcattttaaacggtacgttttacatagagaaaaaataggaccaaaccttacaacacacaattaattagaaaagaactagaaaaaaaatgctactacagcaacacaccaccaattaaactaaactacgaaggcagtgataacaaaaaagcgtagcacaacactcatcaaacgttgtgcactgtacgaacaagcaataaactataagaaaacaagactcctgcacactggcaaagacgcgacgttatcatcatcacaccatcaccctcgcgatctggtgactccgacttcaccaggaaacactaacacaaaggcaacaacctagtccgcgccaaagcataacttaaaagggttcatgtcatcgttgccaaatatcatgccctgtcgatgccgcagctccgacttcactaccaccaatcttgttgatgcacagtcgagctagattgacgagccttgcagacaaaaagcttaaagccccacactagagcgagacacggctaatgaagtctgacttggatcatcattgtcaatccaactgttggtttaagagaaaatgagttttcacataagcgtttgtcgtacttgttttttaggctgacggtcagaccaccaagtgacctatggtcagaccgacgctagtaggtcggata

SEQ ID NO: 53347 - DNA, 1223 bp, Oryza sativa
  unsure (1)..(1223): unsure at all n locations
aaaccctgttacctactagtgacgatagatttgcatgttcctaatgtcgacagtttcagattttacctcggttttcgttagcacgtttttcaaactattaaacggtgagtccagtgtgaaaacattctatataaaagttgttttaaaataccaaaaatattcatgtgttaagtttataataattaaaacttaattaatcatgtgccaatgattttttttcattttacgtgcgtcaacttgatcatcttcgtcttcatccgtttcatcaatcagattcgcaggttacaagaaacggtccacatcttgctgggttcaggaacctcatcatgatattccctccatcccattttaaggctgtgtttggagggaacccctcctcccggcacgcaaaacgaagtttattttattgcataattaattaagtattttttaaaacaacttttatatagaaatttttcgtataaatcacaccgtttagcagtttgaaaagcgtgcgcgcggaaaacgagagaggtgggttgagaaaatggaggaaagaacacagcctaagtgtagctatggttttccgcacataagtttgaccatccatcttatttaaattttttttaaaaaaaaagttaaaaacataagtcaagagtaaagtactattcatgttttatcatctgacaacaacaaagatactaattataaaaaattttcaaataagacatacggtcaaagttaggcgcgaaaagttatggttgcatttaaaatgggacggatggagtagtaaaaattgagcgctatttgaattttgaaaagcaaaagtttcaccccaagctgtttgatttacgtactattgcaaactaggaaacccgtactctaaattggccctacttttgtcgctaaattaggctgtgtttagttcacgataaaattagaagtttggttgaattggaacgatgtgatggaaaagttaaaagtttatgtgtgtagaaaaattttgatgtgatggaaaagttggaagtttgaagaaatatttttgaaactaaacacggcgttaatgtatggccactagtgcaaaaacccctgtaggcaatagataccggttttccagccggcaccaatgactaggtcatagaaccgacactttgtgctctctcggatatacaaaaaaatgaagccgtgtgctctctcggannnnnnnnnnnnnnnnnnnnnnnnnnnnnnnnnnnnnnnnnnnn

SEQ ID NO: 53348 - DNA, 9020 bp, Oryza sativa
  unsure (1)..(9020): unsure at all n locations
nnnnnnnnnnnnnnnnnnnnnnnnnnnnnnnnnnnnnnnnnnnnnnnnnnnnnnnnncgacattaggaacatgcaaatctatcgtcactagtaggttacagggtttaaaaaaccggcacggttatagcagcaatcattcttactgctgggataagttaaagataaaactgtggtaaccctattaaatccaaataaattttaaaaataatttaaatttttgataaattttgtatggtttgtcatggttaccgcatggtaactgtgctgtcgccaggtacggtaaccccaacactgacagtaagggaaaccctaataggttacacttgttacgtctatagtgatatgcaatgatcatgaaaacgattctacactcttaaggatacttctcgttatttgtatggcacttaaatagttataaaatagttatagttttatttcaaaaatcaacaagacatattaataccccaccaacatacaatagcaaatttaacttctgcaattttttaaaataaatttgatggtgaatattagttataatttaatttgttcctttttatactttatagaagttaaattttaacttgtatgtttgaggattgatcatgatatatcacatattaatctaccttctcaaatgtttttaaattcttttataattgttttttccttttacgagggaaagaaaattttatgtatttaaataactttcaaataacgagggatgtcttagggggtgtccactctctcatgatcaatggcaaaggtacaaagtacaatcatgttaggttaggggtgcaggtatgagccctgtcaggttacaggagatgcagtacgaagtggcaatgttgttcaacagaaacatcgtacagcctaccttgtagagccctgtagagtgaggcagattgatcagctgatttttttttattagtacaattggacgcactcagggtgtgtttagtacacgtcaaaattagaattttgattgaaattggaacgatgtaacggaaaagttgaaagttggaagtttgtgtgtctaggaaagttttgatgtgatggaaaagttgaaagttcgaagaaaaagttgggaactaaaccagacctcagtgtaaaagcacatcacacgtcaactaccatacccctctatcgcaaaaaaaagtctaatcatagctactcctccgtaaaaaaaaaaacctaatcctagctatgaacctagatatatacgtatctagattcgtagctagggtttatattttttggaacagagtagtacgaatctagatatatgtctagattagtagctagagtttattttttatagagtagtacagtccatactgtaaaaaaagctttttcttcctttttatgattgcgttgcaggtagacaatcagcatcataagtttgtactccatcctttcaaaatataacaatttttagtcctaaagatttgtcctaaaatataacaacttcttcgccaacattcttttcccaaccaattacaatcctccaccattcacttttttcacctacctccactattcaaccaatcacaactatccatcattcacttttaccatttttttagtaactgtgtccaactctaaaaatattatattatagaatggagatactactagctaatactgcagattctagaaccggatgatgncgtttgcagcctgtactaggcccccgttcttttgagggggttaggaaacattcctttggtccgtgaaacggaacggtgaattaccatagctgttggttcggaagggcctattaatgtcggtttcgacaccggcaccaattagtatgagctgacacctaagaggtattataggtactggttcttttaaagaaccagcaaataatggatgccctcgcaagcctatatgtaccgttattaacaccaaccggcacctatgtaggattagtataatacatgtcggttctaagtttatagccggcacctataatcttgtagaaaaaaaagctagttcacagattatccattcacaatatatgtaattcatctccaaacatcaattcacaaattcacgtcatcccacatccaaaaatttccaaacatacacacataaatgcaattcatctccacattcaagttatcgtacatcaattccatctccgcatgattccattagaagaaaaaatggttcttaccagcatggtgtttctcagttcactctgctcaaacttcagtaagcctcagttgctcaaatcctcgttcaccctagaaaaaaaggaagaacagtttacttgtaatctacttatggtgaaaacaaaaatacaggtaagcctcagttcaccctagaaaaaaggaagaacagtttactagcttgttaacaaactgcaggttttaaagggtacattatgcccactaattataagtctgcgtatccttggttgttgaacggctatctaaaatgtcactatggcaaccagcctcaatgaaacccacgagcccaataggagcttttgaaatgttgtataagccgtctgacgagatgatatgattggagatgaatccacatagttgttcagcaaggccaaagcaagcatgtggtagcaatttacttgttgggagctttaatttttgcaaatggaaggattgaagatgtgaaaacgtattgtgtgtttagaaatttggatttacgtcttaagaggatgggcgaacatcgcatncatanatgtcccgttgttgtcatccatgaaaatctacataaatttcattaggtagaatccacatgtactcgtgcccggatcctggcgtaagcaataagggtgggcccaaacctggaatgtatttgcacacggagcgtgtcaaatacacttattcttatacctcacaagtgccttattgagagtgtcaatgatgtattggaacttggcttgcggggtcctcagtccatcgaagacaactatcttggaatccatcgtttaaatggatcgcaagaaggatccagtggggcctacatacaaggagagagagcaatcaacatcttaaagtacaaatgggaagtgcaatgatatatgtgtcgacgggggatacccgcagaccggatatatagggtattggggtccgttgatacgaggatctatgtaagacgacatcaggcagataaaagacaagaattatactggttcaggcccattgatgggtaatagccctaatccagttggtatgggattatatgatggaaaccacagattacaaagggaatagcagaactcgatgataccgacaagatcgtagtcgagttggttcgactaggtctcccggcgacttggctcctgcgcgctccgcaggctgtggtggttgtgttggcagtaagattcaatgccttaggtcctgcccagggggtcccttatataccacgggtcagttgatctccaagtaggactcgaagacatcggacccctcacgatatggctaaaacccaatcttgtccgagtagaactccttccatctgtagataccacccctatcacgtgatagatttccttaatgtatacggaaactgtccatatacgcgcaggtataccgtattagtatacggtatacatccaaggatagagggtataccttatccgtaaccctgacagtagcccccgacttctacttaaatgaactcatgttatcgatcgcgacttctgatttcggaattgttgccgttctcatctggtcgatcccggtgtaaaaatcataaagacaaagagccatcgacaacaccgcatgaagttcaacggtcatgagtgaatttaaattgaagtctgagaaactaccatgcgcaacagacccagaattttccggcggcaatctctctcctttccttggaatacgcaccgtcggtagtgcgcttatttaagggaattttggggattcacttgaagtccgcttgccagaaaactctcctgccttctagcgctcttcgtcttctccgctcaccgcaaaaaccataactcacttccttagtcctattctccggcgatcctccggcgacgatggacctcgagaagtcttcctcaaacaccgcgtccatgaagaagctacaggacgatggtgccctccccggtcacgggaccatgcagagggaggctggaggtatagaacctgaacccaccttgggccgcatggttgtagttgaagattatgtttcttgcggttttctgcctccaccttccgagtttcttcttcttgtcttgaatttctacggcctttctttactccacttgaaccccaactccatcgcctttctgagcatcttttctcatctttgcgaggcctacattggggtagagccttttcttgacctcttccatttttattacgagctgcgttggatggaatccaacagggtatctggatgcgtcggattccgacttcgggatggcctaaagtcgcgttacatccccttccagtgcccttcttctcgcagcaagtggcggacgagatggttctatctccagatagagaactcggaccccgtccttgttattcctgaggaccagtcagaaaagatcccagagtggactgctaaacccgccctggctccctccctccaatcctttatcgacatcatcgatgacctccgagaacgggggttgtcgggatatgaagtcgctaccgacttcataggtcggtggatttagccgctacaggcctgcacccatccggccttcgattactcagggccaaatgacgtgacccgggtctcttctcggggtatttatcctcgcatttccaattttgttttaagtgcatctgtttctcctgacttatcgagttctcattctcgatttacaggtctggacagtgacactgtgcagcgccgcgtcatccagataatgatcagtggaccctcggaggtgggtaacatccctgtcccactctgcgacaagggctcagccgaacgcgctgccgcgattaacgtgagtgtactcgatgattccttttcatctttcttctcgagatcgcgtcgtgacttcatgttgtgcaggctctccctctgacggacgtcatcggaccactcgtggatcaccaggctgtgacgtcgctgaaggagggcgccgccaaggaagcattagacgctgctgctgccaccacgagtggcagcaatgttccgaagaggggaagagagttctcctgtgtgctcgggacccaccggaaggcgacggacccggcggtaagcttctctttcgtcctagagtacataatcagaacgacttaacctcacatcatatcatccaacttaggactcgggtgcgtctccaccgcctccgcgaaggcagaggttggtgacgatcggtgagaagtaagtaaatgtctttgaggttttttcgttctcaaagtcttgatcacctatcctcacagagaagagaaaaatcttcgcaggatggcgcgggcgaaagatgcgcacaatggggctgatgctgcttccagtgtgtcccctgtggcgacctcgacgggagccgtggtcgctaccaaggaccaggaggcggcaccacatagtcctatcgccagcctcgtgaccgcccagcctctgtccgccgatgccctcacttggggagagctccaggctgagatggagcgcatcctccaagcgggcgcccgcggcgtgggcccgcgaagatagaagaagcccgggcggggcgtcgtcggaaaccagcgcgccgatcagctggcgcgtgattggcggaggcccgcgaggacctccaaaagatgaaggagctggtagctagcaacgagacgcagtggcgcaggctcgagcaccagatgtcggagctcaaggaccatctgacagacatccggggatcgctgcggacatcattcactggcccgcaccaacttgccagggaatgtggcgtcgtgatttcaatcccggcgcaccctgacgagtggtcattgacgtcatcgctcaccaagttggctaaggtgatggaggcgatcccctcccgccacgcggctaggatcagcgaggagacgtccaacggtatatacaccggggcgtgccaagtccttgcgtgcataaggctggcgcatcccgacttgaacctcaaagaggcgttggatcggggagccaccgataacgcgcgcaagggtacgatggaggaagtcggcgacttgggggagtatgtcctcccctttttctagagtagggtttttactttcccttgtactccttaatcttcatgctgtaaaactttctgtgggtcgacactgtttttatttaaacaaccgtttcccttgtttcctcagcgtgtgattccgagtaccttctttattgtagatatgttgatgtcgaggatgtccagcagtgcgggcagcccgatacgccggtagttgttccggcgctcacgcctgagccgcacgtgccggaggtcgaagtcgatcaggttccgtccacgggggcgaacatggcgatgacttctttaggtttgtgtcttgatttctttcgctcctcgtatttggattgacttaattagctgtgttctcgaaagagaggagtagcttgacttagtcctttccgtgttgggtagatttcgagaacgcgttggctgaccgagatcgtcgaatgcagtattggaagacgaaattcgaggtggctgaactcgaaagagccgttgtggaagcgaagaaggaccagggcatagaagctctccgagttcacgaggtgtggttcaactcatacctcaagagttgctgcacagccatggcgtgagtttgtagggagctccgagttccccgtgaagatcccgaggagtccgctgctggttacatctcgtggatgaagggggcctgtgccgaactcgatgggattggcaagcgcatcgacgaggccctgaagcaggagtgccgtcgagcgagccgctacgcgcggaggacacgtgctagcctgcatccgagatcacagcccgcagctgcacctcgagttctttcgtgaagggttctctcgttctcggaggacgcctgggaaatcgacagtcttgcgcagtcgatggcgccacttgccgagaaggtcttctactccatggattggcgttggccatattggtagtttttatttctctgggtatgttgtgtacgagtgttttctcactttgcgacctcgatcagtcacttgagccatacactctccctagaccccagccttgtcgtcagagaattgttttgggaggataagactcttggacccttgacctaccttggttgaaaaagcgctgaccttagcccccagccgtgaagttggaaaactcaatttccgattacacggcttggttaatacgcacggtgagaactgagaactctaacatgaccagatcttacatggtcgtttgtctctgcataacctgacaaggccttatccgctctgggcgtccccagccgaagttcctttaggttcctcagaggccttgccaggacggcgtaaaggcacaaaaggataggtttcaactctaggtgtcgtcgtggtaagggatcgttggaaaggaacactttggcaatattctttacctgaaatcaactttattgaaatcgtaagatatcttacaaatatggatactattgatttatacataaaatttacgtaattgatcaatgttccaagaatttgctaacttgcggccatcgccgtctgcaatcttgaatgcgcccggccgcaagacttgcgtgatcgtgtatggtccttcccatttgggtgagagcttgttgcgccctgtttggctttgaacccgtcggaggacgtaatcgccgatcgaaagtgtacgtgctctggtgcgcttctcgtgatattggcaaagggcctgctggtagctggctgctctgacggcaactctttctcgatgttcctcgagtagattcacatcatcgcttcaccgctcctcctgctcctcgttggagtacttctgtactcatgtgctctgatgtcgtagctctgtggggagcatagcctccgagccatacacgaggaagaaaggtgtctccttattggatgttatcggtgtggtacacacggcccataggacagagggaagttcttcgacccacttcttgtcgtgtgacatgagtctgtcatagacgcgggtcttgatcccttgtagcactatgccgtttgccctttcgacttgtccattgctctgagggtgagaaaccgaggcgaagcaaatcttgactcccaatccaatgctgtaatcctagaagtcggcactgatgaactgggagccgttgtctgttatgatgcggtgagacaatccatatctgcagaatattcctttgatgaacttgatagctttatcggccttgatttcccccgtgggcgtcgcttcaatccacttggtgaatttgtcgatggccacgaacaggaacctgtagccgccctgtcctcgtgggaatggtccgagtatatcgagcccccagcacgtgaatggccaagtaagagggatggtctggagcgcttgcgctggcaattttgtgtgtttgctgtaaaattgacaggcttcacaccgctgcaccatgtcgcaggcgtctttgagggcgttcggccagaaaaacccttgtcggaaagcttttcccaccaacgtccgtccgctggcgtgtgacctgcagatcccttcgtgtatgtccaggaggagatgtttgccgtcatcggacgagatgcatttgagaagtactcaatttggctctttttttgtacagatcattatcgatcatacaatagatcttggcttgtcgagtaatcttctcagcttctgcatcatcctcgggcaactcgtcgctactcaggaacttgatcagcggggttcaccagtcgtctgtagtctcgatatcggcaacgacgtgtaccgcctctgtagccccctagctaatgtcggggactaccgtgctaccttcgtcgtgtaccttcttcaccgatggctttgtcaggacgtctagaaaagtgccaggttcgannnnnnnnnnnnnnnnnnnnnnnnnnnnnnnnnnnnnnnnnnnnnnnnnnnnnnn

SEQ ID NO: 53349 - DNA, 3101 bp, Oryza sativa
  unsure (1)..(3101): unsure at all n locations
acgtctaaaaaagtgcagggttcgagtggctctcgtcgggacacacgccgtgcgaggtcgtctggttcgatattgtccttacggtatacgtgtcggacctcgatcccatcaaacctcttctccagcttcctgacttctgcgaggtacttggataactcggggctggagcacttgtagtctttgtgcacctggttcgtgactagttctgaatcccccttcacaattagtcgcttgactccgagtgtggcagctgctcttatgctggcgagtagtccttcgtactcggctgtgttgttggttgccctgaagttgaggtgaattgcgtgcttgctgaactgatctcccgaaggtgatgtcaagatgaaccatgcccttgctccttggctattgggtgcgccgtcgaacgccattgtccacgtttcgctgtctgtttgactgtttggcctgttctcagacatagtccagtcagctataaaatcagcgagaacctgggaattgatagctattcgtggcacaaagtggacatcaaactggcttagctcgactacccatttcgcaatgcggccgacaacgtctttgtttctcacgacttctccaagggggaaggaggaaacaactgtgactctgtgggcttgaaagtagtggcgtagctttcttgatgtcataactactgcgtaaagcagcttttagatctgttggtatcttgtctttgcgtcgtggagagctttgctgatgtagtaaaccggtctttgcaccttctctctctcgacaacaatgacagtactcacagaatatggcgtggcaacgatataaaggaacaattcttcattaggttggggagcaacaagtatagggggatttgacaggtagcgtttgagcgcgataaatgcgtctttggcttcctgtgtccacacatatttgtcttgtttcttcaggagggcgaagaagagttgtcatcgctctcccatcttagcgacgaatctgctcagtgctgccatgcatccagttaacttctggacctcctttagtcttgtcggctacttcatgttctcgatcgccttgatcttctcgggattttgcttcgatccctcttccggagacgaggaatccgaggagcttgcccgacggtactccgaacgtgcacttctctgggttgagcatgaggcggtatcgtcggaggttgtcgaacgtttcccggaggtcgtcgatcaatgagtcgcttgtcttcgttttgacaacgatgtcatcgacgtaagcctcgacattttgcccaagttggtcgttgagtgccccttgaaccgtgcgctggaaagtatttcctacggttatcagtccaaacggcatcttgacgtagcagaatacaccgaatggcatgatgaatgatgttttctcctcgtcctcttttgccatgctgatctggtggtagccggagtaggcatcaagaaaacttaacaactcacaaccggccgttgagtccactaattggtctattcgaggaagagggaagtgacccttgggacacgccttgttgagatcagtgaagtcgacacacatcctctacttcccgttggccttgcgcaccatgactaggttggctagccactctcgatgtagaacctctctgatgaagccagctttgagaagctcatcgagctcttcccgtatggcttgttttcgatccggtgcaaatctctgcagtttttggtttactggcttggcatcgggtcgcaccatgagtttgtgctcaatcacctccctggggacccccggcatgtcagacggctgccaagcgaacacgtctgcattatcgcggaggaagatgatgagcacgagttcctatttttcgtccagtgaagccccgatcttgatggtcttatcggngttggcactggagagcggaacaatcttgattgcgccgtctgactccggcgtcttgttggttttgttcactttcctgggcggctcaactgcggcgggtgggttgggagtgtgctcgaccatgtcgaggcttcgcttgttgcactgcaccgcaagcttcgcgtttccctgaatagtgattgttctcttcggtccaggcatcttaagcacttgatacgcgtagtgagatgcggccatgaacttcgcgagagcagtcctcctgatgatggtgttatatgccgtgtcgaactcagcgacatcaaaggtgatttgctccgttcggaagttgtttgcttggccgaaagtcatgagtagcgtgatcttgcccaatggcttggacgatgactcaggagtaattccatggaagggttgatcagtgggcatcaactcgcttcgtggaatccccatcgcgtccaaggtgctggcgaagagtaagttgatggagttgccgccgtcgatgagaacccgtgctacgttgatattccgaatagtgggctcgaccacgatcggatatcgccctggtgtgacggtagtctttgggtggtcgacttctgagaactcgatcttctgctctgaccaattcatcttggatgcagccccctgtgatgtcgaacaaacttcgtgctccactttcttgtactctctctttgaggagtacgccgtggaacctacgaagatgtgcgaaacatggaggtcggagtccgggtaagctgaatctgagacctaagtagtcgcttctgcggccttctcgactacatgtactcgcttgcccctctccaacgctagtttctttgtgagtgccttttcgaagatgaaacaagtctccagagagtgcttgtccgtcttgtgtataaggcaccatattttattcgtatcgtcgccttgtgggtctgggttcttgggcgggtcaacatgttctgttgcgaggacctccgcttgagctttccgtttcccactcctgcggctctttttcttgcttgactcaggtgcgtccttggctggtttccactcctctcctatcttcgacttgccttccttgcgtctcagggcgtcgttcgcgtgagcgcatcagtcgacaatttcgaacaccttgcgagtagttgtgatccgtcttgtcgctaactcctgggttgtgtagcgatctcggacaccggacttgaaggcacggattacagaagcatcgg

SEQ ID NO: 53350 - DNA, 1024 bp, Oryza sativa
  unsure (1)..(1024): unsure at all n locations
nnnnnnnnnnnnnnnnnnnnnnnnnnnnnnnnnnnnnnnnnnnnnnnnnnnnnnnncctagaggaccgcggagtagacctggagaaattcttcagggtcggtgcttccatcgtatttctctattgctcccggtcggaacttctcaagccatcgaacatctcgcagggtacgagtgaaagccctgcacccaccgccaggggtagtaggttgttggcgatcacgcgctcatcgtggatgtctgtccgatgatgaagatgatgatgacgacgatgggtcacttggttccgaggcacggcttcaaggacgatgctcgggttctcgtgaacctcgtcgtcgtccatcgttgttgtcccggtgtcgatctctgttgtcactgtcgtcacggcgtcgacctcgactggtatcactcggcatccgctgttcacgattagcatgttcgcggcggttgtggcaatcatcacggtctcggttctggctcggacgtcctccttgttcttcgttcttgcaatgtcgtgaagaggcacgatgtcggcaacggttttcattatctcgagcgagtcgtgcttctcggcggccatttaggtgctcgcggagatcactagtgccgcggggtggaggagtaggttgacgaggtggcgaccgctgagttggatcactgtcctcgggcaggtctccatctcgttgttccctattagcgccatcgatccgcggttgttctagtggtgccctggcggcggcctctgcgaacgcgttattgagattagccactgattcccgtagtcattctgcccagtgatcgagatcagcgtacaggacgggatcaaaagggcttttgttcaatatcgcattgagagttttgatatgttgggccagcgtcggtgtaaccaattgatccgccgttcccgtgtggccgcctccagatgtgccggttccatcgatagcatacacgtcgcgcggtgtacttgtcgatgatgaggcctggtctttgagcagatgtaggatagatggcttgtggggatcaata

SEQ ID NO: 53351 - DNA, 1510 bp, Oryza sativa
ccgttgatacgaggatatacataatatgacatcaggcagataaaagacaaggattttactggttcagaccccttgataggtaatagccctaatccagttggtatgggattatatgatggaaaccatagattacaaagggaatagcagaactcaatgatgccgacgagatcgtagtcgagttggttcgactaggtctcccgacgacttggctcctgcgcgctccgtaggctgtggtggttgtgttggcagtaagattcaatgccttaggtcctgcccagggggtcccttatataccgcgggtcagttgatctccaagtaggactcgaagacattggacccctcacgatatggctaagacccaatcttttccgagtagaactccttccatatgtagataccatccctattacgtgatagatttccttaatgtatacggaaactgtccgtatacgcgcgggtataccgtatcagtatacagtatacatccaaggatagagggtataccttatccgtaactctgacaatatgccacacttagttaaggtggtagggtaaaaggatggtattcatgtcgtactgaattttttctttagtttctaagttctaaccaacaatttttgaaaaatttattaccgaattttagcttagatgtcttttgaaaaatcagaattttggtatattgcatagaaattgtgtgagataattgcatatcaggtcgatctaaccacaacctcatggctggtctggtcgatgcttcaatgccaatctaaccgcggtttcttggccagtatgaccaatgaccatagctctaacatcagtccaactagggattgcagccgtggtatgtagccaggggcatgagctcaaatttgattatataaccgaattgaacctatgaaattcggttgatctattatgaattcaaggtaccaataggaggattccactagtggaacttttcaaagatataagcaagatagttgattgaagaagatatattggagagtttggcgtaagcatccaatacaccttgtttaataaagagttacattgccgaatcatataatagtgctttcaaagtatatgtttggatgccgctcaatctaaaattgctatggatgaagtgtttataaggcattgtgaaatttatcaattggtttgcgagataaatcatttagccggttgattctcctatgtttggtgaggtgatttatcggtcaattgttatgggacactaatagtgataaagtgaccaagaaatttttgaagattagaaagaggtttaacggatgatatgaagttatagacaaagcccataataacagaactggggtagaatcgtttcaagattaaaaattgacatgaatagatgattttaccattatggtctagatgcaaaaggcttgatgggtaatcatctagttggaaatgtctataccgaaatgtgtgaattgttcttagaagattgttgatttgttgggacgctataaagagaatgatttaattacta

SEQ ID NO: 53352 - DNA, 3545 bp, Oryza sativa
  unsure (1)..(3545): unsure at all n locations
nnnnnnnnnnnnnnnnnnnnnnnnnnnnnnnnnnnnnnnnnnnnnnnnnnnnnncgtcctaaaaaaggcatgtattctagtggttgcagtgacctaagtagcacctaaaggtcataatttcaaatctccatatataggagcgaatttcagattaggcttgagggattaagttcataatttaaaaaggctgcatatatccgattggatgcatgtaaaggccaggtaaaaaaatacccttctcttaaaaaaaacgaaatcttatttgccatcctgagaccctctttcgatgggggccttaatcctggcccattcacatgtataagttaggagattgaattaaaatattggcccatgtaaaatcatcgggattgaattctccttaattaaatggaagagtgatatactcttcaactatatatgaaagtgaaccaaaagaaaattaaggagactgaaaacaacaatacagtgtagtgctcccatccgtcttagaaatcactacacagctagagcctagccagagcatgcagatttcactcatgcatacggcgccacgtatctgcccagacgccccatgctgaattcaccggcggcgagatggaaaacctaagcacagcagcatcagcgtgtgtgcacttacctgctcgatcgatctgcacctctatctctccatgtgctatatataatcgatcgatttgcattctgatatatatgatgcgtagacagtgatctcagtttcaactcctaattagctcctagctagctagctttatataccaaatcgaagaagaagaagataatgtccggctacgggcagcagccgacgggcgatcgtcttgagtcggcgacgttggtgcagtccatggagtcgaccaaggatacgatcgtccggcgcatcaccgagtcggcggccaccgtcgacagcgccgacgtgcaggcggccgcggccaagctgacggcggctgtggagtacaggttcgacgttgccaaagctgacgttgatcggatcatggccgggagaggtatagctgaatttactcctctatatatactccctccattctaaaatataaacatttttatatatacttccttcattctaaaatataaacatttttaagtatagtggcagattaacatttaattttgactattaatagtaataaaataaataaaaatcaattatgtaaaattgatgttactatatttattattaaacaaactattatattatgcaactttttttatttaaaacatcttatacttttatagatatagatattgttggtcgtaagtagcatatcggagaccgtgtcaactaaaaaaaatgtttatattttaggacatttaaattcttaatgcccagcagcttatagtgtgctctcggatttaaacggagttatatatatagtacgtttttaattttaatttgaatgcgactttattttgtgtgcatgcaggcaactagacaagtgatcgtggaagacgacgaacaccgctggcacacatgtccgatgcagtacaannnnnnnnnnnnnnnnnnnnnnnnnnnnnnnnnnnnnnctcaaagccggtttcatcagagaggtactccatctatagtggcaagccaacccagtcatggtacggaaggccaacggaaagtggagaatatgtgtcgatttcaccgacctcaacaaggcgtgtcccaaggatcactttcctcttcctcgaatagaccaactggtggacttaacagccggttgcgagttgttgaacttcctcgacgcttactccggttacgaccaaataagcatagcaaaagaggacgaggagaagacagcattcatcacgccgttcggggtattctgctacgttaagatgccgttcggactaataaccgcaggaaacactttccagcgcacggtccaaggtgcacttagcgaccagctcggaaacaatgtcgaggcctacgttgatgacattgttgtcaagaccaagacaagcgactcattgattgacgatctgcgggaaacgttcgacaacctccgacgatatcgcctcgtgctcaatccagagaagtgcacgtttggagtaccatcaggcaagctactcggcttcctcgtctctgccagaggaatagaagcaaatcccgagaagatcaaggcaatcgagaacatgaagtcacctagaagactcaaggaagtacagaagctaaccggatgcatggcagcactaagcaggtttgtcactaggatgggagagcgaggacaacctttcttcgttctattgaaaaagcaagacaaatttgtatggacacaggaggccaaagaggcattcattgcactcaagcgctacctatcaaatccacctgtacttgttgccccccaacctaataaagaattatttctctatattgccgccacgccatattccgttagcactgtcattgttatcgagagagagaaggtgcaacgaccagtctactatgttagcgaagctctccacgacgcaaagacaagatatccatagatccaaaaactgctctacgcagtaatcatgacatcaagaaagctacgccactactttcaagcccacagggtcacagttgtctcctccttccctctcggcgaagtcatgagaaacaaagacgttgtcggccgcattgcgaaatgggtagtcgagctaagccaatttgatatccacttcgtgccacgaacagccatcaagtcccaggtactcgtcgatttcgtagccgattggaccatgcctgataacaggtcagacaaccaaatcgacaatgaaacgtggacaatggcgttcgaaggcgcactcaacagccagggagcaggggcaggattcatcttgacatcaccttcgggagatcaattcaagcatgcaattcacctcaacttcagggcaaccaataacacagccgaatacgaaggactactcgccgggataagagctgcagctgcactcggagtcaggtgactgatcgtgaaaggggattccgaactagtcgcgaaccaggtgcataaagattacaagtgctctagccccgagttatacaattatctcgcagaagtcaggaagctggaaaaaaggttcgatgggatcgaggtctgacatgtataccgtaaagacaacatcgaaccagatgatctagcatgacgtgcgtccaaacgagaaccacttgaacctggcacctttctggatgtcctgacgaggccatcagtgaaagaggcaagcggcgaagatagcccggtcgcccccgacaccagctcgggggctacggaggtagaggacgccgttgccgatatcgagaccacggacgactggcgcacccgactcattaaattcataagcagcgaagagttgtccgaggacgacgcagaagccgagaaaatatcccgtgaagcaaaagtctactgtatgatcggcaacgatctatacaagaaggcaccaaacggggtactcctaaaatgcgtctcgtccgacgacggcagacacctcctcctcgacatacatgaagggatctatgggtcacatgccgcccgtcagacatt

SEQ ID NO: 53353 - DNA, 9133 bp, Oryza sativa
ccgttctcgtgctaggggctagatatacttgggccattcccacgaggacaaggcggctacaggttcctattcgtagcgatcgacaaattcaccaagtggattgaagcgacacccacgggggaaatcaaggccaacaacgccatcaaattcatcaaagggatattttgcagattcggattgccccaccgtatcataacagacaacggctcccagttcatcagtgccgatttccaggattactgcatcaggctgagagtccagatctgattcgcctcggtttctcaccctcagagcaatggacaagtcgagagggcaaacggcatagtactacaaggaatcaagacccgcgtctacgacaggctcatgtcaaacgacaagaagtgggtcgaggaacttccatcagtactatgggccgtgcgtactacaccgacaacgtccaacaaggagacacccttcttcctcgtgtacggctcagaggccatcctccccaccgagctatgacatcaaagtacacgagtacataagtactccgataaggatcaggaggagcagcgatacgacgatgtgaatctactcgaggaacatcgcgaacgagttgctgttcgagcagccagctaccaacaagcccttcgccgttaccacgagaagcgcatccaagcacgcacgctttcgatcggcgactacgtcctccgacgggttcaaagccaagcaggacgcaacaagctctcacccaaatgggaaggaccgtacacgatcacacaagttctgcggccaggcgcattcaaaatcgcagacggcgatggccacgagttggcaaattcctggaacattgatcaagtacgtaaattctatgtttaagtcaatagtatccatacttgtaagacatcttacagcctcaataaagcctattttttaagtacagacgacaatcaaagtgttccttcccgatgatcccttacccagatgacacctagcgttgaaacctatcctcatgtccctttacgccgtcttgacaaggcctccgaggaacctaagggaacttcggctggggacgcccagagccgataaggccttgtcagatcctgtagagacgaaagaccatgtcagatctggtcgtgtaagagttcttgccgtgcatattaaccaagccatgtaatcggaaataaactttccaacttcacggctgaggggctaggatcagtgcttgttcaatcgaggcaggtcaaaggtccaagagccttatcttccgagaagaattctccgatgacaaggctgggggctagggagagtgtataactcaaacgactgatcgaagtcgcgaagttagatagatttctttttctattccacaagtatttcttacaattctatcaaaatccaaaactatattacactttttccaaagacatttgtcacaggacatggagactaccaggaaggccaacaccagtccatcgactggaaaaccatctccgccagcggcgccatcgacttcgccaggccatctatctccgtaggagttctccgagaacgagaaaacccttcgcggaggaactcgaggtacagctgcggacgatgatctcgtatataggccagcacgtgccccccggcatatcggcttgagcgacgacactcctgcttcaaggcctcgtcgatacgttgaccgatgccttcgagctgagcgcaggcccccattcagccacgagatgtatccggccgccgattcctcgggatccccacggggtactcggagctctctacagactctcgacatgaatgtgcagcaactcttcagatacgagttgaaccacacgtcacgaccccggagtgtctctacggcctggtcctttctcacctccagcatagtcctctcgagttccgcaacctcaaacttcgtcctccaatactagatgcgacgatcctggtcaacaagcgcactctcgagatctgctcagcatggaaacgactaagtcaagctgctcttctatcccgagaacacaacaaatcaagtcgatctagacggaagggcaaaggaaatggtaacaaagacaaccaacctaagagagtcgccgccatgctcgtttccacaggcgaacttcgatctacatcgccttccggcacatatggttcggacgcaagtaacggaacgaccactggcaactcaggctgcccgcgctgctggacatcctcgacatcaacatctctacaaaggacaacaaagtactcgagatcaaaatgccaaacaaagctaaggcaatgaccgcacacactagggcggttgggaccaataaaagttttacaaggcatgactaaagagtacaagagagctaagaccctactcttcaaaaagcgggaggacggactcccccagatcgtcgacctcctccatcacatccttgcgcgcgtcgctagccgccccctgatccaagatcttccgcagatcgagttcagggtgcgcaagccttacacacgcaaggacgtggcacgccccggtgtagatcccgttagacgtctcctctccgatcctggccgcatgcttggaggggacctcctccgtcgccatcaccagctccgcaagagaagacgtcagcgagaactcatcgggattcgccgggatggtggacttgataccgcactccccggcgagctggtgcagaccagtataggtgacccgcaacgagccacggatttccaacaagttgttctcaagctctgacatgcggtgctcgagcccctgccgttatcgctcgttgccgggcaccagttccctcatcttctggaggtcctcgcgaacctccgccagatcgcgcgccagtcgattggcgcgctcgttcgccgacaacgcagccgccgccctcgcctccgcgatctcgaggctaacaccgcgaacaccagcctcgaggaggcgccccatctcaacctggagctcctcccaggtgaggacggcagccggcgaaccacgaccagccacgagatcgctggctgggccactaggtgtcgcctcacggctcctgggcacgaccacgacatccgtcgaggccacggcaggagatgcgctggaggtccctccagacccatcttgcgccgcctttgctcgcaccgccctgcgaaaggctacgattgagacagagttcgacgaaatcacgaaacctcaaatttattcacttacttctcgctgagcgtcacaagccgctgctgtcgcggaggcgggagagacgcgtccgaggcctggagtacaatcgatatgatgtgaggtggaagttttccgactaggtgatcaaataacgggagaacttaccgagggagtgggtgtcttccgacgatgtccgactacagaggagaacttcctcccctttttcggaacgtcgccgccactcgtcgtggcagcggcaacagcagcgtcagacgcctccttggcgaccttctccttcagcgacgccgccacctgatggtccacgagcggcccgatgatatcagtcagagggagagcctacgtttcataaagtcataatgcgatcccggaagaaaaatgcaaaaggacagctaagtacacttacattgatggcagcgtcgtgctcggttgcccctttctcgcaaagggggacggggacgttgctcgccgttgtcgggccgctgatcatcagttggccgacgcggcgctccacggttgcgctattcaagcctgtagatcgagaacagaacccgataagccgggaagaacacgcgcataagagagtcaatttaactaaaaaggaaataccccgaggagaaacccgggtcgcgtcctctggcccagaataatcaaaggcgggatgggctcgagcctgaagcggttggatccgcctaccaatgaagtcggcagcaacttcataccccgacaacccccgttctcggaggtcgtcaacgatatcgatgaaagattggagggacggggtcaaggcgggtttggtggtccaagatggaatcttgtctggctgttcctcaggtaaaatgaagacaggatccgaatcctctatctgaagacagaaccacctcccccgccatttgctgcgagatgaggggcactgaaaggggatgtatcgcgacttcaggccatcccgaagtcggaaaccaacacacccggacacctttttggattccatccagcgtaactcatagtaaaagcggaagaggtcaagaaacggctccaccctaatgtaggcctcacaaagatgcgtaaaaatactcaggaaggcgatggagttggggttcaaatggagcaaggaaagaccatagaaattcaagaccaaaaggagaaattcagaaggcggaagaagaaaaccacagagaataaagtcctcaaccgcaaccatgcgacccaggacaggctggggtttagtacctcctacttccctctccgcggccccgcgaccgggaagggcgccatcctcctgcagtttcttcagtgatgcactggtggaggtagacttgtcgagatccatggccaccggagatcgccggagaaaggaccgagacgagttggctatggtttttttgcaggagcgaagaagacgagggacgcttggaagctggagagttttttgaataggctgacctcaaatgggatccccaaaactcccttaaatagacgcacctccgccggtgcgaattcccaggaaaggagagagatggccgccggaaatttttaggtccgttacgcgcggcagtttttcggacttcaatttaaattcactcatgaccgttgagcttcactcgacgttgtcgatcactccttgtctcttggtccccacaccgagaacaacgacaattttgacatcagaagtcgcaatcgatttcacgagttcatttaagcagaagtcgggggctactgtcagggttacgggtaaggtataccctctacccttcgatatacgtcacgtatcgatatggtatgtttgtgtgtatacggacgttctcagcataggttaaggaagtccatcatggagtctacagatggaaagagtcctactcggatagaactgggtcgtcattatatcgtgtcgggtccaatgtctctgagtcttacttagagaccagctgacctacggtaaaaaaagggaccccccgagaggacctaaggcatcgaatctcagagccaacacatccaccacagcctacgaagccggagcttatcgaagccaagtcgccgggagatctagtcggatcaactcaactacgatcttgtcggtatcgtcgagcttcattattccctttgtaatctgtggtttccatcatataatcgcatatcaactggattagggctattacctaccaaggggcctgaaccagtataatccatgtttcctgtttgcttgatgtcgtactatgtagatcctcgtaccagcataccccaatactctctatatccggtctacgggtatccaccgtcgacagttttggaaatggtgcttagaggaatccagggatgaagcccagtagaagcccgtgggtgcagatgaaccccccaaaaaatatcttttagttattacccccatatctcggccctatatgcacccccctcagcccaatatagtgcacccacagcccaaacagcagtccagttaacgtggtaagcccatgagcaggccagtagggtggaagccagatcgatgttttctcctctcgacttcttgtatcgtgtgccgcgccgccgccagtcttgacaactccgcctcgcgtctgtttggcttccacaccgctgctctcaatcagccaatcccagtcagcacttgcccatctcggcatctcaccgtcgccggtcgccctcttctcagttggcgaccgccgcgggcaggaagccgacagctaggcaaccaggagctagcgtcacaagccaacaacgacatcagtccatctccaccaactgatcagcacacaaccacactgtgcgttagtagagccaaggtaagaaaacatgcttcatctatttctttttcaatcaatttgatttattagatacgaagccctaaaatttttattggttgttaatttttatattgtaggattaggaggccaccaagcttcaatttggggtccttcagaatcggagtaagattgcagattggaggaaaaatttgagaatttgaattgaaggtgcaatttggatgtaagtcatgtcaattttcattctatttctttagttgaatgaatgataaaatctctacacatttacatcttcatgaatcatcttttgctcatgggtcagtagccatttatcaatgttattagtggttttcttcattttaaaaaaacaatgttttccacttctttattttattgatgcatgtatgtctctattgttgatgtcaaaaatttatcgatcagcggttgcattgaaaatttagcttgaagttatatatatatatatattgatatacttgtggtacaatcatgaacccctccatttcgctctagcttcgcccttagaggaatccatgcatttgggtgctataagagcaagttcagcagtatagttaattgctagctataaagattaataaatcacttacatctaatctatagcgaactcatataatatatcgctttagatatatatattccatacaacattattaattaatacatatcccacgtctttttcatatagattattggagcacattctacgattggccaaatctatagcccacttttttttctttctcctctctcctccaccttaaacataaatctatttgccatcaagatcaacgagtttatgcgtactagctagaattattatcttttttgtctttgtatgtttttggaattaatatatcagataccaatttttgttaccatttaaaaaaatcaaaattattttgattatatatatatatatatatgagtaaaatacacggccggtccttaaagttgagtgcgggtgtcacttaggtctataatcttgtaaattgcacatctagatccacaatcttatttaagtgactcattgaggaccaaaggatctctgaccaggttgactggcttatgtggcggtccagcgttgcaaaatatttacattttgccccctattttgcttcccgtcttcctaaatctctctctctctcggacacaggtcggcaggtgcgcacggcgaggcttggtggcgagcggcgaacgccgacatggaggggcgggcggcaaatggtggcgcacggggcgggccccgctgccttccgcgcggggtcgccgactttgcccttccgctccgagagcagagtaggaggtagtgcgagcggccggcgggggaggcgggcttgctcgggcgccggtggcgcgctagtgtatccggcagcggaggcggacgtgaaggcgggtagcggcgcgcggggacgggccaacagtcggcgcgcacgacggcagacatggcggagagacggaagtgtcggcgaggcgggcgtggcggagaggcgggtggcggtgtccactcgatggggaagagcggctcgtgcaacaccccgcgcacgtcgccggcgcctcctctctcgccgctctccacccctgagccaaagaaaccgagagggagagctccatcgtgtcctcctcgccttccactccatcgtcggccgccgagaaggatgcattgccgattgtcgtcaagccgcgctcgccattatctctttcctgttccatattctactcaccattccgaagatttctccttttgatttcatcctctatcgtgcagcaaatcaatgggaacgccactgtgtcatcgccggccttgggacgtgctctgcgcgacgtcgtcgtgatctcatcgccgttcccgtcgttctggaccaagtcaagccgagccaccacgccactagtatccccacaccatcacgaccaaaacccctcaagaaccgtggagaatgaagcatcatggacggagatcggcatcatcttctccaactctgactgccggctaccatcgttgattccgcctcctctggtgagccattgtccgattcctcgcgcatacaccatacctgtcacctcactaacctcgtggacgtcatgctagatcttggagccgtttgagctgtcaccgtcatcccggaggttcttaccgccgccgccaatgtccatccatcgccaagtcctcgtcgggcctctccaagccacagtcaatcttcagtgagcctcctggtaaataatagaaccacatgcatgcacgcatttaagcaatacatggtcgtaggcgcacatgcaccaccacccgaaaacgtcttccgctcggactcgccgccggcgctactccgatgtccactaaccgagaaaagtagaggaatggaatcacagtaacatgctcttcattttgtcttttggtcgcaccccgaaacgagccacctatcgccgccggcgagctcgccaagctcacggcctcgaggtgctggtagagcgcggcgacgaggaagagcgcgagcggtgaactcggtgagtgcatacgccggcgacggcgaggacggcgcacggcggagctcctccacagtcggagccagagctcccggatccgcgcggcgacgcagtggcgcttggcgaggcgccacattcggagccagagcggcgcgcaggcgcagttgctgctgcaggggcgggacgacgatgctactattgcggaggggcttgtttgtaaattggtgcttgcgtggcgtgtcacgttggcggtcagacctggtcagaggtcctttagagctcaatgagtcacttaaacaagatagtggatctaaatgtactcgtgcttttatatatatatatatatatatatatatatatatatatatatatatatatatatatatatagcacactcatatggggcaccatggtgcccgggcaccatggtttcaaatgcacaaaatcacttaaatttttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataa

SEQ ID NO: 53354 - DNA, 3499 bp, Oryza sativa
tagttccagatccgagttgtatgggataattaaggatcatgtgaattcatttttcacgtaaaattgaaacgggttcgttcgatgggatccgatagtaaaatcgtgcaggctcattgagatgctttggatcgacggtggatatagcaggagtacgtactcccaggagtatataatcattttcgtatatatatatatatatatatatatatatatatgtatatatatatatgtatatatatatatataagagggatgtccttaagtggcatagaaagaaaacatctccctagaaatatgccatgcacatgtttagaaatctggacttgttgtcactcttaaattaacacgagttaatttgcagatgaaacctataccaagcagtacgtattgaaaaggacatcgatcgatggatcaaacagttggaacatgcatgctactaacattcaggaaagtcagaacgtctagaagcgaagaagcgaagagatcgagatcgttggcgagcggaaaaaacaattcaattaatggtgaaggaattaatgtgacactgacacacgtcatgtaggatatgttagttctcatcttctagacatgtggaggaatttacgtaatatggtcatatttagtccgttaaaaaaaattaacctcgacgtagaagtattctcttctaatacaataaatatatatatgatcctatcttaaaccgctttcacaaaatgaaatatgtattattatataattaattaagtatcaactatttttttagaaatagcttcgtatgattttataaaataactttcatatagaatatttttaaaaaaacacaccacgcgtgaaaaataagagagatgatgagttggaaaaatagagggaagaatatatacagccatatgtagtcatatcttttttaggttaagtttttctgagactcagagattacctcggtagcaccatcatcgaaaccaccaccgctatttggttgcttttgttggaattaatagatgggctaaaaccattcgaagattaattctttggaaaatcacaaaagcccacctcatgagatggcatgcatgtggagtttagtactaccttgtttattccaggagagggggacctccttaaaagggaggatgccctcctagccacttgaaacatgtgtggtggagagaagaggggaaacacgcgcactcgctggcctggcctggccaggcagggcaggcggcgcgcgtgcacgacgtacgcgtcgaatggtccgcaaaattggctcctcacccttgcgcagatgcagcctccttttgcagttttgttttgctgcggaaaattcggatttgttttgttttggaaacattccgaaaaatccggtgcgtgaaaacggcgtggagtcccgataagttacgcgcgacttatccggttcggttacgcggagtggagatcgtgcgggcgccctgatcaagcgacctatctctatataaaccgagtcgccggcctcacgcaacatacgcgaaatcaatctagggtttacctcctactatgtgctgcgccgtcgctcgtagactactccatcccactcgccagcgtgcaccggcgatcgggagagcaggtcttcggaacctctgccttcgacgtcctgcaccgggagaaggcggcaataaggtttttgggaagcgcttagcgcgactgctccctgttcgtccgcgacggctcgccttcctctccgctcgcgtgctgcgcgccttcatcgacgcccgcaaccgtgagtagttcctgcggagcaaccggtctttccgccacctcggtacatgttcgatatgttacgcatatttgatctgttcatgttttacttcttagtttacatgtgtagatctaatgatgcgttcatgctagtttacatctgcaatgtcatgatttatttgtggaataaattaaatcattatgtgcttataatttcaacaatccaaaaaccttattataggcgctgtgattttaccgtggctagttttgccgatgcactgaggccggataaattcaccggtgtgcactttaagagatggtagatcagggtcactctgtggctgacagctatgaaatgcttctgggtgagtactggcaaacctgaaggaattcttactgctgatcagcagaagcaattcgaggaagccactactctctttgtgggatgcattcttagcgttcttggcgaacgtctggtcgaggtgtatatgcacatgactgacgctaaggagttgtgggatgcactgaatactaaattcgttgctactaatgctagcaatgatctatacatcatggagcagtttcatgactataggatagctgacaaccgttctatagtcgaacaggctcatgagatacaaaccatagctaaggaactcgaactccttaagtgtgtcttacccgacaaatttgtggccgggtgcattattgcgaaactacctccatcttcgagaagtttcggtactgcactcaaacacaagagacaggaatactccgttgaggggttggtagcatctcttaatggtgaggagaaagctcggaaaaagacgccgcgtctaagggcgatggtgggcagtccagtgccaatgttgtgcacaaggcctagaacaagagcaaggggaaatacaaagctcaacagaacaccaacttcaagaagcagaagaagaacaacaacaatcctaatcaggatgagaggacttgctttgtgtgtggccaacctggtcatctggctaggaagtatccacagcgcaagggtatgaaggcacctgcagggcagacttctaagtctgctaatgtgaccattggcaacactggagatggaagcgggtatagtaatttacctactgttttttcagttaatcaatctactaattggtgggttgatactgcggccaatgtacatgtttgtgctgacatctcattgttttcttcttatcaggtcgcacggagttccaccgtcctaatggggaatgggtcacatgcttctgttcatggtgttggcacagtagatctgaagtttactttgggaaagatcgtgcagctgaagaacgtgcagcatgtcccttctatcgataggaatcttgttagtggctcccgtctaactagagacggatttaagttggtttttgagtctaataaagtagtcgtgtctaaacatggatattttattggtaaaggttatgagtgcggaggcctgttccgcttttccctttctgatttctgcaataagtctgtcaaccatatttgtggcagtgtggatgatgactaatgtttggcactcacgtttatgtcatattaattttggcttgatgtctcggctttccaacatgtgtttaattcctaagttttccattgtcaaaggttctaagtgccatagttgtgtgcaatcaaagcaacctcgcaagcctcacaaggctgccgatgagagaaacttggcaccactagaactactacattcagatctttgtgaaatgaatggggtgttgatgaa

SEQ ID NO: 53355 - DNA, 2698 bp, Oryza sativa
ttgtttaaacgaaagacgaggctctagactattttaaaatttatttttttttaagttgaaaatcaacttgacagaaagataaaaagacttaggtctgatcgtggtggagagtttttctcaaatgagtttgaattattctgtgaggaacatggcatcatacatgagaggacgcctctctattctcccgagactaatgggattgctgaaaagaagaaccgcacactgactgacttggtgaatgccatgttggacaccgcgggactacctaaggcatggtggggggggcattgttgacctcgaatcatgtgttaaacagagtttctaaaaaaaataaggacaaaataacatatgagatatggattgggagaaaccatcactttcttatttgcgcacatgagggtgattggcgaaagtcaatgtaccaataacgaagaagcgcaaactgagacctaaaactatggactgtgtctttctgggatatgctcatcacagcattgcctatagatttttaatagttaaatctgaggtacctgacatgcatgttggtacaattatggagtctcgtgatgctaccttctttaagtgctttttcccaatgtaggatacacacagtagttcgagccaaccctctgaaataattcccagttcaatcacaccaccagaacaaactgaacatacacatgaacatgtcactaaggaggatgtcagtgaagctcctcgaaggagtaagagacaaaggacggctaagtcctttggtgataatttcactgtgtaccttgtggatgacactcctaagtcaatttcaaaagcttatgtatctcctgatgcagactactggaaggaggctgtccatagtgaaatggattccattatcgctaacgggacttgggaggtgacagagcaaccctatgggtgtaaacctgtggggtgcaagtgggtgttcaagaagaagcttaggcctgacgttactattgaaaagtacaaggctcggcttgttgctaaggctatactcagaaagaagacgaagatatctttgacacttactcacctgttactagatttactacaattcgtgtgctactttctctagcagcctcacatggtcttctcgttcatcaaatggacgttaagacaacttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcagtctttgcagtcaatgaggcagataaatgtgtgtactatcgccatggtgggggtgatggagttattctgtgcttgtatgttgatgacatactgatatttgggcaaaccttgaggtgataaatgaggttaaatcattcttgtctcaaaattttgatatgaaggatttgggagtagctgatgttatcttaaacattaagctaattagaggtgagaataggattacactcttgcagtcccattatgtggagaagatcttgaatcactttggctacattgatagtaagccttctccaacaccttatgatcctagcttgttgcttcgcaagaacaagagaattgctacgaatcaactggaatactcccaaatcattggctcgctgatgtacctggctagtgcaactaggccagatatctcctttgttgtgagcaagttgagccggtttacctctaatccaggcgatgatcactggcgtgcgcttaagcgagtaatgcgctgtctgaaaggtactatggaattggggcttcactatactgtgtatcctgcggtactggagggttatagtgattctaactggatctctgatgtggatgagattgttaacaaccaaatttggttatatcagtatcggagatgaggataagaacgaagcagaatcaaaggtggagatcgattcgagaatagagtaagaatcggttggagtccggatcggctacgatcaagatcggctgggtccgaatcagactgggtaagccgatacagccgattctgacaatacgacttggtgtgcaacatcgggttgagttgatatgcttcaagatgattgccgcgcatggatagagtcctgagaagtctaccgcaaagagattccttagagatatgtttgggcaaaagtctgccacaaagactcgtggtatcttagagtttattagagataagagtcgtgtccgatatggacatagtttgtattttcgggtataaatagaccccgaaccccatgtaatcaattaacacacacgttcaatacaatttcggcgcatcgccacccttttgctttagttttatttcgacgagttcttgctttcgggttgagctgcatcggtttcaatcttcaacaagaggtaaaacttgttatgacggcttgcgttctcgggattagtgcttccatctttatgacactctaatcttgtttatgtaattcgttgagttatcatatatcttacataatctttggcaatatcgctatctaacctacaatcggctaacatctatcggtagagggcagccgattaggttagacatcgacgttgacttagattatatgagatatctaccactctatgaaacttccagcgacttgattgtttagatattgttcttcttttcatacttaatgct

SEQ ID NO: 53356 - DNA, 2426 bp, Oryza sativa
ggcgaccgatctatcccaatcacttgatttaagtgtatatccatataagaattatatattgtgaatatctatagccgatcgaatagatttagttctttattatctatttacaaccgccgatcgatttacatatgacatcagctcaaagataaatgatatgtcatcggcacttagccgatcggctatcgtttataggtttaactgtggtttctttgtttttatttcttattgattgcaggatcaaatcaactggcacgctagcacacccgaaggcgagttttggacatgcactggagttaagcagatctcacaggcctcgtgttttacgtcaacagagatcaaagctactagtggatatgtcttcacactaggtggtggtgctgtttcgtggaggtcttgcaaacagactattttgacgaggtcaaccatggaagcagagctgacggcattggatactgctactattgaggcagaatggctacgtgatctattaatggatctgcctattgttgaaaaaccggtgccgtctatccttatgaactgtaacaatcaaacggtaattgtcaaagtgaatagttctaaggataatatgaaatcgtctagacatgtgaaaagacgattgaagtctgttaggaaattgagaaactccagagttataacgttggattacatccaaacagctagaaacctggcaaatcccttcacgaagggactatcacgaaatgttatagacaatgcatcgaaggagatgggtttgagaccatgtgagttatactatggtggtaacccagtcaatgtgatcggtgatcggagatcccgtagattagaacctgggaagaacaaaccattagtaaactagaggagaggaccaatctataccctctctaagtgaagatgcatgtactctcgtgagctgcaaggcaggttggctatgccttaatgagttctgttggctttaattagcgaagatgttgtcctgcagtgcattcttgaaagaactcacctttgtgagcttgactgttggtcgcagtctatggagattttgggtgaatcttctaggaagcttactaaagacttaggagtatgacttatacgctccacccgaggggtagtctatagacggtctagtaccagataagactctgagtgaaacttgcttgcacaagacttgcaattcaaggcgtagtccattgttcaagttgtgagtaagtgtagcttggagttttaggtggatgttcaaccttaatcggtcttcatcgaaccgctggtatataaacagtacattggaaaagacaaatctcagtgggattttgagatttggtgggggattgttggaattaatagatgggctaaggcccattcgaagattaattctttggaaaatcacaaaaacccacctcatgggatggcatgcatgtggagtttagtaccaccttgctaattctagaagagggggacctccttaaaagggaggatgccctcctagccacttgaagcatgtgtggtggagagaagaggggaaacacgcgcgcgctcgctggcctggccacccagggcaagcggcgcgcgtgcacgacgtacgcgtcgaatggtctgcaaaattggctcctcacccttgcgcagatgcagccttcttttgcagttttgttttgctgcgggaaattcggatttgttttgttttggaagcatttcgaaaaatcaggtgcgtgaaaatggcgtggagtacggataagttacgcgcgacttatccggttcggttacacggaatggaggtcgtgcgggcgccctaatcaagcgacctatctctatataaaccgagccgccgccttcacgcaacacacgcgaaatcaatctagggtttgcctcctactatgtgctgcgccgtcgctcgtagactactcaatcccgctcgccgacgtgcaccggcgatcaggagagcaggtctccggaacctctgccttcgacgtcctgcaccgggagaaggcgacaataaggtttttgggaagcgcttcgcgcgactgctccctgttcgtccgcgacggctcgccttactctccgctcgcgtgctgcgcgcctttgtcgacgcccgcaaccgcgagtagttcctgccgagcaaccggtctttccgccacctcggtacgtgttcgatatgttacgcatatttgatctgttcatattttattgtttagtttatatgtgtagatctaatgatgtgttcatgctagtttagatctgcaatgtcatgatttatttatagaataaattaaatcattatgtgcttataattttaacagttttctcggggttgccacatctcaaatcgcgcaatcggcagcgtgcgcgctctctctctctgccatggcttccatggccatcatagaagccctgtgttggccgacgatgcctgcttgcgtggtgaatggagg

SEQ ID NO: 53357 - DNA, 3518 bp, Oryza sativa
aaaatagctttaagaaaatcatattaatttatttttaaattttactaatacttaatttattatgcgctaatccgtatcttcgttttacatgtgctaaaagcatacctaaacctgtccttccgaacacacattgtattcttaaaatacaaatttcaaaggatataaataattatgagtattcttatcgaggttgccctgccatcccacagcccaagtagctgtactaaccataaagacattctcaatgtaggccattggtggaaagatatcataatactccttccatactaataaaggaagtcattttaaatagcgacatggtctccaaaacacaattttgacttcttgttcctataaaaatattattgaaaagtgatatatgtatacttttatgaaaatatttttcaagataaatatattcatataatttttacattttcaaactcaacaacttgagagttatttatgatttatattcccaagttttgatttaaatattatcctaaacgactttctttacgagtacagagagagtatgtgcatatgtataatggataataagatgaaactcgttgaaaaaattctctaaacgtgagccatgctacaattaaaagaaaaaggcggaacctagtctaaaatactttacctggtagtaagcttatatcctgatagtaattgtttaccatctctataatgtattttaactgataacaataatatatttaatacttattacatgctattccatataagttgttgagttgttcgtcggtccggctcaccgagatggaatttggaagaaaacaaaagtagtgtcctcgattcgtctttggatctctctccagaacaggcaacatgttcccactggtttattagtcaaatgctatcccccagcagacgccagcagacggggtactctcgtacgcagccgactgccgacgtgcgtccgtactccgtaggtgctcatctctactacctccgtcacatattactatttgttttgtcaatgtttgatcattcgtcttattaaaaaaatttgaaattattatttattttgtttgtcatttgctttattatcaaaagtactttatggcttatctttttttatatttgcactaatttttcaaataaaacgaatggtcaaatgttacaaataaaaagtaaaaaacgtcacctattatagaacggagggagcaggacgcaagcggctcctgatggatatttaattaggcgatggtccaaatctatcggagaccaaaattatcgaaattctgaaaaaaatcaaaattcaaatattttttaccaaacctgaataaatatagctaattaagttcaaaaaaaataaaaatttaagataaaataagtttaaaaaatatcgaaccgaaatttacaaaccctaccaacgtgacagtggacacgtaagtgtgcttagcagctcgaagcacgtactcctttagtgaaagaaaaaaaaatatatagtattagatgtgacttactattatggatctaatatgattcataatactaaaatgtgtacgtatgtataacacatcgacacgagtattacgcgcgcatagacacgtaatactggtagaaaggggtgcacgtctggtaacttacaaatgggcccgcgggtgtgataggacccacacatcggtgccatcacgctcctctctgacgtaaccctctcgatcggggggatgctgatgagcgactgaccgcgcgcggccgcagtcgcgcggtcagtttttaatcttatcccctatatatactactagtatactatactcttccttatactactatatcccttatactactatactatatactatatgtatttatacacagatatatacacttttaatatatacatgcacaaagtttatatagtatagatttaaaaaccgaagatacttatatattaaaaaaaaccggaaaaagacccaaagaaaaaaccgagaaaagggggaaaacagcagggaaaagaaagaaaaccggaaaaacccggacgcgcctacggatcggtcgcccgatcgatttggagaaaaatcgggcgctgtcgtaagcttgctcttagagtgcggtttgcatgccaaaactactttgaagtgatttttctcttaaattacttatccaaattatgatccgattacaccattaaattcgttgcaattaaatcttcaaaacaagaccacacatggatatattctgacgaaatttttttagtttattattgaattatttttaaatgttgcacgatgttccaccaggtatatcggaattgtttcactaagtagatcgaaaatgtttcactcgtttaaatcgggtgttgtttcaccttatataaaaacaatgtttcagcaaataacgaaagattatttcagttcactgtaacatttgatccatacatagtaaaacattataagtacactagatgaaatatttttcggtggaacaaaaataaaacgattcccttaatagggctttccaaaatatgtgagttttttttttgcaatggagtatttcagctcactgcaatattagatctatacatagtgaaacattgtgagtatactaggtgaaacacttttggtggaaaaaaaaataaaccgaattcccttaatagggggttttcaaaatatgtgggttttttattgtaatggagtattttagttcactgcaatattagatctatgcatagtgaaacattgtaagtacactagttgaaacatattttgtggaacaaaaaataaaacaaattcccttaacagggggttccaaaatatgtgagtgatttattgcaatagtatgtaggagcagagacatggtggggcccagatctgcatgcagcacgtgggggcgtgcgcggggaagcgcccgatccagctcccctgcgtcggtcgcccgggagcaagtattatcggaaaaaccgtagaaaaagaggaaaaaaccgaaaaaaaaaaaggctactggtgcgctctcccgccgccctcctctcccccgcgcgccacgtggctacgccgcgcggaggaatggcgctggtctgaccgctaattagcagtttcgctttcgatctgcctctgttcgtgtggaaagtccacctcccggtgtgacgcgcgcgggcgacgatcggagggtcaaagcgggggaaagttccggaccttaatcctcctctaggtttttcaacgtcacgacccacgagtcgtgaccggcggggatctacgaacgtgctagtggtactacgtcctaacggcatgtggaaattcatggtaccttacggtgtaacgtcacgtacgttttccccacgctggaacgtatttatgacacattttttctactacgagcaaactcaaaaaacaattactatgattcttttttaaaaaccatatatactcactccttctctaaatgtttaaatgtttgacgccgttgacttttttaaacatatttgaccgttcgtcttatttaaaaaatataagtaactactacctctattttttaatagatgacgcccg

SEQ ID NO: 53358 - DNA, 7586 bp, Oryza sativa
tatgggttcgtaacccatttctcccacacgggaaacgacgtagctcattagcacatgattaattaagtattagcatttttttaaaataaattaatatgattgttgaaagtaacttttatatagaaaattttttggcaaaaatttataccgtttagcagttcggggatgtgtgcgcgtgaaaaatgagagaaagtagaagttagaaaaggggatgatcgaacgcacccttaggctgtgttcggctggctgagttcccagctgtgaacagtgcacaccaaaagcggagtggtccatcaacgtatgattaattaaatattagctatttttttaaaaaagtggatcaatatgatttttttaagtaactttcgtatagaaactttttgtaaaaaaacacaccgtttaatagtttgaaaagcgtgcgcgtggaaaacgagagtaaagggttagttcatttttcatttgcaaagtatctaggcttaaactctaatctatagtttgaaaagcgtgcgcgcggaaaacgagagagtaaaggggtacttcatttttcatttgcaaagtatctaggtttaaactctaatctctagccaaacacctgtccccacacatgtctagatcgttcgggatcctctatgaagatcgatctaaatgtgaaaaagcattaattttgaagcactgtggacacctttaaaacctttttttaaaaaaattcaccaccaacctatcatgtgataggaatttaagaaacaaataggagagtaattttagtatacaatcagtagaaaaaaccgtttctgaaatcttggtctggcaaaactcatcaatattatgctggtagtattattttggtgctaggtgaggctagctagtgcatcgtttcaagtggcgtacaagttagactgagccgctaggactctatgccaatattagtgaggaagagcctacaaatcggacgcccgtttttttaagaaaatcggacgcttttttactagttgggaaaaatgtttcaccgagtaaatagaaaatgttttaatctattgagatggtgaaacacatttgaacttatgactgaaacattttggtggaacatataaaacatcaagttttgctctattgaaataccaagaaatccatattggcaaaggacaaagttatggaacaccataaaaactcattgcaacatttcaattcaacataaaagaacattaagttatattgactgaaacataaaaaaaaaatcaagtcgagatcggggaggatatagttgttgatgccgcgtcgaactcatctacgtcggccacaaactgtgcgctcactgtcctctacgccgcgccgagctcgaccgcatccacgtggccgccgtcgtccactccgtggacctcggccaccgttgttgacgccgcagagctcggccgcatccgtgtgtccaccgtcatcattgacgttgggctgagctcggttgcgtccctatggccaccgtgctactgagctcctattctctgccacgagctcggccatcagcatggcggtggtcgcagagagcacgtccccaagcacggccacctacgacttgagctctaatcgcaagagaagcaggcaatcctcctccttgttttcaccggccagcggcgaggtagcaagagcagcctctcgctcccccgacgatgaggggaggtagaggcacatgtgtggggtgtgtggagagagaagatgggatagagagaaaagagaatgagggaatagataagaagtgggtggggagtaactgccctatatttagtgtgtgcatcggtcacccggataggatcattttcgtattagtgatgctgaaatgttatacctcaatggcaataggagtgaaaacggggtggatatttcccgcccgcccgaccgacccaaggcttgcgggaggaatatgagagagaaaatgggatatccgatattatccgagtttgaacccgaatccataaaaaaatatgggttatgatacgtgaatagttatatccgcccatatgttccatattatgaaacatatgtgaaaatctattataagttcacctataaacatgataaaagattagttaatcactatttttatgagctcacatgtaatattatataatttgttccttgatgtatcttttttagcactttaattgtcttcttacattaaatatccatgaattggacataaaaaaacccgttcccgaatccgattcaaaaaaagttatcggacactacccgtacttgattttgaatttaaaataaaatatgagttaggatatggaaatgttgtgatccgaccttacccaccccgtcttcacccctatatggcaataccctcggaaacctgagccgaggtccattcctgcattactagtatcctgagctgtctatttgcaaaaacaagaatacaacacatgggccataatgtaaaaggtcctgcataggcgggcgcgcaataaagccgagcgtcatttcctcgtcctctcctctgtcctccgttccaccacgcttttctctgcttccttctcttctcttctcttctcttcccttctccatcgttccaaaaccactcgccccgtaaaaccccctcaaacctccctcccgcggcggcgcaatcgcgttcatggcggccgccaccgccgccgccgccgccgagctggagcggcgggtgatggcggcggtgaaggcgtccgcggcgcgcggcgaccccccgctcctgcaggccgccgaggccgcgcgctgcgcccgggaggcctcctcctccatctccgtcgatggcggggccggggccgcgctcgccgcggcgctggtgtccaacctgtgcttcgcgcacaacacgggcgcgatgtggaaggtgctggaccaggccatggcgtcccgccttgtctccccgctcctcgccctcgcgctgctcaccccgaggtcccgagcaagccctcgtttcgccccctaatccaccgccgaatagttcgattccgtgcgggttttgagacctcgggttgagattaatcagattgtgttgggggggaatttctgcagggtggtgcccaaccggcaggcgcagccggaggcatacaggctctacctcgagctgctcggccagtacacggtcgccccggtctgcacggagagcgtggagacgaaggccatgtaagcaccgattgctccatactacagtctcaattgcttgcttcacattggtttgtctcgtgctctggatttgttgatgacatggacatatgcccctatccccacacaaacttatgggcgtgctacaaacctttgaattggtcaacgtgcttgcgagattccgtccaaatccgcggtgtgctcgtgttgctgatgttgatgctattattttccgggttgtagggtagggctgatggtttgagagggatcgcttgcgctgcgccagtggggcctgtgtagagggagaaattttgttaggttgaaaacgatgtgaatttcctagttgtgtgccgtcttggttttgaaagttcaaagttgatagcacaaggccagaggggcactcctttttggtgcactgtggttttgaagacttccaaagtgctcccatggtccaattgtctgattggactgtagtacgagataaaaggatgcatagggcaggataccaccaatgacctttttttttcaatccaaacctgtttggacaactgcagcccatgattacatgatctttgtgcacctgtccacattgtgatctttaccaaggttgtttggacattcgtgaaagatattcatatggatggttacttctttcaccctgttgtggaaacgtggacatatcctctttgttatcaggctaacatagtttatttatataatagtagtagaacaatcaaattaatgtagctgactagctgacatatgcatggctggacagctggctgtgatgagtatgacagccaacagttatgtacagtgatttgtcatgtgtacgcctggactacatgctgtcatgaacgtatgcacaacagtagtcaacagcacccacatgagattcaggatgctagttttaaagtacaacctttgtgcttttttttttgtcatttaggacattaacacgatctccaatgcacatgtattttcattgttcttttcctagttatgtatttataaaaaaagttggtagtgtaactagatgaaagtaattttgaggacaaatatagtaatatcatttttacatatcaaattataatatgttcaataattaaataaaatatacgcagacgcagccaacgtgtaatactatgcatgtagtagcagaacctactgtaaaattcaagtggaattttgattcaagttcttattttcacataataccacatatgctgttaatagtgtgtgggataaaggccatctgctatttctcatgtgctgctattttacactgtcatgcggttctcctcccctcccctcccctcccctcattcatccgtcattggtgatggctagagatggcaacggggacccataacccgagacccgatgggtttttactctattaggaggcaaatgtgttccaaataatgtacccatgggtctcttatcgggcataaacttcacccatcgggtgggccgggtcgtagaacgttctttacccacccgaacccattaacccgtgggtaaaaaatacccataggcctcagcccaaaagaacatgtgcagcccaaggcccaacaacaaatttaaccctaggtataaaagcctcccacccacttcctctccctcactccccctctctacacccatctcacctgtagggtgcccagccggccgccggccgctgcccgcgccacctgtgccgccgcacaccgagaccgcgctcgccctcgcttcccacgctgccgcatgccacccgcgtcgccgcacgccatccccgcgccgccgcacgcagtacacacccgcgcgccgccatcccgtggctggggaagctagccgtcacgcgaacgccgctcgcccgcgccgcgtgcacgaaggctatggccgacgcccgatgcagtccacccactagccgggggccgaggcaggtggctagctaggttaggtattagggatttttgccggggtcgaggcgtcgagcaaagccgagctgccgagttgatttgttatattatatcactgtttgaattatcagttgatttgttgattctgcaatgtgggctgtgcaatgtggctgcatggtttgtgtgtgtgctttttaatcctaatttgtaaataaaactttgctatggtgttgcactgctgattgactggatggattgtgtgctcaatctgattgctccaatgggtatgggtacccaatgggtacccgtcacccgtgcgggtgtgggtatgggggaatttttcacccgtgagcgggtgtgggtaatgaagcgggagcatttcatttcaatgggtgtgggtatggggtaggcgaacccgatgggtacgcacccgttgccatctctagtgatggcgcctccgtgatcctctgtaccacgccccgccggacctccaccaagcttcccctacgagctagagaatgagaggatgagggaaaaaaggtggggactggggaggaaggactccagcaatgacatgtggggccgcagaggtagaaagagagaggaaagagaagagagagatgggagaactgacctgtggggtcaggggtattggatgtttcacgctgtttctctccattatttagccagaaatgaatattctaatagacgcggtgtccagcagcaaatatccatgttttgggagtgctttccccgaaagattaacttctgcagtgttcaccagctaaaattgcaaagtcgtgatgtcctataccaaaatttgccaatctttactgccagtctaaataaagactactacagttggacttcagactctcagagaacggcttgtttattcatctttgctaccatgaatgctgctactgaatactcttttgtgtcaagccagccctaaactcatctaaccaatcatattaacaaacaatacgccatgtggaagggttcatgggggtaaacaatgccatgaaccatagtaaaaaatgccgcaccagccaccgaaccatctgagctcctggtttgctggtgtaacggtccgactgctgggtcagccattcagctgcaggaccagaaacacttatgtcatgtgtacatatccttcattggtcacaccatgcgggttggctagctggagggtttgactcccatatcacctctttttgcacaaatatttggagtaatatgtatatgagccttactaggtagactattgggcctaataaaggtccatgtcttggttagcctgcacacgaaccaccagtttctgtcaataactgcccggttcatctggtcctcacttggtcaattgcatgaatggtccttcaagtaagctgaacagctgagggcgctggttccgcgttttgtactatgacatgaacccctgcacatgaaacactattttagtcatgtatgtttgatatattgtataatatattatacttggaaagcgaaattcatgtgatgatagtctgactgtcatgctttgatatcccttatgtgcaaaaatcctgaatccttcagatgctgtgagatatgatacaagtgtgtttggtattaagtctttaagaccaaagtagatgaataccatagggaactaacatggcaatgaaacaatcatgacattgaagaagatttggttattcctataatcgtattgcatattccttaaactcaagctcaaaatagtacaaggggttgacactttccgacaaccctcttggaccttttgtaccctcgcgtaattgttttacacaagaatccactcatgtgctctaaattgcttctacttgctttggatgagtccctgcggcttgttcatggcttgggttgtttattgccatcccccttttatatacaagttcactagtcatcttccaaacagaagtagaaatcataatcttgttagtgttcgtcctaatcgggtaggatacaagtcacacacctttcaacactggcatactccatttagatccttgtccatacttaaatgtgtacgtataatgcgttatgcaaagcaggcatgtctcctcaagtgcatatctaatggtccagcgcttcatctaatttgtgttatttcatatgtgatcttatctgcatctggtgctgctttcatgtcatcaggataggagcatctgtttttctagctacttcattactaagtactccctccgtcccactcactaaggcgcacgcacacttttaaattcaactctttaaatatttgaccaataaatattttattataaattaaattttatttgatgaaaataataacattggattatcatttagatttacttttatatgattatgatttagttgctacaaacattgtagtatatgagaaatttaaagtcaaagattagtttagtgagtgggatggagggagcactcaacgagaaaaagaaacatatttttagtttatttaattaattatcagaactgttggattctgtaaaatgttcctaattatcttcatttcccattgcaggttag

SEQ ID NO: 53359 - DNA, 5197 bp, Oryza sativa
  unsure (1)..(5197): unsure at all n locations
ttttgacatgtttatggagaacacaatggacggaagacatcttgataccatatcatcaattgaagctctgacaggttctaatatatttttcagttgttgattcaactgctgtataaccttttttatcaacttgaaacctttggttggcacagaacttgctaagacacttcaagttcttaatcgagcaacctggcaagaaacctttcaagctctgtggatttcagctttacggcttatacaacgagttaagataacttttgaaacatcatttttttctttattaacagatgaggaagctagaatgttcgtttaatgtaattttgtatctgtttactaggatcgtggcattccagaagggccatttcctcatcttcattctcgattgtgcatgttattggctattgtacctctgtctattgcttccattcttaaggaagagtctgacaagattgaaggtggaatggtctctgttagaagaggagaattattgtcttcacttcaagttctagggcaattttttggtcttctttctcctccaccagcagtagtgcagtcagcaaatattgcagctaggaaagcattagttgctttatctgttttgaaggatcggaatgagagaggtcacaattattccaaagatatctcctctattaaagcaggttatctcagactgattttacaatatctagtatttttcttatgcatttcttattagtaaacaattcattttctctcataatcattctaaaattgcaggcgggaaatatgctacatcttattgtggaagcttgtatagcaaggaatttagttgatacatctgtttatttctggcctagctatgttgttccagttaaagacgcatctgctgttgaggaatccccttggtcagccttaatggaagggtcaccccttatgggccttaaggatgcacttatggttacacctgcttcgaggtgatgagtcatggacttgtaaaattcaattccttaagagcattttgggttttttaatgtttgctcactagcttgattaatggtaccgttcctacttgattattttagcctagcagagttggagaaattgcaaccttttgcagtaagtgggtcagatgaggaaaagttggcggcgtctaagattctgtgtggagcatcccttcttcgtggctggaacattcaggtagaattctgtgtggagcacaaatagaacgagtggcacatacaaaatgctcttgttctattttacaatctttggcctgaaaagttccgtatagtatgtgtcattattgactattactgcctttgaaaatgatttaatgtggctttcctgtgctcttttaggaacatgttatccaaatggtgcttaagttgctgtctacattgctccccctagactctggatcagatgggttctatatacatcacatgcctatgctgcatgctctcatatctgggatttcttcaattgatgtggttcatattctctctatgtatggcttggtaaggaaatcgatgtttttcataaagacaatgaattgctaaatttcagagttgcattttaaattattaaagcaaatatcaatatgctggattttatataatttacaaacttttcaggttccagaactagctgccattctaatgcctttatgcgaaatatttggatcattaccttcgtctgaccataggaattgtagttttgaagaggcctctgtgtactccgtattctcatgtgctttcctgtgtcttcttcgcttgtggaaatttcatagaccccctgtggagtatgcactatcaaaacatggagtctttgtttgctcagagatcagtttggattttctcctgctactacgaaacagtcattttgctttgaatagtccgtatgatgttagcagaaagagcatatttcaactagatccatcgtttcaaaaaccggtgtatattgactcatttccaaagctacgggcatggtactttcagaatcaggcttgcatagcctctactctttctagttcttacaaaaggaaaagtatccttcaagtagccaataagatactgaaaattgtctgccataaaatgtcaaaaagtggcatccctcctgtcagttcccaatcaacatcaagttccagtatgagtggttcatctctaggcacacaagatgatgtctcccaagggccgccagctactgcatgggaagtgctggaagctgttccttttgtgcttgagactgttttagctgcctgcgcacatgggaggctttcgtctcgtgatttgattacaggtttttattcagtatcctgcattttacttgcatatctaacactggtcttcaatttacactaacaagctaaatcttccatttacatttaagtagtgttgttcagaaactaataatatctttttgatgaagtttcttaattccctcaagttcatactccctcctccgtcccaaaatatagcaaccagtactacatatgacatgtccccctgtccagatccttagtagcagcatgtgtcgcatctagtactacggtgttatattttgggatggagggagtagtatttagttctagctctgtcctgtaagttatcccagttactttccactgtgaaagattgaatcaaatgccttcagtaacaaaatttctttgagctttcattatcatcaatttaactcaacgtngcgatagtactacctttcatagaatgtcagtcccgcatttaaaaattgcttaccgtgtattcaatattcatatattatgtaatttaatttgcaaaaatatttctgtctatggatatacttctcctgtcccaaaataaatggatctctcgcattccaaggaaactttagtagggagggtaaaacactaaaatgcccctcgatgagaaattagtattagtgggtgggtaggtaaggagtattgaagggatacgatttcttgatttgtggaccaagggtaggtaagagcctactccattccaaaatataaacatgtctaggattcaaaaagtgtaccacaacataagcatttttaggatactgattccagtgcatggatatcaaagcattttcaatcatcaggagcttgggaagggaatctaagcaattcaaaatttgaccaatgaggtgattgaaaagaaatcttttccctcaaccttaatctttgccaaacaacttattttgggacaaattttgaactctagaaatcaatttattttgggatgagtacctttgaatatttcagttctcaatgagactatcacctaatatttaggtggtatacataaaaaagttggctttagactttcatttcctgtctttttttttattttcaattaatcaactcgatcatgcatgaaaatattttccttttcctctaagtggtctaaatattttatcagattactgggtttttaagtgtacaggatgaaatggaatgtcatagtttaatatgacctcataaacatttaaaggtaattttaccttgtaagatggtgtcccaggctgatttttgttttcacattttaactcattgagagctgccatggagttgattaaaaatgagagtaactttggtcagaattggaaagaagggattgcacagggtgacaaatgggagatgagattctccatttgccccatttaagctctagttgagtagcctagaactctagataacttcagggtggccaattttggtgtttgagcagtcaacgtagaaacttgtttgtaaaaccaccttttgggagcagtggcggagtccgcatcgtcatcaagcccaggtgtcaaagagcatttcctggttgctggctacttcttataggtgtttctggtagttgatagtgatgacgccagctgcagagctcaggtggacacttgatcagcctgggagctggctgcaccactgcttgggggttaaagatcctgttaagtggactttggtcttgtacttcaaagtttagggcaactcgtctggttgtagttcttagagttatgtaggatctactaagtctatggcactatggacgttttccctctatgtagcattatataaaaagctcaccttccagctatctgcaaattgttttcgtttatcgaaattgacagacatcaactgtatttttcacttcccattgtcattgcatatttactggtgcataccgttacactcttacaggcttgaggaatcttgcggacttcttgcctgcttcagttgctgttatcgtcagctacttttcggcagaaattactcgtggcttatggaagccagttatgctgaatgggactgactggcccagtcctgctgcaacgcttttagaagttgagtccgatattgagaaggctcttgcatccgctggtgttcatattaacatctctccacgaatacgtaagtttatgtctttctatacaaatgattcatttctgtttgctactacaagctaccgttgtttctattttttatttcatttccagtggccttataagttgttgacctcagtatttgatgtttgaacattgttttatgcattcactctgggttctgtggagcaaaatttaagctatcctccctccattattataagtcactttgggtttgtccggagtcaaaccttttcaagtttgaccaagtttatagaaaaatataccagcatctacgacaccaaattagttttattaaatccatcattggatagatttttatagtatatttattatgttggaaattttttgttatatttttctataaaattggtcaaacttaaagagatttgacttaggacaaacccaaagtgacttataatatgaaacggagggagtacatcatgagatatatttgttataaacttataatggtaggtgtgaatgttgtacatgtatacattaaatagctgctttaaattataattagtgatctagcatttaatctgcatacagaagtagtaaatgtactgtgataaacttataatgggcacccaactctggcgacacccaagccagcgactaaatcaggattgtgtgaggattatcttcaagttggttttatcaggattattagattggttcactacttcactgttagttaatgagttccaagagtttagcttcatttgtaggattgatgcctctcctataaagggacttggccagataatgaagagataagcaagaatttagtccactctgttttcttcttcctcca

SEQ ID NO: 53360 - DNA, 2204 bp, Oryza sativa
tctgtagagcagatagcatcacttgcagcatctatgctttgtcatgctggtggaataaagttggttcgtcttctgtatgagcagattctgccaacaatgctgctttcagctggtgaagcaaggctgggttctgctggaccagtgtgcagtagtttcgaaggatttgctttggcatatgttctccttgtttctggggccagcacctggggagtaggagaaacctccccagtttatacttccgtatacacatcgaagaggcaacgggttgtagataggcacttggagtttgtcgccaatgtaatgcagggtaacattgagcttggctgtggccaggtcacttggagaacctatgttatatgttttgtgggcttgctggtcgactttgcgccaacatggatccctgaggtgaagctcgagacgctgaagaagctggcgtctgggctttggaaatggcacgagtgcgatcttgccctctctttgctcgagcgagggggtccaaaggccatatctacagtggttgaatacatcctatgatatgcccgtgccaaattggtgctctaatttgccatgtacttatgctctcttgctccagtacaggcatacacatcttacacctgatctgacgtgcagagacccccatcagagaagcatatgttctagtagatggcttgctctgaactagatagaagtctatactacagaaaggatatccagcagttaggtgtttacactttacagtacatttacaggtcagttcttattctggtcttgctgatcacagtgcatgtgtacataattcgtggaatcttctcttggtcgcaatttatattcacaaatgtaattcaaatgtcttagataggatgacatggtgtaaatgatcaagcatagctgccactccaatgacatggtgtaaatgatctttccggctcaattggagatcagattatttttttggttttgctctttcttcaaaggaaccgagaccaagtcttccaagcctgtttcgaccatagcattggtgacagactacagaaaagagaagttacatttacatatagtccactgtattactgttcatatgatcaatgtacaatctggtaagtacagtagtgactcgctctctagaacatctggaaccaacaaacctgtcatgctattgagcatacaacggtttttttttttctaaaaacagtcgaggcgaagcttgaaaattttccctataccttcaccggctatctcaacggagcaggagagagacgtgacaagtgtctttttgctggtagattttgcatgtacagctaacaacacggcagcgcaatgaagtgaataggtactagttgagtcgttagtcagaactcagaacccattgatttccggtcccagacgaggagattcttgacagcgagagaacaagaaaggcttcgcgaacattatttgcaatcggtcggaacacactagtggtcaatgtagtgttgatcaacggagcacctttcgcgtttaattccagtaactaagaagtctacataaaaattttgcccccactttgtatataactaagaagtctacatatgtatttttataaatattgtttaatataattaccttgaaaaaaaatcacatgtacgaggtaagaaaaaagtagatgaacgggtaaaggtagcgagctaacaggtgtacatatgtatttagcaggtgtacatatgtatttatgtatctttcatgtaatatcatgaccagtaaccggtaacagtatagatcatggtgtggagttaagcaaatagcgcgtgagttaggggtttatcttgcgtgcctagaatgaattgaggcctgcaagcctagtgtgcgtgtggcgtgtggcctattagctcatttcagaacatgttaaatattcaccgggtggctccactgtagccactctggcaaatgaaatgaaacacaatccccaactctgctctcactctctctctctcacgttctctgcttcctcctccgatcaatctccctccctccaaccgaatctcgttggcgacaatctcatcggcgggggtgtgttacagtggtatcaaagactagttgtgggtgtcgctgtgcatctcatttttgttgccgattttccatgatgcccgccaagctcccgctccattaaaacaaggccggaattgatggaatccaagcttctggagaagttggaggtcatcactatt

SEQ ID NO: 53361 - DNA, 788 bp, Oryza sativa
  unsure (1)..(788): unsure at all n locations
gtagtttagtactagtagtacatgtaattttctttatgtgtcttttcagatgtgaaaagataggagtaggattagaccctgtttagatgggattaaaacttttaagtccctatcacatcggatatttggacactaattataaatattaaacgtagactattaataaaacccatatataatcttggactaatttgtgagacgaatctattgagcctaattaatccatgattagactatgtgatgctacagtaaacattctctaattatggattaattaggcttaaaaaatttgtctcgcaaattagctttcatttatgtaattagttttataagtagcctatatttaatactctaaattaatgtttaaatacagagactaaagttaagtccctggatccaaacaccaccttactaatggctgttgtactcatcctcttgggagaagtgtcacaccctaaaaatcttaaatatataaattgttgtttaattggaatttttagaaattattttaaaagcctacaagctaaaccctaattttctaggaaaattttcaacataaaaatgagctagataaaattctattaaatactatgcttgctcctctattttctagatttttctgggaattatttgagcaagggaagtatttttaataattgaaacatcaattcacaaattgtttttgtttaaaaagttcaaaaatccccctcttaggccgttgggccgatttcggcccaactctttctttcctctctcttcccgcgcgcggnccatgccggnccaagccg

SEQ ID NO: 53362 - DNA, 6003 bp, Oryza sativa
  unsure (1)..(6003): unsure at all n locations
tatattcgacccagtacttcgccatgggcagcaccagtcatctttgtggagaagaaagatcatactcagagaatgtgcgtggattatcgagcgttgaataaggttactatcaagaataagtatccgttacccagaattgatgacctgtttgatcaattggaaggtgctacagttttctctaagatagacctccgttctggatatcatcaacttcgaatccgtgaggaagacataccaaagactgccttcacaactcggtatggtttgtttgaatgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagagcatcttcgtctagctttagagaaactacgtaagcatcagctttatgccaagttcagtaaatgtgaattttggttgtccgaagtgaagtttcttggtcatgtcatctcgtctggaggagtggcagtagatccaagcaatgtggagtcagtgttaagttggaagcaacccaagacggtttcagaaattcgtagtttccttggacttgcagggtattaccgcaggtttattgagaacttttcaaagatcgccagaccaatgactcgtcttcttcagaaggaagtgaagtacaagtggacagagagttgcgaacaaagtttccaagaactgaagaaaaggctagtgactgcgcctgtgttaattttgcctgattcgagaaaaggtttccaagtgtattgtgatgcatcccgacacggtttgggttgtgtgttgatgcaagaaggaaaggtggttgcctatgcatctaggcaattacgtcctcatgagaataactacccaacgcatgacctagagttggcagctgtggtgcatgcattgaagatttggcgtcattatcttttcggtaaccgtacagagatatatacggatcataaaagtttgaagtacattttcactcaacctgatttgaacatgcgtcagcgaagatggttagagttgattaaagattatgatatggaaatccactatcacccggggaaagcaaatgttgtagccgatgcccttagtaggaaaaggtactgtaatatgtcagaaggtcgacgtttacctttgggagtatgccaagaatttgaaaagtgaacttgngatagtcagtaaagggtttgggctgctttagagctaaacctactctgcttgatcaagtgagagaagctcaagtgaatgatcctgatatccaggaaataaagaagaacatgagaagaggtaaaagccatcgttttgtagaagatgagcaaggaactgtgtggttaggagaacgaatttgtgtcccagataataaggagttgaaggatactatcatgaaagaagctcatgaaactttgtattccattcaccctggaagcactaagatgtaccaagacttaaagcaacaattctggtgggctagtatgcgacgtgagatagcagaatacatggctctatgtgatgtatgtcagcgggtcaaggcagaacatcagaagccagctggtctgttacaaccgttgaagattccagagtggaagtgggaagaaataggaatggattttataactggtctacccagaacatcggcaggacatgattctatttgggtagtggttgataggttgacaaaagtcgctcacttcataccggtcaaaacaacctatacggggaataagcttgcagagttatacatggtcagagtggtatgtttgcatggtgttcctaagaagatagtgtcagatagaggtagccagtttacttcgaagttctggcagaaattacaatcagaattgggtacccgtttgaatttcagtactgcttatcaccctcaaacagatggacagacggaaagagtaaaccaaattttagaagatatgttgagagcttgtgttctagattttggtggaagttgggataagaatttgccgtacgaggaattctcatataacaatagttatcaagctagtttgcaaatgtctccgaatgaagcattatatggtcgtaagtgccgtacgccgcttctttgggatcaaaccggtgaacgtcaagtttttgggaccgacatattgcgagaggcagaagaaaaagtaaagattatccaagaaaggttgcgtgttgctcagtcgcgtcagaagagctatgccgacaatcgtcgtagagatttagtttttgaagaaggagattatgtgtatcttcgggttacgccgttacgaggagttcatcgtttccaaaccaaagggaaattggcaccgcgttttgtaggaccttttaagatcgtgagtcgaagaggtgaagtagcttaccagttagaattgcctccgtcaatggcaggaatacatgatgtgttccacgtgtctcagttgaagaagtgtttacgtgtacctacggaggaagcagatcctgatcgtatagaacttcaggaagatgtaacttatgttgagaagccagtcagaattttggaagtaagcgagaggaataccaggaatcgcgttatacggttttgcaaggttcagtggagcaatcattcagaagaagaagccacttgggagcgagaagatgaattgaagtcagctcatcctcatctgttcgttagttcttctgaatctcgaggacgagattctgtttaaggggggtaggtttgtcacaccctaaaaatcttaaatatataaattgttgtttaattggaatttttagaaattattttaaaagcctacaagctaaaccctaattttctaggaaaattttcaatataaaaatgagctagataaaattctattaaatactatgcttgctcctctattttctagatttttctgggaattatttgagcaagggaagtatttttaataattgaaacatcaattcacaaattgtttttgtttaaaaagttcaaaaatccccctcttaggccgttgggccgatttcggcccaactctctctttcctctctctccccgcgcgcggcccatgccggcccaagccgccgccgcccgcgcccctctcctccagccgctgacatgtggggcccacatgtcagggccgtcttcaacctccggccggccgccgccgagcccgaaccctagccgccgcttcccgctccgattccgcccaaatccgagcccgattcctccgggtttttgaggggttttgttcctctcgttctcctttcttttcccccaagaatcaaagcgaatcgttgggtattttatccgaatcgaattcgttttgttttatccctaaaaaccgagtttgatttcttcccgagtcgattcctctcgtttgcggcttgatctcttcaatccgagctcatataaagcttcccctcgttgtcctcttccgtttgccccctttcccgagctctcccgtgccccctagcgccgccgcgacgtgcttcaagttcgccgccgccgccggccgtcttcggcatcgtcgcgccgccgcctccgtcgtcgtcgccgctcgccgtttccgccaagaggagcgccgtcgtgcgaggaagctcggccgcccctccgttttcgccgccgacccccggagcaccctcgtcgccgtcgacccgagccgccgcgccgcctcttctcgtcgccggccgccgtcgtgcaccgtttgccgtggtggtgagtaccaacgggttcgcctcgttgtcctctacgcgtaggtggtctccgtttccgccgccgacctccctagcgccggcgagccctccgacctgagccggccgtcgtgctgacgtcatgccgacgtcatcgccagggctgacgtcatcatctccagggctgacgtcatcctctctctctttttcctttttcccgattttctaatagatttaaacttcggaaaatcataactaaataaccgtagatccgttttaggtggttcaagtttctaaattcttctaaaatcaaggtctacatgttaaaaatatccacatgtactgtttatgcttgtttttgtgctgttttgttgattttgtttatttgctttagtttccgacgttctggaggagagcgtttccgttgaggaaggttccgaagcgtttgtggaagcccaaggcaagtcacacagatcccaaacaaccctttgagcatgttgatcccgtttaaagctattattttatttcaactatgcattgtttttgaatgtcatcgggtggtgaacctttcccagttagttaatggccgaagatgactttattttcctatgggttataatttgattagcatgaaccttatatattggattggttcagctaaatgctatatataggtttgcttagctatgcttagaaacattagctaactaaaaggggttaaatataaagtatatacataattattattgttaattagggttatattcaatggtagctcacgatggttaatcgtgtgatgttaattaattgataatttaaaacctggataaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagttttaatctattcgaatagccgtacccgcggttatgggtgagttgagcaatgtttttcgtgattagtctcacactactcattagtggtaataatgtggtaattaatttaattcctggtttggaatggataattcctggtttggaggtttaatttgttcaactggggttggttgtacaaatacggttgggcctatgcaacacgggtgtgttgtatggtgtttatttaatattgattaattattcaactgttttactattctctaaaatatttattaaatgctgttttctgcaaatgaactatattatgccatcctttgttatcctgtgcacttgcatatttgctgtgtggcttgttgagtatgttatatgctcattcttgcaatattcattcatcagaagaggagtacttcagtgaaggtgatgatctggaggattaggcttgttctggttaagttgcatgtggagtggagtcgccatagctgttccgtagtttgttatagttttgttttccgctgcgtagaatgttttatttttctttgagaggaactatctacctctgtaataatttattatttgtgagtattcaatagttaattatttgtactctattatcaatattgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaatagaactgctcttctctattctcttataaattaattaagttggcagcacatgcaaggttatgcacaaaatttctttaattcaatttcttttcttttaaaagcaaaaagttgttcttctcaaaatatttcttttactctttaccaaatcttattgattagtcggcactgtacatctattatggtatcgatacaatcatgatagcactagtactactcatctttcttgtggtgacactgtaccgtgcttaaattaaatcataagtattttagttttatttttgttatttgtcaaaaaaaaaatatttgtccctgtccaaaaaagt

SEQ ID NO: 53363 - DNA, 2181 bp, Oryza sativa
atcgaggtgttaggattcgtcagggagctgaggttgatggcttttgaggtaggctatgaagttgctcccgagtatcgccagatttcccatgaccccgacgaggagaagtgtcgtgttcgtgtgacgttggctagtgatagtgaagaccttccgtcttataagttcgaagctggaggaagatcgtactgccatgcttgtcaagaagtagctttggtggctattggagagttgcgtcaacactttgaagaagagttggattcatcagctttccagtatcatcctcataagcctcatggtcaagattatggaacctatacctgtccagatggtgaagagagtgccactctgatgcatgtggtgcatatgcttagtgctatggatgcagtaagtgtggagcgagacaaagcagctcatgatagggaaaactggaatcgaggcaagatttgcaagttgaagagcaaggtgcaccgtctacagaaggaattagctgaacttaaaggagagacgccaccgccaacatccaagcttcgcctcactgcaaggaagagaacctgtccgccccctcgtctccagttagcttcgaagattcgcgtgatgggtgaagctgtgcccgattgtgctcaacctgtcatcgacatcataagtgatgaggaagaagaggaagatcctaaagaaagagagccagctactccagaggaagaagattcatcgcttcgttccgacgcaaggcggaagtagacgtttagttagatcgttgccatagttcgttgtgttagattgcttgtttaagtttgcttgtgagtgtgtgggttgtagttgttgcttacatcatgggtgggatgtaacagcatgagtctagttcttttgcttgtcagagtgtaagatagttggtgaggtagtgttaatgcaacttaaatgtaatcatacacagttaagagcaatatagaaatttaaattaattaaataacttcgttctaaggctgtctctctgtcgttctttcctgttgtctctgcttatcgtcagatggtgaacacgcgcaccggcactggaagtggaagtggaagtggagccaataacaatgaagagaactcaacgctagctcagattttggcccaacagacacaactgatcaatctgttagtgcagcaggaacagaatcagcagggaaacaatcagaaccagaatccaccccacctccccaaaataagttggcagatttcttacgtgtgagaccccctaccttttcaagcaccaccaatccagtagaagcaggagattggttgcatgcggtggagaagaagttggatttgatccagtgtactgagcaggagaaagtttcttttgcttcgcatcaactgcatggacctgctgctgaatggtgggatcattttcgccaaggcagggcgggaggagaacctattacttggcaggagttcacagctgcttttaagaagacgcatataccgtcaggtgttgtagctctaaagaagagagagtttagagcactcaaccagggatctcgttcggttactgagtaccttcatgatttcaaccgtttagctcgctatgctccagaagatgttcgcactgatgaagagcgtcaggagaagtttttagagggactgaatgatgagttgtcttatgctttgatgtctacggatttccgggatttccagcagttggtggacaaggcgattcgccaggaagacaagtataaccgtatggagcagaagaagcgcagggctgcccaatttaaggcacaacagggcagtaatcagaggccgcgtctcgttactggacctcaagctccatcgtaccctcaaggaggatcttcgtcagttgtccgtccccaacgccagttctacaacaacaatactggtaatcgtggcaatgacaaccgcaacgtgatagctcgtcctgcagcaactccagttcagaatcagtctgtcaggaaggaacagggaagcaagcccgtgatatgcttcaattgtggtgatccaggacattatgctgataagtgtccgaagcctcggcgtgtgaagaacgttccagccccgaacaactccaatgttccagcaccgaaggctcgtgttaatcatgttgtagcagcagaagctcagaatgcaccagatgttgttttgggtatgtttcctgttaactctatacccgcaactgggctg

SEQ ID NO: 53364 - DNA, 7026 bp, Oryza sativa
tacctcacttttcctggtggattcatagacatacttccacttatgatatgagagtggttgccttgggaggttatgatgctaatcttgccatggattggctagaatagtgggttgaaatgtcttgtaattgggcccaaaagaccactaaatttcatcacaaagaagttctcatttcattacaattagtgcaagacccttctactccttccgaacctactgttgtttatatgcaaaaattgtttaaatggcacaaaggccgtgatatctgggctgctgccctattggaacaaccttccaaagtccatatccacctcctctgtcataccagttccagttcagcagttgttgactgaatttgacgatgtgtttcaggatcccaaatgcttaccccctcatcgagtatttgatcatgctatctctctcatgccagatatatctctagttaattgtcgtcccttcagatactctcccttgcagaaagatgagattgaaaaacaagtgacaaaaaatgatagatgttggtcttataacacccaatatgagtccctatgtttccctttgtgttggtggtgaaaaagatagatgacagtcggcgcttttgtgttgattacagaaaactaaactccctcactatcgaaagtaaatttccatgccagttgtgggtgagctagctggcactatattattttctaaattggatttgaaggctggatatcaccaaattcgaaaggttgatgctgatgaggccaagacggctttcaaaacacatcatggccaattccaatttagagtaatgccctttggcctcactaatgtctcctctacttttcaatgtctcataaattcagtctttgcaccatttatcagaaaaatttgtgtttatctttatgtatggcattttggtttatagtcctgatttaaccagtcatttgagttagctgtagcaagtgtttatggttcttagacaacacaatttgtttgctaagagatccaagtgcccttttgcttgtcataagttggaatatcttggccatattatttctgacaaggggatgagtactgatcctgagaaaacaattgttatgcttgcttggccagttcttagctctgtgactgagttgagaggatttctaggtctgactggatattatcaaaaatttgtgaaaggatacagtgtgctggccagacctcttactcttttactgaaaaaaagggctttccaatgaaagaatgaggcagcccaacttgcttttactcaactcaaaacaaccatgagcactactcttgttctagcattgccaaattttcaatttccctttactttgggaactgatgcttgtgcttatggtttgggagctgttcttagtcaacagaaccaccctattgcttactacaacaagactataggtcctaataatcagaagctgtccatttataacaaataatctcttgccatcgtgatggctgtggataagtggaggtgttacttgcaaaggggtcccttcactattaaaactgaccataagagcttgtgtcatcttgatgatcaaatcttgggaactgagctacaacaaaaggtcatgactaaattgatgaggctccaatataccttccagtacggaagtgagtggacaatgtggttactaatgctctttctagaatctaatcccaagtgagtgccatttatgtggttcaaccccagtggattgaagagatgattaattcatatgcagtggatccacatgctcagtggctgttagctgaattggttgtgcattctcccaacagcccgggctattcattgaaggaaggactgattcgatataatgacaaaatttgggtgggctctaatgctggtctccaaaccaagcttattcaggcttttcattcatcaccaattggtgtccattccggtattgctgctacatatcaccgactcaaacgtttgcttgcctagcctgggctgaaagctcatgtggatggttatttgaaacaatgccaaatatgtcaacaagcaaaatatgaacattgtcgtgcactgtcacgcctagaaattcacgaaccagaatttctaagcttaatgtgcattaaatccctgtccaggaccagccagggtacacaaacgacaattgttgacatacagatccacgtcttacaaaaatataaaagattacaaatgcagcgaaaagataaaacgagctaaacttggaagcctgacttctgcagcgggcgactccactccacaggcaacccttgacagcagcgacaaaaccaaccctaacaagatagctccaacttggaagatctccagctctggtgtgggggaaaagagagcaagactgagtactacccactgtactaaacaagtcatactggaagagaaggtatgatgcaggataaaaccaaaggaggctaagggttcatttgcataaagcagtcatttaaaagtagtagttgaaagcagtaaaacagttgtaataattaagcaatattaaccaatcactgtccaacgctacaccacgttgcaaaggcccaaccaaccacctgaactacaccagttcattaagctacactaggggtgagactaatcacggtgaatctggttgatcgcccataaccgcgggcacggctattcgaatagttttactatggccagaggtgtacaactgtacccacaagacacgattccacacatgtcgccatgccccgaagtatcaccatgatactgcaaagggggaaatcgtgacaagaccctccgcataaccctcccctaaccatccacaccacgctaaggtttcacccccacccccagcaggcagtgggcagtcccctctgcgctgcggtgaatccggcagctggacaaccggacaccccggccgacccaactccatcacgcccaccctcgcctaggaaagggtcgagctatacttcagatcaagcagttacccactcccgcttgtggtaagcacggtaagtctcccagggtttcccatgaaccggtccttaattgccatgggtgcgaccagcaaaaccatgcacccacagcccaccattcagtgtattttaattaactgacaccattgtggtggcaccaatccaaagctatactcatagttaaagtctatgtaataatgtgatccgcattggtgtactagttgagctaagcatggctaagcatttcctaaaccaacatctagtcattttgatacccaagttatcaatgacataaggtaaacaataaatggctgagtaataggacccatcccacatgacattgtaaaagaatacaacatttaatagaaatacgggatatttgtaaattgggtacaatatgatcaattgtaatgcatgacttgccttgccctcgcattgatgataccacagcaatgtcttcgagaaaccgcggatcgacgaaacggccgaaatctacgcgacaaacaaagcacacaagcaaaacacactataagactactgaaacaaagaacaaaacaatttttaatggattctagagaattttatgaatttactgagacttgaatggacttaaacggagctcggatgaattacttatgaattttagaagataaactgtgtttttactaatagagaaaaatccttaatcaattttattgcgcaatattgccccagggctgatgtcatcaaaggagggggagcggcgccgacaggcgggccccgcatgtcagtggcatgaggcggccagtccaccgtggaccgggaccacacgagtggtccaccaccggcccacgggactgacggtccagatcggccgggaggccgatcggacggcgcgggcggtggcttggcatggctcggctcggcagaaagccggccggccggccatgaggagcggcggcggcgcaagaggcggcggcggtggccgaaggcgatggcgagctcagagagtggcggcgcatgcgggacagggggaagaagggaggagaggagctcctcaccggcaagcacggcggccggggcgaaggatgaaggtggcggcgacgaccggcgacggcgagcgatggccgagctctgggacaccctaagagagaaaagagaaaggttagagggggagtgggagtccacggcgagtgaggatgccggctgaaggcggggaaatggaggagctcaccgacgtacgtgggaaacggggctccggcggaaatttgcggcaaccgagtggcggccgaggagcaggcggcaccggcgatcgcgaaggcggcagcgacgaggctagacagcggccatagtggcggttagcggctaccgaaggtccgcggtgggcggcggagctcggaagagagatgcgacggcggtagagggcacggatggaagcggcgagggcggaaaacgagagaggggtctcgggggagcgatttataggtgtgagaggggggcgaacgtggtcggttagccaccctattgcgccggcgacgtgggaaggtcgggagggagagagaggggattcaaacttgaatcccggtcggtgcgggacgcgcgcgcgtgcaaaagaggtggaggactaggcggcgacatgggcacgagcgcgggagaggcgcgggatgggcgcgaaggagtggcgtgggcgagcggcgtggcgcaacgccggttcctgccaaggcgcgggtgccgggtggttagggacgactgacaggtgggccccacctatcggcgtccccgagaggagggaggggaaacgggccggcccggccaagaggaaggtgagcgcgggagggagattgggccgacggcccaacaaaggaaaaagggaaaataaaaagaagaaaaaggaaaagggattcctgggattaaatgttgcacttgctcatttttaactggttaaaattatttatagagctctgaaaatttcactaaaaatcatgttaatgtattggagcatggggaactcaagaaaaattccaccacgccgaattcgattattaaatgcattttttaattagggaattagctctaggttaatttaaataatttcttcgagcgatttatttaacaaatttttaaagcaagaaaaagggagaaacttcagggcgtgacatgcagctgggttattggctccattatctattccaaaagaggcatggcaagatatttctatggtttacctagatccgatgactacaatgctatattggtggtggttgatcgttttaccaaaattgccacttttatttctcttaagaattctttcaccgctcctcatgtggtacatatggttggaaaaaaaaatttcaagacaaatggcattcctcgttcaattgtgtctgacaaagatagattgttcactaatcactagcaaattttggacaaccctctttgagatttgtaacactcaacttcagaggagcacaacatatcatccacagactgatggtcggactgaagatgtgaatcaagcaaaatcctaaaaagtggaacaactagatacacttggtagagttttggtataattctaattatcacacatcattggtttgttctccttagaaagctttgtttagcaaagaatcaaattactctcaactccttgacctcactgagacaactcaccctgaagttgtggatttgcagactaaacgatagcatctgtctgaattcttacaacaacagctgactcgtgcccaacttcgtatgaaacaccaagcaaacaagggccgttctgagagggagtttgcagtgggtgatcaagtgttcctgaaactccaaccttatgctcaatcttctgtggttaatcgcccttatcccaagttggcctacaagttctttagtccctttggtatcctggaatgtattggcaatgcagcttatcggcttgatcttccgggtagtagtgctattcaccatgtgtttcatgtctctcagctgaaggggcaagttcccaacaatacacctgcctattcttcattaccttcgccggtcatcctcgacgctgttaaggcaagctattttggatcgccgtttagtaaaaaaggggaacttggctcatgtgcaagtgctgctaaaatggtcttctcttcctgttgatcatgccatttgggaagattatcatgtggtgaagaatcactttcctgatgctctagcttggggacaagttgtaactccagcgggcggcactgtcatgaccggcaatagtatggatcacaacgtagaggagttaagcaagtagcgcgtgagtttgggatttagtcctgcttgcctggaatgatttgaggcctgtgagcccagtgtgcctgtggcccattagcctatttcggaacatgttaaatattcatcaggtggctcaactgtcgcgagtctggcaaatgaaatctatcgtgcatagctaccttaagttcttcccaagtagtaggtaaaactccctcgtcagctaacccagttcaccacatgatagcaaaatctttgaactcactactggcttgtcgaactctatgttgcttaggaacaaggtgggcactaaacttttgttctactgtcatctctcaattaaggtatttctcagcatcataatatccccaaaaagagggtattttaaacttaaccttagcataaggatcatcgggcacacgattattgttaccttgttggtggtggtgatttgaagtgccacccatacctgtgcggtttgtgcgtagatgatgtcgtagccgtgcttgccttgtagcttgtgcatcaatattgccactagaatcatacaccgtgtctttaggatgaccactgtcgttgctgctgcttacttcctctttggaaggttcttgtgtctccaacacagcaacccgatcagttagcttggacatcccgcttgtccaacctctccatttggtttacgaagccgattttaaggatggcatcttggacagcctttgtaacggcctccgtcatctccttttgagcattttctacaacagtaatatggtgcctctcaacaactctcagcaatatggagctccttaccaagccattataaggttcttaccagcaaagcaaaggatacct

SEQ ID NO: 53365 - DNA, 2519 bp, Oryza sativa
tattttttattttccaggagcacaaaaataggcacaccacgaagttacagctcaatcggagttgatatgtggcctacagaattttctgaaaccactataaagaatgtacagaaacttgtgagctcgacagacaattttgcaaaccaaatttcagaattttgtattcgccaaaccctccgaaggtggggagaaacggatgtaaattttttttctcttatccgaaaagttatggttgtttgaagttagggcttccgactaggtttttcagaggggatataacctagtctgtttagcggtggtattgggatatggtggcaacggagtatgtaggatgctctggtgatgcgtggtgatctggataggtgtttatgatggcggaaacggctctcaaaggatgaaccctaacacacggatgaaaggtggcggctagggttacaaaggaaaacacacgactagactaaaacacgcattagaccagcaacaagaacttaaactaggactcaaactcaacactatggactctgaaaaggatcatgcaaaggctaaacacggtctgggttaaggtgtctaacgactacaacttttttttggcttttctgtagactctaggataactgcaaagaacaaaaactaatctagggtaaagaaactgagcgaacctgacggtgaacctagagctctgataccacttgatgtggactagggaacccgatcttccgaaagattctgataatcaacgattttggcggagtcgcgacacaaatcgatccggcttcttgaatgaacacgctcttgagccccgcaatcgcagcaccacgtctgctctagttatcacccgtgttgaaacgcggatgacctcaccgagaaggctaatccttgtttgcgaatagaagaacacaaacaagaacaaggtagaatacaaccaaaattgcagatgaatgattaagctcacaagttggggtcttacaaaccgatctagcgatgaaactgttctcgacagaataatctaagcaaaacccaaaccctatagataatggcgggtactgatatataaagtttaaggttgtgcaaccaacccttgacgcaaccctaatgggttccaacatgatacacagcctaaaggcccaaatacggcgacacaataccgggacagattctggatgtcaacttatttggttgattaccgttgactcggaaagaatttggacgtcggaccaaaaccattgaaaagattatcttcttagctttccatccatataaagaacgcccaatccgagcttgtatgtgacctatgcgcctggtttaatgcagactggtcttggactccgaattgcactcgaagttgacttggtttggacgtccaccttgatcctccataactctaggtccttctccaagtgtcttcttatcctctccattattcctaatcacaatataatcattaggtagcaatatattctcaaattcatacaaagaagaacataggaacgagctcacctctaaattcaattgtcgcgcgcgagctcttgttatcggtccttgaatgaccggtggaggattgttgtgtgtatccgatggagtgatgtccgcatcactctctccctccaacctaatctcgtcggcgacgatctcgttggtggcggtgtgttacatgtaatcaaatcgtagtaaaaaaatgtaaaatggaagaattcttctctgattttattgtgttattttttgaaacacttctccgctttatcaaaatggtgagctttacctacccctggatcctgatcttagccttaagtacttaatcctatcccagtgattgctagatcagcatacggtttcaccgcaccatcacctacttaattgagttttaattattttaaacttagaaaattaatttatctaatattgtagagcaacttctatatagaaagtttttgcacgaaatacaccaaggtaaaatctgtaccctaagtgcaatgcagtgctcttcatctccaatggtacagtatctgctgttacaaaaatactatctctgttccaaagtatctgctgttacaaaaatactatctctgtccaaaaaaaagctaacctagaaggggatgtgactctcctagtgcaatgaatctggatagccctttgtctaaattcgttgtactaggaggagtcacatgactcacatcccctcccaggttggcttttttttttttgatggagggagtaggtttgaatctatattattagtacaaatttgttgttttagcttgatagtcctaaaatgtttggatataagctaattatttttttgtttagtatcataaaactaatattctacttaaggatgttcaatttatacactatattatttttctaggtttaaatcggggttatattatttagttatcttcatgtacttttgtttgataattctcctatttatgttcatggaatgaatctgtcattcctttcttatgttcctagctagttaccaataacatatgcaagtaataaattgcatgcacttttgt
